United States Patent 10,407,724 (METHODS AND COMPOSITIONS FOR SCREENING AND TREATING DEVELOPMENTAL DISORDERS) - sequence listing, part 76

SEQ ID NO: 2053 - DNA, 380928 bp, Homo sapiens
tacaatgctttgagccttaccgcatttcagtgggggaaaaaaagttacctaggaggtctgatttttcaaagaaatttgcatacatgcaaatgtgccgcccggcctcctcctcggttctctacgtgcccacgcggtggcccggggggtgcggggcaacctggcaaagttgcccaagtcctccaccgaggtccgcggaggtctgcagcgggggtggggggatggggacgaggaaaagtagttttgtttgcttaagcacatcctgtggcagcctatagctgcccgggagtacagactgtaactgctcctcactgcgttacccagtaatgcgctgatcgggggagggggcgggggggccggggagcgagcgggagagcgagcaagcgagcgagcaaggagcgagccacggagagagccggggagcgagcgagccagcctgcgagcgcgagcggccgcggaggctcgggacccggctggccgcgcggcgccgcagccgccccctcccccacaccccctcccccccgcggcggcggcgcgagcgggcggcggctgtgcggtgcggtgcagagcggaggcggaggcgggcgcgcgggcagctcgcgggcacccggccgggccggcgcgggagcgggaaagggtgcgctatgcctttaacacccgcgtacagtaggcatgtatagtggagtgtagggaaactctaggcggggttaaagttcagctcatggagcggcaatagcgctggctggctggctgcagttgagccgacttggaaatgtgaacgcaagaagcaggcttgatttttttttctccccccttctctctctctctctctctctctcttcctctctccctctttctcctctctcacccacactcacgcacacctccaaaccgcacacccagacgcacacgcataccccagcgcccggcagttatgtattctccgctctgtctcacccaggtaagccgcggcgtggatgcggagggcttgggggccggggcgccgggggcagggctggggctgggtggggggcaccggggccgtcgctccggccgggcccagggcgtgcgtctcggtgtgtgtctgtgtctgcgcgtgtttctgtgtgtgtgcgcgcgtgtgcccgcgggtggggggggggatcccgcttaaagaaagtaactttgtttccatgcgggtgcattcctcttgcacggccatttgtgtgggcacatggctaatggcgccctcttattaatgcgttaattaatatcggggcgacggactgcggaacagcagtgttttcggacaccccgcacgtgtttcggcggggttgcagtccatgacacgcagaaatctggctcagcgtttctgctgccgggagcagggattccgtagtgccgcagcgcccggggagggggccgccgacggagcccaccgctcaccccgcacgctcgggccggctgcagtcctcgggtgcggggagacctcgggtgcctgcgcccaacggcccgctccccgcagcctgcgctgccgcagccccccgccgtcttcccgaactcttacttttgtttattgtttgtcagccttcggggtccggccgcggaaaggacgcgggctcccgtcccggccccggcccggacagcgcccctcggacgcgggcaggctgcggctagccctcggctgagcggggctacgtggacgcgcgttcccccgcgccggccgggtggagcctgcgtcctcgccgcgcgccggtggcccgttggctctcccggagtgaaagtttcggggccgagacgagcccacgttgtgcagggcgccgaacgccggaggccgcgggccgcgggccgggtagcgccgggcagagttgggctcctagccgggagccggagcggcggcccgggccggacacggctccccccgccgccgccgccgccaccaccaccaccgccaccgcgcgactccggccgctccgcgcgcaggacgggggcaacttttcccctccgactcaactcagagcatggggctcttgcgccccaccgcctctcctttccgtgcccccctgtccattcctcccttgtctacccacccccaggcaaaatattgctacttcgagacttcaaatccggtcccctttgaatatgttatttgttttccttgactaaaaggcttgaagtcaaagtggttttgcgctattttttttttaagcgtgagatttcatactgctttggtacattaggatctgaccattaatcacctacatgaagttatatgcttcacataaaatgtttattcacctctcccttaaaaaacctaccacttcttgccttcatttagtaggagataacggtttaaccggaatagtttctggaaggctaaaaagtatcagtagttttcgctctcctctctagattctggatttatttcccacatgacatcccttcttattgcaatatctaacagtaataataccgggtatttgatctcagaagactcttaaacgcatcttttatgttgaaatggtctgtttgggatttaggcctagcattaataatggatagcagttacttttagttactgtaaaagttttttttttttttcctaacaaacttccaaagttcctattttagtaacttgtggaagtatggaatgaaacttttccaaccacttctggcaaggttcacaattgcatatggataagatgcaaagtgtaagataatttgaatgaattacggactatagtgaaaatgctgagattcgaaggctgaagttctagctggcagaagtttgcaacacacagaacttgtagataatatcagcgagctgcaataaagggaaaggaccctaacagatacattagtgtcttctcaattgagctctgaaaagataaatttatatttgggaatggtgcatatatgagggcacctgtatatccatgcaggcctagggcacagtcaggtatttaacaaagttggcctctgttggttcatgaggtattatgacattaagagagtttttttttttctttttttttcggcttacatattcagcagcgttgattgatgcattcactaggccttcttctggaaacaccactaagagaaatgcttatttagtgtaacagtttgtaaagaaaatgtacaataaatagtgaatgagggctcatattttatgggttctgcttttaaaaatttatttacaatttatttaacttgctgggatatttataatgttttagagccagttttaggaagaagaacttcggtagtttattgctcattaaaaaaaatcagtaagcacagtgatttctatcactatactctaaatgaaactccatttaacttgtaggcaatttaaaaaaaaactttaccaagaaaaacctagacatcttattttaatcaaatatgggcatataatcaaatcaggtactgtccatataatgataacccagcagaaatttgtaggtgaacttttaaaaaaagtagtttccagaaatatcagcattcagtggttcttaaacttggctcactttcaaacagatcaatgtttaagatgctgattcaaagtaataccacttttgaaacaggttttcaggtttgtttttattggtggcctataactttctcactgagtacatatgtaaaacgttctttttttcctcttgaatgttatgaaatagtacctagcttatagcgatatgttcagcaacatgaattataagggcacactactttttttttttaactaatcatttatgctattcctggacatttcttgcaagctaatgatactctttagttttgatattctggaatattttaaatcatgacttgagaaagatacattagaaaaaatcaatactttaattgtgcatatgagtaaagttatacaaaatattgtggacttttactggcaggttcttaacctttggggagtaatacattgtaaatacttttgatgcaaaattggggacttaagttattcttaatgactaattgacatagttgttcttgtttaaggatttttatgatgagatatatgggcatttggttggcaggtaaacagaatcctgttggacacgaatgcatgcatgcagtttgcagttttttgaaaagcatattgggagtatctacagacacttaaaatgccatattagaatgtttattttaaatgcttattatcattaatcaaacttttaaataagataacattttaacatagatatgaatcgtttggagctaagttatactttgcattataaaatggggatgaaactttaaaatgaagtcctccttttggtgaaagctcacttggtagtttaaggtagactccaggagttttttgcataatacaacagagtcttggtccctagcatgtcttgtatatataagaaaatcagtcaatgtgaagttctgtttcaaacctaaaatttatgtattttagatcatttcaaggatgagctcagaatttagtaacgtttagatgctttgtggtttggcgtatacctttgcagataaactgtgacttgccccccatgcctgtcacctaaagtatgagaataagaaatattctcaaacatcagaaattttaaaaatgttaatggtttatggcaagaataacaattcctgtatttttttctattctctctctacttaaagaatgcacacgtgttacaaaagctgactacttctcttttggattcttttattgaaaaagagcagttttgaaagctaaacttgaaacatagaacctgaaatttgtgcagagaggaaaaaagtcagttattgaagtaatttattatgtattaatatatacttacttttaaaagctcagtcatatagagtgtttaaatgattgattataatttgctaaatttttaaacaacacgactattaaatattttaccttatcagttcacatttgaacatttaaaaatttagtaattgtgttaataataatattctggacattactgctacctgtgccttgaaagtatatatttagttagatataacaaactgaaaaagaatgcattttataatatttgtctgtcctacaccatttagcaaaaaagccatcgaatctttctttggtttctaatcctcatttatttgaaggtaatctatgttttggagagggggttatgtggcagagagaagttatgtaacagtgtggattagttaatcaaaagttagacgtactccgaaagctttgtggaggttactgcttaattttttaaaaaatatatttatatttcctaagaaaatgtcatgtataaggatcaaacattttaagcaaaacagaaagaaacatttaaatatttgaaactcaatttttttttcaattttaagaggcatctatgagggttttcccggcatcttgtaaatattgaaaataccaggttctgattccctatgagaaaaatcctgaaatagtatttgcaaaaattaaataatctattttttaggtatgattattactgaaagcacttcacaatcatattagtaaattaaatgtattcatgtatgcttttctttgtttttttttcctctttcttccccctttttgtttcattcccatagtattagcaattatgtcttgggcatagatcttttattttagcctaataaatatcaaattcaatccttcttttgtatatgaacctcccaaatttgtcctagtttttgactaaaaaaattatatgtagttataatatttaaaaggggaatttagacactagcaaaatgagtaagaaacatatcagaatctacatgcaatatttttagggggaaagcctttgttttcattgattgtagagatgattttttgctcctagacttccataaacattgactggcatctaaatgtttaggatttgccaatctggcggctgggccctggctgtactacaagtggtgaggtcaaggctgggacaaaattagatatgccttccttgaaatagggttaagattatacattgttataagcatttagataaacttcacttactatctaaaggatggggagctaggcccgacagtagtagctggtgtaccctggtgaacatattaaaacagttttttaattttcagcagtttttttatttccgatcataagaaatgatactgatagttttctctcccaccttcccagacttcccataggatcctgtgtatgattttggtaacagaatgctctaatcaaatttcaagtgaaatgaggaatttctttcttaaggtgacccgctgaagaaaagttgttttcttttgttttcattctacttatatttttctttttgttcattttcctaggatgaatttcatcctttcatcgaagcacttctgccccacgtccgagcctttgcctacacatggttcaacctgcaggcccgaaaacgaaaatacttcaaaaaacatgaaaagcgtatgtcaaaagaagaagagagagccgtgaaggatgaattgctaagtgaaaaaccagaggtcaagcagaagtgggcatctcgacttctggcaaagttgcggaaagatatccgacccgaatatcgagaggattttgttcttacagttacagggaaaaaacctccatgttgtgttctttccaacccagaccagaaaggcaagatgcgaagaattgactgcctccgccaggcagataaagtctggaggttggaccttgttatggtgattttgtttaaaggtattccgctggaaagtactgatggcgagcgccttgtaaagtccccacaatgctctaatccagggctctgtgtccaaccccatcacataggggtttctgttaaggaactcgatttatatttggcatactttgtgcatgcagcaggtaagtgcgatggtgagaattcctcccactttcttgtgtgtgtttctttcctgatggcctccgcgttatgccggattcttcctgagctccccaagttgcaggccacgtacatgaagccagtgtggtttcaaagattgagagaggtgccaccttcattcaggtgaaaaagcatagctttgagcgaattctcactaagttcagctcttttggtaagtagtgttttcagaggcgttggtaatcagatatgtgatatgtttaaatcacattttttgatgaggggatgagagaagcctcgtgaaaacccttttaataaagagtatattttaactgacaaatgatctagtttaaaagcatttattttggtattgaggcaatatttttagttggttttctgctgggagtgtttttaacctactgaggcctcttgaaccccttgccaattaagaagttggaggtagattactatcaaattgctgatcatttaggaaggaaaaataatcacattaatacgcagacttagtagctttgtatttaggaattcttagtgttgtctcagatagctaagggaaacaaaccagctctttcagtaattgatggagaggttaatattaaaaataaccaacctgtatattgcatgaacacattgaaaaattgctattgataattgatgtagtgagttgctttgattgtaaaatcttaaattttttttctgttttttcaaggcatgtcttacctgtgcatgtttcagtgtttagaatagcatgcaggataaaactattgaggactggataaaataatgcatttttactttgttcctttcgtcttgttttagacaaaaggctcattgtgctatgtgaacgctcaggtcttgtgtaacttgttgactttatatatgtacatatcggtcttgctagattaccttcatggcagttacttgagccagatggaagaaagagggttgtggaatcctaccagtaggttgttttggggttcaaatatttaacgtttttttttctttttttttttttttttttacaaaggagagatgttacctgtaaaaacactgcacttttcttcaaaacatttttaattctaaaaatgttagtgagtttttaaagaagccagctgatagcctgttctctattatttttctcaatatatgttttagaaagagaacttttgttatccatctgcccttacataagaaactggagaaattagctttgcaagcatgtcacatcatcatttgcattctgttggcaggggatagatgagtattttagaggatgtgagctgtaagtgtttcaaatatttgggttttcaaaaatgtatacttaattataagaattgccttttgctttagccaattctgggtagcaagaatgaaaagtcagcacctctcaagtgacctctaagcaggaataagtagcccttttttaacccactcttaaccctgttgttgttcatttgttttgtttactgaaaaagtaaagttaaaatttttaaaaaatgtgtctgcatatgttaagcacagcaaaacgcaaaaaaagtataggtgttacaggtgctttcaagaagcactctttaaaatcttgtttttaccttttagatatttagaaaaatataacctataaattatcccgaatagatgaccaacatcgaaacttgaaagtgccaacaggtgatgcagatcatgatgtgtgcttccatataagataacatcaaaatgaaatacctgtgaagtttttgtcggtgtaagcagtgtccattctaagttttcgtcttaaacatttctctgttatttaaagaaatgcaatcttttcgctgttctcattacgtgccttctttttcgtcgttggtttgttactgtgctattgctcccaatccttgaactaacacagttgttggttgttgcaatgcctgaaggggttatgttggtaaaatgacatttagaaggttacttaggagagttagcatccttattgcttatgaaagatttattgacagcagcatagatcagactactcttcggtttggttttcctgatgtatcccagaatcccttgttatgcctgaatgccagccaaatgtttggccattggttttcacgggaccgcagtaatggctgcttctctgtgcgcgcaacaggaagactgtaaaagaaaatattaagggtcttttgtctgaaaatatttcaaatttgatttaagagattcagagacctgttatttgtggaagggaagctgccaatacaaatatgaggtagatcggtcaacttacatacaactgatttgacaagcatctgttataatactgaagatttgtaaacactaaacaatgtttttacctccttaaaagttttgagaacttgccagtattggcaggaggcagagactctgaaacgtgcttcaagatacatgccaaaaccattgtggccttttcacctataatgcgttttttctcgctctttcttttaaattgttatatttttttcctttccagaatgcctttttttccccctagatggtcatagaaattagatcttcttttccttctgaaatttgtgtgtaataattcttgctttatgtgtccacctttctttggtaggaagttgaaatctcagaacatacgtgagaatactagaagcaaatgcagaatcaatctttttttttttaaagcggaggtgatttattctaagacttattgacatgctaaaatataatacataaactacattccagttttttccctctaaatccagtggcattagaactgtgaattttgtggctgataagcagtaacaagtgtaatgaaattggagtgatttcataagcctgagaatttcatcttgttaaaagaacaaaaccattttatgcccttaatttggtctcaatttgagttgtccttcccatgtatcatatgacaacttggggatactatggtattgtggcaaatggttttctttgtgggtgtgtaacagtaaagctaatttatgaccagtctttaccagatgatctgtatcagaatctacaatatacccggcacgtggcaaggtcacaatttaagttgttaaggtcataaccttagccaccaggcatttgaccttttagataaagttaacctttgttcattagtaggcactcaaccgagaagtttctggagagttgttgtttttttttttttaaccacttctgtataaacttctggtaatgtaatcagattctagaaagattctcagtcaaattagttagattttgtgaaaggttatactttttaaggactcatttcttggatagaggcaggttgctatttttaggccatagaatgacagtttcacaatttatatttgatattattacctgccatggggtagaataaaagcttggaggcagctgtgtggggacatttaaaatctaaaattaaacaaattaatttatgtttaattcaactaaggcctttgctaattttcaagtgacattaggcctaaaagctaaatcacagtgagccatcttcactttttgcagatgaggaattttctaacattagaagtatttttagcagtcttaaaattcagtttgaaagattaataagtgaccacaatttgtcaggtaattgctttaattgttaattagccagtgacaaagcaagttgctgttgtcctaatggcagcagtatgagtacttgttagttttaaggtagaaagagaacacttttgcacggtaatcttttagtgcagtagttactgattgcttccatgctgctaccattattacctttacttaattttgcttgcatcaggaatagcaaagatcctttcaatcactgaaggagctgtttcagtgtctcggaagcctgatacctgtcctataaacctactcaacagtattactgattaccacattacctgtaccatattgttcacttaattatgctgacatgaatgctcatttcaaattatttagattcttgctagttttgttctgctgtacctcatattattccatttcagccaaaagagagctactcccattcaggtgcattttagttttattttggcttcgtgattgccattccttcatatagtaatagagaaagccgtgatatgcagatagaccagatggtcatgttgacagattgagaattcacttcctactgcttcagagcaggtgtaagattaggagtgtctgtgtaggggcgtgtgtgtgcttcgtgtgcatgtgcgtgcacatccaggctgcacagagtgctgtttgagcaatgggaatgatttcttttttgaaatgctagtattttaaatacagtgtaattatacagataaggttttcagtgcatatagaatattataatttttataaataaatcgcattagattgttacagtttataattttatgccaaattaattatgaaaattattttaatttttaggtaacttcctacattagtttgaggcaacattgcatatccaaaatatattcaatatattcttttagcagctacatgtatgtgtgtttacattcaaatctaggactatacgtttttgtaattaaactttttcagtaacttaataaacaccctagtagaaagttgtgcagttacttcctgtgatttgtaattattaataaagtgtgtttggaaaaagaatatacactgtatattgtatacacaatatacacaatatacactgtatattgtaaaactaatatacagtgatatttaaattaggagagtaaggatcaccctatcaaactctagctttaagctcaaggtggattttttggctgatcaagctattgtaaattattgatatatggcatatttttagaaattttaatttatcttttaattcttcaaaaaagatagcagtagcagtcaacaaatttgagataaatattgattttacatccttgagtgttttctgtgtaacttgaggatagtaacaatatcctttacctagaatgtagtaacaaaatcctttatctggaatgtagtgcaaaagatggtagttctaaggcagagagtgtacaggaatagggagaaatagttgttctggagtaaacctttgaatggaagtcagttcatttatggctaagaggttgagtgtgttggtaagaaaatttcccaatgcttctggcttggattttccttgtcttcttttccaccctgtgatgaatagcattaatttaaacctatttaaggctagtgtgggagaaaccacagcctttgttgtggtcactgctgtacacagtaggactgggtgtttcatttggttaaggcctcaagctgcttccagaggacacgggacagcctgtcggcattttaaatcttgcacagaagcagcaacaattctaattgctcacaaatgtcaatatagatttttgaaaccaattttgaggattagactagaagaaaaaacataaaatgcagattgagttcagtgaatgtgctaaacactgatttattaccattttagtaataattttcccatggttatttaagggttagagcttgcttttgaattattataaattgtaaacccatgggggttgagtaagggaaggaagaagtcaggtggaggaggaagagaatgaatgaactcgtatgctttgttaaagagaaacataaaaccctgaacttaatcacaaatggagataccgtaaaagtattttggtttcagtaatgactgtaaagcagtcttgggcagtgagctatcaagtggagaattttataatttgtcttcccacaattttttgcatagcttttttcagactaagacactatttagagctttgggagtttttattcaagtttttaggaaaaggttttgcaaaaattctttttagaatttaggagtccagttagagacatcattgcacacttaagctcagaaaaggggccatggagatgtttattctttttactattttgctttctaaggtggcagttcagagtattgtcaaatttttggctctttcccagtaggcaacggtaagatactcattattgatccaaacttttgggtccctgaacttaacagaattatttagttgctgcttagacagaaatgacttttttccttagattttccccaaaatattagaaaacaattcctcatgttttgttttaactccacagcgtaaagcatattttatctaatggaattagtcctcccgttagtgttctagctaaataaacatggcttatgaagtgaagaaataagtccaacaaatgacaagttgcagcaactctgaagcagaagatatttttgcttttctgtttgtaaaacaagctaaataagataaaactgagaaaaagaagttcatttgtattgtgtattttggcaaatcttggtcttctttaaaatgttgctaaccctaaaacaagaaatgatgaggataattatgataactagagattgaagtggaataactgtaatgttctttgagaactttaaacttacttcttttcatgtctttcaaatacttccctagtggtagatattttggacctagatcaattgggagtagagaaaaggagatggaaggaaggaaaggaaataacttttattgaatgtctgttctgcagcaggcactgagtaaggtttgtcatagtcatatattgtagcttgctgtcgctttcatagcagtattatgaattagtaatgcactctctatttgaacggatgaggatagactcttcagagtggccaggttacatgtccagagcaagattcaaacccaggtcttctgatttcaaatcttatgctcttaaacaattcaaattcattttgtatccttctttatatcttattgtttagggttggatgtcgttttcatggtatcacacacctgtcttgaatcaaagggaaagtaaaaagtcaaaatccaaacccctcccattgagatatttcactgtcaaattcagatgttagccacagaatgaggccacacttgataaagagagaaatgatgttacacttgtcactgttagggtcaaaatctgaaatgatttgttcttttttgtttttataatgttgaaatttagtgaatagaagcattatgacacaggtttaagatttttagttgttgttaagacaaagttaaactaattcgttctagatgctttgagaagcctttgtgtattaaactaagcactattttaaaaactaaattgcatgtaatttttactatgcagatttttgtacatggttttatatgtacaagacataatatatatttctaatttcccctatacattacatatatttttatatatatatttacagacagagaaatatatatctatttctaacttcccctaatgattggattttaaaatgtaaaattcactttgctctgaaaaaatcctttggttatggctgtgtgtgtaattatttaaaataaagccaaaatcatgtttgagaaaagaatggaattttattagtttaaaattaaaaaattaaaataggaaaaaaattgaagatggacatgtttcaatttcgtgcccttaaattagtgaattagtgagcttttttttgttgttgttgttgtttgagacggagtttagcccttgttttctaggctggagtgcagtggcatgatctcggctcaccgcaatctctgcctccctggttcaagcgattctcctgtctcagcctcccgaatagctgtgattacaggcatgcacccccatgcatgtaatttttagtagagacagggtttctccatgttggtcaggctggtctcgaactcctggcctcaggtgttccacctgcctcggcctgccaaagtgctgggattacaggcatgagccaccacgcctggccatgagctttgtttctaactctttaaacttagtcaagattagttctttttttttttttttttttttttgagacggagtcttgctctgtcacccaggctggagtgcaatggcatgatcttggctcactgcaacctctgcctcctgggttcaaacaattctcctgcctcagtctcctgagtagctgggattacaggctcccaccaccacgccaggctaatttttgtattttgagtggagatggggtttcaccatcttggtgaggctggactcgaactcctgactttgtgatctgcccacctcggcctctcaaaatgctgggattacaggcgtgagccaccgcgcctggcgacaagattagttcttaatgatttcagtgcaaaaactcaaagcctcactcaacataatttttataattgtaaatagaaaaagatgaccaataagtataatttatactatattaagtcattatacatattaattcttctaaggtttaatttaaaaataagcagctgaactgaacttacagcaaagaaaataaaatagctttctttttaagaaatattaatgaatcttaaagttagggttgtgtagcatcagttatgctagaaagggaaaactgagtttgaggcatgtgaagaaaagtgattaaattggttaaaaaaatagtactcatatcctattgtcaactgtatctagttccatactgtatgtatttttatatctctggtaagtgcttatggtggtcccaaataacttgtgagtttccagacatagacagttctcagagcatgtgtattcatataaatttttaaatggctattgctgtagtgctctacaggttaaaaaaagtgaggcgaaattgaaacatttaaaaaatactgtactatttaaaaatttgtatgaatgtctgtgtagcagctgccattttcaggctgtctttgttgctatggtttggttgattttatttccttttgtaattttgccagccagtgattgggtagtacattgcattcatgctgttggggaagatatatctgtggtgagtcagatagcttgatctgagtagtaatttttagtagggaaaggtatttgtcagtgggtaatagaaactgtagtgttacattacccatcttcatttaattttcaaatttacagacatgtcacttaatatcagaaattcagaaccatctcttttgcagtgatatgtacttgcctctctccttttgtcctgtcagatgcacttagaattctgtgtagtttaatcttaaagggattagttatttaattttaagctcctacataaaatgaatattgtacatacagggtcccatcattgtcactttcaaatattccattgcctttcaaaggagctgacatgacaagtccttaggttgacaaattctcatcaacttttatgaaaatgttggctgcagaaggagtaaagtcaaaggagggccatagacagatggctttcagtgttgagatgacatcaagcccttcttcgtggcattttttaacattccaaatgaatgagggatggagatgcttaaagagcttactatagaataagtaattaagatattgtgtatctgcatgtaaacccctgttgcatactattaaacagagttgtgcaggctcagatataatagcagattaacaatgacaattgtaaatatcttttatgctgaatgtaactcataaataatattacacattaacatgttgctgatggaaaactgtgtacctgagaacatattttcaacattagataattgagaactaacgataagtgggttaccagtgtttgaaatgaagcaaagattctagataagaacttggcaaaagcttatttgcataagaaattttgcgtctttatatgactatgacaagatttttttggatggatgcacaccatataaaaattactaagttactaaagtttctgatggattcatttagttggctttcctccccctcttcttttaaatggtagaggttctcttttggagagtagtttcaagtaacttctgagaatgaagtctttgtaacgatgctgttcaacagcgtaactattgttgtgcattcctgtcagggaaagatagtcattgcagtacttttattgtatggcctcttaatatgtgacaaggacttttattaagaattcttttcttaacatacttttagaagtctctccttttcccacattcaatcagtaactacagttttaaaaaaatatttaaatgaacttttattgatttcttagcttactgtatagacaaaaatcttacgtttaaaaaaggttttaaaattaatgtattttagagtttcagtaaaatgaagtgggaacaaaaattaacaaaaaagtgccatctcattggatccaggatatgtagtaatacacacacacagttctatgtctgtgtaaccatatatatatatgtatacacagttctttggagaatgaggatatttcagtccaaaatgttatggttgaagaactaattgttctaaagatatttgcccctggccccagaaaagacgacaaacatgcaaaatggataaatgtaatcctttgtacttttaccacctacatttttaaactacagtaactctgatttctctagaaaggtcagaggtttcagacagaaagctttgtaattcttcaaagaaagacattttcagtttggctgtataaagactgattatgcatagctttttactttatgtgcggttgaatcttggaggtgctggagtggggtggggacgatgaataagtgaagctgtgttttgagacattagaattggagggaaacagacagattggagaggaacatagattcatatttttgggctttttactatcaagtcacccagtctaaaactcaggacagagcagcattaaccattcattttgctttgtgatagagcattcgattaccaactctttaaactcttttggcaattcaaggaggttgcctatctgggtaccatttcttaggatttgctttgttggattttctaaattgtggatgtgagtttctttggttttgcattttttaaaaaaattttttggtcctttttaacttttccaagttttggagaatttttcatgttgggcggtgttggagaagtagagattgtagatgaccttcgttgtggcttactcctgttatttgggaaatagacgttcagagagcatctcacttgaggccacaccaacagttaagaggcaaagccagcatttaagccaactcccttagatcccagacttttgccctaaaactatattatttaaattatcttttcttatgtgtttttaaattagcccttcatataaacttcaaattttaggtaggggagcttttatggttccctttatgccagtgaggaaacagccagagaggttgagtaacttgtccagggttatatggttaataagtggttaggattagtaactaggccagacccttctatggcctgtttttatctctaagatgatccccagtatgttagacttgaaactatggatggagtgaaaaatattctctgcaaatacatcaacactctgaaagccattgttttctctgtttagaaagtagttgaaaaagtagtgagaaactagagctttttcttttctggtgttagtttcagcttcctaccttgaagggaaccttaaggcccaaaccttcttttttacatttgaggattctaagtccatgcatctcggaaactatggagacgggaacttcttgtgtgagttggagagcagttgtagaccgttatcatttccatcggtgcggatgctctttgggtggtggtggcatagaagatctgttttggttacctttattgacaagctctactgtgtgactggcagttcagttcagcagataggtttccagcactaatcttaggcactgtgatagattcccgagatgcaaaactgaagaaaataccttgagacaagtcagtgccatctcagatataatttcctcagaaatcaagattttagagcatttgatgtttttaaattagagtcctttcaactaatagcctgtatgaagtttttaaaacacttataaaaaatttatggtgattattattattttgagacagggtcttgctctgttgcctagctggagtgcagtggtgcagtcgtagctcactgctgcctcaaacttctgggcccacacaatcctcctacttcagcctcctaagtagctgggactaaaggtgaatcccaacaccctgggctaacttaaaaaaatattttgtggagatagagtctcactacattgcccaggctggtcactgaactcccagcttccagtgatcctcccacctcagcctctcaaagttctgagattctaagtatgagctgccaaacctggcctatatgaagttttaaacatttgtagaaccagttgttaacattgctttttttttttttaccataaaattggtatatgtcgaggaattctatcgtttgactatatttctattgtgttaaattttttgttttcttatatcaaaaatatttttgtaaatgtaaagaaaattcaagcagacagaagatggtgcaggtgctttctattatttaatagttcacctggccaggcacagtggctcatgcctgtaatcccggcactttgggaggctgaggcaggcacatcacctgaggtcgggagttcgagatcagcctgacaaatatggagaaactccgtctctactgaaaatacaaaattagccgggtgtggtggtgcatgcctgcgatcccagctactcgggaggccgaggcaggagaatcgcttgaacccgggaggcaaaggttgtagtgagctgagatcgcgccattgcactccagcctgggcaacaagagtgaaactccatctcaaaaaaaaaaaaaaaaaaagtagttcgccaccatagcatgttttctctaaagaaagctggttgtgcacagaaaagttctattttttttaaagggcatccttctagtaatgctgaaatataaaacaaatagcgttataggaaaatgaaacagcaggagaacgagagagtagaaaacagaaaggaagcgaaggccttggagagcaggcggtagtgaattcatttggcagttcctaaaacacagccaagtcccagtagcatagccacctaaattccctattttgctccttcttggaaaaaagttagcagtctcgagacttttacgctgaagtggattttaagttgtcagaagtgtcaagctgatttgcctttttttctctcttttattaaaagaaaagagatacatactacattcagacagaaagcatgtaaggggtcttataagtgtgagcatgtgttagtggattaatgggacaatgtgtgtggatggtgatagaaaatatgagagaactattgcttggctgataaatgaaataacaacaagaaaaatctggtggcccaatatatattggatttgttgttattctctgttatatctgctggttgttcaatctgaaagtgaaatctgtttctccattcattaatacgtgtgcttttctttgtatagagcacagaacaaattatttgttccataattatttttaaaaagcagaaaatgtgtttgtaacatttaagaaatggcatgggattgtcatagaaactcattctgaacactgtaaataaaaatggttggggattagtcacagtaacatgtaggacatcatgaaattcaagacagatttctttgtctaacagtcagtaagagacatgaagcgaacttgatatagttcatgagatattagcagttcagttccttcagagaaagagaaaaccatgttgcttcatattaaataagccatctgtatacaaatctcacaatttacttgatgattttagcaatatttgatgtttcctttcagagtcttatttccaaataatgaaagcttaaaaaatttgaaaatctctctgtttttgctactaaatctttagaaccatatccctccttttcttctttccctatcttattttttggtaatcttgaatagcattttaaaagttttagctttattctgtttcctttagttttcccttacttcatataatatgaataaaactgaacacattaatgataaatagccttcaataatactatatatttttaaatatttcaggttagaattatgagtctgcagtattaccattaacatctttttctgtttttcttttaatccagtatttagaaggaaattgtttcagggtactttttttctccaactctgtccaacatctggaagaacgattgcctgtctttaaatttggaattaatctccaattgcatactcctgctaggctgatgtttcagtaaattctaacgcatcagcctcagatctttgattccttgagcttttggaagtagaagttaaagtctgagagggtgtttcaagacttaggaaacttagtgctgtggaatgacctgtgcatctgacaaggcccctttaacaatgttgtgtgtcactgcatgttcttatttgtaatcaaaacagtaggtacaatatttcaataagggtaagtgtatttagacaaatgtagcctgataaaagtggataaattaccttttgtggttgagttaattagtgaacacaacgaaccttgaaactggtgggagcatgtgcaaagacatatgtgaaaatgttggtacatggaacatatggaaccatcttgtcttcctgcctgtgtacacaggttctattgtagtacaggtatatgcacgcatatttttgttttattccttgtagtagtcctacttgggatgtcctcacccacctttacttggctaacattatttatactttaaggctcagctgtaacatcatttcctcaaggaagctttcttttccccccaaggttaggctaaggactgcttccctgcctgcccacagcatccattagcagcatattagtacttgccattagcacttcctttatcataataaaactatttgtctacatctgtatttccagattgggctgtgatttctttctgagcagggactgggttgtattcagtgtttttgtacccccacataggggtgcatagaacctggcacttaactgtgcactcagtatctttgtttagctggtgactagatgagaaatctggattgaacaaaacaagaacttgagaagcttataatatggatcttaaaactaggtaacatataaaatagtttttgggcatttaccttaggactgaatttaagcctatgttttttacagaatgattttcctttctcaccctaccatgtcaatggatttctatttcttcacccaaatccatagtttcatattaacccaaaggaattattgacatgtaagtaattataattctgaaaacaaaggtctgatgatgctagacaattgatgatgctaaaccatttaggctatctgtttttccctttaagatcctggtcttgacttttatttgagctttttatctagaaaagatgatttggtgatgatggagtaatatagtaactgctctagcttatatgtgagggtataatctttataccaataataatttatcaagtgcctactatgtgctgggtaccctgctaggggaggaaataaaggatttcaatttaatgctattgcatttttaaagagcacaattttgattaaaaattgacccattctcttcagagtggacactcacattttttgtgggttttgaatcacatagtgtcttgctgtgcaggaaaagggcctgtcagtcatgtctttatttctcttgagcatttgtacgttgtatgtctgtcctcacttatcagggtgtttttggcatggttacttaatcctaagctctgagaggcacaggaagtaaaagaaaagttaaagatgacaattaaggtgttgggcccagttagatatagtgaagtcagaattttccctcattaaaactgttagaccaatttcattagacggaaatgcacccacatatgtaaatcttctttgtttaattggagacctattgattgtaggtaacataagcctctctaagggaaacagaacccaactgaagataagagtttcttccccccaacacatacagcattcatgattttatttctctaggcgtgttcattatcaaaatcattctactgcagactttcccataaagtgtttctgtctggccctgttttcatatctaaaagcttctagtggtttcagcaagaaatgatggaaacattttgacagaatatatatttctttttttaaaactaagatcttaaaattaaagagaaacaaaaacttacaaaatcacatgaaaatataatgctttaaagagactgagaataattgtcttcttttgtgctttcatagaatgctaaaagaaaccaaattctgatcttctttggtgagcaatcaccaaaaatattgcagtggggaatgaaaaatagaatggatttttaaaaaaacttacattctaattaggtctcaatgctgcagagaaaatagtgtaccagtgcaaactctacactgtggtataaggcacaggattttcccgctgcgcttccaaggatagggtcatcctattataactgtttaataataggggattgtgtgtattttcttatatatcttcttgcaattccatgtttctgaagtgtgagattcaggtcaaggtcaatgtgtggccagttgtttataaagtattaagaatctcatgaaggagaaatacagtttagatgtagattttcttacgataactcaaattatgtttaaatgacaaaaactaggtaggtattgaggaggtaaatatctctatttttcatttcttaacattacactacaatatgtgtaatatttagaatttgaattaggaagaactttaacttttttattccttagggtattactgatctctaaacaagatgtttaattagcagaattatagcatcttagataaaattggttatttttaacttaatcacgtagttgatgctacagaaatgaattcatggcctttcttgtggtgctcgtctttttcttgtttgatgttgctagttgaacacatctcaggttgtgagaagtgcatatttagatgggaacatcttggagagatcttgattggtagagagtaactttatatcagtgagtataatgcttatcagtgaaattctaactcatttaattattacttaattttctgattatgtttttgtatttgagagaagattatttccattatggcaaagtatggatggatggacattgctattgccatttcttgacttagcacacctaggaaggcattttgaaacatactttttaaaaaaagaattgcatatctgtgcacctacaacagtgggtgtgctgaaattctgacttgggttttgatgaaagaattccccaattcagttaaattcatccttgactgtcgtgtgccactcatgttcacttggttaaaaaaaaattgttttttggagattatttgtagaatctcggttctgtaaccagatattgaatattaccactggagggaagctttgaactcatttatcacccttctgccaaaccacaaaaatcctctctctctctctcatgcatctatctatctatctatctatctatctatctatatcttactgatttattcatatatatatttcttcatatatatgatatatgacactgtatatttacagcatatatattacagcacagctatttacagcaacctggatcattcattcttagccccttctcaagaatggaagtttattttaaaccagacataaacaggacataaaatgaaatattaaaagactggataatgcattttaagtcagacatacatttggatagctgttgtttgagtttgtccatgctggagttacctcctcctcactgcaccctccctgtttgcatggggagctgagattagattttaactacaaattattcacattagtcaaataaaaaagaatgacatttcccccaaatttgattattattgtattttcttggagaaaaagatcgtgttagtaaaataattcaaaatggaaatccaaatgtatttcttttaaaatttttcaaatctgttgctaaaaagctgtagaatatcgtggaaaattcttttattgtaacaaacattcctggtttaatttcttattttcactttatttttaatataaatatatatgtaacttataacacatagtatgaactgaaaatctgtgaaccaagaaagataacaaccaatacctttcatttacctgtgtgttcttttcctctcccattaccctgaaattcctcctattatcctgaattttgtgtttgtaattcccctcctataaaataaatggtttatcactcataggtactaaatatattgttcagttttgcttgtttttttaagttttataaaaaatcatatatacacacatacatatacatacatatatatatataaatacatatacacacacacttctgggaattgctttttttcactctacaatatgttcataatgtcatatatactgtaatttattattgtttcttgtgtaatattctgtgatggatctatagaaggtttccagtttcttggtcttagcaagtgctatgaactgtaacatgtcttctagagcaagtgtgtaaaagtttctttatggtatgtgcctaggacttaaattgttgaattacagggtgtgtaaatgttaagtttttttttttaagaaaagatagtgatattttatcttactaacaagttatgcctgtttatacgatcactcgctgtagcagtatacaaaaaattctgttgatctgcattctctccagaatttggcactgccagatttttctttttgccaatcttgaggctaaaaaagagtatttcattgtgtttttaatttgcatttataatttgattactaatgagactaaacatctttttgtatatgtatgagccactttactgtggaataaatgtttttgtcatttattcatttttttctattttattgcttattgtttacttattggtttgtaggagttctttatagattctgcattctaatttttggccagtgtacgtttgccaatatattttcgtagtttctggcttgttttaaaattttcttcatgttatctttgatcaacaaaaattcttaattttaatacagtaaaatttatcaatctttatcacatggttattgcttttttgtcttgttgaagatatccttttttactccaagtttagaagtatatggtattttttgtatatcttttaagtgttcatctcacattaggtttgtattccatccggaatttgtgtatggtgtgaggtagggatccaatttcattttattctgtatgaatggacagttttcactttatcacttattgaataatttctctattccccaaataatgtaaaatgatacctctgtcatttattttttatatttgtgtatgtctgtttttggattctttgctctgttacactgatcaacttgtctgccctataccatcaccacaatttttcacttactaagcccttataatgagtcttgataaagcaaaatttcacacctctttttgaaataaattttttagttattctttacccctcactattccatatatatcatggcattactttgtcaagttttgtgaaacatcctattgggactttgtttagaaatatattgaatctacagataaaggaaattgacatctttttttaactatcaaatattattatctatgaacatggtatgtctcttcatttatttagatcttattcttggttacactgaattttatttttcaccaggttttgaacacttttgtgaagctgcttttgtaaattgtttttaatattttgtttttaactctaatttctagtatagaaatacagttactttgtgtatagtgatcttatattcagcgatatttacatatttttagccaataatgtattggtaagttcttttttgtttactatttcgataatcatatcaaatgcaaacagtgagaaagatgttcatttctattctatgcttttatcttccttacccttctcattgcactgagatctgcaactcagtgttaaattaacctgtgatagtgggcattcttgatttttttttcttgatttcctatttatttttaatccctgaatgaatcagagttaatgccttaatatttaaatattactttcgctgctcacattttaatcagagaaaggacaagacctgacctagttttgttaattttcctcttatttttaaaaattttatggtttggtatatgctaccataattgaaacctcagattctcctcacaaattactttatgccaagtggtatagtatctgttaattagtgggtaaatagtgtttttaaagaatgcagtcatctaaaatttcaaaatataaggctcatttgtatgaattaattattttaggtatttcagggaaaagaattaccatatttcatactgatgagattttttgatactgtgttgtgtggctcagtctcttacgttttgatttgaactatagaacccttaagtagcattctgttttttacaatttaaaatgtctggtttgcatgggtttactttttcctttttcctcatgtaatttttgttaagacttgaatagattactcttctaatcttgtgagcagactgcaggaagacaactattaagagtagaaagctattaagcagtcaggggtttattatgctttagtgttttgtttaagtctgttcttaattggttgattaatgtacgagaagtccttttcccccctccatctctacagatggcaaatggtaggtcccaactgtcattgttcacaaaaaaggttatggttcaaagtcaaagattcagagataccacaataatcaatcataggaacttgtctcagagtgcccagccaggcaaaagttaggcagagtaataatatttactgagaatctcttatgagtatttttttttggtgtgttctttattttatttagaaaatattatttaattaattgaaatgcctctgaatttagtgacaagcatttaaataaatatgaaaaataatggtcaaaaagttttctgtttatcggttttatcagatagtgctagaatacataattttaaaatgggtgtaacacagaaaataacattcttaatatattgagattaacagaacattttcaaaggaatacctttttaccattttcatgtgaagattatttataatagttaacttccttttttaggaggaagagtagaattatgttctggtattgatccacaaagaggatttgcattttattcatactataaaagtacctttaatggagaccttgtggtaattgaatctatactgtgtatcactatcaaagtatctttttaattattttatgttatacaatttaagtcatggaaagggggatgactgtattgtatcttttaagtataatgtatagcctttaatattcttaaagtggatgttagttaaggacaatttttagttgagagagagtgaaagagagagagataaggggggcagagaggattccattacattcagcacagtatgaaactaagtcaaaggagttttgttaattaaattcaattgccatccattagaccagtggaatgagatgactctgcctggtgctgacacagcacaggtatgcaatttggctaaatggccatttccaaaccatagcacacatttgtctacttgttcacttttttttttttttacatgagagtttttactcttagaaaagtcaaagagtaacccagtgcttgtcgaggggtaaaggtatcatttttatgcagcatattgtgaagtgattaattttttaggtgaaaaatatatagttcacatagagattatttgggagaaaatgattttttaaaaaatatgcagtatctgcgggcaagcatacgaacaaatatatatacacacacacgtatcagtatagaaaaatgtgtacttttaaaattcagttgtcttaatctgaagctatttgagtcatattctctggattttttaaagcatcctacaatctgtatatataattaggggaagttgtaataattgcaggagttataaaagcgaaatttaggtggtgggtaagtgtatctacattttggcataaatcactacttttagaggatttatatgtcagactgataagtttcttaccatggtgaaatgacaagaataccactcaggcattggctgagacataattttgacagccagcaagcttgcagtgttgctgagtgcacagatttccacttcctgccaagattaaaattggcaaaaaccaaaaaggatattagggattgtcactttaagaagaaataacatgttaatgttctgcatttgcttaagaaatgtaagagtgatctcttgaactgtagtctgttgaaacttacaagtttgcaatcaatagaagagtttgattaatatgagcatcaaaaattaaaataagtagaggctctctgacacttgttagaattaagactcattataggtttacttaataggacataattactttccttctatataagatgaattcttcacaaaagctatgaaatagttttcctcacagtccctgaagaacaaaggcctactttaagtttgtagatttgaagactgaatgcttgctttacttcctgaattttcttattttttcctgtgtgagcagatggtttttctttttataagttgccagatctttcctataacaataactgccattattgagaacctactgtgcgcttattctgtactgagcactcagatcttcagagttttttcttacttaggactttttgtttaactctaggtgtaaaaatgaagaaaaaattatatctcatgttgtgaaagagtcagactctgaaatctgcttatactttgctatttacagtaagtacttttgaaacagctgtagacgttcaaatgaaagtagcaatgtggagtggggaatgtgggaacattcatttgtgaagactttgcatttcttcagctttatagccaacagaaaaggagattgttgtgcattctattaaatactgccagtatgattaatttaaagggttacattttattgaaccctggtgtagatgttctttgtcaacccacattcacagctagttagagtgtgtgtagcatttatcaaaactttctggagcccctctcacctcattagcatctgaatctctattcagcagttaatgtccgttactgctagagtgctcaattcttgttttcaataagccagttgtaaaatgtcagactgtcacttacaatataaaaaaccaaaaatgatggtatttgtaaaaatgttatcacctcataaaaacaaattgtaaagacatgaaagtgatcttgctatgctggtctttcagaagtgagttagtacagctactttaaataccagttgtgtagattcccacacttttctaccaatggagaggtttacacaagcataatttaagttacaattacactaattaacatctcatttgcataaattgttgaagtcaaaacaacaaagaattgtctaagaagcttaatcctatttgtccaaaatagaaagattttttttttttaaaaaaaaactatgctctaaaaattggcagcttaagtatgtctttagtatgttgagctgtgtccttttaaaaataaatgttttcaattttcttaataatatatttctctattctttttagaatccttcatttttagtatacttttaaaattgaacacacacaacactttggttcctaaagtaatgataacaagaaattaaaatcaaggtacagtatcatttatatgtagtagtacagagtaaccatgacttactaggtgttatgatgaaggtgtatgtgtgtgtatatgtgtgcatgcatgtagataagtgtgtgcatttgcacacataagagttttaagctgctcctgtcatttattgatggtcaaaggtttcttttggctattgctggactcttaagattgtcttgtaattgtctttttgttgttgttgaaaattaagggtgtatattaaaggtagtttttacccagatcttatatgtgtgatagctcacatctgtaatcagaaacttactgtttaatggccacccaattgccattagcttcctagagggtgatttaataaactatcttctttaaaactcatttaaaattagagacatgtttgcatacaatggattaatgacgttttcatactaacccacaaaagtctgctgcactttcttttgtaggcctaacattcatttcatatgcattgattattattgttgaacttgcattaattacatcgtgcatatatggacatacaatgtcatctgcagaatttaggattttttattgttaatttttatagtgactgtggattgaggaattaaaattagcatgcttcatttataatagtatttctagtgtttcattagccctaaaaatgtgataagatcaggaataagattggaatgaaaatttctccttaaaatggtacgtcttttgaaaacattttgtttataatatatagctaatcctaatttattacagtctttcaatatattctttaatttgattctataaggcttataaatcactgtctttgagataagtttcttaattcacaggtttgtatcagttgtactaggtttggtgaaggatgtcatcctagatatacagtgtagacgtgctttatgaaacatacttcttcttagggacatttttaaataccaaatgagaatatgtttggtgggccaggtgcaggggatcacacctggaatcccagcactttgggtggccaaggcaggtggattgcctgaggtcaggagtttgagaccagcctggccaacatggcaaaacccagtctcttctaaaaatacaaaaaaattactaggcatggtggcaggcacctgtaatcccagctactctggaggctgaggcaggagaattgcttgaaccgttgaggcggaggttgtaatgagctgagagtgcaccattgcactccagcctgggcaacaagagtgaaactccatctcagaaaaaaaaaaaaaaaaaaaagagaatatgtttggtagaaatctgaaagagaatttatgctgaattgagaccatttggaaggcttcttgggtaaaactgatttgagttgtggatgaaggattgtttggaaatgagagaatgagcagaggccatggtggagagaagagttggagagcaggtgaaaggcgtgagcacagctgcagaagcagacatatgcacgatttgtcctagagcaggtcggttggcgagtttggttagaatggggggtttacatagcggagggtattgaatgccaatttaaagatctaggcagtaagaatcatgtagggtttttgaacagggatatgacatgcttcaagaggttttttttgaaaggattaatcatgaagtccaaatgtagggagcattgaaaacaagagtagagtgacagacagtggaacagtagctttgtctcggcacaaaattataaatcatgatggtttttatttcctgtgccctgagtaatatcataaacaaaatatacaaaatggcaagagcacttttgagataatacatggtttctgattctgagtagtacttgaaacttcaaaaataacattatacgataaaacacatgttatttctttgttatcttaaaatagcaacaaattctatatacgtagaaagacctatgtagaaaaaaaatgaacattctagcctggacaacatagcaagaccccatcttaaaaaaattttttttttttagtcagccaggtgtggtggcctttgcctgtagtcccagctactcaggagactgaggtgggaggatcacttgagcagggagattgaggcttcagtgagcctcagttgtaccactgcactccagcctgggcaacagagcaagatcctttctcaaaacataaagcaaaaaacattatttcctttctcctttcagaggaaaattatttccagattattttttcttatatttttttaaaagttggctttaagggagcacgtttctctttgagggtggcctgtttcattgtcaatatttgctcttcattggaagctgaggtcatgtcagagttactcaggagaaagacctggacttttcttcttatcttttaatggtttatcattgataagtttggacatggtatgcatggtgacttttttcactcttgtcacttttctatatttaccttgttcatagtatgtaatctgagtgccttcaagacactagaaaagatttgatctcaaacaccacattttgggtattttaatataatcaggagaaaagtggatataatattcagacaggaagctggaatacactggcataggtagaagtattcatttcaacattaagtgaatatatatatatttgttgttgtttgttttgttttgtttttgtttattttggttagaatctcactctgtcacccaggctggagtgcagtggtgcgatcttggcccactgcaacctacacctcccgggttcaaactattctctttgctcagcttcctgagtagctgggattacaggcaaaggccaccacgcccagctaactttttgtatttttagcagagacggggtttcaccatgttggccaggctgatcttgaattcctgacctcaggtgatccacccacttcagcctcccaaagtcctgggattacaggtgtgagctactgcacccagccgcaaatatatattgataacttactggaagtaaggtaacatggtacaggttggtagaagaaatatagagaaaaacaggaagctgggcttcccttccagatgtccctagattcaaaggggaagaggcaaaatgtattaaatgctgtcttacacatagactacaagggatttacttggccagggagagaacagggttgattctgagctggagagaatgaggatggcttctgtgaaggagatgacctaaagcagggcctcgaaggttggcaagggacttgcagggacagagcatggagatgggcatatgtagcgtgtgttctggacacggcacgtggaggcagagcacacatgcatagagtgtgtaatgcttcacttccatccttgttccttcagcaagcacccgtgctttacctcgtgctgacccttgagcaaggctgcccgtgagaaacttcccaacttcatgggcaatgttgaaaacatttgtccacttgcccttgccccagagagggagaaggtccacatatggtgcctttgacatgttatcccttggcataaagtttggcccaaatgtacatttgaaacctcacgttccctcgataaatttaaagtatgaaacttttgaaactctaaaaaggtggtgaagaccacagttctccctgttctttttcttctttcactctgcagctggattctgcctttcctccagtggttatctgaggagtgtctgccatgtcttctgtttttttttttttttgccttgttttgaggagtccccttttttcctcccctgggagagtttaaatatgatgctgatttcttgtcatcttagggctcctcagctacaacaaagttaaatggtataaaagcaaagcccaaattagagaccctaaaataaccttggagaaggagagttctcagttatcagtagaattgtcttaggaatttgaggaagcccttgtatacagtgaaaatgagaccctaagttaattaacaaaatgaaaataacttacagtacatatctgccacttccagtactgctataaataattgcaagtgtaaggatttttagtgcaaatatgcagaaaacatgggcatagaaagtttagatgaccttaatgaagaaacagagttggctctgaaactgtgcttagcaggaacaacgttttgtgcacttgataaacactgtcagttgttaaggcatcttctgataggtgaaaagcggttttttgatgcagtactgcctggcatgcatcttctcgatggtctgttatcttgtgggaatgacattcgttaagttgttttctgtgtgcatcccacccaaataaagaatgtttcatcagcaaagtgaattgccgtatagtcatcagactctagaaataaattatcaacgatgactgcagtgggtgaggctgtttgtttatcacatcacttgagaacagagtaaagtgagtttcatattttcctgagtcttgaattctcattttagacatctgttcagaagctttctaagccatggagtattctaaatgagcattttgttaaatggatgaaggaagacttagttttccattgttaggtgaaacctaattaaaaattaaataatgaccttgtgttggcttgtaaattccttatttcctgcatgtgtgagtgtattttgttagaacattccattttaaagcatgccttttttatgacaagaaatacttttaaaatactatttgcttttgaaattacagtagggaatcaaaggatagtctcttgttgagaggaaggtattagaagcatgtagctttatgaactatattttctgtgaatatagcagaattagtttaattgttcaatttcaccctctccagcatgattgcacccatcagggcagttaacagagacaccgctatttgtgttatactaggaattctttataaacttaataaatgaaagctttttctcttataggcccgattctctagtggacttctggtgaaattatgtggctaccttccattaatgttaatggaggttatggatataaatccctccatagtgatggaagaatgagccccagagagaagaatgtttctaatgaatcactggattgtgatataggattaacttggtgtccctaataccatttttttttcctcctgaaagtttaaggtcttatgtttaggaactagtttctctccaccttaatcctttattgtcaagtctgcaataatgttaagaacaggaaaaaaaaatgtagattcctggataggcacagtttttatattaatgtaactatataggcatagtttttatattaatgtaactatacagcacctatttttgtgttttactattacttggcagacatcttgagtgttttacaaggttatcgtatatttcactaataatcgttgcttgataatttggtgtcctgacagactgcagtttattatttagtattaaagctctcaaatgtatttattgagcacctgctgggtacaaggctttgagcttagtgatgaaagcatatgacatagtctgtagcctcaaattttctataatctcgtgataaaagtaggtaccagttcattagttgctttccagtggggcacaaattatggaacatcgtctggctggccgggcgtggtggctcaagcctgtaatcccagcactttgggaggctgaggcaggtggattgcctgagatcaggagtccaagaccagcctggccaacatggtgaaaccccatctctactaaaaatacaaaaaatgagccaggcatggtggcaggcgcctgtgatcccagctactcaggaggttgagacaggagaatcacttgaacctgggaggtggaggttgcagtgagctgaggccgcaccactgcactccagcctgggcaacagagtgagactctgtctcaaagaacaaaaaaaaaaaaaagaaaagaaaaaaaagaaatattgtctggctaaagaaaggaaaagaattcttattcagaatcagcatgatcacttctgggaatctgaatggagaaaataattctatatgtaatgatgttttcaatcaatattattttaggtggtttatttattcagccaactgttgttggctgcccactgtataccaggcagtgtgctagatactgggagtacagcagtgagcagcacagagacagccctggtctcatggagtgtgcactttgagtgtgggaaacagtatgtgggtacataaacaaaataatttctaatgtgatagatctctaaaggaaacaggcaaggtgatagagaataactaagaggacctgctttagatgggaatgtgaaggatgaggccgcattcatactaagcatccaagtaaggagaagaccaagtgcaaaaagtttggtcgggatgagtgtgtgtgtgtgtgtgtgtgtgtgtgtgtgtgtgtgtgtgtgtgtgtgtaccagagactgaaggccattatggctggacagttaagggagagtgacctaaataaagttcatattggcgggagagcagcttgccacagggttacacagaataggcagtggtggtaaaggcagcatttgaatccaggtccatttggctttggaatgtgctgttatagcagcagagggcaagtgtgaaacataattcaaggaaataattgctgtagccatccagaccagaggaggatcgctttgatctaggaaaacatctcagtagtctttgaaaaaatgtacagaatatgaaagatattataggtcttttcctcctataatacaaccaggaaattattcaggctaattttttcagaaaaattattacaataaattatgatctccctttgaaaggtataatgtattcaaacctttttaattagctaatcttttcctgtgaaatcttaaatatttgcacgtataattggtaattttagcttttatgtaggtatgtttccccctggtgttacttacaaaacctggcttactcaaggcccaaagtccaccccactagtaaactctctcgtctctgttcctgtgccaagtgctcttcctttgttaccaggtccacataattaatagctttatcatatgaggtaattcagttactcagcaaaacaaatgatatacacttttagaaatagctctagaaagtaaacttgaacgtaaaattgtttagtaagaggaaatttctgtttgtctttaattaagagaaactgtatggaaatgtaagctaaggatgcattaatcagagaagttggcattgcactgttcttcatttttatttggcatagattgcatgggtgctcattaaataatttgtatgactgaaataacttgtgatagttcttgctaaagttttgcatggactcagactaaagaaactttaaaatttgaattaaaaaacattcaattcttaggtttgaaggtttgagttacttattataactgaaaatctttattatcaaaatgtgtgttcattatagtgtttgcttgccttcttgggtgaagaaatacttattatgagagtatgtagattttccgtgaagaattagtaatcatgcatcaggttgatacctggtgagtagatatttgtatttaatgctcttaaattttaacagccttgcctctgtatgccctgctcatctgtgtcttaccaactttgatattgtttgaaaaataaacatttgaaggaagaagtttgcatatttagagggttggtagttcattacctgcatgtaggttatgcccacatcgcaaagaaatctgatctatatgggtaacatatttggataatcaaggccaaggtaaagggattcattcccccttcttgaattttatggtttctgtatgtcaaaccagatttcattggtttaaatcttgtggtgtacacttggccattgatttggtttgagctctgtaatatttgtaattatgtgagatgacaagattgaattaacttaattgtagagttttacatagtgtctgtatcaacatcctaataaaataatatgaaattcaataagtaatgccaagtgggacagtgagccactcacataagcttactaaacttgatatattcttatggcactcctccagaatgtagaagaaacacatttatctaggtgattagtattctttctgtctgccagatttaaggattgtttggaaatattgttagaatcaaaatcaacgtttgttactacacagggttgagcattccaggcacactctggtcgttttgttattctaatgtccacttatttcatgtctgccgtgaccgtgacagttttcagtcacacagagctgccatcaaaagagtgataagcttgtaagtgaagcctttggggaagcaataaagtcatttttctggtcccatctcaaaagacattattggaaatttatttaaaagtgatcaaggtagcacatacgaggccttctacagtttgcattttggaagttattaacaatctgcagttaagtccatttaaaactgaaagtggctcttccacaaactactttttaaatagcttgctggttctaaatttaaggagaatggaaatattggaaattaaaagtcaaaagaaatttctggggcataagatcctttcaagtttacaatttctcactttagatttaaaacttgaacacggccatactttgcattttatgatatctaattagtgccttgtaatatattttgtgaacagtatctgttagccataatatcagggacagtttaaaaaatcttcagtacatttatgataaaagtattagcattgtaaggtcttaaattgacatctaggacattaggaaatcaaatttaaagcattgcattgtctgttactcaatggagtggactgaggacagcgtgtgacttgtgtactgcaaatgatgcaatagctaaatatcctagtgtgagttaaggttgattaagtgatcatctttaactctgcttttcccagggctctttgaactcttgttttattaggtaatatgctatgctgttattttattgctgtttaaaaaaccttctcttttgggaaagaaaacatgtgaattctttggtttctagatagaaattagcaatcttttgctcggaatgtaaaagtatgctgtattatcacaaactgaccctcctcctccccaagaattctagggagtaaaatgcgtgcacaggaaatcagaaatggatcaacagagttataggttttaaaaaaactgccttgcatttttgccctggaattaattttcagtgaaaattaaaatattttttctgttcatctggaatcagtttttacttcattagcaggaaatggtaaatatacattcagcacaaatagagttttctttatgggacacaggatttgtactccataggtagatgtgtaacataaaagaatctttctgctctccttgtaattttctccctcttaccctcaataagttaaaagaaaggaaaattttttaacctaacctgttaggaaccattttagtgtagcctctagtattttgataaaacaaaatgttcactagctggaccctggtggtgatagcatgaaggactggggtagaactctctttttcattttcttttaatcctgaagttacatcactgtgcagtcagctcaacttgtgtcattgcagtaggaagatatgtaggtggaaagctattccagaaggaggctggagctaccttccctgacaagaaaaaaaatccaagcaaatacatacataaaaagacactcaaagcatcataggatgttatagttataagggaccataggtttcatttaacgcacattttagcatccaggtcctacataaaatgtatattttgtgattgtgaatgggagttttccatatttaaaagttaagtttattaatgtgtcattttacccatcatgtatttgtggccatttttttaataccacgaatgggaacatactgtatcatagtttctttttatttgtctggatgcttgtgtatgccttttagtctactaatatgctcacatgtgcaaactaacaagagaagatggcaatccggtattataaactggtaaagagttatagtgcagtaagactggattaactgtgctttcagcagtcaagttgctgtaagagttatattgtaaagttttagactaacttgcatgtatcccagagtttgcacggtgttgctgagtgtctcgttagacatacaccctacctactattctctcctgacataaaaaaaggtggtaattgagctggcatctagaaagtggtggtagcactacagattgtatcactaatcccaaacaaaggagttgcaaaacacctttctttaaatattttctcttcatggtgcaactggggagggccaaattccagccttaataaagttttaacctgaccagttggtagaaatggcagagtaatagaatgtttggtccagaaaccaatgtgtggactgtgtctaggattagactctgcatttctgtctgttccagatgagctgctcatttcttttctttttttaatttaaatttttaagttctggagtacgtgtgaaggatgtgcaggtttgtttcataggtaaatgtgtgccatggtggtttgctgcacctgtcagccatcttctaggttttaagcccagcatgcatttgctatttttcctaatgctctcccccacccagcccaagctcttcatttctactcagtacgtatgtccatgtatccaggagaaatggagagttctacttttggattcttctagagagattccctgtgggacttctaacccctaatcagtattcttccgttgatgataatctacttaaatgatatcctatcatcagaatccctttatggaattatctttgtattttgcacgttcttccattctagcttctaaatgtaatttttcctcccttaaatcatttttctaatggagacaacattcaaatacataggacagagcccacagccagggcgggaaacctgcatagtgaggctggttttgatacgcaggccatcctactggcagctgttttgtaggcagcttcatgtaatagtgcagagggtacagagagagagacctacactgtgatttctttcgtttgtatattttgtattgaaattgtagattttttggttggaatttatttgagatgattcaagacattttgcatagtactcaaatataggtgaaagaatttcaagtttgctcattttggcataattctaaaacaaaagtgttactgttggatctgggcatgtgatgggtgaatgagtgtttcagtgaaatgacataagtctgtataatttggagggtaatgatgccttagaacaagaataaatctggagcgatggaaaggctccatattctagatgaatgcatgcttcctcttatgactctgaaaaataaaattaaatctttatttatacaaatccagtgaggggggaaggctacatggtttggcttaatgatatatttcagaacaggaatattagccttaacctctttcctcacattgcatatgatatttaatccatcatctttgttttaaacaaacaatacacaagctgttgctggcattggtataaagctgatggtccatctggagagcaggaatatagatcaggaaaataagagaattgaaattgggtgcaagggcagatttgcatgtgtaaaaacctttctgttttaccagcttttatcaaattatttaatactgggcaaaacagattcctttttcttgaagctgagaaagatacctcctcctagaggaagagttgcttcagtgttctaggaagaacaattggttttgaaagacaataaaataatgagccattaggatcatgttttgtaatatagggagttggtgtggaagaggagagagaggactgctggtgtagtgagttcttgttctagctgtgtatgatcattggccagtcgttcagcttcttggccttcagtgcttcctttgactcaagtcaattcagcaaccatttattgaggcaaatgtgaggatgttctgtgggctacctatttagctaggcattgtggatccatagacaagtatgactgggtcctatgcttatgaaactccaggtcttacaatggaaacatactgtggttgaacgatgtagagagtgttgtatatgagatatgggtgcacaaaaacaggaaaagtcaattctgtctggtgtagacaggaagaattgtattacaaatccttcttaaggattttctattttgacatgcaagaggagcaggcattccaggtatttgaatactgagagattcaaattatcagcaaggttctttccagttccacgtttgttgtgttatcagtgtaaaattatttgaatagctttccactgatgagttattagctgaaaagtgtttattgtcatggttgaaagaaaataataatgaaagaagaaacgattacctttagtgataaagttggggccggatgggacgaagcagtgcaatttttttctttataattattcccctatttgaaaaatcaacttgtatatgaggcagcaaacaccttgcagagcagcattcccttttagtttcaggacgtggtggtggatggaaccactgtaacctggcctccctccatgagaggagggaatccaggtggccatgttgaaatgtgcctgtgtgcagcaaggcttctgaaatgacaagagagcccagcagcttccaaagcagctgtgactctggatctcacccatcatctctgcttctcactgttagaggagtgaatctgtgctgccttaggaggcatggaacctgggacttttcttccttgtttaatgtttaattttattaaaataatttgtaagtgatagatgttgatctcgtgacaaaagagagattccctctttataaaactattctaactaaagatcttttgtaagcccatgtgttagaaataaaacttgaatatccccttttttgttgttgtttatgaatggccaataatttattcacatgtgacatttgagctggcattttttcctcctgagatgacagtagcgtccgctgtgttgtattctaaagcaaagtcagaatagccctttgcttttgtcccgattagtagttctgttttgccttcttgccttttccatttagaccttatggtatttcctaaaccttagactgttttgaaaggctttgattaaaatatgctgataaaagaattcgataaccaagttaggaacgacaaggctatctggagaagaccaaatgacttggcagcctaacaaattctattcagagcacacaaagagatcctggaacgttttatagggactcgtgtgtggggaatggtatgaactcaggttacctgcaaaatatggtgtcatatggaaacatttaagagcttatggaaaattctttgaaataaagtggaatgagctagcaagcatattatacctaagaagaaaaacaagagcattcattctggttttttaaggtagctgctcaaggaagggagatagatgaaagtaaattgttttctactttgtacacataatatagaagagatcacctaagcctagttttgctaaccagaccctagacttaaaattagaggtcatgatgtctagccaccttcctctgtaggaacctctcgtgataccctgaaagcctctgcttaaatacttccagagaaaagtgaggaaggtaggggtggggatgaaggtttgcaggaactcgtgttgagtacctagtatctgcaagatactagagtaggtactttatcgccatctcatctgacttatgtatgagtgcaggttttataaccctcaagtttacaagtgaggaaactaagtttatataagtgtcacgaaacttgcttcagttcagatgtctagcttgaggcaaatctgaaattagaacctaggtccatcttcttgcattacactaaactgcctctcaggatgagggagagctcccttcatggctaaggcaacctcttctgtctaataatgcagattctttaaaaattctttcttttatttaactgaaatctgcctcccattaacatctctcattggtcctgattcggcctcaggaggatcacagagctgatgcaattctctttccttatgcaggtatgtttgcaaccactgctgccaaaatggcctctgccatcttttacctagttggttttttttgaaaatgaacacacacacacacacacacacacacacacacacacactcacagaaatatcctcttattgactgcaatccatctttcaacatatggagttctttttgaatactagaggtatagccttaaagaatatgagtatcagaagatactttagtttcatctttccctgcctgattcatcagccaattgttagtatgccatcagtcaagccattaataaaaataatgaacaaggtgaacaggataggttaacttgtagtctatgtataagtttctgaagttgcatgcagaatttagcctatatgtgaatttttctggaaaaatggtcagtaactattgtcagattccttttttttttttttttttttttttgaagacaaagtcttgctctcttgcccaggctggagtgcagtggtgtgatcttggctcactgcaacctccacctcccaggttcaagtgattatcgtgcctcagcctcctgagtagctgggactacagatgtgtaccaccacgtccgactgtccgactagtttttgtatttttagtagagatggggtttcgccatgatggccaggctggtctcctcctgacctcaggcagtctgcctgcctcggcttcccaaagcgctgagattaaaatagaatcgcttgaacccaggaggtggaggttgcagtgagccaagctcgtgccactgcactccagcctgggtgacagaacaaaactcccatctcaaaaaaaaaaaaaaatgccaggtagagcagctcacgcctgtaatcccagcactttgggaggccaaggtggatggatcgcgaggtcaggagatcgagaccatcctggctaacactgtgaaaccccatctctactaaaaatacaaaaaattagccgggcatggtggcgcacacccatagccccagctacttggaaggctgaggcaggagaattgcttgaacccgggaggtggaggttgcagtgagctgagatcgcatcgtgtcactgcactccagcctgggtgacagggcaagattccatattaaaaaaaaaaaaagtattgagaagtactcagagtagagaacttactcccgaatgaatatactaacctctttgaggagagctccccaaatgaccataaattcatatagctcagccatcactagaccgtgtatttcagccagaagatatggtgaatggtcttgtaagatgcctgactaaattaaagtattaaagtatttcttgaattctcttgatattcctggactttgagaaagaataattatgcccttaaaaatggaaaaagagactgcaatattgttatacaggccttttaaaaaaaaagtatccttaaatttttagttacagagttcacttttttcccctacttttctttgttttagattataagcccaggattgttcaccagaaggttaccctttagtctgcaggaacctttgaaaacagatgtggtattgaagaatatctctgtaagcccagaacttatccattgtataaagaattttattttccccagtagaccgggagctcctcaagggcagggacctttgcaagtctttgactccctagcactgaacccagcatctggcaaatcttatttcatgtgactttattttggctgaatggcctaaaaatgcgcttgtactgagcacctaatacatttaatttaatttttaaatttttattcaataatgtagacgtggagtccccctatgttgcccacgctggctcaaactcctggcctcaaggatgttcctgcctcagtctcccaaagtgctgggattacaggcatgagccactgcaccaagccctaatacatttaataaattgtaaggaggaagaacagtggaccgcagtgagatatggtctacagggaaaatgaagaacctcttcaaaaatgatgatcttcaggcctgtaatcccagaactttgggagccgaggcgggtggatcacttgagcccaggagttcaagaccagcctaggaaacatagcgaaaccacatctctaccgaaaaatacaaaaattagccatgcttgtagtcctagctattaatacgtgggaggctgaggtgggaagatggtttgagtccgggaggtggaggttacagtgagccactgtaccccaacctgggtgacagagtgagaccccatctcaaaaccaaaaaagatgacctttattatgtttgacatttaaaaaaatgtagccaaagtaaaagtgttgattagcataaccccgatcacatgttgttgttgaaaatgagcactggcttgcataaaatggacattcatggacatgaaatggacattaatgattttacatatgttaagaagagaattttagacttgagaccttagggagatctgttgatagaattccctatgctctacagataaggatacttagtgaagggactttcctaagctcacagacccagaagagtagtactctttccagccaatggtgatgcttacttatgtttttttttttttttttttttttttgagacggagtcttgctctgtcgcccaggctggagtgcagtgacacgatctcggctcactgcaagctccgcctcccagattcacgccattctcctgcctcagcctcctgagtagctgggactacagacgcccaccaccacgcccggctaattttttgtatttttagtagagacggggtttcaccgtgttagccaggatggtcttgatctcctgacctcgtgatccgttcgcctcggcctcccagagtgctgggattacaggtgtgagccaccgcgcccggcctacttatgtgttttagaaaaatctttaaaatgttaaaagatgacaggtaatttctagaccatatgaagtagcccagttgtcccaggattagtttattatgtgtatatcagccattattttacagagtcatctcacataaatccacacaaccttaaaggattaaaggatggtttctgtgcaactgaaacatatgcacagaatgacaatagtcgtgatactttctttattctttttttttttttttttgagatggagtctcactctgtcgccctggctggagtgcagtggtgtgatctcggctcactgcagcctccatctcccagattcaagcgattctcatgcctcagcctcccgagtagctgggattataggtgcacgccacccgcctgggtaatttttgtatttttagtagagatggggtttcagcatgttggccaggctgatcttggaactcctgacctcaagtgatccgcccacctcagcctcccaaagtgctgagattacaggtgtgagccaccacgcctggccagtcatgctactttataatctgaagttaccagttctttgcagtgtttcacattaggggcattctccaaagggaactttagagataacaaatatgttaaaaatatcgaataaagttagagatgtggggagacattcctactcctacagagagcaaccataccttcctatagactgtgcactgaagaaagggcggaggggatgcgcctgttagagttagaatcttggcttgataggcaaggaaattgacccggtgtggtggttcttatattggtaagaagacccttctttggtttctttttttccagatagctaaagtcaatgtcagtgattgcttcaagcatgatagtcttaccagcctacactctaagcttttcttatgcttccagaatgacttactcagcaatcacttctactttgtattaaaacagttttggttattcaggtaggaagaagagaaaaaaaccaggctgtttccagttgtctggggtttacattatgttacctctcagactgttagtgaaatcagggagactagtggtttttacggcatcagagataccaaatgtacaacagacagatgtcatcttactctttttaagtcatggacaaaaagacagacacattgccctgtaactttcagatcttctgtaacctttttaaacaacataggagagaagttggtacttgtacccaagggaagagaaagttaatgagtagaaaagacagaatttatttaggaaaacgatggaattaagctctggacaaaacatgcatcagtgatgcataacatttttgttaattgggtcttaacaggtttctgactcatatggtaatcattgtagaagtgggtcttactagaccacgccagtggcaaattgcgaagctgtaagaactcttacctccctgtgtgtgtgcacctgagtgtgtgggggggcgtacgtttctgtagcttaatttaggttccacatacacttcagtggttaaacctgagctagactcaaatagtttgtttccattaagaaaatgaatcttttatgtggaccaaggtcaggttagttaatttgtttgcttttattggaataacttttcccattccaattcatcacttaattttaagtggttctactaaaatacccattaaagtcctttacatttctcacagactagggctatgacagattcataagacgtttcttttttcctcaaggcacaaaaggtagcttttctggtcatcaatctagtcttccttgttcctaatttcacaacagtggggcaacattttatataataccaatatgaactctaattgcaaagagactaaatgaaatcttcacacgaagcaagattaattaaaatataaaatgtgcttgactgtggtaaaacatttcttttaaaaaaaatagtatgacttttttttttttttttgctaaatctttcttttttgtacacctcaccctcttcttcactgatgcattttccagcaactggaagttcactctggctaggaaagtaactaaatgtgatgttatcattctaattagtgattacaaaagatcaattaatgttataattaaaaacagtgtctagatctgttgtttgtagtgaataaatgtgacaattactttgttcattgacatagatgtgttgaatttcctccctagattttaaggggatgcattttagtgctgatgtgtgcatttaactgtggacagtaggaacaaggcaagcatattaggggaagagtagggcccctaatgtctaagctacagacatattttagcatgcttgacacctttccttggtatatgatgctatatcagcaacttgtactcattggatctggagcctctagcttttaatattttatcactaaatgcttaagtgtttatgttgcaaaaagaaaaggaaaaaaaaaagattcccacttggactctcaaaccatgtgaacaggctactctatgataactatgtcattaatgattttggtttcatttatggcaataatttttaagttgatcagtcaggatagtaagtatgtgatttttgcagatctggttgaatttttttctgatacagaccaagctgtttttcatacattgaagcctgggaaagctctgttactgttaaaagagtaaccatatctcttcactgaattgttgccaagcagatgtagacttttggagtgtgcccagaaaacctctacagctgatactttggtgacttgttcctactcctggctttactggcacctatttaaatagcagaggaacataattgtgttttggtaggtcaaaattttatacacttctgtagaaaaaattatatataggtaagccaattggtagaaatgaagtaaacccaatttgcttgttgagattagcactgaagatatgctaagctttggttatgtcatttggtcaaaaaagaatgaggaaaatccctcagaaaagttatctgagagatcagcactgaacgtcaagccagcctgtccactcccattactaaaagaaatctccccttttaacttcatcccataaatggatcatgcttcctggatccacccgaggaggacgtggtttagttttagattcttagattacagacttccaccatcagtttcagtattcttttcacgatattaatgttatgaaaactgttagaaatgaggaaataccgccatgtcaggttcactcatggatcaagaaatgagcattttcttaaacatcagtccaaaacaacaaacctcaagtaccataagttcagataacttgggagcagttgaaatcctttaagccacaaagatagtgtcttttggcatggctggtgaaagaaggaagctggttgaattcattgactaactctgttgctggctaaaaagacaattaaggagaaaagggatggaagaagaaaagaaccaaagaaactaaaatctgtttctttttcaggaggagttggaagatgaggagtaacacaacactttagatatacatgttaaaaacttataacaaatcatagatcatactaaaggattaccgaagtttagaacatggctgagggtatagatgtcagattttcttacacaatagtgggtcttttgtttcagagttcactcttggcaagcaactccctaccactgcgttaatttcctgtcgatctttcattcagcaacagacctagagatggggagcagacactgccccccccacccaggctttttaagactgtgctttgtgtagattaaaaagacgaaggaaaaaagaataaactttttccaaacaagatgtccatgtgcattctttaagatcctgtgtgtgcttaaaacgatcctgtaaaaaagccctctccataattttgaacctctcctttttctaaagacttttataggcatttttttttcttcttctcagcatgtgaaccaatgtgtaactcaaatagatgttactttgctgtttacttagattgttttaaaaggctagctgtgtggaggaatgaggaaggaagggaggcgggagtggctggagtttttttttttctctgttgacctaatgaatgcagttcttaaaaaataataaatatttatatgtggtcttaatttttaatgagtctcataaactggctggtatagaaaagtgtatgaaaagccatatatattaaactatagttattataaatacatgcatatgtacactagaatgttttatgaggaagggaacttactagtcttgttcactctttgttttcccagtgtctagaacagtgcctgacatacaactggtactcagtaaatatttgttgagtgaacaaaatgaatgtaaattgacagcattgcctagtgggggtaccattagactagaattcagaaaacttggagtctggttccatcactgccattaatcaagaatatattgttgctgaaatcacataacttctttgctcctctgttttttataaaaaactgggactagcccagctattcaggagtctgtggtggaaggatgacttgagcccaggagtttgaggctgtagtgggctacgattgtgcctgtgaatagccactgcactccagcctgggcaacatagtgagaccctgtctcttaaaggaataataggggctgggtgcggtggctcacacctgtaatcctagcactttgggaggctgagggggtggatccagaccagcctggccaacatggtgaaaccccatctctctaactaaaaatacaaaaattagccgggcgtggtggtgcatgcctgtaatcccagctactcaggaggctgaggcaggagaatcgcttgaatccaggaggcagaggttacagtgagcactccagcctgggtgacggtgcaagactctgtctcaaaaacaaaaaacaaaaagaggaataatagtatctgctctccttgccttttgtgggtttttttgatgattaaatgatatctgagggatacaaaaatgctttggaaactacagggtgctttacagactgtgtgtgtgagtgtgtgtgtgtgtgtgtgtgtgtgtgtgtgtgtgtgtgtgtacagaaaatcctttatctctttgcttctcaatttcttttcttaggaaaatcagattatttaaatcccattatgcacagctctcctctgttcttactaagcctctgtattccattacctccagtaaatcagtaaaaggtggtgagtcaggctgtagtggaaagcggggtctgctgttttctcatgtccatgttactctgtgggactcagaaatcttgcttacatgtctcatgaactttcttacctgtttgaactatacaggctataacatatgacttagagtcttttagttatgaccactcttaagattgatgactaagttgaagtatttattagttgttattatggtggattgataatcatgcattttaacatagtaaactaaagtctgtgtcgtagaattagctataatttactttttaggctggatgaggttactgatgcttgtaatcccagcacatcgaaaggctgaggtgggaggattgtttgagtccaggagttcaagacaggcctgggcaacatagggagaccctgtctctattatcataaataaaaacaaatttttttaaacaagtgtatatatgcatatgcttatgtgttgtaataataatatgtcccagagttgcacatctggaagagaagaagatagcaactgaaaagaaaatagaatggtattgacaaagagaaaagatggcgtcattaggacaattactttttatttttggaacaactcgaggctttacacccattcttttcccacatttattttttctatcagaattcttaaatctaagaaacaaataatatggaggttctttatattaacacattgctttaaattaggaagaaaactgtgtataggctgcagcagactttaaaagcattgtaagactttagatttggaaatcaactttaataacatggaaactttagatttaagagatcatttaatacagctactttgatttggcttttaagagaactgaggcccaggtagcccagaccaaggatcttttgcaaggtcgtgctactgggttctttagcgtcaagactgtaacctacatctttaggttcctaaatttttatcatgccttcttgttacctaactgttgattgttgaactttcttttttcttttttgagacagggtcttgctctgttgcacaggctggagtgcagtggcgcagtcatggctcactgcagcctgaaacttgagctcaagcaatcctcccatgtcagcctctcaagtagctgggactactggcatgtgccatcacacctggataatttttaaaaattatttgtagacacagggtctccctgtgttgtgtgggctggtctcaaactactgggctcaagctgtcctcctgcctcagcctcacaaagtgctgggatttgaattttcttaaacctaaatcaatattataggcctcaccttaggagaactttccaaaatattgttagtgttgaccaccttagcattacatttgctaacgacagtcatccaggtttactgaaccaggaaaccaactttcaggttaataagacagtttcgtctatgtgccatccttatccttgtctggacatatccatagagcacgcattttaaatctgaaagaatatatgtagtctcccctaccccagctttttttaagtagcaagggctattgaaaaaaatcagaaccctccgcttacgctcgcatacatgtagcttaaaatatatgttgcttattgaaagcattgtttaagttgaactcacgagatatactacatcatgtaatatgtctgcatttgtccatgcattcttttcggaaacctgatcttacttatgtctgcatttaacagataggctaggttaagttatgttaaaacatgttgtactgaggttggattcaccgtgtcacagcctggctttcttccttgattagctttaatcaaactctctgcattccgtgaccttaataaagctatttttcctgacaactgaagactgtcttaacaagcatagttcatctgtgctgaaactaaggctgagttaagatggggtttaggtcctcattaaagtccacagcatggagtgtaagaagaaatgatgaaatggtgctccctgaaacatctcttctttaaatttaattagacaaattatacgcaaactagtagatgccctgggaaggcaatcaacattagggctaataaaaagcttgagtagtataaaaaggctgggggaggtgctgtggagcctttctaacgcctatgagaggcaaattaaaaccaattgcgaaacatggaaactggatgaatttcaatattgatttagaaattaattttattatgttgttctaaatataaaaataaaggctatacttattaatcttccagaatttgacatgttaacacctatgcacaaagcattttatggatctttatatgctgggagacacaattatgggctgacttggaagttttggcagacctgggttcaaattctagcaacttcccctactagtttttttgtttgggggggttttttcggtgcacattacttcacctttgtgaaatccaatttcatcatctataaaatgagataaataattctattcctgaagaggctttataagaattttagaaaattaaaatagtaagtatagaacacttggtacaatgcctggcacataataggtgttcagaaataggtaccccatatttagaaggaacttccactgagttaagagtggtttcaagcaaactgtcctataaatatgtgagaattggattatgaatgtaaatattgtgtgcgtaatcttatggatcaagataagtttaagggaaaatgctagcggacagaaacttatagcttttggaagaaaaggtgactcaaacataagaagcaaattatttgaagcccacagtagccaaatggagagagtaggttgaaacatttgttaagtgctgcatgccaaacatcctgtataccttaccatctcatttaatattgataacaactccacaaggtagttattactgacctaattttgcagataaggaaaaaagagattcagaaaggctacgtgaattgcattttagcatagaagagtcaggactggaactcagtgttggcctagttcttgggggtggttggatggcaaactagtgcaggtatgttcataacttgtaagatcaaatttgtcatataaattacggggatatgtaatctctctcccttctggctcttttcatccttgggtgagttctaaataaaactattttgtgttatttttttaaccctcattccattgctttcagactctggttctcaaccttggctgcccatttagaatcacctggagtgggatctgggcgttagcattttttaaagctcctctagtgattccaggtaggcaacctgcactaaagacctctgctttaaaatctctctacctcaggcgtaggtgttttcattgcccatagtattaagcctagcttttagcagagatttgccaaggttgattatgatcctcttgcttgtttggaagaagaaatatggaagctgtgaaatcttttccagttgtgatagatgttgtttatgcattaattagcatgtaaaaattaaacactgtctattcttaatgttagcacattttctttctctctctctctctctcccacctctttttttttttttctattgaaggaggccaaattagatggagtgaagagaaaagtgattatggtaacttttcccttcagagaagtcaagagcaagagtatttttttccaatttcttagtaaaacaaaaaatattttctttccttttttcttttttgtttttgagacatggtctttctctgtcacccatgctggagtacattggtgagataatggctcgctgcagccttgacctcccaggctcaattgatcctcccacctcagcctcctaggtagctgggactacaggcacacgccaccacgtagggctaatttttgtattttttgtaaagatagggtctcaccatgttgcccaggctggttgcaaaccaccagactcaagtgatgctcctgccttagcttcccaaagtattggaattacaggcatgagccactgctctggccaaagttattttcaaaatacagtggttttaccccaccacccttagaggtagaaagaatctttgaccccaccacccttagaggtagaaagaatctttgttgccggacagatttgtggtaaatcctggtttctcactttctgataaagaattagtcattttatttgtttgtttgtttatttatttatttatttatttatttattattgagacaagatcttactctgtttcccaggctggagtgcggtggtacaatctcagctcactgcaacctccgcttcctgggttccagaaatctccctcctcagcctcccaagtagctgggattacaggcatgtgctactgcactcagactaattttttgtatctttagtagagacatggtttcaccatgttggccatgctggtctcgaactcctggcctcaagtcgtccgcccacctcggcctcccaaagtgctactattacgggtgtgagccaccgtgcctggctagaattagtcattttaaattcactggggctgggcgcagtggctcatgcctgtaaccccagcactttgggaggccgaggtaggcagatcacttgaagccaggagatcgagaccagcctggccaacatggtgaaacctcatctctgctaaaaatacaaaaattaactgggtgcctgtaatcccagctacttgggagactgaagcacaagaactgcttgaacccgggaggcggaggttgcagtgagctaagatcacgtcactgcactccagcctgggcaacagagcaagactgtctcaaacaaaacaaaagaacaaaactctctgggcttgatttcttaatctgtaaaacagaaataattcttaacacatttggttactctgaggataaaagtggaggaaaaaacatgcagaggatagtccggaactccccatgtagatcccattattaggtaactgaggtacaagtatcttaggctactggtccgggcaggctttgctgaggggctccgtgcagcttgctggtgcagccgagcaaatgggcctgtagccgactcttaatccaggttggtgctattcaaagagatcatctttcacccgagggatttctgggcatctattttgcggatcagaaagtagagaaagaaggtaactttgccgaaagctagtctggggagttagtagctgatacagatcagcatttcctaactatgagatttcataatattctctcttgtctcgattctgagtcactggtgcctgctgtggtggcattgttcatgaacatgtacagttattgggaagtgatcttgtctttcctcctgccttcaggcactgctacctaaattacaccccgacagatgtattcccattcttctttaaaagactatgtcatgagctgaactattaagttttaaagttgataagcatcaggctaagcatatttttcctgccatctcccacggaggtataacattgttttctatacttagggaatttaccaaaaaaaaaaaaaaaaaaaaaaaagttggtatctgctaatgggtcaaattagcaggatgttttgaaaactcagtggaagaatagctcttcctgcagatgcatgacctggtagaaatccagacattgggctccaccaaactcgaatgatacccaataaatgatgagaggaatatccaaagagttaaatgccatgagaccactcaccccctaaactctaaatccttgtatgaccctgagacaggcaggcagtagggctgcaaggctgagataagtactgaaaattggcccatatacattttgttttaacatagctccttcctttacacttttctgtacccctggcctgaaggctctacagcttgttacatactgatagctaagtaaatgcaatcaacattccatgctactgcctgcagaaaaaccgaaattgtttactgcctccaggatgttggtaaatatctggctgtattttttttttttttggcgggcgggggcggggggaggcaatgggtaggagaaagctagtatacagtgtcccaatttacattataaaatgcaaattttgtactccagaataagaaacaacttagagtagacctgtattgttccaaaactaatgagaaattatcatgttttctatgtgtagaaaagttttctcttcgcaatggctttacatattttctgtagggaaaaattctatttataaaatagcctgggatatggagaactcagtgataaaaggggcaagaacattttcagattgttttaccctgctggaatgtagcatgggaaagctccttccaaaaggctattacctctgggcattctggcacagttggggagtgaattggtaagataaaaatgggacgaaaatccctattttctgttaaatacaaacaggctcagaatggggcatcctgcatttaggattagaaacttcattatacaaaagcagggtggagaaaccctaatttgacagctaacccaagagtgtatggtgaccacaagattaacaggggccagcagtgtgacattgccattcaaaaagctggtgctgtagttgggctgtggtctaaccacagctgggtttttttttttttttttttttttgcccagttttgggcacagaatgctaagaggaacgccaacagaatggagactcgatgccaatgaattgggaaatcatattatgtgacgggcagttgaagaaggcatgtctgtaaaattgaagaagagatttcttagaatgacctcagtaacaagcttaaatatttaagtgtctggtgaaagtaggggtgggatagtctctgatgtgctacaagatcgaagaaggagttaagtccttctctagagcctcaaacccctgctcagcatgaaaaaaacaacagaaacccaagttaacatctccttgcaatatctgatctgtttttccaatacatctgctcatcttgtttcaaaacaagtagctgtcaccattcttaaccctgtcgtccaaaccagaaaccgggcatcatctttgactggtcccctttactcagggggaaaaaaaaccatgtcttttaaagtcagcgcctataatactggtctttggtttatctccaataactcgattgttaacagcccttgaaggggaggcaatactgttaaacttgataatttctaaagagttttgagctatttagcacgaagtgatgccaagaaaaaggaatactaacattactcacagcagagggaaaaattttatatcctttctgaaggccaaggttaagttctgtgtgactcagcacattgactttctatatgaccctaaatcccttctatttcctgatctacttgtcttgacctgtttcatttccacaccaaaatagtttcattaacacagcgatcatgctcaggagatagtggctaactgatgtaattaactgacatgtcaaaggctattggtttattgcatatgcaactgtctttcctggtgggaagatacagtttctgctgacataataggtatgcaaacatgccaaattgcccaataatctgcccccgtgatggtgaggtgtttgcggccattctacttacaggaacagaatggcggatctgttactatgttctcctaaaatgcagctggccaaaggtgctaattggtaaacagttaaaatagaaagaagagaaggcaattcagttttgggccttagtgagttttttttccttttctttccttaaaaaaaaaaaattgtgcttttggcatgctaatgcatgcatttagtctctgcaagaaatttccatttaagaaagaatttaaaaacatgaagtgctcaatccatatctcctaaacaactaaaaagactgcaatttcaaatgagaaattatgttgcaaagaagaaaaaagttgtttattatggctcaaaattttaatcacccaagggctgtaaagttaaaaatagacaattctgccttctgtttatggtaaacttggctgagtcccggcaaatttcaaagctgaacatactgtatgttatttttgcttaattttagattccacattttaaaattatttcttacaagaagcatatttcaggatataaacttagcctgaagaacagtattcttgatttttgcccatattgaaactcctttgaaaatagtaaactatggttttgggattttcctattcccaagagtccaaatgggtacctttctaagtcttttacattatgaatgaacacaggattatgaaattgtaaaggttactttctgctctctaattcctttactcgtaattttagttttcttaacggtataacttgatgcaaatatatacacagtagatactaactttcactgaagtgttttcgggagggaggggcactttacaagatgtgttgcctttagtttttccggtaaggagacaggaagacacagacacaggctcttagggcacatggaaagcgcctgcccctgtgccaagaacttaagagagagccggggatggaccctccttgctgtggctcctgaacagtgcagcctctcttctgatgcactcaccctggcgaggagaaccgcttgtgtggcgactgcttggcccaagagcgagtaggattgttgactcaactctcttcgtgtctcctcagagaggaggaacacctggcttcacctgtttacataactcttgttgattcttgtccctaagctcttccagaatgctcttttgggcttttcctcaaaaggtttttagaagaacaagctttttggggtggcaagaaatttaggatggagatttttgtttttaacctattagtcagcgtggcatcagagaaccacatgtgccccacagtcagtggcatgctcagtaaatatttgttgaatattatttaagtgaatgactgtttgctgaagaacaagatttctctgatgaccttgacaaacgtatgtttgtgattaagttaatcatagctaccacttagaacttcttactcactagacatgtagctgaacacttcatatgtcattctgctttttgtttttttaaagacagggtccctcccactctgtcacccaggctggagtatagtggtgcagtctcagctcattgcaacctctgacccccaggttcaagcagtcctcccacctcagcctcccaggtaactggggctacaggtgtctgccaccacacctggttaatttttgtatttttttgtacagatggggtttcaccatgttgcccaggctggtctagaacttctggactcaagtgatctgcccaccttggcctcccaaagtgctaggattacaggcatgagccactgtgccttgccttcatatgttatttctgatccactaggtttggaacctatcccaggacacctggccatatagagtagctatatcgagtctatattcagcaagtgcagggtaagctctgattccatggtccttccaatatgccataccaccgaggttgagaaaggtggtgttaacagtacccatacgttgacataaggcctctgagaggccaaaggatatgccacagtattctttaaggtgcttaagcccttaatcatgaaatgttttcctaggccacagtaagaatctacttagtttacacacaattctaataaatccggttatctgtttttcaaatacaaagcagattgattcattcagcaaatattttctgaatacctattatgtgccaagtagattgttctagatacagtgaacaaaaaagaatccttgctctgacagaggtgatgttgcagattaatagatcagtggttctcaaaagtgtagttcctggatcagtggcattagcataacatggggacttgttagcagtgcaaatgttggtccccacccccgacttactcagtgagaagctctaggggtggggcctgattttaaacaagccctgtagatgattatgatgtatgtgaaagtgtgagaaccagtattctagaagattttaaacaatttgtgttcctatggcagatagctctctggagaactttgtctcctgattcattcccagactaccgtgtgtgtgtacatgtgagtgttggggtcttaccttataacggcatttagtgattggcaaagctcagatgctgggcctctatggggcagaggcacttggacatttgtacctaaggatgtgggccctggagttacatgtacctgaattcagattcttactttgccaagcacagccacaagaacttgggagagttaggaaaactctctaagccttagtttcttcattgtgcaaatgaggttgacagtaataggaccatacctccatttgtagcatggctacttggtacaaagaaaatgtccagtaactagtaacaattgcttttctctctccaggatccagcacctggcctggcacagggtacatgctcagagaacaagtctttgaaagaatgggtagatgtttattttcctttgtattagccattagctcaaggtctgcagctacttaattccaacctgggtccatttttagcagaagaaaaaagaataatgggactcagcatcaaggcgcacctgacacagagtcctcttggaaatgtgtgacctgcctcagtttagccactgcttttacttcatcctcatcagtcagagtatgacattgccttcccctttacctcttaattttggaatatttcaagtgcctctaaaattttatttaattaaggggcttccaaatctgcttgtagatattttattcttgaaatgcttgtggcattaatagtaaatcagaatcagacctccacctattttgtgccatttcagcactaagccaaggagaaaaattattgaggaaattaatgcttcccttaagcacagtaggaacacgaagctaacatactgccgtataacctgatttcactggtattctttctgaaatttttgtttttctatttctattgcatattggacttcatggctaaaacaaagtgcaattatgaggaggatgttttctcaaaatctgtagggtctggttggtcacataacctttcagaagaaacattatctactggatgacttagatgttattcaccaatagattatcaaggtttatctccagatgttcattaattcactaagtattaattgagtatctactatgtgccaagcatcgtcctaggtgctaaagatatagcagtgaatgaatgggacaaaagtctctgccctcttggtatatacttagttactttctttttcacacatgggcatgtgtgtaggtgtctctggagtaatgcgttatatgcaggtgttgagcctagggtggtgttgggtgcatcatgggcactcacatgttaatttcctgcactgtagatgattgctgattctcagtgatataatccagtcaaaccatttggcgttcttctgctttaaattttattggtgaggtttaactcttcattaatgaacgctgtcacattttctctcttctctgacatgtcctggtgccctgggtttgtggggtcaagtcactgccgatttaattcaactcttctttgtatgactacaagtcctgtgttttagtttcctattgctgctgtaaaaaatcaacatgaacttaatggtttacagtaacacagatctattccctgataggtctggaggtggggagtctcaaatccagtgttactgggctgaaatgaaggtgttccgaggactggttccttctgtaggctccaggggagaacctgttccttgggccttccagcatctagaggctggctcttcactgcatcactgcatttgagctccgcttccttctcctggacctttgaccctcctgcctcccacttaaggagccttccagttgcatcattgggcctgcctgaataatccagggtaatctgtctacctcaagatcttcaacttgatcacagctgcagagtcccttttgttgtattcatgcattctggacattaggatatagacatcttggtggttggtcattgttcggccgatcataccttgtgagaaattccagtgtccctgggctgagctgctaaggagcaggttttattgagcagtctttcccattctatgaaacccaacccaggagaaaacgctctaaaatgcaaatgttgctaacttggcagagcctaattatatgtgcacaactacctaaaattttcttaataattgctctctgttccacaagacttggctcaaaaacccctcctccaaggagccttcctgaattttcctgggcttgtatagtactctgtgtttgtgattctgtgtcacgctctgtgtaagtgactccatgatcaaagctttcctgttgtaattgtgtggatttacttgttgcccactgtccccataccctccacccccacatggtgtgctttctccagaaagggactacttctgctgaccacacagaagacgtgtgtaaagtctgtgtatcaatgaatggattctcatctttcatagttttttttttaaatagttttatgtgtgtttaacttaatttcacttaaaaagatatttaccagaagctgaaagtagggtgtgatgaggttgggttcaggaaggactggtatcacatggcttccctaagttgtatattacattgttaggacacctgacagagctgtggattagtgaatcttacggatggctcttttcagttgaatataattctgaagctctgcaccattcttcccactgtgttgctgttaatctaccataaaccaggtagattctgcatagttggaagtgatggaaatcaaggtgaatgcctgattctttaaatctttttttttttttgagatggcgtcttgctctgttgcccaggctggcatccattggtgcaatcttggttcactgcaacctccgcctcctgagttcaagcaattctcgtgcctcagcctcctgagtagctggaattacaggtgggcaccaccatgcctggctaatttttgtatttttagtagagacgaggtttcaccacgttggccaggttggtctcaaactcctgacctcaagtgatctgcccgcctcggcctcccgaagtgctaggattacaggtgtgagccactgcgcctgacctgaatctttaaattcttaaaatcagttttagtcaccaaagaagatactctgtagcttaataactttgagttactgtaacggaatcaagtcactggtattgagacatttttatttaaaaattttaaattagaatcttactatgtggaaaaatacggtcattgttggaaaatcattttgcctctttttaacagcattcaggcagtttttttttccctttgaaaatagaccttggtctgtgttgttggaaagcatgtaattttcatttgttttttttcacctagtagtgcttaatgataccatgtgaatttttatagtcccagctgcactgaagtgtgtgccctgaaacttcggttggattaagaaaagtagcttggtgtgagggctgaaattggtgaaatgggagaacacagggttgcatctatatatattgcaattaatattgacgagtgggcagaagtccaacattatcctagggggttggctaatgttctttgtacaccaatgcaagtgagtcttttccctccaggtgtgaatagtttaatttagtaggtcgattagtagaagcaaggggtgttttcttgtattccagtttacattatacactcaacattaactagctgtttaaggtacagtgcattgttgagtagttgtggtacaggtatcctgagacgttgctaacccatcttggtatctccagggcctggcatctaatgtagtaggtactcattagcatttgcaacatgaataggagaatgaatgagtggttgttgtggcaaagtctcttaaaaatcctggtccctgcgtacctctgtagccttctcatctccccaccttctagcaataatattctatttgtagcttgttaaatactccacattctttccggcctttggacttttgtacatttcattccctctgactctcacaccaccttccctgtcccctatcccctttgtctggctaattcccgctggttctttatgacttagcaccttctagaagacgttttaggaggcatcatagtgggtattttgttgaaggcctggtttgtttttcatatctctatgataacatatctctttgggtaacaacagagagctgctgactagtggcaccgttgaaagctgcatatctgaagcttcttttcaggagaatgtggatcatttcaggtgcctgcatcatttgcatgtacatcttccaaactctattggtactttccatttagatatgggcagaacatgatgctacagtaactgaaacagaagttaagttagcagcagattctcttccatttatagcatcagtatcagggtaaaatgggaagatgaaggaaaactattgatgaattacctttggtacagctgatactaaagtgggtaaacaggcaaaaagaagttgggaaattgaaccattctctttcttttctttttttcaaaattagagacagggtcttaatttgtcacccaggctggagtgcaatggcacgatcctagctcactacagcctcgaactcctgggcttaagggatcctcctgccccagccgcatgagtagcaagtgcatgccaccatgcctggttaatttctttcttttctttttctttctttctttttttttttttttttggatgagatatgggtctaattatgttgaccaggctggtctcgaactcctggcctcaagcagtcttctcaccctaggcccccagaatgctgggattacaggctttagcaaccacacccagcctgaaccatttcctttctgatttaacttaggaaagtttgctgcatagtaggagctcagctaacatttgctgaggatgaaaaaaataaatgaaccaagtttgttttgtttgcatctttttccttttgctttacaataatatattttttaaaattccctgtcttttctactacacttcttttggccttcatagctctagccccagactatacttagtgcttttgctaagactgactcatcttgtttgattgctttagtgatataagattcttgtatccataggaatggtgtgagactgtatgcctttcatgtttgcaaaaatgtaaaccagaagagccagttattggtaccagtaccaactaattcctcagagctatagggcagtattaaattactaagccagtgtggaaacagcatgatctaatggaaagctaattagcctttgtgtcagatgggtgtgattcaaatcttgtctgtactgctgatgggctgtgtgactttgggcaagtagcttaacttctctgagttcccctgtctctgttttttcatttgtaaaatggagtggaggggacaatattaacttgcaggatggcttgatgatgagaaatgataaatgtcttagtctatattagatcttcagtaaatggtagttgttttgaccactgttactgcaatgagccaaggtggctataagcccttcagtgtttcagtaaggacaagcttacaggtaaccaccaagatcagggcagaacagctgatttaggtctaaacaggttccatcgtgtgtcttcaaaaaggttttcctttttttcctctggagaaaattcagactggtttaagaaggaaactgagagcctcttccctccctatgttctgagtgtttcagagatggccagaaatggatactagttactaagcaagacctttaaaaaatacacgttacaaggcaggttggtatgaaggaaagagcactgacccgtgagttattctcgcggggccaggctctgctccactcagctctgtgttctctgccaagtccctttagatcaatgtgtcgcatgtccccccattgtgagttgagtacattggaccaaaggattatagtttgttttcttcccaggcaagtgcctcctcctgatggggagttagtatgatgtgggtggccccagtaggactgggctggtcttactgttctaagaagtgttagcagaaaaatggctaggcattggagtaaccctgtgatttgacattttggggcatcctttcatggtacgatacacctggccaaaagtctcccagctcagaaattctataactagaaatgctttgaataaatatatactgagaaggtattttggggggaaattttaaaattcttatctgacttggctagagcaactgcttacgacactggacttcttaggggtatcgataatggttgtctttgaatggggagtggatttctcagcttcctgggaacagcaacaaaattcccccaacaaaccccagggtgtctgaagcgcctgctttcttctcaaagagcccgatcgaatactcttctgtgggctcaagagctatcaacagtattgaacagttagactagaaggatgggttgagaacagttgctccctcaaggcttggaaattaacaaagaccatattagtaagaatggggagggaggtgggaggtgaagagaatgagggctgggaggagcaattcggaagtggagagggtgattggaggggtttgtttcccagacagttttcaaagaagagggatttgtgtagtatgccatgggactgaagatgcagtgcaagaccagttgatgttcttcttttaatcaaccaattaatttctctatcatgtttcttttaggctaacgaagtgtcttctttcctttatcatggccattgatagcaagagcttaagggaatcttgcctccctgggctcaggataggctggagagaaggacacacataagaggaaattgacattttgcagtttttgttgttgttgtttgtttgtttgtttttttgagacagtctccactccgttgcccaggctggagtccagtggcacgatctcagctcactgcaacctctgcctcccaggttcaagtgattttcattcctcagcctcccaagtagctgggactacaggcttgcaccaccgtgcctggctaatacagcttttttttttttttcttaattttatcataggtaagggaagacgatccaatgtgcagagaaggctcaggttttcattttagtctgcgggtgattgatttctttctttcaaggggctggttgaggaggtcagagtcttagaaagggagaagaaatcagggaaaaggagaaaagaaggaatgagatttatgaccctctggatcccagattttatgtcgcgtaaccattcccaatactggaagttcatgacaccctgagaaacagccctggaactcagagcagtgatctgcatgcaaaggcaaaattaaatagtccagcaactgctttgaccgagagacacacatagtactattctgggtcctgagtgctgcttccctttcatttctcccctaggcacagattccactggctcacagagtgatgagttagaccacccagggccacttatgttatactgagggcggatgctgatagtgcttatagaggaattatttcaacaatgagacttttccattattctttctgcaatcaccctctatactcagaatgtggaaaccttggcatctctcacttaagaacactgaattcatggtgttgctcagagagtcctgtcctggttccataacactgtgataataactgaagatctttaaaaatgtatgtatcttccatttttattccatatggccccttaggtaacatgacccaatggggccattaaatgaccctgcctacacttggattactcagtacaaagcaaatttatggttgtttattctctcctcctatcagctattagtgcctaatcatatggtctatcgatcatgagattaatcgcctgcccaaagaggcagcaggtcttgtggaatgctgcactgcgccagactgaacttcaaccttttatacaaactggaggagtcaaaatcatcattcactgcctgaaatccttgcaccctgggcctcctgcaccccaggaggtaaatccctgctttttcaaacagtgtactttgcacttcctttccttgtgtaaaactttacctcattgattcaggcaggcacttgtaaataaaatcctttccaaggcatcctataaataatgatctaagctgaaaatatgtgggctttattatacaaagccccatagtgctgccataattaaaggtctgtcagtatttctattataaattctcattttagaagatttatcactgggctattaaagttttctctaagactttccaagagtatcatgatctaaggccttttttttctttctgtggaatgtgttgctttgaagatataaaaaataaagtccagaaacattatcacataggagtacacacatgcagagattggacactttaaaatttgagctctgcctccactaaagtggcttctgtttgcctcttgtgttctcattgcatttatgagaacagagaatcattgtagggctaatactgtattgtaatatttgtttcctggtctgtgtcttttactctgaggagagagagggcagggagttaaatcatttgtctttctggccctggttccaccagagggccttggcaatataagcactgggtttgttcagtaaatgagccccagggtgagagtcaggaaattttcttcctagtcttcatctagtcattaaaggtgaggagtgaattcaggcagtgaatttaggcaagtccctttactttcctgaaaacaagttttctgatcaatgaaacgagtgtgttgagttcagggctagtaaatctgtttttggtgggttgaatactgccggcacagtgttttcaaacacttgaattggaatgtctttagatggaatctgtgccttctagtttgccataatccccactgttccctattatattatgttgtatcagcagcctgcttctatcatttgcctgcagagtctataagcatttatgattccttgtaattattgatcatgtggtcttttgttgctatactaagggtctaaatctgattcaggttagccgttgatgcctttgactgtaactgtaattctctaactttcaacccttttatcatcaaggacctcaactattattttttgttccatatttgaaaacttttggtgttccagacacactgcattggttaataactaattttcccgttgtaaaaacagacacgtgtaactgaacacacaaatgagccatcaacagtatgaatataaaagtgtttgtgcaatgagttggttgacgtttcagctagcttgttcagttgtttcatgggtaagtgtatagtttttgtttgaagttttgatatatgaaaaatagttccgaggtcttctgccttattagacatgtgatagacaaaggattctaggtgagaacttagtttattcttttatgagttgctgaactgccctggtcattagaacatcaagtaagttgtttatccacatgcagttcatgtcttttcagttgtctccttattggtcagcttagagagggctctacaaaacctggcttttacattcagtgagctgaaaagagcttcctatatgagtttacccaaaggcccttgttacattttctccctttagtcaagagtactttggaattttacattttctccctttagtcaagagcactttggaatttgttaaaaggattgggagacaatttgaaaacttggctctccagttaagaagaatcattttttacactttaactcagactgttggtgaatattgtaaattgacaatttaaaaacacacatttgttttattttattttattttttatttatttttgaggtggagtctcacaccgtctcccaggcttgagtgcgtggtgcgatcttggctcactgcaaccaagtgagccttggctcaccgcctcccagattctcctacctcagccttccgagtagctgagattacaggcatgcaccaccatgcccagctaatttctgtatttttagtagagacagggttttgttgtgttgggcaggctggtctcaaactcctgaccttaggtgatccgcccgccttggcctcccaaagtgctgggattataggcatgagccaccacacccggccttattttatttttgagacagggtcttactctgtcacccagactggagtgcagtgacacgatattggctcactgcagccctcgccttctgggctcaagtgatcctcccacctcagcctcctgagtaactgggattacaggcacacgccaccctgcctggctaatttttttgtatttttaatagagatgggttttgccatgttgcccagactggtattgaactcctgggctcaagccatccacctgcctcaccctccccaagcgttgagactacaggcagtgagccactgcatctggccaaacatacatttaaatagagcagatgaaagatctatagtgtagaagtaatctgcatataaaccagtcttaaattgagacgtgacctatgactgttaaagcagtccacatcacacaaaaataaagggcttggaagatagcagcctggtttaaccaggttagatataatttaacaggaagagatagtgtctacattgttgctaaaagcttaggctctggggttcctaatttgggtttaattctgtcttggttacttgttaattctgtcaccttggagtggttccttaaatctccctaggccttggtttcctcatttgtaaaatggggataataatggcttaccgtgtggaataaattagagtaattcatacaaaggatttatcatcatattggttatagaagaaacaatgaatattcatgatcatttttatcaagaatataattgaaatatatttctgagcgttgaggtttttctcttaaagaaaagtgtaaaggtatactttcttaagactgctcatacatgctggatcacccatatacatttccaggaaattgtatgttctagcaattctatgttccaaatgtgctgctttcagttttttcgagaaacaaatgatgtttgactttaaaattctagagttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggtgggtgcctgtagtcccagctactcaggaggctgaggcaggaggatggcgtgaacccgggaagcggagcttgcagtgagccgagattgcgccactgcagtccgcagtccggcctgggcgacagagcgagactccatctcaaaaaaaaaaaaaaaaaatctagagttgaaatttttctcttacatttccttttccctctagatcaatcccaattaaagtttcattgcaaaagtttcacaaactcatattggcattaattattattggtgtgctggtgaaagtcctaaagtgagttcattaagaattaaaaaccttggctgggcgcggtggctcacgcctgtaatcgcagcactttgggaggccgaggtggatggatcacctgaggtcaggagttcgagaccagcctgaccaaacatggtgaaatcccgtcactactaaaaatgcaaaaattagctcggcgttgcgtgcgcctgtagtcccagctactcggaggctgtgacaggagaactgtttgaacccgggaggcggaggttgcagtgagctgagatcatgccattgcgctccagcctgggcgacagagcgagactgtctccaaaataaaaagaattaaaacccttgagaaaactttaaaccctcctggactcatagagctggaggggacctaagaggttatctcctctaagccccattttccagataaggaaagtgtattttccaaggtaaaataagttttcaacagtgaatatccttcataatggctttttaatttgtactgtcactggagtcagccctcatttgccatgttatgattatgttcttcttgtgggacttgtatgtatttattagagaccattgagacgtagcactgggcattacttttgtggcaaaggcaccagggcagtaatcattattaatggatttcattatttgggagagcattttactgactatagagaattcattgcattgatctattgtgccacagttttattataccgggtagtttaaaatgatattctctaaactgttaggctgaaaaattgtccagtgttggcagttatcccatcagtaagacattccttttactaccgaaaatacatagttctgtcgaaagagaccttttgactggtccccagtgccctgactgtgtttaaatccctcactagtgaaataggaggattactactgccatcattgttctaaaacaaacttccttttggaagataacagcagcggtaaatcagatgttgaagaaagtaccagcttaacttcactttgctttaaaagggtttcctctttaattgacaagtgtcatgtataatagggcatggcaactcacatagtaaaccttgtgtggggctgcctgctggggttggagttcttaatgaacatacaagtgaatacactgaggcaaaaaaattaaagctctccaactgtggggtattcattctgttcactgtggccagtgtggtgatcagtactggccacaccagtggccaaagagaactgcattcatcatgtggctgttctatagctgtgagctgtggtgactgttatttttcctagtgatagttttcagtgacagcatagattctggtatcatatccaaggaataaacaaacactgtttttggctttttgtttttttgtttttgacataaaaataataagctatttttggcatatgcagacttttcacaaagtgattgttttcttgagctctggactacttggtaacattcataagttccttcactttgtagctccctctttccttccctccactccctgcaaaagagagcagaactgatttttcagaggtgatgtttacaacagttcaacacactcgaatgagcacttagaataatgtcaatagaggaagaaaaaaaaggacatattattatcaaattaagtaatggatgggcagtgatattttatttattaaagcttgtctgagtaccattggaaacagagtatgttggttctgaagtgcacagattagaaaggaatgttgagtttggaaacgtggcagcctgcagcactgtgtatggtttaaattaaacctttttttggaaagcagaatagctgtaggccacatttaagggaaaagccacagcagagtgagctggctgtggtttttcttttactctgtaaccggcccactttcccttgttttaacacagaaaaagactttggactccttcagaccaaccacatagcttctctgctgaccacaaaaaggaagcttggcgtagaagccataggattaatacccactgtctcttaacccaacagagtgtgaaaactttcataagagatttctctgggcagactgacactgtggttggactttaaacattttaaatcaagcacaactttgaattgcattatgccacagtgctctgtaaattgttatgtgtgatcccactgttaaaagttatttacatgaatccccaggtttcagagggataaaccactaacagctttgtgtatcttataaagaaatacaaagagaattaaaggtatgcctatgacacattatctcagatagagtaggtagatcatagtcagattttattattcttaagcaaatggaggcaattggcttttggcagaaaagccttttcatctttgaaaataataggattaagattgtggattctgttaatcacttgatcagctttattaattaaccacatttttaaattagaaaaaaccctttttactagatgtgcatctttcttaataattttacattgcaggttttatttaatatactgatctactcaggtattataaatggttgtttctatgtcctgcacattaattttaataattggaatcctactaccctgatttactaatcatgcatttgtacaaagcaactctgaaatgaccaaaaataaccacaaaaaaaccttttgtgtttgtatttatatttactcattcagatgcctaggattaatatgttttacaagaaatcatttgaatttacatcttaccatgttgaattaatcagcttttcataagtgcactgtctcagtattctggtttctatttaacagagaatctcaatggaagagattgatttgaaaagttgaaggaaaaatcgtgcatacatgtttcaaaactgtggtcttacagtaaccacagagttaattcttggttgactttatgtcgcgagaggggttgatttgctgtcattagagaaattggtctgtataacacttcctgtatgtgaagaaatgcagttgtcatcatgcctagaccattaaagcagtatttaaatacttccagttgtgaggagccatgcatttattttggttattttcccaggtgtcttaggagcagctgttttgtgctttactgaacttaatagttgaagaatgtgggaaagaaatggtgtactttctgggtaaagtattttagccaccctggagtagttgcattgcatcttgatcttttttcatcttggtagaattatactgtaactaattgaatccattgatcactgtcttgttttttttccatcttcttctccgaggattcatttcataggggtctatacatcagtcaagaaaatagctaccgaggaattaccgagactagtaataaaggtaatttaacctagtttaatattttttttaaaggcaaaacactgtaaacattttttacctggtgagagttaacttcttaattaggccatgttggaaaacaaatcaaaaagacacttactggtagttttcagagagtgagagaaaaaaagaggcaagagaaagcattgatcttggaattagatgacctggtttctaggcctatctaccccaatgcttttcaaacttcaatgtgcatacgaatcaactggggatcttgttaaactgcagagtctgaatcagtatggttgcagtgggcctgagatgctgcatttctgacaagctcgctgagacatccctgctgtagaacctctgaccacaccctgagtagcaagggtctgctttaccacttagctaactttgtggctttgggtatactgtttaacaactctgcatctcagtttcctaatctataaaattgggatattaatctttgttctgcctacctcattgggttgttatgagaataaaattagataatgtagatgctttttttttttttttttttgagatggagtcttgctctgttgcccgggctggagtgcagtggctcgatctcggctcattgcaacctctgcctcccgggctcaagcagttctcctgattcagcctcccaagtaattggaattacaggcgcctgccaccatgcccgactaatttttatatttttagtagagacggggtttcaccatgttggccaggctggtctcaaactcctgacctcaggtgatcctcctgcctcggcctcccaaagtgctgggattacaggcgtgagccaccgcgcccggcctgtagatgtaattttaaagtgtcaaataagcataaggcagcaaggacatttgtttatagatacagacattctttggatacctttcatcaaatcagtgtgggctgttctttaataggaggggcctggaactgtgaggcaggagaagggaactggaatccctgcctccctagtacccattctgtgcctttggccaaatcatctcccctggtcccctgttgcgtcatctttaaaataagggcttgacctaggttagtgctcttaaagggtagttgcaagactagcagcatcagcatcactgggaaacttgctagaaatgcaggttagattcctagccccttccgagacctggtgaatcagaaactctgggaatgcagtccagcaatctgatttctaatgagctcttcaggtgattctgatgcagctaaattttgagaaactttctgaagtgtcatccaactttgaaatgagatatttaagccttctctttataggttcagccaacagagagcctatctgtgtgatctctagacactttcccatctcccaggtagaggaagattggggaattgaaccttctgtgattgtattgcattgagcatgtggtaaggaggactgaacttggacggttaaaacctcacctctctggaactcggaatagattataattgcattgacttacactggtctagcttatccagttttggggctgctttagtagcccacaaacgctgactaatgcagatgactgtacacactgagaaagttctcttccattttagtttcctccttactctcttcctgttccccgaatggttgtcatcatgatatagcaccaagtcacattttatagacttttcaataactttctaaagttgatcacaatctagattatttgcattgttgtgagatgagggaaactgagaaagtaaaatacatgttttgttttgttttgagacagagcctcactctgttgtccaggctggagtgcagtggcacaatctcagctcactgcaacctctgcctcccaggttcaagtgactctcctgcctcagcctcttgagtagcagcgattacaggcactcgccactatgcccagctaatttttgtatttttagtagcgatgggatttcaccatattggccaggctggtctcgaactcctgacctcaagtgatccgtccaccttggcctcccaaagtgctgggattacaggtgtgcaccaccgtgcctggcagtacatgtttttcttaaagtcatttacggttacgtttcctttatctgcagtttttgtttgttagtttgtacatttggaaatacatctgaaaacttaccaagttcaagcgctagagagcacaatctttatgtacagagaagacctcctcgatgaggtctaacaacttctgttctagacacaagtctgatttttcattccagagcagcaaataaagtcatagtggacagctgcttcagtctggaaactagaaacaaacaagaggtgttagctggcagctgaacaatgaagaaagacatggagacactgtccaagaggtcgagatggatagtagcttgagatcctctctttctctctagacatgcgccatgtgcaacacacacacacacacacacacacacacacacacgcagacagtctctgactttcaacggtttgactttatgatgagtttatcaggatgtaactctgtcacaagttgaggagcatgtgtttatgtgtgtatgtgtatccgtatacatttacatttatatatacacacacacacacccctctataatcctgtatacttaaattcctaaatagttgtttgggtgttcactatattggaacgctttaacttgtgttcttaataatatctttaggaaaagattaaagcatgtttctgcatataataatattagtaacaaatgatggaagattttgctccaaaatgagttaatgtagaaaacaggtagtgattaaagtggtgaatgtaagcaattttgtaaatttataaagtcatagacatctgtagttatgaaggacctcatagataattttctccagtggtttcaaatattatttaaataggaatgtttccttcaggaccaaatctgtggagaagctatgtacatgtatttatttttttaagttgaaaagtatgcgagtactggatccatattattaataactttggcccacctgttctttctcccagaagcagccccagttggaatcagcccctagagcgaggagtcacctgggaagcttgttacatgcagattctgattctgtgtgtctgggaaggcacctgagactctgcatttcagataaactcctaatgtgttaaacatgcattggccacattttgagaagcaaggccctgggggaaactgtgcacgtagttcgaaaacctttgatgggttaacttcttcatgtttcaaatgtgaaaagacagagttataaatgatctgccaaaagccacatgcttacctggggtcttgagtcttgggaaggctgtgttcttttacccaaggcctgggtgggatggctgtgtccttaccctttgggctgaaggaggcatcctagtaccagggttccacgggcactatccgtattcttagtttctatcatgatagattatgctgggaacttgttccttttagcccactatctgtcccatggaaaacagtactctgaatcagaccccatggagggtggaacattctgattagccagcaagggcagttaggcccgtagctgtggtgtctgctgccacagcagaatggataagcagttctcagccaccaccccccacaacataatccataaaactctttcaacctttttttttttttttgcatgtctagtgtttgcaaatggaaaatggctgaggaaaaacagagtgaaagtttatataaaatatttataccttaaagatcttttatcttgtgtcattcaagagagaagtgaaaaatgtattgggagtacattatcaagagtacattataaatttaaatctcagattgaataatatcagctgctaatgtgtggagctttggaaatgagtcacttttgaatctcaagaacttaactgtaccaggtcagttacacttaagaaggaagtgccttttgaaaaaagaaaaatcctataccggaataaagacttatactaatgggcattaaagatcaaatacttgacataatattcatgttagaatgtagctacataggaataagttgtaggatctgagacactttatggaatgtttctcaaaaacaatcaaataattttggtcttttctttgtgaagcaatataacctgtggttacgagttatgtgtcttagaaagacttagatttgaattctctgtctgctgcttgttagctgtgccattttggatcagttcttttctttgagactcactttattttaaagcaaagttaatatacctacctaattggttttttttgtaaaggattaaacatcatggtatttgtaaagcattcagcactttgcctagaattttatagttccagtaaatagtagctatttttatcattattgtcaccatgatattgtttttagacctaactagtattgcatcattctttggtgacctggtggtgtgctatggaagcgaaattggtgtgcctgttgaaaaagttagtagtcagaaaaaaagacatacttttataagtgagactgtgactattatgctggacacctgcattctaactagcaaaacagaaaatactttgttggttttaatggtgctttgtttttatactgcatggtatctatttttgtatgctggggtcttaaaatgcttggagcatctagagaggtaactaaaggaatgaagtaggccatagacatagcaacagcccatgtcccattgaaaggccatgagtcccagttgaggccccttggctctagccaattggtgctgtgtgaaaatctgggcccagtgttgtcagttcttttaattttttcctaagaatctggaagtgcagatttttacatgaatcataggatgctttaaataattgcagctgtatcttgagaatgctgttggctgcaagaaagaaaaattttagtttaacagtggtctaaacaaagatttttttttcttacatagcagtgagtccagcagtaatagctagtgtttttatttgctcactaataccaacaagaatttagacactttccatttttctgtcctgacatgcttcatttgttgacttgaaaaaaaaaagtgcttgtcatttatggttgccatatgtatgttgaaggtaggataatgaaggagatacattagactagccttatttattccatttatcaggaaagtgaaaacttttccagaaactacacaggagacatcccttatgatttactggccaaaactgggtcattctggctgcaaggaagcttgggaaaatgtctcaagctttcttttttttgttgttatgtgttttttttgtttgtttgtttgttttttggagatggagtattgctctgtcgcccaggctggagtgcagtggcgtgatctcagctcactgcaagctctgcttcctgggttcacgccattctcctgcctcagcctcccgagtagctgggactacagccgcccgccgccacgcccggctaatttttttgtatttttagtagagatggggtttcaccatgttagccaggatggtctcaatctcctgacctcatgatctgcccacctcagcctcccaaagtgctgggattacaggtgtgagccaccacgtccagccaaatgtctcaagctttctagcctctacagtgggagatggtgaagaagtgggaaatcattgttgcacttactagtgaacagttgctgtctggcacagcagctaactcaacatgaaacccaactgcaggacctgaagaccctgtggcctgcagtatttatcaaaaatcttcagattggggattataaagtgaaggtatcatttgggtggaaaggaggagggtcggagaggcagccagtgctttatttttttgtttaaatggtttcgtattatatatacgataggtcattgctaacaatgtgcaaactgttgagggaacattgtataaatttatttcttggaaaagtttatttagagttttagtggagaagctagagaagaaaataccatttaatgttatttctgtactgctatattacattttaatatatgaattactctattttttaaaaatgatggataaactacacttccctttagttgtttttattctgagataaatgcctgttttgtaaatcattgttacctgattttggtaatctctattagaaagaaatctctttttattaatatctgtatacttaactcagacactgggaaattcttgcaaaatgctttacaaaagcagccattttaagctgattaaaagtatattctatatgcatgtatgtagttgaagtgctaccaaaccacgtatgtatttagttaactaaactcaagaatcatggaagtttgaagaactccaaatcacagctaagaatgcactaaaggaaaaccatatctgtttgactccagcaaattgactcgtgtgatatttttgcttacacctttctgcagcttaactgctgagttagctgttctttaatgtccttgacaaattcaggaagtcatcacatgtagataaattgagaaaaatatttctgccaatttggtcctgatcatttcttcttggggttataaatttgggttttcatgatctagatgttaataaaaaagaaccccagataatctgaagggttactcctcaatattactatgataagtttagggtctgtgagttggctgcctactgagtacctaaaagcatgggaacttttacaacatataatccaatacgtaatcactttgtcaggctgagcaagttagtggaatctttagtaatactacgataattaaatagttaagctataggataaaaggcaaaactgttttattagggaagactatgcttagacagtcttttagaatgattgaaagggtatatagatatgagaaccagtctgctattccaaataatctagttaggattaaaaataaaaattttgtccagatgctgtatgaaaatctactttatagtaggattataattattgctttgttttaataggggactcttagagacaaggaagaaaagagtagggaaacctatttgtataggaaaatatagtacatttccattcaatatctacctataatgtgagagattatgccagacgcattgaaattgctgtctttaatcttcatcccaatcttataaattagcttttgttaccactgtttccttgatgaggatgccaagtccacaccaaatgacttgcctgagatatgtattcattacattttggagttgagctttgaacccagctccgtctgtgttccatactcatttcttttccctgtatcagaagatccacccacactggccaactgagaagaaaaatagcagatgggcttaaatatgggtaaatgtatgataatgtacttagtgaagaaacacctaccaaactacttatagtttatagactcttaggtgttaattttaactcatgaaagaaacctgggagtcataggtttctttcttaaatatgggtaaatatatgataatgtacttagtgaagaaacacctaccaaactacttatagtttatagactcttaggtgttaattttaactcatgaaagaaacctgggagtataggctctctcagcatgattattgtctcttccctacagtcaattcaggagggtttattgaggacctactttgtgtgaggataaatatagtgttcttgtacttaaagaacttacatcttttccttccttctggccgggcgcagtggctcacgcctgtaatcccaacactttgggaggccaaggcgggcggatcacaagttcaggagatcgagaccatcctggctaacacggtgaaaccccatctctactaaaaatacaaaaaattagccgggcgaggtggcacacacctgtaatcccagctactcgggaggctgaggcaggggaatggcatgaacccaggaggtggaggttgcagtgagctgagatcatgccactgcactccagcctgggtgacagagtgagactctgtctaaacaaaaaaagaatttacatattttcccataagacatttcttatgttcccatagtgagaaaaataaccctgtaaaaacctctttaagcaatatctcaatctgtatggcaaggaagatagatgagtgtactcatgtatgatcgtgtactgatttggagtatgttttggaaatgaagactaaaactttcactttaaaataaggttacttttctctaaaggaggcattttctttgtagagtcattatgatattatttcatagctattaaaatttgctatcttgatgcttggttattcactgaaaggaatgaaatatttattaaggtcatattactgttgtgtacaaagggagccacagggtgacttttatgctatgcctttttggtagcggtgtttctgctgggttgcatcaatgtctgtagattttattgattataattaagtcagtctgcattgtctctgagaatttacatggctttaaaaatcaatctctcacatactcattttttgaaataatttgaaaaaggatctcagtagaagggacaaatctacaactattaatcctgttgttatttgtttgagccaaaaatggtgttatttctcattaaaacatttgcaggttttaggtgttatgatccttttagttttcttttaatttcattttctctaccaccaagctttcaaaggcattttacagcttatttttatctctggtagatttctgggtatgcctggcaaaacccctagctcaaatcctgaaggttatttaaattccagtgttggatgctctccacatatatagattttgatgtacacttaataagattaggaagattttatgccagttgataccttgcatgtacatgatggatcagataaaggaccatcagagggctagtgggtctgagctttgattgcaggtagtggggaacattgtcagagctttttttgtgttactttaggtatacatttttaagccaagtttagcacatatatttatgttaacttggggcattaataatcatataagcttgtggaattaacccatacagatatagaaaagcaaagccctaatcaatagtgcaaagaccagttgtgatttttaaaaaccactgcttctgtggaagtgcaagcattgacttatgtttacattatttttctaaagcaactgatttcagtgacacctacttctgcctaaattggctgtctctgcgtgtgcatgtatattaaaggtatatattgagagatatatttgaaaaagttatagtttttgaaataaaaaataccctagtaaattgcccttttatgatggggaatgattaaataaaacagcattatttataacattaactagaattaaatatacagctgggtgagactttgtttgtttggaatttcttaaaggaattagcttcagtttcctaaactagagatatgtgaagattatgaacaccaacatattcttatgaccttgatttttgaaggtgttcaatgaaaaattcttggattatattccttaaaattcaaaatatatttggaatactccaggactatttcatgcttgtaagatggaggttatgtatctcttttctaaggcttgaaaaattaagccctggctatagcaatcttggtgttgtctacaaacccacagctttggtcacagttttttgaaaacttaattatgaatggctgttaaatatttttcatttaccaacttatcagcatttccttttttgcagcaagacttacttcctttgcttatggaaggccctaagtttgtttagaaaacaaagtctgtcttatcataattttgttggtgagaagatgcagctatataaaacaaagaacaaacctgtgaaacttctgctcctcctatcaggctctgtttgtgggaagcctaaatgcataaaatagcaacttgttaaacttagccttgactctgtttaaggggatcttttatttgcaaaatttagtcaattcctccctaaaggaaaaaaagtcattttagtggatcttgaaagcttttagataaatattccaagttttttttcccctgctgctgcaagcttaaaaggcaacatagaaggtctgaagcctggtttttccagctgtgtaacaagcacagaagagaggattctaaatatttactcctttttccttcccactattctgtgttccagtcaaacttgatttcttgctgtttgtttccaggacacttctcaccctgcattctcttagtttgtccccccaaggaatgctcttctttccatcctcacatctctgtccagtagaatcctatttgtcattcaatctgcatttaaaatgctatcagctcttcctgaagactttatggacacccccaaccaaatgtggaaaggggtccacaatttccagtgcaattaccttacctactttttggctggactcagtactctcattctaccttgtgtgttaggtgttcgtgtactcagtaatgttcggtggtcaaccgatatttactaaatgccccttattgtcaaacactgtgttacttactggggaaagcgaacggtttaaaacatggcccatgatgtcagtaacctctttcttgttttttttctccccaacttggttctgaattcccagttggtagaaatggccttataattctttggtgttctctgtgaatcctggcttcttgcacatagtagctgctcaagaaatggtcattgagccatattagttgagtaaaccagttttcttctgattgaatttgaacagcaaagatttttagctttcttctttggtatttaaataaaagtaatgttatttgttctatttgccattatattgtgatttttggtggtacagaaaggaagatttttcccattacccctaccatgtagtcgttgggcatttgttgtttggaaggcatggtaaattagcacaggtcaggcagtcaattttattgagtacctgtaggcactgtgttggcctcctcatctggctatatagagctaccctggagatcctcatgcatagacaactgtctgactgcaacctctggacaccatcagctgtggctttcatcaagttcccaaaggcatccttgaccccagaggttaagtgaatgaatctcacacctgtctccctgaaagatttctaaaatgtcagtggcatttggacaggttcacagctgctctgatccacagcattttctagaacttccttttacctcgatgggggaggaggaatgcctgtgaacttgagctgaccttcaagacgctgtagggctcttgggcaaattatggacaagacctacattgttaggataggcccagaaatccagcttgctaataaatagccttgggaggtgctcacagtcgagtcatagcatttggcatttccctgtactctagcctgtgtaggatttctggatgcttaggactgtaaccaaacttgaactcttgcctgggaatatgccctcccccacacccccagacctttttttgccatctaaatgacaaagataactatcagtaacattttgaactttcctacaaaattgcattcttcgtggtgtatagtaggaagcatttctttaccttggaactttagaagagggtctgaactgagcaaaaattagtgtccctgcctttttaacggctggacacttatcacaaagctgtgccaacatcagtgatggtgcacccacaaaggtgtttggtcttgataagcttctaaagaagcagactttgttgttgttttaaacagtaatgaactgtttcagtttcataaaaaaaaaagagacattctttcttaaatagaaaagggcagaaagtttatagagaataatgtctaacttgctaatgcagtgtttgcctttgctctgtggcatgtgtgtgtgtgtgtgtttatgtaggcatgcctacacggctgcttgtgttaatacttagtataaagccttaaaatggataccagattggctatgtaaccttggaagatttatttacactctcagtttcttttattcccaatcttttatcaaatggtgtttattatattctctgaaaccattaaataaaaaggactgtggaaaaattctaaaatgctaaaattattccaggctaaaaaaagtattacaataggatgatgatgtttaacccatctacttgaaataaaaagccgagcaaatcgaaatgtgatatattttagaaggtatttcttagagaaaaaaatgtttaatgttccttctagactgccattattcattgtatttttattttaaacataattatgaaatattttgaaagtaatcaagtaaatgtggtgacatttttttctctggttgagccaagtgataataacagataactgttatctataatgcatactacgttgactcattaaagcctcatctttgttaaaacattgaatataggatttgagaagaggagaagtttccttatttaggaaaggtttttggtaggtctttcttgaagaaatggagaaaatggcctgctgatctaatctgaggacgaataagagaatcctcctccctgtggctatcattcctatggtgctatacctgtgtgggtgtggatgtgatggtgtgtgcctttgttgggggaaagagagcacagattgtcataaggttgtacccttaattctcatcttctgtacttataggaactgtgtgcttgcctagagacagcagcatttggtccttgaaaaacgggatttcctgtgcaccccttagaaatcctcaggggctgatacaaagagtaatttcaaagagtttaccttaagagctttgtcactgagtgcagagaaaggaatttctgtgatgattccaaacttagagtcagtgctaaggaagaatccatagagctccaaggacttcaacctcaggggagaaaagcagtaatttatggatctttctagaaattacggttgggttctttcccctctcaacccaggcttccttagtcacgtgactggaatttaattatcagtgccataaataatcttgtgaatggaagcagtgtatttggcagtgaatttctgcttcctaaagagaaaggaacctttagaagttatttgaaataattctgtattagccacgatcctggaggcaaatggtcacagaagcagaggatggtatccccagagaaaagtgggttttagatgagtcagataatgtggatatgtgctggtgacgaatgacatgaaggttggatgtattttttaaaatacaaatttaaagcaggctgtatttagaagtttatttataattggttttaggataaagccagcctgttgatgcataacagagttgatcttttggttccattagcacccttgaaatatttaacaagaagctgactttagcatctgagcccttccaaccactgttggagatgaggcagtccatgttggataattcttgttgtaaaacaagcagacacctcctttgtttttccatcttgccccaagccctgtgttctagactagggaaggtcagctctttttatagtcagaggtctgtatgcctttgaaaatatccattcccttacctgtcctcagccagtaacaatttatgtcctgaagatagcaaggagtgctgatttaatttattttacaaacagtgtcctttcatgggagagagcaggctggtaaaattgtttcaagaatcagaacatttttcttggttatttataacataactcgacaatctagctacacagggcttcattcatttgagaaagactattgaatccaaaaataataatcctttatatttgtacagtatttgcagttttataaggaactcttcacgttcattttctcatttgatttttctgacaactccattagggtagagagggcaggtattgttacctccaaattacagatgaggaacctgaaacctgagtgcttgtaagtcctacccagggtttcacagccactcagtgactgggactggagccccctagattttaccctagctcaaaagccagtgctctttccactattccgttttgatacccttggaaagttcactgcttatctaggaaagaaaaattggtagttcttgctgaggaacgtggaaatctgaaggagagacagatctgagagagtcacattggctagtaagtaaaacaggaaaagaccaagggtgtctagggacctggcctcctgccctggttcattcactgtgtgatcatgggcaagtcactgacttctccttgcttgagatttattttcttctcttttcttttcttttcttttttgacagtctcattctgttgcccacgcaggagtgcagtggcgtgatctcggctcactgcagcttccacctcctgggttcaagtgattctcctgcctcagcctcccgagtagctgggattacagacattgcaccactatgccctgctaatttttttgtattttaatagagataaggtttcaccatgttggccaggctagtctcgaactgctggcctcaagtgatccacctgcctcggcctcccaaagtgctgggattatagatgtgagccactgtgcctggccctaattcccctttatgttttctctcacctctctggccagggctctgaagatattcctgggagaatgagggtacatgccacagagggagccttgggtttacagtcagcatagccctgcccatttccagctgcgtaaccaggagaagtggtggcttttctcagcctcagtttattctgtacagctggggtgagggtggtacctaagagaattaagtgaggtaatggatgtagggtccttggcatagtgactggtactcaatatcctctaaataaatattattctgtgttagggaaaagtgaatagagataaatgctaagggtagaggtgacgagagaagtggatggagacaaggatggcttttggatttgactgttttctccactgtaagcactgtttgttatctttcagctttcattttgtctctcatcttttcccccttcagatgtgaggtgtcttgaaggaagagacatttagaaggtgagggcattatgcagatggagaggtcggcggctaaatgtggttactgaagccctgccttgggtctgttcccagccttccttgattttgaaacacatgcgctctcagcaggccagggtagtttgcaaagctgttgtggaggcttttcccaggcagtgttacctgctccgaaagctgcaagcgtgcctacacacacttcacaaagcagatggtttcttttgctttccatgtggtctaaaaatcaaatggacttttaatggaaaggttggggaattccacactcaattatgaatccagtgcagtgcaaggggcagagagatggtataccacaccttttagaagaatttgttactcctggtctcatctggcattggagtggggaggtgagaaagaggaagtaagtaaataaagctgctactctgtgctccaaaactactgagtagctgacatctgccatttgcattgaaaactgagaaagaggagtgtggttttgtttttgattccacaagatgatgtggaagggcaaattgttttggttctatgtgataaactttgagtacctcctgtgtgcctgatactatgatggatacatatgcctagggtaaaaggatgagaagacacagatcatgtctttgagacgtttagcttgagtcacatttgctgagactgaagttgggctttgcatttgaaaagctagcatttttggatgcacttttgatgggacccaacaagagatgatttgtttatttgggaagaatcctggcatgcagtgaggagcacctttgtagctagaacatgcttagattttggtattcttgaaaatgtggcctcctccccaatgccagtgtataggatttaaaaaaaaacaaaaaaacacatctcaaaccttggcatttattgaatattaacaggccaggcaccaaagcattattcagcattgacacttaaacttttctgtattgattattattattattattattattattttttgagacaggatctcactctcttgcccaggctggagtacagtgacataatcttggctcactacaacttgtgcctcccaggctcaagtgattctcttgcctcagtcttttgagtagctgggactacaagctcgcaccaccacacccatctaatttttgtattttttgtagagacgggctttcaccatgttggccaggctgagctcaaactcctggcctcaagggatccacctgccttggcttcccaaagtgctgggattagagtcatgagccacagcgcctggcccttatcatgattttgagtttatgaaaaatgttgtataactatagatgggaaaaactattattgaatgttgttgtcattttctaccattgtaattgttagggtagagtaccaaatggtatttagcaaggtaacaatgccatacctcctccaggtcctcaaaaaaggcagtattaaaaatgaacctacactataggaagccttattctagtaggccagtatttatgcagatgattgttacatttatttattgtcacatgtcatagtctgtgtaagtcagttatttcacaggtaagctacatcttcatgtggttgccttctgcaagtgtctctttccttcttaggtcacagctagctatatagtcagtcacttcctcacttgctcatgcaacaatttttttgacacctactctgtgccacaaactgtaatagtcatgccatcacgaagctcatagtccaggggagaaagaaaagcaaagacaatacagcttgatttgtgatagaattaatgcagagtgccccgggctatctttctgcacgagaccccatcaaagccaagttgcagaggatgagtgggaattgagaggcaaagggttggtgcaggatggagataggaagcatggcatgtgtaaagaaaagcagagaggttggggagaacagggtgtgttccagcagttgtgcctagttctgcccaggccgaagagcaaggcaggagtccgcttaggaaagcctgcagctaactgctgtgtcacctctagtggaaggcttcatggcagctggtgaaagtctcctagcagggccatacttatcttttaccgggtgataattctcccccaccctttttaatttttgccattttttttattataaatgctgtcattttaagttggggcgtaaacgtagtatgcaggaggcaggcatgaattaatgaatagtaaagtcctcttaaattgccttataaaactaagtcctaccaggttcccctttcatctcagcagatgttttacaggatagaaataaaatctattttggttttttagcgtaccagaagataaaacatctggctgagtggattttctcccctctgattgcttacttccacttaaagcttttttcatataaaatttattgatatttttaaaaattctttcttattataaatgagtaatattatcttaagtttagaaaatttggaaaaagaaaaactacatagatgaatactacagttaaccttaatcttactacttgaagaactactataaaatgatagatggatattctttaaaaatttttttttctatgcttgtatacattctttaatatgagcagaatcaaattgcaataaactgatttttaaaaaattcatttattcaagagatacttgggctgggcgcggtggctcatacctgtaatcccagcactttgggaggctgcggcgggcagatcacgaggtcaggagatcgagaccatcctggctaacacagtgaaaccccgtctctactaaaagtacaaaaaaaattagctgggcatggtggcgggcgcctgtagtcccagctactcggcaggctgaggcaggagaatagcgtgaacctgggaggcagagcttgcagtgagccaagatcgcaccactgcactccagcctgggcgacagagcgagactctgtctcaaccaaaaaaaaaaaagagagagatacttgttatgtttccgtgctttatcttcatttttgcttggtaaaacctttcaaatgccctacagggaaatctggcaattgttgggaatatcaaacataggaaagtagaagtaactgtatttccctccttcccacatttgggtctctctatttatgaaaaaacgcaaaagaagcttatccggagatagttcaaagattgctttaaatgtgtcaagttatttcaatctcctatgccttctgtacacatcttcaacaggatttggtgaattcacagtgagagtcataataataatcgtgattttgaaaagtaatagttgtctaacactttcccatttatctagtgatgctatatgcattatcacatttaatgcttaaaacttgagctattgttatccctattctaacaagataatcaaagcatggagaaattaactctgtcttgctaagatcctcagatatgttctgaatcataaaaggttatgttatatttagcacagtgtttatagtaagaatgttttctctattgtgtgtgtgtgtgtgtgtgtgtgtgtgtgtgttggaataccattataatctataagtctctcttgattttcagctagtgtgactcccctttccataactcccacctcaaatttgaaccatcctgaatagagaggagctttaataaaccaactctattattggttctgtaagaccttgacatttgcaaactttattttttgccttttctcccacacagtagccactcttgcaaatcaaccttgggaagttagcattcttaatgaagatctataggagactttatccttagacagtaaatcagctctttcaaggcaccattcatctcccttcgagcgcatgaattggtatatggcaccttacaagagctcatttatcttatgtgggtccctagttattacttttgcccacttcccctagatcgccagagatcaaggcagaaatgaagtagaggatggctttgcactttgaaaatttgccaaggtcagctgaggtacctgtggcattgacttagagctggtgttgagtattacccataacttttagggtgatatcacccacactggcaaataattagtttagtttgtcaaagcatttgaattgtgcttggttaaataaaaatggctagaaggtaaagtaataggggaaaaagtttgttaccttgagaatttttttcctctttaacatttgtccaaatcatattgacatacttttggcttccatattagtgataaggatgaatttttactaagtgcctaggctatatgctaggtgcttttccaaatgccttaaaaaacaattctaccacgatataggagccattatcctcctttcatataggaggagctgatcatcactgatgttaaataacttgctgaaggatatgtgtaaccagataggtggaatcaggattcaatccgtgtatctccagtgtttgcccctgtgactgtggtaaggctgcagccttattggaagtcatccacttgtttaaaaggatgatgcatactctgtgcataatgtttgataacgaattaattgaagtggaatagcatgagcttacagtttgcagtggaccccgaagccaggctttcattgctaaaggagctaatacttgtttctgtggtttgggtttcctcacaagcagactctgaaacaaggttttgagtgcaagtattatagtttatttgggaggtgatcccaggaagtatggtgagggcatatactcaataacggatgccctaatgagcagattatcactgtgagagattgggctccctgcctgtgggcacctccctgacagactgtagaacatgcctcattgtttaactgagaagcaactccttgtctttcactagttgagagttgctcctgagtgcattaagtcccctgccctttcagcctgccccactttgccatgtggacagagaaagccctgaggcagagagactacggtgtttgtgcttcaagttggacagcatgtctgccccagctccaggtgacctccacggagtgtgagcagcatgtggggaggacaccaatagtttctgttacatttgcttttgaagccagcatcagtgctgataaagatgcatccagactgatgcacctggctttgggggtgacaaccttgtataaacaagtgagacaggagaggaggcagtgaagctaggattcctcttaagagaagaaggtaggatttggaatcaggcagtctggggtattgttcctagttctgtacttactagctgtatgctgggcaagtcaatttgttcgagtctcagttttctcagctataaagtggacatagctgcctcacagggatcaaatgcaatgccattcgtaaaagcgtttgtaaatgataaagcgacatgccacctttgagtcattgccattggagctcctgattgaggaatctggtggagtactaggtgctagcagagctttgagggcagctgtttgctttacaagacacacctgaaggctgctatcttggctcaagaagcctgtcctcaaatatcctgacgctttgaaagtcaagggtaagggattcaaaccctatgtaggcccctttctctcatctggtttctggcctactgagagttgctaaccctgctttgcaccaggtgagactgtatttccaatagccccctatcgagtgcagagatgttttggggggtgaaagttgattttgattggatttacaaccccatatatcaagcactagactaaaggtccatcagcctttagaagaagccacagtggttttcatttctttcactctgtttatcttctgaccaaaggctgactcttccacaggcggctgatatcgagtcaatcaggactctttatgcattatgtgaatttggccctcacacagctgagaatggcctgaatagctaagagagcatcctctctgcagcacctcttgactcctcaggacgagtcacactgaaagaggcaggtggatgcccctgattgtgtcccctcccatccagcatcatggccagcactgccattccttcaccccacccaccccagttagcccctggcttgaactccgtcactcaagagggaacattaaaaaccccacacctctgactcatactttgattttgtggcctaaagaggcaaagacgccgtaaggagcttttaggggccatcactatggagcctctttattgcccagcaaaagccttaaatgataatgggaaacctcactattgattggctgactcttaattcttcctctttgggttttgaagtagaagtgatggtccagaatatttatattactcattggatatattaaattaaacatacaaaagtcctacagccatttaagatggggttgcagcactggtgaatacgactttattaccaagagagaagagtagcttttagttgtggcttagctggaatatattgatgataagaatggctcagcagacagaagtcttgggactctcaaaaaggctccaagtgtgctttcttttaaaaaagttatttaggcccatcctttataaacacccaagtagatggtctgatggggtcatggtaacaaagattcagcttctatctaggtggatggtaagacccgctaacatcttggcaaaccgtgttattgggccattaaggaccagtgcttgaattctggggctgaaaattcaacgtattcccttataagaaaatgtctgctcatgataagaagtcacacaaagtacaacctcactatagtacaggatttagaatctttatttctccatctcatcttaaacccattggaagttagcatggattagagggtcggttgactcttctcaatgacggggctggcatataagagctaaaatttttattattgagttactactcaaggttttaaaagattttgacccctggaaaaaaatacagtgcttgaggcagtgaaatagttaatatgactgcctcccttacaggtttccccagatatgcttacttgctgtacaatggataattgttagctcttgttgtgcagatgctgttgcagatggagtcctgtacctgcatgcatagcaaatgaattagactggcaatcccctttataaagcataaatatgtaatttgttcagctgttgtaattaaatatgtatgtgtgaaacagccaccattcaggtcattaatgatgcgccatgccaaattagagcttacagacagtaatgtacattgttgtgcaatgagggaattgcaaataacatggctaagcctttcctagtaaagggatgcattcagcagctttaaaaagaatatttacatttgtaacataatttttatttagaaggtacatttttgttcattgtgaaagtctgtaagatggaattactttcatctccactttagttttattattgttttaacattttatcatacaaatgcaacagactttattaaacatgctgcttggtgataagtgttaagtatctacttacatataaaacagcagttacccctggttttctacatggctgtgatagaactgatgtatcatagcactgtggaatgtcttgataatttcattgcattaaaaaaaccacctcataatatttcaactctattccctactgatacataaagaaattcctgtgatagtaaatagtatttttatttccatagaaattgggctgagaaaaatgcagttatcaaaatataaacaaataaaagtggtaaatgtgcctcttgtgctttaattcccaatgaattacttgtgaatccaaggaatttcctaagaaaagtgtcatatatgggtcagaatggttgctttttaaaatttaagactcaaagtttgttaagtgaatgcacttgggaaaattattgctttgtcctttttctccttggttttaggttacagtctttgaaaatacttgaagctgaaatttaaatatataaaaactatttttactttaaattctttctgtatttgtattttggttgcctgcagtctatttttaacatacatgttgttttgacggttcatactgtgactacatgagctaaccatcttgacctttctgtccaccagggcagcaggaggaagcatcttagagttaattctgtcttgttcacagctgggaacagaacattcctctgtgatccccttgcacatgattcactgggatctcttggaagctggacttgatactataagtcctaggcttctaaggtcgaacacagatcaaacttagtggcatgtttggttaagagttagattagacaaaaccaatgaagttgttaaaagtttcagaaacaattgaaaatgaaattgatgcatgattttagctttgcaacaaattcaactttagaaatatccttaagcctaagattaatcaagattcaggaccttgaagaattttcaaagttagaactgtaatttgtgtagggacgtaaaatctttattttcaacaaacagcaaatgtttccgttaaacaaatgtgtattttatttgaaacagatgaaatcataacagtttggcttgctttacctaagttattgttccataatatcaaaaaaattacttaaaataagttcttctcttcatattccccgaagtttttgtccagttttctgtatagctttttggttcagccaaaaagagacatttcatttgcagcattagggaaaagtttaattattgtttatgaagatagaaatgttatatgaatgacagtgatttaaaaatattattacttatgattgtagtcaaccttttccccgaatattgaaaaccatgaaaaggctttgccctgacagctacatgcttagcattaactatacttgcaagttttccaaaaagatttttttcaagacctgttttcatttacttcctttatcctaattagagatcgtaatcttttgatgggcagcttctcttatttctacctgtttcagtactatagtactggtaaaatggcacagtgtatattttggttcttggagggagacttgggaggatccattactttaaaatattttgttgcagccacctatcagaggtttcttttaatttcttttactgcaggaatttcagagatgcttaaattatagaattatggactacagaattatagaatacctagggatgggaattgggaggtttgtaggaggcgtgcacgtcagaaggtgggagccatgcagaaaggtcacaggtcttatctaggtagtttcaaggagcaaatgcttgttttgcagtagtggtggcagggtggtttggctcattcaagccccttgctctggaggaacaccgataaaccatcaggatgtcttttcgtcttgcgttaactgtggcaaggctgtgcattaaagaacataaccatcactaaaagggtgggaacaccccagcgaccagtggccagtggccaggtgctttatggtaacaccacagacatgcctggccaatcagatgtgatcttttgctggcacttgctcctttggcccccactgcagtaaacactttcccttggatgttggttttctgttgtgtctggcagccacacagggctgcttgaactttagccagaggcaaatatttatacatcagagtgtgcagtgttcaactggtcaggcctgagagggagagggagagacctccgtgccttttagccaaagaggatatgtcctttttttccccttccctttccaccgtgacatggtaaagtgggaccatactggatgtcatttgagcttgctgcatgtgcttctctccaaaacgtacacgtgcgcaaacttgggatgtgctttcaaaagagaggacgtcctgacatttctgcctgctcctttaattcctcttggaaagtttacggttaatattttccctggaacattgtcaagcttttgacagtgcctgagtgtatgccgaactgtgaaattgagccggagaagcaagttgtgagaaatctgtttctactcagatccgtaaggtttatgggggggggaaaaaaaaccaaaaaaaaaaaaaaaaacccaaaaaaacaaaacaaaacaaaaaacaaaaaacttcagaggggaaactgagaatgggactcggcttgcttctcctggtgtgggttcaggccgccattttaaggagccagtgaagggcgacgttccgctccttacatggcggctgtatttactcggccgcagccaatcagccggcagtgccaagccacgtgacatgccacgagggcacgcacagccatttccttgtttctaaaaaacttgctacctccacagagtactttaccttgttttgcatgccaaatgttcttgctgaatgtgtctagcagactggcatttgtccataaagttattttagtaggtaaaaagtctctgagcacttgagctttgtgcattctttatgtaaaatggatttcccttcttggccagaggccaagggtacagcacactcgctgggtgagaagagagcttctctgctgagaaactggtggaccgacacactctaattttttggcttctgaccaaacaagctagaaggatgccaaaattcaacaaaataacacattattgtgtgataggagccgtgctccaagagagcaggaactcagaggaacttcatactggccccttttaaaaaagcattgtcactttggggagctttcttagagaaacgagaggaaaatggtaaaatgcaacctggagagtaaggtataatttgcacatgaacacgaaggaaggaactgaaagaaaacagaggagtttaaagttacttctatgaacttttcccagacataacacacagttctctgacttgacttacattcttttaaccctgaaagttccatctctgtgtctgagcagaatgctggactgcttaacgttaatatgagaactaatgtgagatttaaacacttttaaaaggttttaatgtctaaggatagctgcaaattccaaatatgaaaatttggcaggcttttggggggtaacagaaaactttttaaacttacatgctttatctttgcaccctgacatgtgttaagtgagtcaaatcttcctgttaattactcttgtgacattagcaagttatgtaagcccactatacctgtttccacatatgtataatgaagacgttaaagaagataggtagtagtcttctgagccctaaagaaattgaatttgaataaacaactggaataagtataaaatgcatttctagtttttatgtggaaatttgtcaatcaaaaggaaaaaaaggggaatatctccagttgaagccaccatcatccttacccagactacttgggtaatcctgagtattccctctttttccattcttgttccttcacaccatagccagagtggtatttcaaagaagttagttagtttatatcactcttctgcgtaagaacctccaatgttttcttatgcatctagaataaaatccaaacttgttgcattggcctgcaaagacactgcatgatctgtctggcttctgtatctacctttctaaccccactttttttttttttttttttttaaccgtgactccttagatgctccagccatactggtttcctttcagttttcagaacctgccatcccatttgctacttgtctgcttagaatgcatttttcccagctccttttgtggctggcttattcttacctttcagttctttcagttcgaataatagccctgtaaaagagtgttctgtctaaaattgtccttcctgtttatattttccataatactaataacagtctgaaatgctcttgttaatttatttgattactcattttatttatttatcttttgcactatgatgtcagtcccacaaggatgcaaactacgtttactaccttcttttctaccttttgcacttttcctaatcacattgggaataaaatgttgggcaagttagaatactccaaaatatttcatttaccttaaattttactcaatcctacattttattacctatactcataagaattgtattataaaatacattgttaaacgaatgttttcagtgctccattgagagtcggtggagcacactggttgggagaagacagagctgtgagccatccgtctgcctgtgcttgagtcttggctctgccattgactagttgtatgaactgccgcaggtggttcagccactcagaacctctgtaaaagtgagatgtaaaaacactttctacatcataggattattgtgaagattaaatgtgatatgttgtaaaattctggtcacacaagtattaacttactgttatttttgctgccactgctattaattaatggcagtgtggcggctcagtactaggcaatgggcgtgcaactgtgatgagaaacgcttctgtccattaaatcgttcagtcagtggaagagacatgtatgtaaataggtaagttacctaccatacattgtgccaagacctctcacattatgtgaacagaatattaaagaattataaaagagggagcaattgcctctgttaagtagacagcaaagatgccttataggaagtagcatttgagacagattaagtttctttttaggtaaaaatatgtcccctagagataataataaaataatagcaacggatacctatgtacttcttttactaatgcaccagagtctgttttacatatattctctcatttaatccttacagcaaccttatgaaacagtactgttatcaccttgattttacagagaaggaaagtgagccaaagagaggttatgtggcatgcccaaggtcatataactattaaatgtcagtgctgggatctcgtacattttcactcttaggacatctgtgctatccctgcttagtcactttggcatcccagtggtgctgtacttttgctttcataatacatggaagccctggaaggattcagtaaagagccagtttcaccctgttagcccttgttgctttatttgtaaaatgtcaactgtaaaagtatgcacctaccttatagggtgattatgagaattaaatgagataattcaggtaaagtgcttagcatattgcttggcatatggtaagcatttaacaaatgttccccgtaactactactacgactgctattattattattatgccatattgaaatgagatctgtgatcccttgtgacctgcccgagccccccttctcatgttagcatccatgctggtatatccacttccaaagagaacaagttcccagcagttgaaatggcatcctacccaggttgctagcaccatccctcagctgcttctccaactgccataactgccttagtcatttaaaaattactcttctcgttttatatttcaactcagaaatcgatgcatctgtgaggcagtttgttttcctggggaagtgtaaggagcggtggtggtggcatggagatgcgctccgtttagactcaatattgccacccactccctctgcagtgtcagagaacagtctcagaaagatctgttcctttctttctagactcagtaccacagactggcctatcctctgcaactttgcttagcagcaggagtagagaagtattgattgcccacaacttgcctttaagtcttgtttctgtggtgcaggatttttaaaaagcatttaatgttttccctgccttgaagacttcagaaccgtataaatgccactgtttaaagtcctgtccctgctgaaaaccagggcaggtctcatcacagccccatctccattttccttttgttgaagtgggtctgtgtgagagcgggctgtgccctccttctccacagggtggggaaaaggcagccctgtagtaaggaggttgaatagcctcgctcactttgcctcctgcttgaggtggactccgtgttcccagagatgttgggcctggtttagccagttgttaaactgaagcagggttagcttacccttgaagtgtttttgtttgtttgtttttgttgagacagagtctcgctctgtcacccaggctggagtgtagtggtgcgatctcggctcactgcaccctccgcctcccgggttcaagtgattctcctgcctcagccccggagtaactgggaccacaggtgcgcgcccccacgccagctaatttttgtatttttggtagagatgggatttcgctgtgttggccagcctggtagttttcttacatgaccatctttagatttcagagaaggaagaacatgatcccagaaagcacacagagttacaacatagcaatagcccctccgagctcaacaaaaacatctattgtgtcatgggctgcaaagaaagaggtatgctgggaaccaataacaagatgctaggaatttttttttctgttctattttagcttgaaaaacttgttttccccatatgagttgtgcatttactcttggatcttaaaagaggacaatttattaatctgggtttaaatcctggcccagccacttggatgctgtttgattttaggcaaattatttgactttgtgctattgtgtcgtcatcgacatcatcatcatcgtcatcttttagctgaattctgtgactcttctagggcatttatggtagacagaaatctgttcttgtaatgtagaaatcagtcatttagtgtatctgaaaattcccatcttcaaaaactagggccagatttagtcattcttttactcttaactgttgctaccaggtcatacctaatttgtatttttccaagttacgtatattaaagtcatactaattggtgcctgagcaagttttcagattcctgtttgtccgattccatctgggtcaaattacttaggtacaataagtgcttccttgtctgtaaaataaggatagtagtatccatttaataggcttactgtgaaaatgacacatgatttatataaaaaatggccagtatggtgtctcttaaaaattgtggggcattatgaccagtcaggcaaataagggaccaaggagataactgtaatcaaatcaaagtcctggtatcaggaggtatagtagggtaacgggtcaaggaaaggcatggtcttctgtggcccagagaaagcagtggtcttggcaggtcgtgggctggcaaggtatggaggagacagattcagaagctaagcagacaaggacaaggagccctgaagattagagtgtggagctggggcctgaccttagggcagtgactcttgcccttctgcttctgttctgctctgcttggattgcatatggcttcaggccctggagttacaggtttggagagagtgctctagagtgtggttaaaagtcattggctgggtgcagtggctcacgcctgtaatcccagcactttgggaggccgaggtgggctgatcatgaggtcaggagatcgagactatcctggccaacatggtgaaaccccctctctactaaaatacaaaaaattagctgggcatggtggcgcgcagctgtagtcccagctactcgggaggctgaggcaggggaattgcttgaaactgggaggcggaagttgcagtgagccgagatcgggccactgcactccagcctgggcgacagagcaagactccatctcaaaaaataaaaataaaaaaggctgccataggttgcgtctccagctttcaagtcagtagatctatatcagtaagttcactgctagtgttttactatgcagactcagtttgcctatattaaaaagacttcctgtcttcttacatccgaggagactggctaagcaggagggctaggcgtgttgaatcctagaaactcactgaatacttactgatgaatggactgggtctgggtcacatcttggatctggggaactttagttcacatttacagtcttaggataaggaataatgtcacgtattgcttgttcttcttaccgtgctgtttgattttaataatgatatttagtgaatttaatgaaattaaatgtgatattaaagaataatgatattttaatagcattggttgagtgctgcaatgtggcacacaggtagcgttggaagcctctccatcagttacctcatttaatcctcacactacctctttagagaggtggtactatttccccccatgttttactgaccaggaaattggcaccaggcaggtgacactagaggccacggtcttaatgaccacacaacatggtcttcatcagaatagattccatctccatgatgctttgcactaattaattctttccgcagcagcaccatgaggttggcggttcctttatttgccagctgtttattatttctgtgctaccaacattatgccaggcatggattggagtgtggaatcattcctggaagccaggccatgttcctgagttgtgctgctgtaagaattgggatttaaagttccaaatgtgtggcttccagtattttccttctaaaacagacacacgtcttatcccatttttatggttacatcacaagaatgattcacatttaatcaaacaagtcaggcagaatgatagctaatctatctcagggtttgttgcaaatgttatttacacatattgtgatatacctgattgtgtctaggcatccactgaaacaaacaaacaaattttatgacctgtagttacacagtttctaattagaatatgtgggaaatcagggtccaggaatatgagttgaataacatacattcactctagaccatatttggttaccctggtacttaaaatcttagtcacatgatttagacttcttgcaacaccaacttcttttcttcctttctccatggcagtctttgtatcatttttttctgctgagcaccaaactcttctggcagtttttaaattgaggtttgtagttttaatggtctggtactataaaaagccaactttgtgccaaaatttttccaagaccagacatgggttttgacaccacaataaattaaagataaataaagaaactggcagtgaaaatgaaggatttttttttttttcaagcaagcaagggtagcctatttgtaaatttcaggcatgttttcttagtactttagctcaatgttacaatgcttagctacattaatctgttactgggtaactccagaaagaatgttagaccaaaccattaagagattggcgatttttttcccccttgagcattattgaaatttgacaacattctcatagtctctgctttcttttaaggatttggctatcaaaaatacgggtaagtaaaaggaaccaagagaaactaatgaccaaatgaatagtagtatttaaagtctcaagttgctatgatacaggcttcaccgtgacctgagtggataaatgctaaacgggatttgctttccggagaatctgggtgcctgttccaccaattctgtttgtctctagcctggtttttttttgcctcctccctttcccagcaccatttattttgggttctgagaaacagcttcctcccattacaggcaccaattcaattaggcaggagatagtgctgaaggtttttgtttccatcagcttctgctgtgtagatagtagctctgtttgaaaaactttgagaagttgttgtgatgtgcctctttctgggttccgatcccttctcagcctggtgatgccatggcattcaaatcaatttgtttctcttcccctcccctaccctacatccatcatacaaaatgggggtggttgcactaatcagagatctgcttttttccccccacagatattggtaaattattaaaaaaccataaattttcttctagatgctaagtaactcttaacagtcttctgagtacgtgagtttgggatttggccttgcccttacagagacctgttaacttttcaaacccgtgacttaaaatttactaaaaataacaagttttgttgttgttgttgttttgttttttgtttttttttgacatggagtcttgctctggtgcccaggctggattgcagtggtgcagtctcagctcactgcaacctccacctcccgggttcaggcagttctcctcctcagcctcccgagtagctgggactacaggtgcgtgacaccacacctggctaattttttgtatttctagtagacatgggatttcaccgtgttagccaggatggtttcgatctcctgaccttgtaatccgcccgccttggcctcccaaaattacaggtgtgagccacagtgcaaagtgttgggattataggcatgagccactgcacccggccaaaaaataacaagttttgaagcatattagaaataatccaacaaaaaatttatttttctttagtcttctaaattagcaagttttaggccaccatgtggaactgaacctttttggaggtttaaaatgtcaaaataccttgccaggcgcagtggctcatgcctgtaatcacagcactttgggaggccatggtgggcagatgacaagttcaggagtttgagaccagcctgaccaacatggtgaaaccccatgactactaaaaatacaaaaaaaattagctgagcgtggtggtgggcgcctgtaatcccagctactcaggagacagaggcaggagaatcccctgaactggggaggcggaggttgcagtgagccgagatcgtgccattgcactccagcctgggtgacggagcgagactcttgtctcaaaaaaaaaaagaaaaaaaaagaaatgtcaaagtaaggaaggagttgtgtgtattttcagtcttgacttcatttactgtaagtgccgaagcaccaagtgggaggtggtttgggaagtatttctgatctaaagaggaaactccataaatcacccatggtaatgtgtctcattagcaacactccaagtagatgaccaacattccgaggagatgttgctcattttcatcctgcatcttggcctttgtgcttacctggccctagcttagattttaaaatttaaacatttttgtttctcactcttgaaaactttggtactcagattcttaaactcctctgttaaatagttttcagattagcctagtatagcgttcaaaactggaaaccactgccagaatcctctaatgtgggggaaaacatggctattatcattgaatgtgcctccaaaacctatcaaagttggcagatgtccatgtgtttggcttggaccaatttataaaacgttcacatgcttatgaaaattgttatctctgctattcagaatagttgagtataaaattgagcagaaaagcataataagagaagaagctctgctatgacttgcagtatttttcttttgatcactgaatactacaagaaggatcttttgtttgcgtgtttgtttcaaacttttccatgtatagaggtgtcttaggtgaagtgacaactaatgacatgtggaagtcactctctctggtgttctgtttcttctataactaccctcccttcctgtctaaagagagagggaatagctcctgaattaggtgaaacaaatagtttttaatgtatggtaaaaataagtcattcttcctctgttggcaaaattcattgtaggtgcctttcagtgtagttctgcaaatgttttttccattagttggagtagaaaagagatgaaggattatcagttgtcaggtatattttgcttctaccaaagatgatacataaatatgaaatatttgcagaacaagctgcaaaaccactaggtcctagaaataaaattctgatggttaatgcatttactttataatatgaccactttttccttttaacattttccccagtatgtccttagtgcctttcctggaaataccaaaaggcaaacatcccactttaatagaagtgataattgtagtacacattcttaagagaatgcctccttatgcctacatttttattgagggctttgtctacatacatccagagtcaacttaacttttggacccaattaactgattggcctgatgaatttaattaaaataggggaagtgcttgtacagagaggaacagcattagtataatgtggtggttaagattaacaagattgatttgacttgataattaattaatttgattaacaagataatttagtgtcaggcggagacctaggttcaaatccttactatagatgaccttggttttaaactctttaagtctcattttttccccatccattaagatgtcataaaaacactgaccccagaaggtagtgagaactggggagataagttagggaagtgctcagcacaacacttgggccagtcactgatggacggtagtaccttttgttattttctagtatttttaaagtatgtgttgtctgaaagacaccatgtctcagatcgctgtcagatttctttgagtgaacagagtcacttctttttctgaagacatcagtagtgcaagcatcatgtctttgccttgtattttgttcatctttttgcagttggaacgtttctccttcccttatttatatcaactttaggtcgtgttaactgtccctatattttaaaaaataacattttataatttccatgcaaacttaattaattttcacaaaacccctgtaaggtaggcaaggtagatattaggttatagagataaagaattgtaaaactggaaagaaatatggccttgacttcaccctatcattttgctggtaaagaagcaccatgttcaaggtcctgtatgtaggaactggcaaagataacaaagtagatctgaactcagtgcccttcccactatcccatgctgatcacttttctttttaattaaactgccctgttcctggccttccattgacaggttgcttacagctcttaatttctagggttctcaaaactgtttaatgagtgtgtctggattaaatccagatactctgactatatagagctcttttcattttcaaagatatctaagtaaacacagcatagaattcttcacaagttcctatcaatttccccttttgaaaattatggctcttttctgtagctttctgagacatcaattctgtgaacctttgcttctttctctcaccacctcttgttgtatgttattctgacttcaactgccacattttaagtcatggtaaccaggaatctatactgaaatattttcattaattcttatttattcggcagcatgaacagttgcagggattcttggtgtacatttgtaagttttcctttcctgttgtattttatggaatgttaattttgctcaattgggattcctttgtcaaaactgctgtgatgacagggtcttacggcatcatgaatgtgttcccctattaattaatattatcttagccatataagaaaatgacaggcacatgcagcttgtaagtgaaatgcaacccaaggagccggaagtctttcacctaaaccttaattttgttcaatcgtttgtatttcaaggtctagtctgtaatttattcccataaacaatgttgttctcctgacctttcttgtgtaccctcctctgtctgtatattatcattttccttatttttgtctatattgtgtcactaagagttaagacattttaaaatgtaatttggctacctcatccattttatctgcatttaaattgtgtttgaaaattttacttttgcagatttataaatttttttatccccttacagttttagcctattcaaaggggatacttattttttgtaaatgttttataataaatttaccattttgtgaaaaacagtgaaaatttacatactttttagaaccacaagaaatatctcttttaaaagctactttttaataatgtcattttggaggctagaaattcaatttcactttttattaacttagttcttgtgtgagaaagaaatgtgacgtataaagaaagcagagtaaaatactataaccgttttaaatcagtctggattttcttacagagtaactgaatttttctgtaccatagatttgatctttttagtcagactttgctttatttctctacagatgaattcagaatccactaatgttgtttgcaaagtatattttaaactctgtaattaacatgtttacaagtttttaattttacaaagaaaattaaaagtcagtttgctttgtaggtatgtttgttcttgtcttatgtgtaggtgctttatatgtgttttaaacagagtttaatggtatcttctgagaaaattatagctttagtgtgctactgaaaacctcaagtagggaatcaatacctaaaatttgatttggataagaaatttgtataaactttataaaggatttttgcagggcaaaaatttgcatcctcatgcccaatattctgccttacttagtaaattcctaggtcatggctatggagctcctaattaagttaaagaaatcttcacttgaaccagctaaaagctggtttaagataaatttggaaaatgtctagaattgataatatattttcttttagttttctctgctactcttaagggtacatgtaaatacatttcttagcgtagagcaaatgttgcatgcaatatgactggccagtggcattttatttcaaagatctcatgctaatatataggagactatatattatttttttttgtatcagcatgtttaatttttttaaggttaactgtgtgcaaatgcatatttgctgtccaaactagttaatgggcttacaactgaagggtgtaaattctagtatctgtattctccagcttgaagcagtgttgtctgaagcctgaaacggctgatgttaatcttcagcttattttgttgatatccaaaaattaacttgaagtagaataaaatgtgatgtaaatcgacttctctgcatactcataacagtgtcaatagttaaaaaataaagtctatataggtcacactgtttaaaaccttaaaggagtgtgtgtgtgtgtgtgtgtgtgtgtgtgtgtgtgtgtgtgtgcgcgcgcgcgctgtgtgtgtgtgatgcatatgtatttgtgtttaattaaacagagggaattgctggcttttaatcaagttgatgaattttgaatttccacttcagtgatggctctaccttaaattcatttggctgatgtgatagcagtattcggaatgcaacgaagagataagagtttggaccccatatttataatattccagaagaatttcattatgtaatggctagaaactcagatttcccacagagttgtagagtgtgcagtttggcatgcttatttactactctggttcttttttttttttttttttttttgagacggagtctctctgtgtcacgcaggctggtgtgcagtggcgtgatctcggctcactgcaacctttgcctcctgggttcaagcgattcttctgcctcagcctcctgagtagctgggattacaggcgcctgccaccacatccagcttatttttctatttttagtagagatgggatttcactgagttggccaggctggtttcgaactcctgaccttgcgatccacttacctctgcctcccaaagtgctgggattacaagcgtgagccaccgcacccggccactactctggttcttaatagtgaaagatttatacctcaaaaacactctgtagataaagaaggattcaaatatgattctcttaatattgcatggtttggctaagaaaccttgttattattcaagttactgtgagtcaagggcttgcttagaaacagcagacgtaggcatggcgcggtggctcatgcctgtaatcccagcactttgggaggctgaggcaggcagatcaccaggtcaggagttcaagaccagcctagccaatatagtgaaaccccatctctactaaaaatacaaaaaattagccgggcttggtggtgggtgccagtaattccagctactcgggaggctgaggcaggagaatcgcttgaacccgagaggcggaggttgcagtgagccaagatcgtgccattgcactccagcctgggtgacaagaatgaaactatgcaagaaagaaagaaagagagaaagaagaaagaaagaaagagaaagaacgaacagacatagatagtctattcccacttcaagtagagtaaacaggcaaagtggggcaaggaagagcggatgaaaaagccacaaggcaattcattaacccattttaagacattttcaggcaacttgtgaagcttcaaaggtcaaactgaccaacatttaattcatcacagaaaaaaaattctgggagaagaaaaaagaaaacttgaccttcacggtttaacaagttttcttaaaatgtctttatacaatcttgatagagttctttgctaacatgattcatcttccaatctatgcaaatcagacttttaaatcatacttggttttatataagggcttccttctgattgactttggagcaggtaacacagagctcttgatggcagtgccttgctgtgtgttctgttatggtgacagagagagcaccccctgcaagggtgatttagtgtgaaagtactagggtctttgactgagaagtcaccaaaaatcaatggctgtattgttttgaatgttatctgggcttgcaactgagaataggacctgggggttttactctttttattccttttcattcgttcttcactctctatctgaattgcagtcgtggtcctctggcaggcagcgtctgtatgcgaccggaaggcagtgctgaatagtggggtgatgttggcagagcactttccaggcatgctagcacctagcgcacaagcagagaactttgcttctgccaactgtgacttcagaacccaggtctgttcctgaacctggatgcccagctgtcagtgtgtcgccatatgtcaccagcacatggcaccctaattaaaatttcaaattgcatgcatttgtgtttgctggctggcttgcttaaaaggcagagacctcaccaccccggcttgcccccctccttcatcactctgaagtattatgtttgccatccttaggaatgagttggaaaacggcctttgcccactaaaaaatcatcactctccaattctctcacctcccattttgaaataggaatagtccttattttaagggagaaggagtggtgtgaagaaacgtggctggtacccttcagtagaattctaaagaccagaaatgtggttctcgtgtttccagtggttcatacagatcactcttcaatgctgtcctctctttgtgaatatgtttagctctttttatgtttacatttgaaattttaaaataggattagatggagcattcttggaaaacagtaacaacaaaatttaatgaagtaggtcccttcgtgcaaagcaaaaaagacatactgctggttgaggatatctgttaatagctaccatttattgatcatttacaaaatgctaaggaaaaatgcaagtcgatttacctgtgttgcctcatttgattctcacaccacttctattctgtggcaactgctaacactctcattttagagatgagcataccatggcttatgtagcatttccaatcttatgtaccgtatctcgtgagtagtagacatgaaatttgaactcagatccgtttgacttgagattgtatatactacattgcttccttcctgggaagaaaatggaagttttttctggttccttctaatcgtagcttcatagatatgtggtgtgcttccaagtgtgtatacttttccatgtatgctaagttttggtgatgtattaaaaaaaggttgaatggccaagtacagtggctcatgcctgcaatcccagcactttgggaggccgaggtaggtgggtcacttgaggtcaggagttcgagaccagcctgggcaacacggtgaaatcccatctctactaaaaatacaaaaattagccgggcgtggttgtgcgtgcctgtaatcgcagctactctggaggctgaggcaggagaatcacttgaaaccaggaggcggaggctgcagttagctgaaattgcatcactgcactccagcctgcacgacagagcgagactccaactcacaaaatatatatatgtatatatatatatatatatatatatatatatatatatatatatatatatatatatatgtatgtatgttgagctagaattatgcaattccctattgacccttagtcaccatttgcagtgatgacaaactggggtattttaaatgacagcaggaggcagtgcagtcattagcagcatggactctggagcccagttgctgctttagatctcagctcccctttgactagcgtcatgatcttgtgcaaatcacttgaccgctcagtgcctcagtttcctcatctgtatgggataataatattatgagttaatccatgtaaaacacttagaatcttcctcctggactattgaaagtacccattagaggttagctaaaattaatcaacacatttttagacttcacacagaaaaaaaaagaaattaaggaagattaattgatccattctttagaaaattctgatactaaacactggcctttatatagcatctgattaattaaaatgagtcaccctcttgatttgatctgccagtcaacaattgctgatggagcttctgctataaaatgatgtatacattctccaaaataaaaaacagtatcataaaccttaaaaaggtaccagtcatgttgggtagacaagacatatctacttaggttccacaagtgctctagagttgtttacctattcagtccagtgaattatcacaaccacataattaaatgtgtattcatccccaagtaatgacagaaaagatgaagaaaacctaaacaaaccaaaaaacctccagaaattttaacaatgtgtataatgctaataatatttctaactgtgataatagcagtaatagaaggtagtagtactcatttaagtggcttctgttatggctgtagacaagttatttacacatttagcaaagttatgaaattctgtcatctataatcttttcatgtatgaatgattcctttcttataaaactcccatttattctgtagggttgctgaaacacagcaaagtgtaaaagggaaaacaacgactccctctacgttttattttaaaatagaaaattctgatgggaatctgcaatataagccaagatatgtagtaagatctcacatactttctcagatttggcttttttgttgttgttaccttaagtatcacataccctgatagcgtaaagaatcagtatcttttatcctatctatggaaaatataatgattgttgataattttatgagccattgtactaattttaatcgacacatccgctcctctatagcacacttccttgagataaaactggctaatagtatcaactgacctgttttctgttttttcattgaactttaaaatgtaattctttttctttttctggtgctcaaagagatacatttgtttgagtccttgtgtattttatgtatcacattaagaaaattataaagaacttaaaagcttaaggcaaactttaaaaagtgtcttgtcaggttagatttctctttcctttcaactaaaaaacaaaaaaaaaaaaggaaaaaggaaataagggaaggaggaaggggtgggggccatcaggtggtaaaagcctgtttaatgtaacatcagttgtggagaaaatattaggttcaattacataaggattgtgtgagagggagcaccttgagaagcataatttaattagaatgaatttatgagcgagaggtcctgagctattagacaaagcgaaggcagtggtgtgctctcctttcacgagagcattttaatgagtttccatacaaagtatttcaggtaaaagatttgtagcaagtgtgaatagaaatgtagctccaaataaaaactgtcaaatagctctagtagcaatttctgggctaagagtatttaataaagtatgctgacattgttatttcttgatgattttattgaacaactatcgtgtaagaaaatcttaaaaaaaaaacactcagattccaatgtgttctttaatttgccattaaaaattgaactgcagggctggccttgcttgacttccaatttgggcaggtgttagattgtgacttacataacattgcaaactcatccattgccctgatattccagaaggataggtgccaatggtaacttaagattgagatttcacctttatggcttgcttcctatttctggtaagagggaattaaagcgttatctccctatagtgtaattatggtcataaacttgattagagttctttaaataaaatccaactaggaaaaaggcaggaaaacactgtggtcaattttggggaaggaggatggaatacaggcatgaccttcaccttggtcaaaatatgttccctaagactctgggaagtcttgtatatataagattcatatggcagggtttttaaaaagttgacaggagagtacatccttgtttaaggatttatttgtgtatgatcctcacaaggtacatttttgagatttattgcaaataattctgttaatcctttcctagatattctgacatgccaggtggttaaagaaggatgatacataccaggtctatagaaatatcataaattattacacagtaatataagtatttttgtcatccatgactaacttttaaaatggcaaaattataaatatctgtaaagtctatgcgcagttgttactgattattgtggcaataatacataaagaacatgttttttgttttattttccacccttatgttttatttataaaacaaaaatttatatttgcacaggaggagaattagcaggatgtaaaataaaaatgaaagaccccaatggggagaatattttaaatgtcttgcagggagtggaagaaagctttgcttaaaaatgtcaccatatgctaactatatacagcacttcaagtttatttattgttaaagcctcatgtaaatcacgtcattctgaaaatcatggaaactgcacatttgtgcattaaactatgtaaacaacaaaaactggtcatccgtccaattgttgcttcacttattttgaattatagtgcaattttgtggagggtgaaatggggattacacaatatagcgatttcctgttaacacctacatttttgctgatcaagcaaggtctgttggtgcgagagcttaacctttattttatttccaaatgtgttttttattccgagtcccgttggtgtctatggtttcacttttctccatgagccacatgttaaagcctgccctgactaaatgaaggagtgtaagcagtgggatagacattgcaggcaggcgaaactgggataagccccagaatcttttgaacctatcagtaatattactaacagggagaaagtataaaagtgagcgcttcaagtgctctagtgtacatgtcaaaattaaagcacgagttccacgggatggctcaccaccctcccttatttataaaacagaagtatcttttgagcccgctgtgccctcctcccccttttctatgcctgtttttctgcctgggttgcctggtttttgctctgcttgttgaaaccctgctcatccttcaggctgcctcaaaacttttgtggaagaaggtagggaacacatatctcttcttttgtccagccttccttgattagccttcttcctctcccttctacccattgtacatggtttctgttgccatgtagtggttaaatctggtttacgttgtagttgtttgtgtgtaaggaggtctcctacaccgggccatgttttcttaaacactgggatggtgttttcttagtgcttgtgatgttctttgtaacagtgggtgccctataacttttgtttggactgaattaaagaaaaaaaagaaatcgactttagtaggagccggcctttgagtgataaagatacattgagggaactctgtacatccccaagatcgtggccagttgccaggctccatttggattatgggagagcttaaccccatatttcagggcagatatttaggtgtgtgtatgagctgtagttggtgaatactcatttttgaccaaagaagatactggtttgttttccaggtgttgctgtgacttccgtttctgtaaattccgtgggatgtattttgccaccaactgcctagcagtttatgaaatggtgaactggacgggggcctttctgcatccacattgctctcattaaagtgacccctgctttcctctggccctcttgaagtgtatctagtttagaacttcttattagtctgtggtcttaagatctttgtcatcttaggcataggctcaaaggaattaaacttgggttttgattagtgaacttgagccagttagctggtggactggatgttattcaggcataaacttactcctatgtagtttctagaaggttggcctgggccacagaactttctatagaatatctcatccatgcatctatttggatttagagcatggatgtaaatgaccctaaaggtagtacctaatgtgagatgcagcaggagggacctttatatttttttattttttattttattttttttaagaaacagccttttctatgcaatcctggatggttacgtaagttccattttatttgtatctatattccttataaagacaaagcagcaaaaatgcactaaaattagatttaatttccagctgtgggtatttgtattatgtctgccttagtccaccttctgccccccccacccttgggttgatgtggttactgaagatagtgaggctatctggagattggacattgaccttcactatagaacaaactcaactgttcttatctaccagggatggtgagttgaagacacctgtagtctatgattagtttattgtgtgagcatttttctgacatatgctgagtgatattgaaaacatttaggtagagcttttttctctaaaaacctgctcattcattcactccatgactttttacttggcacccaccattctaggcactgggattgtattctgttggcccaaacatacttcactttgttgagaaggtttagcataggactaggaacatgctagtatacactgatggatttaaagcccattgccaattataaattcattttcactatcaattaggtacttaatggctatcctataaggtaatactattattatctatctccattttacaaatgaggaaactgaagcacaaagaagtggatcagtttatcgaaggccatactgctaggatattttatagaaatgcgttttgaaccgaggttgtcttaattcccaagtctgtactcttaatattatactaagttgcctgagaattttagcaagacttagcctaaatgatgtagagcatctcaatttctgtgcaggtccatttaacagattttcttgattcaagaggtgtttcatcataactcaattgtcttagcagttgtataaaaagctagctctcagagatggggctttctcataggcatagcagtaattatgtcaacatagagaaacttctagaatcgagcaaatctggtgctcctggctgtggcctagcactcggtccagtgtcttcatattaacccatttatgctggaggttgcaattttttgaatttttgcaatcagaccttggcgatgatcttgagcagtaggatataaataacttccacatccttagtgttccaataatggaacactaggcataaatatgttaaaaagtgaaagtaggaagtcagaaagttgtgagactgggcagagttcaaacacttggttatccaacgagacaggaccagagaggtttgttgaattgagcggacgagaacttcaacaggctcacgtttagtccagtcagtgtttcagcactgacacaggttaccatgttttaccttgattcacagtttcacagtagtcagcaaatgccctacactgaggttttactctttttattttgcagccctttttttttttttttttttttttttttttgagacagggtcttgcttgctgtgtcacccatgctggagtgcagtgatgcaatcatggctcactacaccctgacctccctggctcaactgatcctccctcctcagcctcccgagtagctgggaccacaggtgtgcatcaattaacttttttatgcccaactaatgtttttaaaattattttttgtctccctttattgctcaggcttattttgcagacatttttaagacaaaatttttgttatgtaagactttttgttataaaaattgttatataagactttataagacataaaattttgtaatatgaggcttttcctggttgaaaagtgtttcatttttcaatgttttgtatttgtatgaaatcagtctttttgccagcacactgaatcttgtcagattggatgcagagtttctttctgcaacacttttactgtttggtaacaaccttttcttaggaggagaagctacagatactaccttggctgctaacaagttttcagattagaccaatttcacagtgttgactagggaagaaaactgattgaacttccatgggctttagactgaaaccaatgactagcattttatctcttttggatgtgagcatgattagaagtcagtctgaagattttctttcaccagcattgataattcttgtcagtgcgacctcagacacatattgccttcttttctgtgcatcctctgaccagatagaatttcttctattttggatgacatgctgcattttaaagatgcaaggtgtaatctagataaatataaattcattggatgctacctttggaaaagagctgaggattatcttagagctgttcttttcctctttttctttcagaattgttattttctgctcaagattgccctcccaagcctacctcatggcagcacacacacacatacagtcacattcaaacacaccattgtactgttacttgcaaaattttgcatatttgggaccaacatacctgttattctgaagtgctgtcgtatgaaagaataagtaaaggtactgtttatatctttcgatgtatgtctagcactaatgggagttaggggacagatagatgtcaactccatgcaaagaaagtcattatgacaatgaagaaggccaacagtggacttgtggaggagctggggaccctacatctgggagggaatggttctgctgaggtggttcagagattttgtagctgtgatgggttagaaaattagatgagaagattgtcaaaattttgtacaatgtacagaattttgaaacaaaaatttaatgaatggtttggggaataaatggcattttacgttgactgttttatttctctcaaatttagaccctcactgggaaattatttttgagtcataaacaatagacccatttcacatctattcatattttctctctctccatgatttttagatttaaaacaagaccacaagccaactttaaacagttcatctttcttcctttttttattgttttttaacttcatggttttatctcagataatttgctaattctagctacgggtgccttcctcccagctcccccagtgtggtagctgtcattcttaacaaactgggatactcacgagacatctagagttcagttgatgatagtccagagtgtgtgagcagtgcagggaaatctgtagctgtgagcactcatctttgaccacagaagcgctgttcagatgtggccagatggaattcctatgaatctctcttctgtgaagtgggatttttgtggcaccaacagcaaagcgattcatgagtgaaaagccttctctggtgctgccatttccatcactgtttctgcctccttttgcttttgttaggcgtaggccctttatttattcagacaaaagtttttaaaagattagagcatacttccatattaataacatcccatgagttaccattttgagggaaatgtgcacatttgtgtaggggttttgctgaggaaaaggaatgaggagtgaaaggagtctcacccagttggatagtggtatgccttggaaatgcactgaacctttttttttttttttttttttttgatgcagctcttcacagatggataaggtaaggcactgtctgcaatgcgtgaagcactttttaaaaagtgagaactcccagtagacctgtggtgttgcaggagcaggtcaagtgctttctttctttaatatttagctaagagagatcacttaggtgaaccgttccctataactagatcatcctttgctttttcctgttcacattatgattgaactcttgtttttgtacaccagtaaaatcttgcatctgaaaatcttattgcaagcaagtctgcccagttttatcattttttctgccatattccttctgagagcagctagtttggaaaagtatggtccatgccaggcagagtgagctcagaagaggaagggaaatatgtagtgttttaagagcatgaagaggaaaagactactctggtagcttttctatctgtatgtttgttttggcttttagtcttgaaaagactcaaattctctttcccatcctttatttctaaattcaaagggaagcagtttgacatattagaagccctgtctttggagtcaggaagacctgagtttgaaactgtgtgttgtgaccttagacaaactacttaatctttctgagatccagtttgctgtctgtacaataggaataatagaagtctatcataggattgttataagggttaaataagacattgcttatgaaccttatacgtagtggcttgctattattcttgtattaacaaggttgtcctggcatttcttcctactgttaattttcacaaaatatgatatgtcttaagctttattattgaaaataataaagctttaaacttttaataaacatgtctggagtctaagatggaagatgttaaaaagggctcagacgtgattggtttcttgatgattaagtagtgggcagtcaaagatacttgttttatgacacatttaggagaaagtactgaatgaagctcttaacagtaacagcccctttaattaggggaccagagtagaggagtcattcccagcgctgcctgggaggaggatgaatttcctgctgtactggagtagccctgggcaaaggacccaaaagaactgctgtattaaggaaacctggaaactaaaaaacacaagagttttgttttttttttcccctgtcagatattggtcttttgtattccagtggtattaaatggaaatgggttttttcagaggaaaagtaatacttgagagaactccattatctatcagatttatatattttgccttagagaaatgcaacctgttcattgtgtaaaaagccgtcgtgtgtatacagatttgctcttctggaagccatcaatagccagctagggttaaacaggtttcccttcccctaaatggttttgttattatttatttattttgtgttcttttaaaatttatttttccatataatctctgtgagggcagggatcatacagctctcaaggtacacatcacagtatgcagataggcccaaaataaacaaacatctttatttttaaagttttttaattataaaaagtaatacgaggccaggcacagtggctcatacctgatacctgtaatcccagcactttgggaggctgaggcgggtggatcacctgaggtcaggagtttgagaccaatctggccaacatggtgataccccatctctatgaaaaatacaacaacaacaacaacaacaacaacaacaacaaattagccaggaatggtggtgtgtgcctgtagttccagctactcggaagggtgaggcaggagaatcacttgaacccaggagatggaagttacagtaagcagagattgcggccactgcactccagcctgggcaacagagcaagactctgtctcaaaaaaaaaattaaaaagtaatatgggattattatagtttggaaaatacagaaaaatggaagagaagtcaggtacagtttcactgtccaaaaataattaacattaacatcttggtatacttccttccagcctttttctgttagtacagagctttatgctagctatttatgattatgaatacagatatatcctaaaagatcttctcatgctgagcccaggtgttgtaggatagaaactgatggtagccaggcaaagtgtatagacataaaaactgggatgacagaatcacggggaagggtataatacctttgggttccttagctcagggctgtctcatttctgcagcaggcaatgtggttttcctcaagtggaataagattgcaaaaggaaggttggtaagctcaaaagaaatcttcacattgcccctgtgataggtagcaaaggtgatgaaacaacccaattttgctgtgttatggtattcctgttttcagaaaaattaaaaaaacacaaaaaccatttctttgaataaattcaggctttaatgtacttttttcccccagaacatttctcctaagggcttaaattattatcacatatggagaaggagacttaaatatgagaggatgtaagatccttaagcatgtacaaattttcgtggcatctatcacagtcctgaatcctgaaagactattttctgttgagttagatctttccttataaatgctttctgggatggcccatgcatctctgacagttctcatgctgagtcataccttgttctgttaaatttatccattattggacaaagactggaagaatggatatgacattgggaagtgtgcaagacttccacagatcacttgtagagagggatgatttcattgtaatcctacctcactggacacctcaaacctgccagtctcatctgtaaagtgagcatttttatcccctttccttggctctcttggctccatctacaggcaacactcaggtggacttctttactgaagagaagagcgtaatattcttctagtttgcctagctctttggcatttagaaaactagagaaatgcataaatttagcaaaggatcagggccaatgtgatggctgaactggcatcatttcacatttttcatgctctgtatttatagcaataaatttcaagtaagaaaatagattgcaaggagtatgctgtattaggaaggaagtttgtacactttcgtggcttatgggtatcttagtataaccttttctggttgagtgaactgtgtcatttcaaaagcctgaagacattgtgatgactgctgcctccataatggctacattctaggggctttgccctgaatcgcatatattaactcaaaaaacaaacagtacccagtttttattgggaaaattacagtaccagaagttatgtttctcagtcattgagaccttatgaagccttaataatatttagaagattctggttccttgtcttccttttttgagtcagcagttggtcacagttcagaaatgaattacaaattacaatttattagtaatgataatatttaagtagtaatgatgatgataaatagtaacagcttattttttaaaaagataccaagctaaatgctttcatggattatctcatttaattgtctcaacaaccttttaagtcttatatttttatcattgccgttttatagatgaagaaagtcaattttcagagaacttaaataacttctcatagatgtctagagcaaataagagacaccaggaaatattacacccaattaaacatgttttctcccacatattccgtcaattagagacttgtagagaagggtgctatttttcttttcatttttatttttttcgagacaaagtctggctctgtcacccaggctggagttcagtggtgcagtcttggctcactgcaacctctgcctcatgggctcgagccatccttgcacctcagcccccaagtagctgggactacaggcatgcaccaccacacctggataatttttgtattttttgtagacactgggttttgccatgttgcccaggctggtctcgaacttgtgaactcaaaccatctgcccgcctggcctcccaaagtgctgggattggttgctatttttcaaatgtgagaaaactcctttagaagttttagtcttcatgagtcttatgcgcttagggtgtggatttaaattagcaaattgggttgttggatttgtagttgcagcagaaaggggttgtttgtggatttttaagtaggggtgatagcataggggcctgcttttaaaagagggataagcaagcaaggaactttcagtgcttaagggcacaggtggggcagaacatcaaagacagattccatctgtgctaacatttcacctttactccactgaaaattttctaagatgtcacctttgagacacactaaagcttatttttctagacaattaacaaataaattacatttactccaaggacagtgtaatattaatctataaggatattttagattttagaaagcatgagttttgaattctagtttattatgcagtatggtctgtgagccatgaattgtcttcatctttatgtccagcagataatgtggtaaggacttcttaaagctttttgaataattgaattaatgaataaaatttataaagttttctatcatctactaaacatctgcttgtgaattttaaagaagctcattttctataacattaaaaagaggctgtaaaacatcgtttttactaacaatttcattttatacattgcagttgtccttattgataaaagagaactttgtggtttgatgcataaaagaaaatttactattcagtatagttgggactgtatcttcaggcacagacactgcattcagacctgcagacccccaccctgctcagtgtctgggttgcagcccagactgaggttgagccagaggaagaaggaggccgtgtggttaaaccacttgtggataatcgaaagtagaccatacttattttcaatttggcagctgcattagttttttactaaagtgtgcagctttgcctggttctgctaatgttgccttcacactgtggcctggtcaccattagtggtctggcagagatatctgaggaggctcaccattgctcctcttgactgttccactgcccatcccagtattttccctgacttttcctatgttctgtggtatcaggcagttggatcaattgcagtgactgcatcgaaagaaaaagacaaaaatcgggaaagtataaccccgagggcaacaataatgaaattttaaatttaaagtgacccaagtttgatgtacaggatatgaaaatgctgtggttcctccagtggtttcatatactttgattcagacccttagaagttcctggtgggcagttgacaattgagtatcagtcttgatgctccagatttgaataccatttcagttggaggcatggtgcgcctgatatagatgacgtgtgaatgtttcaatgtcaacaggagatgcgggttgtgaagatatgtgttcacatgaaacagactgcaagtctaagtctccaaggatgagctgatatatgtaaccctgttcatgatgggcctgtgtttttttcattttctgttttcctctctggcagatgatagatcatttaaatctgtactggcacatggacgtggtttcccaccccaactgaacttgagttagaagaacctcagctctgtagtgatcttattttactgttttcccaggataaaatgcccttggtaccacatactgtatgcagagtatttatgattgcttgagtacagttccttggaaaggacacaaggggtttcataaagcggtactaaaaatctgcttttctccctagcatttaccaacaaccttgcgatccgatggcttgaaataatggtcagagtgcatgttacccaacttctcctggctgctcctactctgtcacactgcacacagatcatgcccgccaccaccctacactccccgacctcacccaccagtcagacagtttaagtcctgctgacgcaccaggcgtgtgttggctcgtggttgtacttttcatgagtagcagggaagatacactccaggaaggtgggatacaaattattgaactgtgtgacttaaaagctccagtgagtttcgtcggaagtataggagtttgaaagtgctccccagtcaaacccagaactacatagggtcagccgtggttgagctaatttctgcttacacatgtgtggagggtgtcattttctgactacgcctaggcctgagtggacagccgattaaaagatgtaaattcgtggattgtatcaaggagagcgggttccatctttgtggtcaggagggggcccactcttttgttccgcaaagggtttatctggatgttccttgctggaagttgcttttccagtttggatcaaaccacttaagtggagctccagcctcagtccttgcaataaaaaaaaaaaagtcctggaaagccagaattttgctaatatcttacatagaatctcaatgatgggaattgggagtagaaggcagagagtggtgcttggctgatggaagttaaaagttgggttaataataaactacatttatatatcagttaacagcttgctaagtgcccacatattatttgagcttcatacttgcttgctgagaaagaatggctattattatcattatcatcattaccactttccattttatagataacaaaactgaggctctgagaatttaaagagattttccccaaatcattaaacggtgacttctgaatctggatatatgacaagacctctgtccccagtccccttgctttcacctctataatatatagtagctaagctcagctttctgagaacttccctgtcttatgtcatatttgacattataggagaattgaagatgttttgtaagtacatactttgtttactacctcagtagccagtataacaaatggcactgaagttttatgctttgcttgctaaaaccagcaccatttgtgaaacaggtcttggctccgagttacccttaaatgtaactcctttattataaaatcatttgcaaagagctgcagagatcaaggaatacactcttcccacttccctaatgccaggtagtactatgacaggacttcatagtaccacttcttcaacaaaataagtgtctgcagtgaaatatttgttaaaatgcacatttctcagtgaatatatttcttttaaaactgaaaaaaatagtacctaacggaaattttatcattgctttaaaatgtattttaatgaagatattaaaaaatacctttgatggattcttcaatattgtcgaactgctcaaaatgattatactgttatatgaagtctaaaatctttcatgcaacttacaagaatatttttgttgtatgcaacacagttggaaaattctagtgggaccatgtccatgcaattactgattatgtaatgctgtaaatttttgataagcatgttccaagttttcctgttctaaaaacaaaaacattaaaatcacccactgttgaagacaaaagatcattactttattaggagatattattagatatgtttagaactagttaaaaaaaaaaagtaaaagactggttaaaaaattaaattaactccaccaataaaaattcagttccttctgtagctgattaatgtaaggttctttccactgatgaccactgaatagaaaaaactaaagtaaatttcatcatcattgtagaagtgtaacttattcaagtaaatgagataagccaattttatatctatcaagctataattaaataaggatgatactatttgacttataaatgacctctgttttatatttcctgtggaaatcagctaactacaaaggaattgtttattaacttacttcactaacatgatgaacagaagtatttcaggactcatttgccccttttttatgtgactcagcgtcagattctgccctttgctcttctgaggtcagtctgacccagtcaggtaaaatgaacagcacatgaaagtttagcgcatgcggtcagcattcacgtaccttgctttggttaaataaattcttgaaatgcttgatggcttatttgccatgaacttgataattccccaaattgctgatgttaccaggtgcaaggacaaatattgatggctatgaaccttgcatggtgctgatgcactgtgatagtcatatcttgttgtaaaccatgttgtagtgacatagttccagttcatttacccattccctgtatcagagagtttgggccattgttgaacatcgctgagttcagttcatggtgctgggtagttcacatttctggaagggctgtaaggtttgcataatcgtccagtgctatcatcatatcatctttgcctggaagatgcatctgcatagcttcagtagtttttaatgtcttgggatgcccaacccagtactgtgggtttcaatttttatctgtcatcgccacaaacccctaaattaaaaaaaaaacatgaagaatattcaggtgactataaacatttcaaagaaggcctctacttcttgctctgggtaaaaggtagatgcagtctcatggtggaacatgagagttatctcagttggctcttgaaatgagaatgtttcactgtttcagctgaactgaatagtcactttagtttttaaaaacctgctcaattcaacaaaacatgattgattgctcaggtaaattaattgcctctgagacacatgtttgaaatagatatctatactctctctgatactagtgtgtagcaataacttttactgtcctattttgtttaactgtctgtgtatgtatgctctaaaaaggggattgaggctggaagcagtggcttacgcctgtaatcccagcactttgggaggccgaggcaggcagatcacttaaagtcaggagttcgagaccagtctgaccaaaatggtggaaccccgtctatactaaaactacaaaaattggctgggcgtggtggtgggtgcctgtaatcccagctacccgggaggctgaggcaggagaatcgcttgaacctgggaggcaaaggttacagtgaaccaagatcacgccattgcactccagcctgggtgacagaatgagacttcatctctaaattaattaattaattaattaataaaaaggacattgattaaacttttttttttcttttttcttttttttttttgagatggagtttcactctgtcacccaggctagagtgcagtggcgcagtcttggctcactgcaacctccgcctcctgggttcaagcgattcttctgcctcagccttctgagtagctgggactgccggcacatgccaccacaccttgctaatttttttttttttgttttgtatttttagtagagacggggtttcaccacattggtcaggctggtcttgaactcctgatctcgtgatccacccaccttggcctcccaaagtgctgggattacaggtgtgagccaccctgcctggccgattaaacttttcaatagctatatctactgtatggactctattaatgtacataattatgcccagaagagaactatatgtcattattaaatttatggttagaatagttgatctatacttttttctccttagcattcctttagctgtgcttccagagctgctcagaaacatgagttttgcttaataatccatagcagagctgaagtcaagaggggaaggacccacaggacttcagctggatctggttgggaaaagctcaagattgggaaatggaactttggtaggcacatgtcagtatgaaacatttgcctcacagccccatacatgattaacctttactttgcaggggaaaggctcacagtcttactgcagaatgagaataaacctcatttcagtggtttataaactcttaaatgtaacagaatataggcctaaaattagacattgtattcagtctgagctctgccacttaagaattctgggactttgggcaggctgcttattatccactaacctcaatttcttcagctcctaaaagggcagttgtcatacctatattatggcactgttttgaagaagaaatgaggtaatgcctaaaagtgtttaacatagtcactggcacagagaagatacttaataaatgttgatttccttcttgttcagcaaaaccttaaggcagaaagctcctaaggcatgattatatatttcattctttcagtagcatttgccaaacatttttaccatattgttgctaagtaggtaaaacagaaagacacatatctaaatatgcagagacatattttgtaatggaggtaccactctgtttttgtaaggcgttgctgattctcacttcgcttctgcatctctgaatatgttacaattgtaagagatgtttgaagctttggggatcttctaatggaaatgggggttcttcaccgaatgttcatgtaccgacttcaagaggtcaaagaatcacgaattgatatacaaagtggtgtatgttggagtatagtcgtcgcttggtatctgcaggggattcgttcccagacattcccacagatgataaaatccacggatgctcaagttcctcacagtcagtccttcatgccagtgggttctgtatccatggattcaatcaaccacgaattgaaaataccgtcatcacgtaaaacttgtaacatacattctaggaaaaagaagaaaataaaatcaccttgggaaaataatccttaaaattttactatgtagggatttattcttccaaacatatatatgtatttttgaaatcctttaaaaaataatgctgtatcacaagcacctttccctattatgtattcttctacagaatcatttcagtgggcgtatagtatttcatgttattgatggatcatttgtgaaaccaattctgtgatggtcactgagtttgtttgcaagtttttattattataattaatgtggcaattaagatctatattgctcaaacatgactgtgtacttatagatcatctttgtaaaaaagcagcattaacttgtgtttttaaaacatttttaaacaaaactaagtgataagaaattgatcaactcagccaggcgtggtggctcacgcctataatcccaacactttgggaggccgaggcgggcatatcacctgaggtcaggagttcaagaccagtctggccaatatggagaaaccccgtctctactaaaaatacaaaaagtagctgggtgtagtggcgggcacctataatcccagttactcgagaggctgaggcaggagaatcacttgaacccacagggcagaggttgcagtaagctgagatcaggtcactgatctccagcctaggtgaaaaagcgaaactcagtctcaaaaaaaaaaaaacctctaccctttattattgcttgcatactttgtaaaagaattttttccaaccactagcctcaattatttctaaactatttttaaacatttattagatatatggatttggcatatataaggagtctagttaggcttaaaactatctaaggaactaccaactatctaacatttaaataatagaacaaagaagccgggtgcggtggctcacacctgtaatcccaacactttaggaggctgaggcaggcggatcacgaggtcaggatatcgagaccctcctggctaacacggtgaaactccgtctctactaaaaatacaaaaaattagccgggcgtggtggcgggcgcctgtaatctcagctatttgggaggctgaggcaggagaatggcgtgaacgcgggaggcggagcttgcagtgagccgagatcgcgccattgccctccatcctgggtgacagagcgagactccgtctcaaaaaaaaaaaaagaaaaaaggcgggcggatcacgaggtcaaaagatcaagaccatcctggctaacatggtgaaaccctgtctctactaagcatagaaaaattagtggggcgcagtggcccacgccttagtcccagctactcaggaggctgaggcaggagaatcacttggacccgggaggcagaggttgcagtgagctgaaatcgcgccactgcactccagcctggagacagaacgagactccgtctcaaaataaataaataaataaataaataaataacgcataatagcttctatttgggggtggcaggtaaactatggcatgtcaggtcccatcggcattttccgccaatgatagggaggcatgttttatgcccctgtctttctgttgatgagaaaggagcaagtgaagaactccttgggtcttaaggaacaaggactagaaaccccacaatattagtgtttctgttttttgtaatgatctgtcacctcctgtttgttttcaaaacccatgagattttaactctgcatgtgtgtgtacatgtgtgtttcttccctgttcatattgcctccctatccatcagagaatatcttaaatgccactgggatacttgatgccatcccctccatttgtgggtttgtgggctagtccagcaacaggctttggagaagttactcgctactttattataacatacttaaactcaatagcaattcaggccttactgggtatttacctaatttattgtggcaatgcggtatttagaccactgattaagtgaagtttgtcagtatagttaaaagaaattagagacactatcattgctaaatcactttacaattcaaagaagaattgtaaacatatgaatccatttaattataatagtgccaattataagagaaattgtaacgctgggaacagtggcttttatgtaatcataataatggcatgtatttatcttggtttggcaagttaggcctttctttaatacttggctttgcctaaatagaatgtggtttgctgaaacccacaataacccccacaccctccaatttgttattgcagaaaatactgaacaataatcatgcggtatgaatgattaatgtatgcatgggttagtaagtatatttgaggtttaaaaagtgtttttatttacattcttctgttggctgaaggtataaaacaaataaatataaatccacatgttaaatattctcatccctttccatacagatacttgcagtgtgaatacaatcatagctttaattcattgtttctgtgcttttttggtttactcaacacgtgtcttttaaatatatttcaactgtagtatttgatagtaatccattttttaatttactaagtactttgaatatagcttccccaaaacatagaaataatcaatttaataatatctgaagattggcaaacttcatttataatgttgtgttcaaataatactatcagaataacagttgtttgaagagtgtatgtataaaaattacattctctatttaataagattactattattattgaggaagaggtgctatctagtggtataaacaaaattattatggaattgaaacatttctacactttggtgtcagggttttcatttatttctgtttcctgcttccagaaagataatttgcagcagtttcacactgtgtattagtagatgtggaaggaaatcctactttgctgagaaaagaaggaaggaatttaagtttaaaagggatctgacaaaaacttatttaaaaatttttattttaagaataaatagaccttccatagacacttagcatttattgtaaaagctgtattttatagagaacagtagaaatccaaatcgttgatagttttgcaagacatagccaaaaagtgaagataaatggtggattttaaaaattggcatcctgaaagagttaatatttttattagttgaaatttgatataaaattgtgggcaacccatgacatggtttggagtacttgattattcttttctcaataaataagagtggcgtacagttaatttcagcactgtaattgagcaatgcattctgggaagttaaaaagcactgtaagatgaggaaatgttttagggactaatcatgagaagaaaggagcctttcatagcccgtatgatgctgttgtcagagctaaaggcagataatgattcggtaataatggcacattgtgaatatttaagctgaaaagatttgggcaaaatgaacagacattgttggtttgttaaaactgagcgtttggtctttgggcttcaaaagcactctgaactctgtacaacatttttgttcacaaattttctctaaaacaagatacttttaaaataagttatgttaaacactatcactatatgaagttttaaagtgatctacgtgttttaagttttactgtagaaatggatagtgtgggctctttgttatggagaagtttaaaaagttttacggttttcttacacatattttaaatttagttggcagaagcaacacctttaaagaatattctcatagcaatgatgtaaaatattaaatctaagtccaagagtatccagttgcaaagaaagtcaagtaatttgcattatgtttctaaggtttccgttataccgtttagagtcttgcagttgggtttctatgtaccttgccttttctcctcattagcatattttcaacctgtttgttttcattcttgaatcatctgttacatgcagatgtattcagctctagtttcccattttggggtgaatgttaccaggagtttaaaggttgagtccttatagtctttctttaacttaggaaaagaagagaattgagccctgagagctgagaggtatagtttcaaacttactaactttaatgatgggtatttagagtcagtaccacatctggtaaaaagctagattctgttttgctaaagtataggtaaaacactgttatgctgaaataatgctttatagaactttaaaaatgtgattcaattagaatactcctttagagtaggttttaagacagaattcaaccttcatatatgtaagatatgtatatctccagtgagctctcatttattatatatatgctacagtgacataaataattccaagtctggtatttcctttataaatatacttttcatgtgcagttttatacaaagactgaaatgaaacagatttctgaggctatacaaatgttttttcttgaggaagaaatgattacttattaaaatggcttcacaatttaaaccaaaataacttttttttgtttctgctctgaaatttttttgaagggaaaaaatgttgccgaatgtttacactaacattcatttttacccatatgctttaaatctgtgtatttgtttaaccaaatattgtttatttttagaactgtttaatctttctttttaactggaattttttaacagcagttctttgaaaattaaattgaataaaatttcactatttaaagaacattttctttaggagttttaaccaagaagtaaatcatttattaccattaggtgagactactctttggccaggaaatagagaccagaagcaaaaataaaatagagcaaatgtttaccaggaaaatgtgttgtaatccaagcatattcttgtgtcatttttttaaaaaaagtagctttaatgaaaggtgtcacatgcagctatgagtagaagaacctttccctgtactttgcaaggagacaaaatatggattttgatggacctgtacaaacttacagtttttcaggtttcataaagggaattgagaatataaaatgagactacttggaaactccacaaattttaacttatttttagaatataagataaacatttcaaattatattttaaaaattttatgatcacttgttgactttctctgagattccacgattccagaattgtttttttgtaaatattttgtctgaatgtggaattctcatttgataataaacagtaattttatttagaatgatagctatcctccacctcttctctgtatttctatttattaaaatttacattttctaattggacaactctgtgaccaaaatctagatcattagggtgctaaattctattaacaaatactttgaggttttctgaggatatcaactaaaacttcatctcagaaaccttctagaaaaattaaattttgttttaaataattaaaacccatattcagaaaccagcctgtttgaaaactgacctctctatttacatattaccagagggttcttgcctaatatgaagaaaaaagcttgtgttagagttgggttttatttggaggtggggaggacttttaatgctgataagatagaattttacttattgagatacatacagtaaggtcagttagacactgtgtttaaaatagggaaattattacttagtttttaatattagtttaatatttaaaaattagttttaaaaatatatttaaaattagtttattgtcttgaacttaacttttcaatttaattttaaacaagtttacttaagtctaacttttaaaagctcaagttaatattagccaaaatatacttcttaatgcttatctcttatgctccatagaaaaaagtgtgcttttttggtgaattaagatttaaatatgtatgcatactgttgtctctcttggagagagtcatgacgcacattaatatattagagggtctgagaactttgtttaaactagcagtagccaaatttatttgtcagtggaatccttttttcatgcaacccccattaacctcccaaaacacactttgagaaattatgcccttagccttttctctgcttttgagtgaagaaacttattctgattcagtcctgttggtgtaaaaatcatcttcctgctgacccttctgtttatctgaagcccttaaaaattaataacgctctagtctccatttggtaccaagtgcctggtggtgggggactctgtctcagaagcagtgatacttgattcagttgtctcacctcctctactcatctatccagtccattgcaatttactctaagtacttcaaactgtgtccttggaagacagagttgcctggagctattccaagttggcaaagggatgttctaataaagctcttaagtggtactacttgctgatcaagagcagaggataagggtgttgaaaatgtgatgctgcaaaggtcatttcatgaggcactaaagtccatttttaaaaggtctccactcctttcaccccataattttgagtattggaaagatttactaatgaagctctttgctgtgttatccctgccaagaaacagactttaaaaatatattattttccagattcatgacataggaatctattgaacccttccaccttaagtttgctccattcctcaaaatgtgtttctatcacttatatattttgttttttgtttttttaaaaaacaaaaaaaaaagtctgtgagaaggaaattgatttgaaggttttagcctaaaacacagtaaatactcaatgtaaagccattacatgagtttttatgtccatagtacttttttttttttgagactgagtctcgctttgttgccaggctggagtgcagtggcccaatctcagctcactgcaacctctgcctcccgggttcaagtgattctcctgcctcagcctcctgagtagctgggactacaggtgcatgccaccatgcccagctaatttttgtatttttagtagagacggggtttcaccatgttggccaggatggtcttgatctcttgactttgtgatccgcctgcctcggcctcccaaagtgctggcattacagctgtgagccatcgcgcccagctcgtactttttttttttttttttttgcatgtgaaagagatggagcaactatagcaggaaattttattttgtatcaccaaaaggaagtttgcttgttcgtatctacgattgacatcttcagtacttgctgaataagcacaaatgattccttttctatcgcaatatatatgtttgcatctacctaagagattttagatttgtgagtgtatggagccctcattagtatgagagattaatttatttcagtgtttgagctgttactgagcttaaaatcttaaaaaacacacacaatacaacaccagctctgtaatctttttaccgagtagactataataattccagaagatttaacatagtttattagatgaatggcttgcaactttaagggaccataaacttatatttaaaaattatcataagtaaaacaggattctgacagtaatgcatgtaatctaattcactaatgtatcagttgtgaatactttttagatatccagtaaactaaaatgaaacagtggacatacaacaaacatgtgtaacagaagaaaacccaactttagaagaaagtagtatttgtgtaatatttaatgtggtacgatagtagtagcattacaagattagtgatcagctggggttattaaaccaaagtttgcctcatgctgtcgacgttaagcagccacttggtaaagcctgggaagtaacatgtgcctcaacagttagcacttaaagactgtgttttaacgagtctccagatatgtatttacatgatagaccatactaacaccttttagtgttatctgtcaatcaagatttcataatattcctttacaaaatgtatctgctgtccacatccattatcctactctacttactttgtatttttatgtatttattaggaattcatagtcacctgacctcttggcagccatccctaaacttcacattaaccctgcttctcagggattgcaggggtcattttaacccccatgaacctgaaaggtccaaataattcagtccaaagatggttgaaaagggatctgcaaagtctcctcccacaaagaaatgctttatttcatgcatttggcaaccaacccctcccatctttttatttttatttttatttttggtaaagggattttacatcagacagatattattaaaaaattttatttaacactcagacacattttattctaaaacgaatgcttgctcaagagtctaagaaggcttcatgggaagagcaaagcaatctaagccatatgtattgggcaggttgccagttgtttgccaatatgcccaagccacctggctgtgcattcagccaagtatgccattccgaccagccagctttaacctcccggctgcttttcagcacttaggaaactccaaaggcctgggagctgcacttcatttctcccatgccaatagttttcacttatacaaactgcacagctacactgaccggtaactctcaaacgcccattttgaatgagctctccttttgtttaaagcaccattcactggtgttgaaccagtgccataagatgagtctggagatagcagactgaaacctttacccatatgccatagacagacactttgactgacaagcagcatttttttcccaagcctgtagcgacagggttttgtgattctggtttgctgagatttggattggctttatttgccgctggtttcaattttattttgggtggttctaacttttaaatgtttggaaacgtttgttcatttgattttccctttttgtttagtttagaaattggttgagctgtttcataatttatcaagcttgatttcataatctttggcaatctaggtcaggaatcatgcagaacaggcacgatttgatgatgggatcttgaagactgattcgttctttttaaaagtcacgatagagaaagctttactcctgaaaggcggtattctttctttcatcagggcgtaaaaattatataatgccttgtttccctttttgccttggctcccaagaaactcagagataagtttaattcttaaccttggtgaatatttcagcctaagtttttgcccccactacttctctaacccctgcagtttttgttcatgtttttcttcttttatggacttaaatgtgtatgtgtgctaatttactatatgtttatgaaccatctcaaattatttttggaaggtagatgaagtaaccagtaagtaaataaaacttcagattagaaactttagtctattcctaattaaaatctttaagtggccttgtctggtatcataagcaggtgtttcagattcattatctcaggttttaaatgaggaaagctgtgaatatttaagcctagaagtttcattattataaatttttgtgctagcctttggactgaccaatttattattttctatcactattgtggtctgtacattctcaagttgatgccatttccctcttcccggctcaatgaccactatctctcagatcttgaagatctgttttggcttggttccaatttaatcagtctgaatggatcctattgagtaacttgactcattcaccctgctaaagagagtctgaatacactatttctgaaggtttttttaaacctattataatgttcttttttattagaattgtcagtcatttcaggaaaaacatgtgatctgtatgtaagtgtgttttgagagtccatttttcatcccattaataagacccattcgaattgtagcattttggccaaagtcctgtgacacactcaacaaagccgtgagcaaggtggagttgcaccagctcacaagatggatagacagagctgggggaagtgtcccagcgggtttttgcagtctgtcagaggagctgcagctgtaaccacccatctgtgcatccttggcttggactgggcttcagtattgaacacttaccctgaagaaagatgttcaaagaaatggatggtgtggctcaaataataatggccaaaatgtgacagggttaatgttggaagagaaaaactattatgttccagaaactatgagatttagctttttggcatttctaaaattttaaaatttctgcagtattcaattcattcattcattttgtttttttctggacctggtagaaatactgggctttctgtattttttaaaaaaaatgtgtacatgaaggttttcggtgtaatgttaaatccaaaagaatcctgaagatcatattagtagtattttccctgatttatgtttatatcttatgatttaagctttcttcgttaggcagccacattgtatgtctttgctctctaatgtttattatctcctcatttattctgagatataaatttttcttttgaaaacatttgagtgcaacaataagctcaataatcctgaacaaagaaaagactattaattatttgtgcctttaaaggttaattatttcaaccttaaaagaatcttataagaacccattaataaaaaagaatgcaaatatattgcccaaaaaaatacacaaattattgtctttcatataggggaggaaataaatatgtttcatctgaattgtctgaagtaagtcatgaatggagtcagggtaaaagaaaaaaaaaaagcaacgtaattttttcctttattggaaccaaatttcttaattcctctgtacaaatcaacttgaccattttattgaactaaaaagcataaaatataagatcacgttaaagatattcttagaaagataaattactatgtcatttttctcaatataacccgcaaattactcagtcatatattctgaaaataaatatcttttgtatttatgcttgaaattttgtgatatatttatagtgcagtgaatttttcatcccatctctcaaatattttctcatgtacataggcctccaaaacatcattgttgctctaggtaagatcttaggaaatgttttattaaaatttcttgtatttgattttgtttgataagctcaaacaaaaatggaatgtgaaactagatgtcatctcaaagagaaatcaatattggttcatttattgaatgcctactatgctaggtgctataagaatcccatccttgctctgtgatcaaagtctgattgaatcaggagctgtgtgtctttccttcctccccaacatgcatttattgccttttcattcaaattttaaatattttaaatgttgacttttctacaaaaatctgggatacaggtgtgaaaaccttactaaaaatcatgtggaacaaaaagaatttgatacaatttagcattgattccaaattttttaaaaccagtaacaaaggagaatagtatccttaacaggataaaattatctatgtcatgtcaacagaaggaatcatactgaattgtgaaatattggaatcatctcccctaagatcaggaagaaaacaaagatggctgctatcaccattattatttaatgttcttctagaagttttggacaatgtcatattatatgacttagaaataagaattataactatctgaaaggaagaaatgaaattatcactatttggaaatgatagaattatctacctagacaaaaggtttaattaaaaaacatttggaattaataagaaaatttagcagaagatctagttaaaagataaacatcccaaagccaaaaattgtgttatataatcatctccaataagaagctgtgacagaaaaaagatctcattcaggagagcaataaaaaacagaatatctagaaataaccttaaaataatttgacagtaatttgatggaaagacctactgtgaagtgggtgttctgaattatgagagttatatgaataggaaggaatggcatctaatggtatcaccccttaaatatttctgtcaaatcataacctagaagttatctcttactcttctttcatgtttcatatctaatcatccactaagttccccgagtccaccttttcattagcatgcaaattaattcctatcctaccctatgtttccttcaattttagacctttattatttctaacctagactttgtaacctctttactcccagtctttcccaatcatctatcccttcattacactactgccagagtgatctttctgaaataacaactattgctcctttgttaacataccttcattgactccctctcaccagctgtataaagtccactctcctcacccgcatcccgtttttcacacttgggcacaccctgctccagctctgtgttctagctgggttgccatgcttacagtttaccaaggtgctgtgctttaccagtgcctcagtactgcagtgtcagtgcagggccattgcgtcttctggtttctctacaggacactctccatctaaatggcttcacagtgtggaaaactccagctcttctttacattcagtttaggcattggatcacttggaaaaccattccacacactttcttgcagttagggacttaccttccctgtttcctgagaagctttgtatacttctgccacagtacttatcacattatactgtagctactagtgacccccactagagtgtaaagctcgttgcatctctagcatgtagctcagtggctggctctttgttatttgttgaaatgtatatttttaacaaatttgatactcatgaagttctgtgtttctgagataattttatagttacacagctgttttctgggacagttactttaaaatttcctggttttttcttttgcatattggaactaagcaatgactggatataaagtatcactatacacatatttgatgtcaccactaaagtttgaccaatgtttaatggtttttcaggaataaaaataaagtcctatgaattaggatataaattgtgtttatgttgccactgcttaccatttctttgttagatgttatgcctagattaatgtcattagcttatatgctgaaaatgtaatcacataatgtttttaaaatagtaaatgacacaattattatatatatgtaaaattcagatccattcaaaaaatatccatgttcttttatatgcttaggactcaacttggtgctattgtatttagctattgtaaaatagctcagcctttaagaagtttgtatataaggtaagacctgcttatataacagccaatttaagattaaaaatagcagtctaagctgagtatagtggcacatgcctatagtcccagctactcaggaggctaaggcaggaggattgcttgagctaagagtttaaggctacagtgagctgtgattgtaactgagaatagccactgtactccagcctgggtaacacagagagaccatgcctcagtgtaaaaaacaaacaaacaaacaacaacaacaaaaaaaaacaaaacaagaaataatacaacagtattgcattctgagagggcctatatcatctattttatagataaggaaactgactttcaaagaaattctgtgactactatcattacccagctgttagtgacgggtttgaggctggaaccttagttttcagtttcttgattgagggctcaaaacagaactcaatatgcaaaaaagaaatgtaatgcattgggaaagtataaagcaagtccacaaagattaaacagaacagaacagtgattctggatttttctaatagtttttcccttaatttacttctacgtttgtagaagtaaatattgagtaggttatatctgaataataaagcatggcattgggtagcccttcagttttataggcattccacaaccactaattatgaataatccaagtttacaaatattcctctgagtgattgggctagactcattttaactaaaagggaaaattaagccatatatattatatatgtacatatttatgtaaagcatagtatagcaatattacataaaagttttattgccatgagtttgagatgacatgttataagtggtaaagccacaagtgaattatgcaggtcatctcaactaaatgccaaaaatgtttttactgtaccacatcatccagtattctgcctatgctacaaatttaaagagaaccaattttagaaatttccagagttgtaaaagtttttattggcactatatttcaaacttgctggcctgtaaatattagttccattaattgtggcaaaaattaatgcacagagatttttttaaaaaacacttgtgacaggagttttttttaaaaaacatcttcctttccagtttagtttagtttttcctgctctaagtataaacactttctactttcttccctttttatgtaagtttttttcttttttgaaacccatctcaagctccatctccaagaaactctctgtgggtacttacgtcaccccaagtttatttttctgaactcttgctttttcactcattgctcataaattcatttggcaagaatttttcgttgggttttaaccactcttttagttctggtttgttctatttttttctcagaattgtaattgagtgtatattgtctttgctaaataaattctaagctcctagagtgtgtatttagtgcctttatattgtctctggactctggagcactgctttttaaaaaaatgttctttcttttttccccctccctccttgcctttcacagacattgattcagtacctactatattcttgtctaagctatgcattggattttgtagatgaaaggcagcctagaaaaaatcttatacagaaattattctcaaactattgtgtgcacaaaaatcacttggaaagaattgttaagcaagtattttcccaagccttaaatgcagagattctgaactagaggccaaagatcatgctactgaataccaggtgattcagatgcagggagcccacagaccatactgagaaactcagttcataggtgacgggagaaagttccgtaagttgaccgtcacgatgctaagctatttaaaaaggcctgtggtagcaacatgctgcaggtatttgaggagcccagtgaaggggaacctactgaaactggggaagtcagaagagtctcgtcatagttggtgcttactacttgtgctgtgaatagaagaatgaatatttgaatttataattggaggaggtggttgaaatcctggggccttatgaccttgaacaaattccttaatttctctgagcccgagttcctttatctgtaaaattgggatgatagtaaccacctcaaagaggatttgtgagatgaaattaatagacataagtaaaaaacctagcacagtgccgacgcagaggtgctcaatcaataattacactttcccttctgtgccagcagcctcctggagatagctgtggtctctccttgggagggtgtttggccatgggtcagtgtatccacaaagctacaaaattggtttccattacattagtttcaatagttgcttggcataatttatgattttctactgagaatctataggtagatctacagagagctgtgaagagatccttgacctcttaactgtttcttgttttaaatcatctggtcagaaggggaagtgagagaatggctctcctttccacacaaagacctaatgtagaaagtggctcctggctgggcgcggtggctcacacttgtaatcccagcactttgggaggccgaggcgggcggatcacctgaggtcgggagtttgcgaccagcctgacccacatggagaaaccccatctctactaaaaatacaaaattagcctggagtgttggcacatgcctgtaatcccagctactcaggaggctgaggcaggagaatcgcttgaacccgggaggcggaggttgcggtgaaccgagatcgtgccattgcgccccagcctgggcaacaagagtgaaacgccatctcaaaaaaaaaaaaaaaaaaaaaagtggctcctgagaccacagacccagctttgtggttttgaatgcttgatgctgataatccttgcgttatgcgggtatacgtctgcctcctctgttccgattgccaactcttctgtgagctctgaaagtttgttctcttgtttctacccacctaccatattactttgcccttactaatcccttcataaatactagcatataaaagaaagtagtccctcagagaggcccctaatggttagctctagtcccagcaagagatgcagtatttaactactttaggcaaaaaaaaggttgtgcttttcgtgttaccataaaactgtcaatattccctcctttctagctgtgctgctttaatggtctgagagcggatgacttacaagttactcaagaagactgagtatgtattttgactgcctgcacttcctgaataggctttttaaattaaaaatacagtttatgttgttttactttttttgttgttgtttttaagtggctacatctgcattgtttcctaaaaacacaatagctgcgattggccataccagttggcatctgtctgtggttcccctggcttcttattttagttcctccctcttcctggtaggtcctgtcttgatcctagtcaagcctttataccccttttaagacttttttcttaagaaagaagctattcccacaaaaataagttgccacttgcagtgaaaggcataatggacaggaggaccagtgtttgttgagtgaataaaggaatgaaactactacatcacaggcaatttttaaaaatgaacaaaggggctgggcgcggtggctcatgcctatgatcccagcactttgggaggccgaggcgtgtggatcatgaggtcaggagatcgagaccatcctgtctaacacggtgaaaccccgtctctactaaaaatacaaaaaaattagccaggtgtggtgggtggtgcctgtagtcccagctactcgggaggctgaggcaggagaatggcgtgaacccgggaggcggaggttgcagtgagccgagatggcgccactgcactccagcctgggcaacagagcgagactccatctcaaaataaataaataaataaataaataaataaataaataaataaaaataaaaaataaaaaaaaatgaacaaaggttgggtttggtggcccatgcctgtaatcccaacactttggaaggctgaagtgggagaatcacttgagcccaggagtttgagaccagcctgggcaacatagtgagaccccatctctttaaaaaaaaaaaaaagctgggtgtggtgatgcacacctgtggtcctagctacttgggaggctgaggtgggaggatcgcttgaacctgggaagttgaagctgcagtgagctgtgatagtgccactgcactccatcctgggtgacagagtaagatcctgtctcaaaaaaaaaaaaaagaaaaagaaaaagaaagagacaaaaggtttttcagcttcatttgtaagaaaaaagactgagttggctcccccactcaactgaagattgtcttgctattatagagacacatagttgttttaggttagtgcctgacaatgtggatgacagatcagtggggaatgatatgttatttacatggttctgaacttcacttccctcctcttatccctactttggggctgatcttatgttctactgctgattcagaacacgttaaaaacagcctgaaatgggcaattcatctgcatccaattcaaggtatacttattgttttggagaaaagtccatcttaaaaaaaaaaaaaaggtggaaagagagggcagagagaagccaatttctctaggtcagtatcaacatgggaacagccatcctatttagagctgacaaacccagtagccatctgagagagttctttagctaaataggtgtgaagcaggggctgtatcttgagggtacttgtagttagggtccccaaacatatggcacaagctatctttgaacaaaataacagacggcagtgtttgctctgtgcttttaaggcaggtgttttatataatttttacgttatttatttgatatgatttctcaccaatgtacttcatcacatctaaaccccaaatcatgacccttacctacaaaaatactacacagagaaagagaaaatgccgaagttgtagggctaacaaacaccttccaagccacactttggcctaatagtattacttggatatgtttttaacaggtactaaacaggattttttttttttcaagaaaggacttctttcttgtttgtgatcattttgttatttttgcaacttctttcttttccttattgtctaaaatggctcagtgtattcatcagtggtattaacgtgtgaaggacataaccaaggacttagtccataggcagatatggtccatttctctaatcatttcctgcccaaagagctatggcaatcactcttttgcttgtcaccagtgagaatatcttaagaaaattaaattttctaagaagaaaacagaacaacctctttgaagccatagccaatgactctttcatacttttattccagaggctgaggtgtttcataattgttgaatgaattaattaatacatatctagaacccttcttctcaagtccagtctaatataagctcctgaagggtggggactttttgtctcttgttcactgctctattcctagcaccttgatcactgcatggcacataggagatgtgcctcacctctccaccaccatgttgaatgaataaatgatcaaagcatttcttaaccctaaaatagttggtgatatagttatctctcatttgcattattgagaacatcaaacttacatagccatgtcgcaagtcaaagcactctcccaactcagaaaaatatgcacttattattattttaattttgtatttccataggttattggggaataggtggtgtttggttacatgagtaagttctttagtggtgatttgtaattctgttaaacagaaggtaatatgagaagctcatctttgttggatgacattagcaacagaagaattagtttgacaattgactgataaatctctggcagagaaaatattgtgcttatgtatattaaaactgaaattcagaaaacaaatagtgttttcatcattggcagaataggtaaaagcaagtaaacaaacaaataaaacccattgtgggtgttctttaatcaacagaatcaacaggagataagcccttttgtttcttcattagttattccatgcaagtttttttcctctcccatcattgttttcaaatatggatttcaagatgcactattttgtgagtttactacattcttgttttcattcttgtgcctgctgtaggaccttgatttacccttaccactttgctgtgcctcagctttcccagatataaaattggcatcacagtactcatctacctagtaagggagtggggaatatgagacttaattagggaacagctgtaaaacctcttgagatagttctgtgagtcagaatggaagtgcatcattattaatcattattattattgttagtattttcaaatggctcaaagccgtctctaaatttaatagtaaaatgagtgcatctaataattctttgtatgtacatgctctgtggtcatgcatttcacaaattaaatggcagaatacttgtaggatatgattataatgatccaagtaaatgatcctcaaccaattcaagattatgtgattaagaccccaaggagctaaagcaagcagtttgctttgttaccttttagcttctcgaataacccattttgtgttaatttatgtgaaagggaagaagttagctctttaaaaattaacttagagttttctgtgtcattagtttggaatttgggagtaagtgggttactccttaatttccaaataaatctatctgtaacaccttgtccataatctacatttaaatggtttcgaatatgattggcctagcttcctagcagttgttgagtcgagcataatttatgaactttcagagtcatatgcggtatcttcagacatcatcggaaaagaaaattatatgttttagttttgcagttgttcccttgtctcctgtacccttctgtcaagaaactgcatttgtctctgaggttatgttgcaagtcaatggagaattgccttccaccgtacactgcttggtttcagcttgaattatctcagacagacatcctggctagctgcaatgcaagctcacagggctcaagcctgagaagacctaagtttggcagcgcactaagttgaggatgagaaaagaaaaaagaaattctgtcttttctggtgcttttccctcttggtttctccactaaaaatcaatagcgtggtcgatagttggttttgagttgtcccctacatgctggagtttttctgatgtaaacctttggtgtctgggcttcagacattataatgtgtcagggaaagtttgatagctgtcacagctctcctgggttacattttattcccacgatagcctttgtaatttgagaagggaagaatagatcaatttttataccatttagttgttgggggaatttcttttccataaattgatttttctttgaaaaatttacaatatttattttccttcttcacagcaaaagcaaataaaatgaaatattttcattaatgaatattttaaaataaaagcaatcccaatcttgctgtaagttgttaagactcagttatatcctgttcaggatttctcacgttccttttgcataacttggaatgacacttttaattttaaatgtatccatttgggaaaacctggtgtcttttcttagtagtactctagaatggcaatatcacgaagaataaagtggcacaacaacagctctaatgcttgcgtggttttaatgcagattttggtttctttgaaactaaatgattacttttatggataccaaataattatggataatgaataattattataagtgatgtctgttaaaaagtgtttatttttattttgagtcttttctatgaaatctcgttatcgggactatcagataacattaaatcattaattttctcttctgaaaatatttttagttgcttatctatctttcattctaatatgtattcttcttcaacataataactcttattagaattatccttgaaaaactttggggtaacttctagcatgttctatgaatataaggtgataaaattgtgtttgtaaggtggcttaaagtttcaaaagatagctttctgagtgaaataatgtttgtataaaattgtgttgaaacagcatcttatagaggagcaaatgctatgtctttaaacacttaatatattattcgaaataattgtcaaatatttgaacaataatatttaagaaggaacactagaattgggtgtcttttcatcagatagtgttagatatcaactatgctgtattaattgaaaggatttggtataatctcataaagaaacaggcaaattctggggtttcctctctagtgaaaatatatcattcatgtctttcattactgtgctataattatggtaagtgaagcagaacgagatcgatagagcaatttatcaatgcattccaaactattctagcatggtttacgtcatatctctgcagatactgtcattcaataaagagacatctaatagtataaagacttcagatggatccatttcagcataatgtctttctacgtgatgttctaatttcgatcatggtttaactaattgtttcactctgtatagtattaagtgaagtaaaatgttttctttgttgaatttcaatagaaattttaaaattcagctttcaagtgtaaaaagcactgcagtagtggaaacattgttattaatggatggctttagccttctttttcagtgccattgtaagttatatcaccattgaaactagaatacaagtcaggtatccatcatgcccccaaaagcattaaaattcaaataacaaaaataacagtcattatttaatgactgtaaatttttgtcttttaacatcacaagattcaaaattctttaggctttatcaccgtatttatgatttaactataagagtaggttcacaggctagctcatttagacttttttttccacaaaccgtacacaatggggtcttttttttaatcgtaaatattccccccatactgacatgatattaaatattgataatattgaagagaagatactgaagtatacatgaaagtgttatttatttcagtatggacaaaaaatattttcaaattactagattgtaattttcttttttcatatgttataaaattatcacccactgtcattttggttaattcagttttctacaaaactatataggtctggtaatgatgccagagtcacaccagtgcaaaattgtcatttgtatttcaggtttgtagacatcgagaaatattttcaaggacagaacttattttttattgagttagaaatgttgaaacgtaagggaaaagagtgaagttgaatatgaccactttgtcagaaaactgtatacgtaactcttgattttggaaaaatcagcacctgcaaattttgtcttttggggtttgtttttttttttttagtccagttcataagattacatgtttttggtttataatttctttacctaaggagagttttgtgctgcatgactccttaagagagtttccatgagctcataaaacatgaagtgggacagtctgaaatattgtgatcgttttctagaattatacctgatggaatgtgatgacagcacctctcccttctattttatatgttgaatttgaaagtgcttgggaatgtgttgatgtcaatcgtggctgtgtttttggccatctttctttccttataccttccactttcctactaactggtgcccctctgacattgtttcttaagagcttgtctgttaaagggttaaagaattagatttttaagctgctttcgtgcaatgtatttaagttaaggaaattgggatatcattacctcagtgaggatgttgtaaattgttttgttggcaagatttattgggggttattttacctgatatcacattgtattgtttaatgtggactatttttaactagcgttctatttaaacagtgtcagtgaattctgagagcttgccaaacaaattctcaaaatggttgccaagctgtaagatggctgccaaggtctgagcacattgaacaggttcaaaatggtgaccaacttctcagaatctgttggtcagattcccccactgccaaccccctccccccacacaactaccacccaaaaaggaaggaaaaaaaccacaaacccgaagatgcaagacttggcaccatctccttggcacgagtggctgtagtgtcatccagagattcaagtagtcaccacgtactacttgtttcacatgcttggcagaagactattcaggggaatacatgaggtgaaaaaccactgtaaaataacatggtcattttctttaccttatctaatatgcacaaaataattctttagaaaggggaaaagcctagacaaggcaatactttcaaagagctttctaaatgagatcgaagagcgttaactaagacttcgggctgtgcctttttgtactgcttgcctgaagtggcacaaactttatatacaacaggtttaagatttattttagttttgcatttgtttacttaagtttatagcaattgctttctggcagttgtggtacttagcagattgaaataaaatcataagggtgaattaaaacatactgctgttagtgctgattagaattttagcttagtgtaaataccggatgcagggtccaacttttcagacacttggcatgagctcaatagggatctccaggctacacaggagacagtgtgtgtgcttggatgcttttaaaattcttggataggtggagcatactacttctgctggcatgttggttcattgtgctggctgcataatgtgcttggattccaaggtagatagaagaagctgaggaaatggtaataagggaagatagtttgaacttaaaaaacaaagcctggaaaaaagaattttatttgaaccctctgcagtttgtactctgtgatatggttaattatataaataaccagtactaaactaagttgaaaatggcaggatttgtggtagtttgaagaatgacctagaagtgaatttgtttccacaagttgttgaaatttttctgtgtgatcctttaaaaaatagacagataaattaacttctccaggcagttagtttagtcagtgaattccttaaatagatcttctgtttaatatcagcaatggactaggttttatattctgattgagacctgcattcctaaagatagtttttaggtgataaaacattttatttaatgcttaagtagctgttaaaaaaggctggttgtcatgaaggtactggcgttttgtttttatctcaattggtagtggaatcagctagggataatactatagagcgatatagtttatatagcttgagttttgaaaaatctatagctttaggatttgttcagtcatggagcccttaggtggtgtgtacattttgtatattctctatcacaaggggtagtcaagaaatgtgacttttcggtcctttttttaatgattttctcctgccatttaggcaacaatgttagtagccatcaaagcttctcgtatgtttatttctagtcttttctcacctagtaagcaattgtcaaccaaggcccaatcattcaataggtaaaaccaaatgttattgacagagctgaaatctgaactctgtatccttcagcgtagaagatcaatgttcattaagatgcttcagttctggaaatttcaacataaagctatggaggcatttagaggttagcagggcaaatgtgtgatatgcaaggtgtgtagcagatcccttcttacatatttccagagtatatttgtaatgttacatgttacaaatgtaaaatagtttaattaaaagtctttcttgccaattcttacatattgtactgtaagttagtgacaaggaactcaaataaaacctttctttttaaattagaaaaccaagagtccacacctcattacagtaaatcatagtgcattttaaatcttcagattaagaatgtgtaatactgattattacttgtcaattttgttgttttttttctattacatattcattgatgatttattcagatgactaacgttgttgtagctgaggcaaaaattaaatcattttaaaatatgtcatttttacttattcgtaacaagttatgagtatgtaagcaagtagaattttttcaaattgcctgaagcatgacaaaattctagatttatagtataaaatgccaatcaggcagtgtttacgtaggtagaataaggcatatttttgcaaattcccacatcaccattcttgcttatatgaaaaagcatagtactttttagtattttgagagaaactttattcattttgctgttgtagacacagtccgtgttttaaattagtgaactgcagaaatcttttctttaggaaattttttctattagtccttccaaagtgagtattttactttaaaagagttgtttgtgttttaaatttatgtggtggtatatttagcattttacccttttctacgtagcatacacgtgtaattagtacatggggtgtatgtgtatgctggtgtctacccaagtatgtattgaaatataaaatttactttctatatagtagctttctgcatagggcaacccaaacagctgttattcctttttatagcttctttaatctatgtgccaacaagtcagtttacaaaatctgttttgttgatgactgctgcgataataattgtggtgttttgtggcttggcaaaaggctggggtctcctctgaggactcttgccaaaggctttgaaggggttgaggtggattcactgccaaaatgagtcaccactctctattttatttagtgtccttctgccaaggccttagacactgtctgttttcattcttttgtaggctttcctccccacattgtggttttcttcacagccagaggcctgggtctgccaggataggtgagagaggctgtgtgtagggaaactgaagggctaggggtttagctgttgtataccttgaatgtatatgtgagttaaattatatggttataagttacaaatgatggacttaaataatctagtaccttgtggtcacctgggtttgggtcagacattctcagaagagtattatttacttttaagtaggattcaaataatgtgacagtgttttcataattggtattgattatttaaaaaccctagattatttgtgagttctggctagaggcctaaatcttgaatttttcctcaaacaaaagagtatcatcctcctccttttaaatggcataataatttacttcacataaatgcgttttctacgtacacacctaatagacttcagggaattatgctaaaattttatttctacctgtctagatttaaattgtcaaccattaagtagactgagcaatatgaattgctggtctgttccctgagatatatttgagatttaaacatttttttcttcattaaatactttcagtagattgaaataaatggaactaaatgtcctcttgctaggtttgtccaactcaaacatgtattatgtatagaaaaatggctgggatgaatttgagtcttcaaaatataagcagaaatggcatttcatgcattagtatgaggaggacatacttgggtttttgctaactttcaacctataaaatttagatgggtttttcttaactaaaagctatgacaccatcctgaaatcttgtagattatgtatgcagaattaaattgaggggcatggtttttgttttgtaagtattcattcattgtgttaactctttaaacatcgtatacacaggaaaacttcattataacatcccctgaaaacatttccataaatataaagtaaattttcaaagttcaaagtcctaactataggcaacaaaatgttttccatatattatggtcgaagcttttgttcttcaggggaaaaaatgttataaaaatgattttaacactttgttcacaaaataaattctattaataattgattattatttttcataaatctttcagttagaaaacataattacgtaggtaaagagtgagataatattaggataaatactgatctcattatattctacaaaggtcagtggttagtatccactaagttaatatatgaaagtcctttgtaaactgttaaatatatagatatcaagacatttaggtttttatttttgttttttttaaaactttggattatcacattctcctctctgtgtatctacttcatggttttcatttaaaatagcaaaaataagaaaatagaaacagttactaaaaacttgtagtcattctgtgatataaattcatttggaatttaaatacttagagctcacggcaagagtccaagacagaaattcttttggatgatctataaaccactcaatccctggttaatgctcaaaccatgtgaaaagttccaggtgaaattcactatgagccttgtctgaaccccataaactgagggaagtcctataaaccctatatgaaccccaaagaatcaaaataactaaatccggcacataattaaaaaccactattttctagtggctgctttatgtgtccacagtttgaagacaagctttgcatatggaagtgaactattttatttcgaagatatgaatcataagctacttagtatttaaatatagttatcctgttgtgaagatctaataataatgctgtttaaaaagaggaactggaactcctttacaagtattaccatttccaggatctctcggaaagttgccaagacataaatatagttgtagtaatgattgttgttttaggagtggaattaacagtagatatgttcatcaacgttattttgaaaaagtaacgttatcttggatttgtactaacctttatgccgtatacttaaaatgcaactcttgataatcatttactatgacagtgtgggttgatagaagctaggtattatggttctctttaggcagaaagagaaacagaacccctgcatgacttcagatgcagtatattaatcttttgggggcatcagtttcctcttctgaaaaatgaagggattagactaaaacaatgtctcagattccttccaactcttaaaaaaaaaatctggaagcaactatctttgcgttattgtccataatatccccttcaaaggtgggatgactgatttatggaggacacattgtaaatcactaggctaatatctcttattaattattgcaatcagaagtataatcattgttaacgtgtaccgagtacttactcctagacatcacctgctgggctcctgatgtgaaattggctcactggttcgtctgtagttctttattagtagccttagtatcttagcatattagtgattttattaagttgactaagcattgtatgactttttacaggccagtgtcttggatgctcaagaatcctgaactcattccctttacctgtaaatgttgaccgtgaaccaaaatgagctctgtcagtctcttaaccattttacttttttgaccgtttgtctcatgataagttttgtaagcattaagtaattttcatacatcatctgtttttgcattcattcttccagccatctgccatgtacttggcttttgggcactgggaagagctagatggggtagaaatgcatcttctcttaaaaggagcttacaactcccaaagttacaactctatcacaaaaagagtgtcaagacacaacccaagttcatcacctgaatgccattgataaggatttccagatggacaaaacattaagctgacaccaagtgaaacgtgtacttcacagactttcatgtttcatttcgtgatatgcagtggcactctgaagaactgggctttcagaatgtatgtgtttggtccggttcttcgtatagggagcagtatctttggaacagtcacagcatacaccacaccacactaggttctatctgtggcagggtcagctcattaaagctactttctgggtcctcgttaatgtcatgcaggccttgtgacaggtgttacagctccccacctggcacggtccattgggggtgtgctgtaattgctcttgatgccacacttaatgggtgggggaagaaagtagcattatgtgtgaggggaggtgagagggatgccctcgggccgttgctgacatctggtcaccactcctgttttgctggcttgtctgtttggtgcctacaaatattgggcctttgagttgagtttgctgccaccattgggttccttgcagccatcattatttcacagctgggccatggttttaacttggaaaaagggcattcatctcagggccagaaatggtctactgccaacatgatcctgagaactttcttagtttaataaatgagagaataagtattctcatgagctcctgtatcaagtgtttcctggttttgagcttttttgttttttggtgagaatgttatctttcattgttatttctgaacccttaaaggactaaatttccttttcaagagtttcaagtagttcttgtacatgtgtgcggtgataagcaaacattagtctgagaaagttctgaaaaatctaattgagccagcatttaccaagcccttctatgtcagctactgaactaggtgcagggaaaaaaataaaggtcctcaactagctcaccctcaactagctgtccctccagctagagaaccaaacctctgcataattaaccataataatgggcagatagattcaagggagaatgcagtaaaatatgtaatatcatgagtgcagtttttatctgtgtgcacaattacgcaagccttttaactaaaaggcttcggtgagatggatttcgtaaaaatgcacagaacttcctgaagcacaaattagacagttccctaatattaaaacacagccctgagaggtagggtttcaggctttctggaacccccaaacttgaattggtccacagaactaaattagaagtaacaacctttccttatgatgtgtgatttctcaaatggtggcatcttcccagagctgtgtgttcttttgtttggagcacagctgcttcctattgttaagttgcaccggagagctctgagacaattaatgaaggggatttaaatgttatttaaaggtaatcccaaaacgtttctttgtgaaagatgccccttactgcagtcccaacttaaataccaacttaaataagaaacttccactctaggcatgctcaataaatattcagtgaccatttctggtttctggggcataactaaaactaaataactaaaaaattgccaattaaatcttccccagccccaattccacataacgcctatgcacaaccacttctgaatgctcatggagaaatagcattaaggctctgatctgacctcagtaattttacaaatgtaaaggtagcatctcatggtccctgtagggatatattattagaagaacatgcatacaattttgttttaattgattctcactcttaagtatgcaaccaatctgtgtatatctccttttaattatttatctgagttgtgagagaaaagtaggtaattatttggtgatccattcaaatgtcttgaaaggaaggcatccaacttttatgacatacatcctgaaagacataaaacaatacatttttattttataatttcatcagtatcaagtgtagtgtaaactattttaaaacaatttataaaaggtgcttacatacttactgattgaaaaaatggccacaagaattaagtttatggaattgaaaaaatttagaccacaacaacatggtaaacattgatttttttcagaaggaaataatttctacaaatcaaaaactttactaaccagatgttatagttaggacaaacaatgaaataatcttactgtaagaaaaataattcagccaacacgttttttaagtgtcttctttacgcttaacatgggtatttgctattagatgggggaggtggaaggaatgtatcaaaaatgaataatggccagatgcggtggctcacgcctataatccaagcactttcagaggccaaggcaggtggatcccagcactttcggaggccgaggcgggtagatcacttgaggtcaggagtttgacactagcctggcctcaaactctggtgaaaccccatctctactaaaaatacaaaaattagctgggcgcggtggcagtcgccggtagtcccagttgctcaggaggctgaggcacaagaattgcttgaacccgggaggcggaggttgcagtgagccagtgagccaagatcatgccacagcattccagcctaggcaacagagtgagacttgatctcaaaaaaaagaaaaaaagaataatattcgttaccatgttcctgctgacagtttgagtacacaagatacactgtgacatagtgaattcaaggaagcaaacatggtatgggttggaataatcatggatggatacttactgcaagaggcagaaaaacacatgcagttccttttctaggaaaatattggtaaattatgcttggttagtaaaagtgcacagaaagcatatggaagtttcaaatctattttccataaatttttccccaaagtatttctgagatgctgggtgcaaggtacggttcattgtcctagtcctctatgctgaaaatgatcattttaattggattgcttctttggaaacaagacaaagcgtacattgctaaaagcttctggaggccattttcaatatttgtaataatataagtgctagaaatgtgctttcatttatattcaaaggcaataatgccttctgtaagcatggcgtctctgtaagacttttataatgtctacttaaatgcaagcagacaaaattagttttcactttagattggaagacctttctccattgcaactttttggcctctctttttgttctgctccccaagagcaatgtaaatgttgctctttgttttgctaaaagaggaatgtttatttttacaagtaccatgccacttccatatgatctacatggtatgtgtcatgaatataatttctgtatgattggccaaatttttcacttttaattaagatgaccagacaaaaatttgaattgtaagaaaattatgggccaatttagtgcctgttgaaatgtacactggatattgaaatgttctacagagcataatgaatgaaagtaaaaaggctctatctcttttctgaagcctacttgaaaattttgctttcataacatgacattgaaaaagatactataaaaatatttattaaaatcatagctcgagttttttcttagaagtaagaaattatgtttaatatcaaggactttactacaggataacatgattgtgtttcacatagaaaaactttgttgaaaaatcagtgtggagttgagttcatctgggccctagctgaaactaattttacttttggatattccataaactgcatacatctctttcttactgttttgtttttctatgtatgagaaatccatagacacagaaaaaagatggagagccttcatttctcttattttcacttttgtcccatccctctgtgcttgttctttgtttaaataaacttttgttgtatgtctttcacacatcatcactctctgcttcaaaggcttcttttaataacttagccctggctcacttttcttttgcatatgaaattgatttaactaaagtgtatgtgtgtgtttgtgtgcgcatatgcctacatacacatgcatccgtacaaataaaaatttcactggaaagggaactccgtgatctctttactacgtacatacacacaccttgtcgaagtgggaaaacttaagtttggagttaatttggttttgagttccagctttttctcttagtgctgtctgtttcctcaccctgaaatgaagatggtaatgtttactttgcaaaagttgctgggaaagttatgtatatataaatcactttatttttattgctagacattcaataaatgctagctgttactgtgaccatcattattgtcatatatgtaacacaattatgtcatacatttattttgaagctgataataagtaaactgataaaaagcagaaggttgagattaaggcttcttattgctaaaagattgatcttaagtacaatcacgtgaaaactgatagttacataacctgaaaaatcataaaatactgaaaaattatgactgttatgtgattgttttcagttgtcagactacgtgatgttaaaatggcagttgattttttgtattaacacagtgcctctaattttaaaaactgcttcagcaatcatgtatttaatgaaaacagaagtaacgatacaaaataacaaaaatataaatagagttcagaatttgaaaatactgtattaggaggtaagctgactatttttcgtgttctttaaatatatttagatcaacttgaatattaagcctcctacagcaggtagatagaggtatcaattcagttaccatttaaaatacagtaactccaatgaggagtttcttataattatttctaattactttttgatattagaaattagagctataccagaatgctgggaaagatgtctttttcaacattgtatcacagcatcaagcattatgcatcaaacatcaattcctactcacaatatccattcaatgtatatttggattatattttctttggatagaccctcatagtagaaactctgtattaaccagcttgcaagatgaaccaagactttttgttttctttgtaatatactgattcctttggcatgttgaattttcatggccaacagttacctactaccacatcctagcactattgtttttaccagttgtgtgcttaccacgtcagttgtgttattccggacctgtttatactagtcttatttgtatcaccattgtgtaatttaattaaatttatgtgaaccaatggcatgcaagttcaaaatggaaaagttttatttctatgaaactaacccagtgccttggaaagaatcagtaaaggcaagctacaaaaatttctgtcagattacatgtcagtgagataactacagaagatgagagaaggttgtaaaaataagagttttgttagattattttagaaatatctttaaattctcccactacttaaagtaaatggaactggaaatcttttatgatgcattatagatacgcattatataagaaagatgctgtggagctccaattattaacagacattattaaatttaaatttttgcctctgcataaaaagattggccaaagaatgtacatacacatgctcaaagttaaaatgtttaaggtgcatatgtctcattaatgagtatcttcttcatccattttttcaaattaaccaatcaacaactggccctaacagtactggataaggtaacttctattctattttgtattcctactctttacagagttttagagatgttttgtttcctacctaccaagggaaaaaaagggaattggcagatagagtttatatcttgggatgagatgtgtaaagggccaggacctgaaattacgtgaaggttgatattctgggattggtagttttgaagttccataaagaagttcagtccagccatgttccaaatgctctgagtataggcactggctggtaagcttagtggagtgttatacaacatggaagtctaactggcagttcaatgtcccaaaagttggacagaaccaagaaatagagaacataagcagatgacagtaatccaggcagaaggttagtgtcagagaagtctgtcagtgggtcatagggctccacgtgctagcctgggtttccgtgccagaattttgttcttgggaggcaggtagggaaaagcaagtcaacatctccagttccagatgagctagggcacttgaccaaatacaggtacagaagttagtccttgaggtagagcttacctgttggagaacatggcagaaatcattgtaccaaaattggagcacaggtcagaggctaaagcatggcttactgctgtggctcatggtgaacttgagcttctcatggcccctcctatctcctgaggatggctgagctcacagatggggactgttatgtaatcagaggtcaagtggtttagctggggtggcagagagccaggtgaagactgaaagtgttcaaataaggaagagaacagaattgctttatgtctgccttcatgaagacaaaccctaatagccaaaggactgaaagtttgcccaaagagacctcaatttttgaaaggaaaatgcatcttctccttatgttagaatgaccacgtctaaataaaataaactcttttgccttttgttgttacttgtcttggtatctaccattgtttgacactaaaaaaaaataaagcagtgactaattattggctaatttaatctgtcatgatggcatttgtaattcaggtacatccttcattaaagcaagtataggcattattatttttaaaactttttttttctatttggatttcttctattttgtttgattatttattttgttgttactggtggtggtggtgttttacagtgagacatactggttagctcagctaaggtgtttgagtaagacttcataaacataaagtactttgtgtgggtttgttttgtgtgttccatcttacgtcatttgtggcactgaaaatgagattgcaattcccagagtactgggatagttcattcagaggttagcccacctaagtttatagcagttgtctgtaatagaattgtaactaatttccactgttgtttttggagaaaactgtagactataattatgtgttagcactttttaaacagctccctgcattgtcatatcattttaaatgggctctgttttaaaatgacctttcatgttttgattgcaaaaatatagcttacacaggtctgtagttagcaaaatacaaggatccagtaaatgatagagcattgacacaactctagaagcatgtgttaaacatcactggcactgccctaggtttaaaggggaagaaatagggaagtagaaattcactgttcttcaacactccttctgttggataggcaagattagtacatagaacagttatggagccatgtgaaaaaaaatagtagttatacaaatgtaaaatgctacacatgaagtatattgcattacctttttgtggcctatggaaagaagtctcagagcacagtaagattcaagtaccatctcccagaattggggtcagcaacaccattttatattttggcaaatgctacccactgtctcccaaacggcagatatctgcatatagttagtcatgtggacacacccttcctctgctacattgcattgccatattagtagtagaattttagtgttgatttaaaagacagtctgccttaaagcagattgcatagtttgcacactgtgaattgtaattaaagtgtaaggggggcttattatgtcaacaactggcatgagaacccccgagcagcaggtgaccctgaccatgtgacgtttgtgacagctaggatccccttttcactggcttagcgatctgaaagtccaaattgaaagaagcccagaggctgtatatttcattagatcccaggggaagtacaggatacagcttccttctgttttcctgggaggtcgccagaaagtttgtagagctctgtttctgtcagagactcaaaagagaaaagaaaaagcacacacaaaacaaaacaaaacaccatacacaccacaaaaccatccaccaatcacccccaggaccataaatttgacatttcccacagtctgagaccacagtgttgctgtgtcagcaatacgctccttgtttgaattgtctgaaaggaaggctcagtgttctagcttttaaaaaatgtgtaatcttcaatatgcagtgattctcttggtgtaaaaccatgagaaattatcaagtacagatatcatatgatttgcttgaaatacttttgcattatgcgttactttctcctgaccttctaaaatggggcataagtccgaatttagaaagaggaaaccacatgtgtaataagggaaacagactaaggagacatgccatgtgtatttcagatcttattgtgatgggtaaactgtttgaaatgtggtcacattaaaagtatgttactttgtgggagactcaaaatcttttacgagtagatttttattgtgttccatagtggaaatagaactagggtttggttttggtgggaagttttggtcttcaagtcaccttggcacctgactggcagttgtgaaactaagtagaaaagatacctcttttttcttggcacctcacacgggatcataggattcttactatcatacaatttatatatcacagaaatgaaaacttcggtactttgttgtataatacagatcttgtgcttgttgatttttaatttggggctcaagcttcccatgtcaactaatgtggccgctgctaggctgccctcgggtagaccaaatgtaagctcactaggaagtatttctagctctgtaaatacctagcatatcgtttagtccaggcatgtccaatcttttggcttccctcgaccacattggaagaagaagaattgccttgggtcacacataaagtacactaacattaacgatagctgatgagcttaaaacaaaaatcgcaaaaaaatcttagcatgttggccaggcatggtggctcacgcctgtaatcccagcacttggggaggccaaggcgggtggatcatttgaggtgaggtcaggagttcaagaccagcctggccaacatggtgaaaccccatctctactaaaaatacaaaaaaaattatctgggtgtggtggtgcgtgcctgtaatcccagctactcaggaggctgaggcaggagaatcgcttgaaccgaggagacagaggttgcagtgagccaagatcgcacctctgcactccagcctgggtgagaaagtgagactccatctaaaaaaaaaaaaaaaaaaaaaaaatctcataatgttgtaagaaagtttacgaatttgtgttgggccgtgttcaaagctgtcctgggctgcatgtggcccctgggccgtgggttggacgagcttggtttagtccctaagtgttgttcattttaaaccagaaagtgagaattttctgagcccagattctacctttatactgctatttgttatgttttggtcaaaagggaaatacagaaagaggaaagttaacagtcatggtttgtgtgcttgtatgttgtatactttcatgttttgattgcaagaatatggtttacacaggtctgtagttagcaaaatacaaggatccagtaaatgatccttgtatcatttatttaggaccctctgttgtaagggcccaaaaagactcactcacagtgccatacacatggcactgcatgtgtgtgtgcttgtgccagcctgggacgagaacttcaaggcttgagagaaagatgtaccattttcataaatttggtaaataaattaaaacctttcaacttagagctgcatttaagtgttataattaaaggactaccagttgggttttttgttttgttttgttttgttgttttacagtccatctattttagcaaattcgcaaataattagtttcttttatttatgtttttcaagatcggttcctctattcagccagaggaaaacccaatatccttagctgcgttttacctcaggtacccagagaattgaggcaagaataggttgtgggaatgtgagagaagtgtgtctgtgctgtctcagctcagttaactagtcctctgtagcaggataagcatgtttgtgcagaggtagagaattgtctccagtcatgattttgttttttatattttttactgcgttgttttttttttttttttttttttttttgagacagagtctccctctgtcacccaggctggagtgcagtggcatgatcttggctcattgcaacctctgcctcccggattcaagcaattctcctgactcaggctcccgagtagctgggattacaggcacacatcaccatgtccagctaatttttgtatttttttagtagagacggggtttcaccatgttagccaggatggtctcgaactcctgacctcatgatctgcctactttggcctcccaaagtgctgggattataggcgtgagccaccacacccagctctactgagttcgtaagtgaagctttttcccctctcatgttatttgaatattgtttccttcatctttgtttatttattatttatttttcaaaccagggtctcactctgttgccagaactggagtgcagtggcacacaatcatagctcagcatagcctcaaactcctggacttaggtgatcctctcatctcagcctcctgagtaactaggactacatgcttagctgtttttttttttttttctttttttcttttttttttttcctgagacagggttttgctaagtttcccaggctggtcttaaatgatgctctcatcttggcctcctaaagtgctgggattacagggatgtaatcctggacccttaatctttattattagttcatcatcttttatcatgtatactatgtgccttgaaagtgtgtattattttattatctgcacaattccacatcactttattgatattctgaatatacctgtagtatgttaataaatagcatctaataaaatgtagatacataaaaataagccattttcataacttttggctaattttggaaacagcattctcaactgcaggtcagatttttaaaagaatttaattttatctgtgattgtgtatacatcatgccaaagataaaagcaattcagttgagtgagatagggtgtggaaacaggctacatgttggagtttgttgccagcctgacattttcaacacagtttctagacccatctttttaaatgcgtgctacaatgaaaaccaaaaggactttttcatattgtatttgcagtcatctatagatgtaacttctgatgtctttatttttgttgctcttctcttctcattaacagcagacctgtagacacactagtcccaacatggttgttttacttcctcatatgtgtactgaagtgttctttgctgtctgatgtatattaaggggtcttcagcaattatgaaaccattgctgcagaagcccagagtcacatactatagaaatattctatagtaaggacctaacaggattcacattaaacagaacttgactataaactaatggattcctactacagataataggaaatgtggttttttttttatttttttgaaacagggtctcactttgccacccaggctggagtggggtgacatgatcatggctcactgcagtctcgactcctgggctgaagtgatcttcccacctcagccttctaagtagctgggattacaggcacacatcaccacacccagctaatttttttgtagagacggggttttgccacattgcccaggctggtctcgaactcctgagctcaagcgatccacctgccttggcctcccaaagtgctgggattacaggcataagccaccatgcctggccaggaaatgtttttaaagactctggttcctacaaaatttgcaaagaattgtgaaaactgtctatccacttctttaaattttaatttttgttggtttatatttcaaatattacattgtcaattaggattattatgaccatagatgacacattttgcccatccctgataaagagaagaaatttgctccctaatgtgtagccagtttaggaattttagccttaattgaaaaatgtatacttttttgtaactggactttgtttctgctaggagatagaaaagtctataagccatctctgagatagatttctactcttcctttaaaatcttgcccggactggcccttcccctctctgttcttccattcaaggctcacttattgaacatatattatgtgcaagcacttcatttaggcaagtacgagctgtgtgccctcaagggcttataacttgttgggaaggcacgtgggagttatatacacagagaaatgaattaggatctgagtcccattctcagtaaccagggtgtagggagccagaggaaggaatgatgagttctgccaagaggaagggaaaggattctgacgttatcttctacactggttagaatagaaggatggaatcctaaatttaagacggagatctgtgctgtatacatgtgactaacagagattgggaaagagtgtaattacctcctgtgcctaagaaggttgttggcgtaaacaaggtagaagcaaagccaatttttgggacagtttaaccgaaatcttttcaaatatttggtagaaagcattggatgaagtgttacaattttaattaatgtttttaaatgacaattgagggttaataaagccattgttgccgtgcagttgagaagagtagaatgggtttgtttttgcaatcccagtggggtaattaaacttgcagtgcctgtcactcattccttaggctgagggacttttgagattgcaatagctcatcttgtgttgcagctttgtttttaaatttagctaagttaaagcctatggaaaaaaaatcaagggaatggaagagatgagttttgaactagtgaatgtgttcactcaaggcacagggcctctttgaggaatttaggtcgcagacgtctttcacagaaaagctgtgtccaaactgtcacagttactgcctcagtgtcctgttttgttctgaaggacatgacacctattttccatgcactttttcagaaaatagtatttgtacccatttgttttgtcttcttaaggaacgttcatgcagacttttcgagcagtgagcaggcgccagagactatgtcactgttctgttctgcacagtgtagcgatttgcagttggcgaatgaattcatcagcggatgaatgtcagctcactaggtgacaagcttcctgtgatatagactgggtgaggacagagcttggtgagccttttttgttcacgacttcatctctagcactcacagtagtgcttggcacatagtacatgctcaataaatatttgtagttttatttgtggaatgatatgctgagtaaatgattagagtatattatcaagaaattactatttttttttgagacggagtctcgctctgtcgcccaggctggagtgcagtggcctgatctcggctcactgcaagctccgcctcccgggttcatgccattctcctgcctcaacctctggagtaactgggactacaggcgcccaccaccaggcccggctaattttttgtatttttagtagagacggggtttcaccgtgttagccaggatggtctcgatctcctgacctcatgatctgcccacctcggcctcccgaggtgctgggattacaggcgtgagcccctgcgcccggccaagaaattttcatagagtttccacttccttggttgctgaatgatttgtaatattgtaatcagtatatctatgacacaatttctaaagttatttagtgtttgtcagtgatgtctgaagctccatttgctcttttgaagtcatttgtttcttaggacctacaattcttaggaaaaaatgacttacagtcaaataatttaggaattttaggggaaatctggagcccattttatttagtggccttaaagatgaggtacataagacccaggctaacccagcttctaacagttgattctgaatcccaggtttcctgattctgaacttgatgtccattttgaggggttgttaagccaaataccttcaagcttttcccctctgttgcactcacatttatgaatacagatggtctctaacttaggatggttcaacttaagaatccacattccataaaaatgggactttgattacccatacaatactggttttcactttcagtacagtattcaataaattacatgagatatttaacactttaatataaaagaggctgtgtgttagatgattttgcccaactgcaggataacgttaagtgttctgagcacatttaaggtagactagcctaagctgtaatgtttggtagtttaggtgtatcaaatgcattttcaactgatgatactttcaacttccaatggatttatcaggatgcaacccccatcataagtcgaagtgcatctgtacttactttagactaaacaggaataataaagtactctaggagaagagaactcagtaagaggttaactttacgtggaaatgttacaggcctaatgtaaggtacagccaacaacaacaaaaaaagcaagctggcgatctgccttccatgcaaaggttatttttcttattacaacaaaactaattagtggattttctaatgtaagaaaatgttgctgttagtaaaagtttcctcagtgtgccagaaagcagatggtggcagtgaatagtgttttcttttgccaggttttgtatatgctttctaaacctgcaagagattttgcttttccagattcagatttctgatcttttttattttaaaacagaaatagaaacttatatttaaatgtacttgcatcatgtggtctgtttgacatattatggttacttgaaaatgttgagtaacatttgatgttctgcatgaatttcttctctaagagtcttgggacttttaatgttgttctatactctctctctttatggaaataaagagtttctgccttgagagtgctacaatggggagttttgagtgatttatgaaaagcaatgggtaagatttttttatgtgaaaatttgtattttgtttcactcccaattactgtgcaagtaccagcttttcacagtgaggtttcttacagcatgactttgttcattatgacttcagtgtttgtatacagttttgaataatttatttctgtctactactggtgagatgttactttctgctaatttaaaatgttttgcctaacgtttttaatgaaagtccttataaatatgtttgtttaaagtctgaaatctaaacatgtccttaacagtaccaacgaggcagcattaaaacaaaaggcatgttgattttaaggccaactggaagaatgtatatctacaatggtgtagacgtgaggctgtaatgagcatgagtgtagtcaagacttatggctttgttgactaaaacttaagagatgctttcctttctataggacctccatttagaggagaaaaggaaatcattaagtcaatagatgagttattaaagtataaagtaaaaatggaaaatgaaaacacactcagtgatttttttggaaatcatttgggcaaaagtatcaagaaagaattgtctcaaagttactaaatggaatagtctccttatggaattatgtgctattttgggaggtgatagccagaatcaaaggaaatgaaagaaggactttcatcccttctttcacctcattcccatgtagctctgctgtgttgttccatccatccccaacactaacctgataattcggagacaccttgccgcatattgtttcacctttaattcttgaataaactctgattcttacttataacttttcccatgtttgttgccaataaaatttcccatctcatttgaagagttgctatttctgtcacctgttcaaaggatagcacttcttttattactacctctttctttttccttttccaactatttctcctttgactttgtttttcccaataatgatttgtttttatcttctttcctagtaaccaaaaattaaaacaggacagagtttccaaaggaaatgtctgtagatgttaaccaaactgattgaatcactggttattctttgcttactttaaggctgtaaatctgcaaaaagacagaggtgatactggtatcactcacagccacaggttagtgccttggctgtgctgatgctgccagggtttaaacattgctgtgaggagcccagcacaggcaggagtgtggggtgaggatgtgtgataacagggcatgacgggcaggtagaactgctcgcttgtgttttacacacaggcgccccagccttcctataggctctttcttgtgaataggcttccaccatgaccaaaatgtttgaaaaaccgtaaagccaagagataagtaatttttgttgaatataaaatagataagccattacctattcataggaatatttacctcctgatagactttggcaagggttctaacacagagacactccatgttctcaccaccagtgaagacgagggaagtagctactctcaaaaaacaaatagcattggctgggcacggtggctcacgcctgtaatcccagcactttgggaggctgaggcagctggatcacttgaggccaggaagtcaagacaagcctggccaacgtagccctgtctctactaaaaatacaaaaattagctgggcatggcaacatgcacctggagtcccagctactcacgaggctgaggcaggagaatcgcttgaacccgggaggcagaggttgcagtgagcagagatcacaccactgcactccagcctgggtggcagagtgagactctgacttaaaaaaaaaaaagtgtaaacttttataaatgatacagagttgaatgaatggaattcttggtgaacatgatgagctatctcaagactgaataatgctttgcacacagtaggtgataacaaatgtttgaggccctgacataaacaagcttcctcctcctaagaaaggttaatcaatagtcattctttagagtgagggatccatgctgatttttgaaaagtgaatcagagtaaaagttccaatcgccctcttggactttttgatgatcagctattgaaatagcacgtatgttagagacagtcctcccagcaaacatgattttctattaaaatacatccaggtgacaaaaaagaagcttttagaaaaaaagaatttgactgagcgtggtgactcacgcctataatcccagcgcttcaggaggctgaggcgggtggattgcttgagctcaggagttcaggaccagcctagccaacatggtgaaaccctgtctctactaaaaaatacaaaaaagaaaaagagctgggcatggaggtgggcgcctgtaatcccagctactcaggaggctgagacgggagaattgccagaacccggaaggcgaaggttgcagtgagccgagatcgcaccattgcactccagcctgggcgataagagcaaaactccaccttacaaaaaaaaaaaaaaaaaaaaaaaaaaaggatttcccgaaggtagtttatttggcaaatcccacacaaactattagtagtccttatacgaagacaatttaattttgggattattactaagcaaattactcacaaatactgagttactgaaatggaaaatatttttatctccccccagtgtaactacagacaagaatgtagatagtgtacttaggtgtaaatgacagatggaatgaactttgggtgaaggcgagagcacagaagctcagtggtactgagctgggtttgagtgggtgggaccccatgactggttactgatctttgaaagcgtttcaggatttcaaagctacataagcgaattcacgtgttttagttatctaggtttgttttttccttgttatataggatgtttgcagttttcccatttgtatcaactcatacatctttgaagttttgtaattcagtatagctttggttatagattaaagttcactggaaaatcactgactaatccttttagcatgttccactgttccatagtataaagatacacagaacttgatggcttccaagtgtggttcaaacatccaaagcactcgagattagcaccatgtgaagaaattttaaaatattgtactgcaattaattttaaataacttagcactgcatatgtcagggagaaagccatggtagaattcaaacagaagctcctataagtgaaatgattcacttacatcatttaaataattttatctctcataaagacatagaagcaaaatatatgcctatttccacttaggaaaggcttgggtgaatttctgaagaatcagatattacctgaggtttattataatatgggaagtctgtggagcatttattggttaccaaatgattaactccctatattcatgtgtatttgttataggttcaaaaaccaagttattacagaaaagttattgtcaatgtggaaattgaaaacacattattttaataatataacgtagagaaggtatatctaaaatacatatttttaagtattatcctaaattctaggatctagattaaattctttgaggatatctttttagtagctcctgaaacacaaagttttctggaagacccgatgggtcaagatataaaggaaaaaacttagtttatggccttctgtggtcaggggttagccaagtcactgaaaataaacatttgcaactgttagtgggctatttgcggtcatttataaagtataataagacacagtttatgacttgtagtgattattgcactcatgttatttctaattgcacttatgatcagcagcaaataagcaaatatcactcagtgccttttgatgaaatgagagtcttagccttgaatgcagccgaagaccaacagctcaattgctagtgatgtgtttcaaatgtagaaaggctggaaagaacctttgctgaacacctaaccctcaccttcatctatagatattctggcctggagaggtaagaatttacatatccaagggaaaatgggtgatttacgaccagaaagtagacctcctgactcccatagagacccttcttaccacatgaaacataccatcttccagtcatagagtctcctccaaaccagaaagaacaccccaaacacctattgacctttcccaagagagaccctattgtattttatggctctgaaagagctaattttttttctttctttctttattttttattttattttatttttatttttgagacggagtttcactctgtgtcccaggctggagtgcagtggcacgatctcagctcactgcaacctctgtctcctgggtttaagccatcctcccggttcaagcaattctcctgcctcagcctcccaagtagctgggattacaggcatgctccaccacgcccagctaatttttgtatttttagtagagacggggtttctccatattggccaggctggtctcaaactctcctgacctcaggtgatctgcccacctcggcctcccaaagtgctgggattacaggcatgagccactgtacctggcctgaaagagctattttttcatctttgtatttaaattccatttcaacaaacatgtgttagtatctgtatgttccaggcatggtgctatctgccagtaaaaatgagacagaaaattaaatagcatgatgctttaaccagtctatatgctttagaaaacctgcttccaagcagtgaacagttagagaattatagccactcataatttacaaggcactgtaaatcatgccattcagtcctggtactctctagagtcaggtatttggaatgagtcagttgaggttcagggaggtaaaggggcttgcccaattcctcaaagctaatataaatagccaagaagggactcaaacccaggttttcttttatcatgccttttgccttttttcactataccatagctacttctggtagaactgtcatttctattaaagggaggataccaggcctaattcagaataacattctgtactatgtatgcaattgtttctaaggagaaaagtctgatttaaaaaaaaatatttttatacttttaggctgggtgccgtggctcatgcctgtaatcccagcactttgggaagctgaggtgggtggatcacctgaggtcagtagttcgagagcagcctggccaacatggtgaaaccctgtctctaccaaaaaacacaaaaattagctgggcgtggtggcagcacctgtaatcccagctacttgggaggctgaggcaggagaatcacttgaactcaggaggcggaggttgcagtgagccgagattgcaccattgcactccagcctgggcaacaaagggagacttcgtctcaagaaaaaaaaaaattggatactttacaccatttccagcaatgctagttatgcagtaatagcttaatatttcacttaaaaaaagattctgcctaaacctctctttatctcactagaagagctaaccctaaccactaccaccgccagttagtatcagggctgctgtaaattgttccaagggtacatttagtggtattgattgctgctaatagtaaaagaataaaagcaattatgaatgtacacaacaacttgttgctctaccccagtttcaccaggagataggatttagtcaagaggggatgtcacagaatctttatcctgattaggagctttttgaggggagggaccttgccttttttcattttgtatctccaggtatacagggtgaaaggcaccatagtagatgccaagcgaatgaatgaatgaacgagatggataggcccaaagacaactaaatcaaaaaacctgtgttgtttcagaggagaatgatccagtatcatttcccctttgggtaggagtagtggtatgaatattgctatgactgcagaatcccagacttgtctagaatctctagttatagctttcctcagcagtgggattcaccaacacactgaaataacctgtctgtggcaaaactccatacacaatcctgttttctcaaatgcttcaaggggaaaagaaattcctgatttacccaaccacagaatcttcaaccttctcattaaggcttctgcattttttaggcaaattgttactgtgccattcttactcctatcctttcacagaattattttctgattatggatatgacaagacccagttgattttttcagagtttagtcatttattctgtggtttcaaatctcttctaccatgttatcttcctgcccctctactcccctgcccccaccccccgacaccaattcttaattccctttcttccttttattctcaccaggaagggatatgtcacagtaaaccctaccaccttgtcatccaaaatttctagggagccttagttctgagggtcttcttcttgaggccttaaccttacttttagacagttgtcattatctttgtctaaaggtcatagctaaattgaataaaaggaaagctgtgttttcctgttgatgcacaaaggcagtattgacttccctaatccagtttgctgaggggtgagagaattaaattagatatctaagcacagaaattgagagcctttgaaaacaaagataaggagacaagactgtattttcccttttcctgggagctctgggctcaagattttgcaggtgtgtcatctgatccatggcttgcatcgatcaaaactgtgccaatgcatatttaattagcaaggggaccctggatgcattatagccatcatccctatattgaatggactgtcagactctccgcacacttctccacccccaccgtcccctgaacccgtgctccctcccttgcctcgttgtttgggaagcttctgcattttgtctgagcagctaaaaagtttctttgtttttagctgctgatgcatacagcgccactgaggagaatacaaacaagtagagtcctaaagtgtttattttgtctaggaagacaagctaaaccaatttgattccttcggtaagattttcaaaccctgtagaaaaccgacaagaaaagcaaaaagaaaatgaatacactgttcaactcttcacgtatagaatttaaaaaaaaaaaaaagaattggttatattaggaataaagaagacttcggacaaatattttaataatagaattaaagaatactttctattatgatagaaggtattttattttaaaagctctgttttgatacttaaataagacatttgttgttggcaaatattttattgatcagtctaatttgcttgatgcaattcaccattctgacatgaatctgtcattaccattaggaaatccaatgcctgtacaaaagttatttatgatagaaggtgacaaagagttagagctggatgtatttttttttaaagtttctaaggttttgtgggtgtttctgttggtgagaattcttaaagtgcaggaggtttggagttttgccacagacaggttatttcatgggattatggtcactgttcattttcacacaggttccaaagcttgaatatccagacagtgttgtctgataaacagatgtaatgcaccaagtctgcttagaataaagagcaacagactgtgagcacatgtttaggactcatttaaactcatcagcatagtctagctcatagttctctgtctctagtctacttttgaggtagcttcttgctggtaaagtaacaaggaattattttttctctgctacaatttgctgcagagactcatgggaaattcatttgcatacatcttgttacaaagactgactacttcctggcttagacaaagtgttgcctgataaacagacttaacacacaaatgtctgtctggaataaacaacggcaagctgagatttacatttcattatcaaagataatctctttcccagtatatgagaattaagaacctgttctttaaaaccaggtctgtgctcctgatgttttatactagaatcacatcatgtgtcggttggggttgattttcacaaagaaacgaaaaacttgttgggatgtgaagatctgtagggcagaggtaaatgtacattttggggggcctttatgagtttcaaaaccaggttttcttgctttattttatttgaaccacacaacatcctgttaagttaggcaaaatcatcagtagtgtctccattttacagatgaagaaactgagatccagcacagttaaattatatagctgaggtttctaggacaccatctttttaccatttcatactcttttcaatggtggaatatgaatgcaagaaaattagtactttaaggtgctacctggacttaaatagcatgtttacacttgatagagggcattttattatttcaataaaagtttgtgcagacatccaggtacatgaaaataatgcatgtagattataactcaattatccttcattttcatttgaagcatgtattttatagtaggaaagaatacagggacattttctacattaagtagtatagatggctgtatgagtaatcttcaagtatatatcatcctgttgaagaactccaagaacctagtgttaagattaattttgattgtgaaaaaagtgactaaatggggaaattaagcacaattctgctatgcaataatgttgcagggatggctttttaagcaggtctttgtttacatgggagtgggtaggtgatcgggtagactcaataacttgagttctgaattaatcagcaggcaccgctgtgaacacagcgcctcttatggggaaaacaaaattcaaaatgattacctagacattttagtttagtttagtcaaagcgtcttctcaaagaaaatgtgagaagttacaaacttagtcaaagtatcatgtttgcctgtcttttataatcaccagcttcttaccattgacttcatttataacatcactgaaaaagctgatcattacttgaaattcagcctcatgcgaagattgaaggtttaatgattgagtcattttgtcattactttcagagtgactgaatttgtcatttttaaagcttagaaatgatcctcccctcactgtcataacacaacaatagttatgccatttcatttttttctcaacgtgttagaactgtgtatcattctgcaacctccttgtgcatgtagaaaaataacacattgatgagtaggtgataaggcagttgactcactcttcaacttaaacagtcttatcatcgtacacagtaccgactaaacagatgggccctggaataccaacattaatgaaataccagaaaagttgaatttctgtaaatttaatatttcacaaacttgtggccagaaaggcattacaaaaagaaaagttttgagaaagaaaatggtagtaacctagattatgtaacagtcttaagtaggccttgacaatgcggtacaggggagtgactaaggggtggatctccagagcagctggcagcccccagggtggtctggtggagggagcccttccaagtggctgctgcaggaacacagaccttgctccctgtctgaatcaggagtagaggagatgaggaccaatgcgtgcaaactagcctggtccttttggagctaggagttcccctgcaccccgccacagctccccatctcccttcgataaaggacttactctgcatacattaattactgcagttaccgtgtacatatatctagacaaacactcaattctagcttgctgggaaagttataaagatgaaattttgtatttaaaatccagtaatgataagatttcccatttaaagaaccacagagtgtttccatttttaaagcttaagaaaacttttatggtatgactcacctcatcttttatctgttttaggaactcggttattgtacgttaattttcattaagcgggccacagttgtgtacattaattgaccttaaatattagtttggttattcactgagcttaaaagattttattcattctctgtaaatgctaatcataattgcatattttcggtggtccggatttagtaatggtgttacagatttctgtttgttcttaaccagaccatgatggataatattatatttagctgatggtgttgtattcatcaatgtttacccttaagctacaaattgtatatacatgtgtacacctgtacgctgacattctacattctcaaataaggtttttccaatattttcttcacacgtcagtctttaaggtcacggtcatactggaaaaaatagataattttcctaaatattacaaagtattacaataataatttcttttataactgcagctgtgagactaataagcaaaatgtgactattatagttatttgattttctggatttcgttaatgtaataaacttatggtactggctgatcaaaacagagtaattttaaaaattatgttactcataagaacagaattatttctctattacaaccttatagatgtagaaaaatgaattccttggcctcttctgcagagtacttatcttcccaaaccctcagaaactaaaacttatctaaattttgaacatctttaaggtctacagttgtagagggtaactgcttattacactcagagtgtaatcacccttactccttactttcttttacctcagaaatgttcctaactcttcatttatttgcaggaaagtattcactcctgtctttgccttttagtttttatactacaaacaactctagctcatgagagtggaattttcgctttatttctttcactaatatttttgggtttggatgccttctggtttcttcataccgtcttttaatttgggagatttaaaactggacataaaattctaacaaaggctcttcagacttcatctttagccaaatcattatgcatgtagggaggctgaaacttaggctatattatttttctagtggaaccagaatttgtgcttttatggtccatagactttggttgctatcgtgttgatggaccaggaatgacatcggtttgttttagggtgggaagggttcctcaccagtgtgtctgcttttcctttatcaagaaattcacaacagcagttgtgaggattttgaggcagtctacaggcaccagaatatggtgggtttctctaatcattgtaatttttaaatgtgtgaaatattcctccatcattcatcattttaacctgtatacatttctggagggcctcctatgtgtcagatacggcttcagctcagcctctgtgctgcttgggccagtggatcataggaggtgattgtctgcaatttctaaacactgtgtaagatttccaaaccactcacaaaccagagggatatgccctatattcccttgccaggtctcaagaagcaaggcatcaagcagagatagaggactttttgcgctcctttctcatcttagaagtcccactcccctttcaggtgtaagcttagcatatttttcagtcactgacagtggttcagtatcagaaagctgaacaacaattgaaatttcgtctcttcagttcagcagttattgaactccttggctgggccaggcaccctgtggaaagtaccggggataagagaagagtaggaaggaactcctttctttagaagctgacattctcagatggtttgaactcaccttactacagcataatattaatcacactgtaagagatacatttgcaatgaaagagggactggagaggacaaagtgtttaattctaggtgaaagggaagatttagcaatattctatctttgtttattgcctaaagaacataaaatacatggaagggatatttatatttttgcctcactcattttaccatactaacatgtttttgtcattcctcaccttccccaaaggaatactgaagtttcattctgaaggggagtagacctgaggtttgaggagccgaatatgtgtacatgtagcaaatccagtacaaggtttccgttcttgcattgtacaagcgtttggaagcagagacaaatatgtaggcatcaggatttattttattcctttccctagtgattacgttgacagtgaactatctttgtctgagtactccagcaatatagctgtaggcgccataaaactgcataggtggatggctaccagttcaattaagagttcttaacctagcctcccatatgcaaaccctgtctattttaggtttaaatttctgctcataaattttttaaaaatccaaagaaacattgcttttcaaggttaggttgaagtctaagtttccttaaacaaaaagcaaatccctagatagggaaaaaaaattgataaccctaatgtacttccttacaagagcatttccaaccccatcctttaaacacagtgtaagtaaaattctcttcattgtaatatacagatcttctggctttcaaccagtaagccagagaaactcactggtatgggagactcagatacaagaagaacatccagttctatgcagttgggtttgttttctgaggttcctaattatttaaggtggtagaaatcaatcaaccacgtgatatttgtccgaaagagtaagacacaaagttaccttggcttctgacaggtgtctatggagtatataaaggagaaaagtgaattaattgttaaccttcttgatagtgttttaatgcaaatgtttgagaaagagatctttcatttgtatcaattatacctgggtagaaattaatttataattttggtcatctggttggctccacacttaacagcatcagtgaccttttgcaataccagaaagagtgtccatgcatcctcagcagagaatagcactaagactgggtagttttgctccttcttggctgaaaaagaaaatggtattgaacggccgagggtagaaaataattattgaagttttgagatcatatgcattttcttgtagatctttggctttgcttgccccttagcaggatggtgcattttagtatgcagtcctcagatggatagcggtgtctccagcttttgaataaaactagaaaaattaaattccgttttcagtttggctggatgccttctccagtgtttgtatctgagctttcacgagaatgcggcggccccttgcagaccaactctgagcattttcttgccactcactcctttgctgttggtttgcttatttttctgtggcttggaattttaaactttctttggacatacctaatattcatcttttattgttgttcatgttttctattattatgctatgtatctgtaaaggtaggtgacaaatttaaacaaaaagtgaaaagaagaaagaagtctgctttcagattaaataaaaaaaatttagggtctttcctgatccctttttgctttaatattcatggataaatatcggaaaagtaattggctattgtatatctaataattgagataaaactattttccatttattcatagagaagtgattaattataaagatattacacatagaagtagtacatggatagagatgtatgtttgctagtattattccaaagaaaatattatgtttggcaaaattttatgtatctgtttcgggacatgatcaagaattttaattttccctaaaacaaaattagatattttgctttcattttagttatagaaattaatggtttaagattttccagaacaaaaacaatggaggcatgtctttctcctaaaatacattgaattactactcaaaatatttaatgtgtaatttctaatggcaaaattataggcttgtttcctagaagaaaaagaaggtagtcatgctgtattttttaattgtttgtgatatatataatattaatttatgtagttaaaattttaaatatgggtcaatgtaaatttgtttgcatttctaatttttagtctaggttttgtatttttgtagtttattctgaaggatttctttaaaggtttttggcatataataatacattttgtttgtgtcttctctgtggcaattgttacagaacgataaaagctgtcactttgccagactcaaataaaaattcactttttagcatcttctgttatttaaacctttgaatcaacatagaatttttgctatagtcaccaggttaagattatctgaaaattttaaaatggatattttttgctatagcactttcttataagtaaaatcttcgtttgcttaaaagcagggagtcttttaaagtaataaattagcatttctagacctaaggtcactagtagtgccacttctttctgcagcatctccaagaaagagaagggtgatgctataactcagttgctatagaagtaatattttctgtttaatcacagttaagtgtcatgaccttttgaccttacattaaacttgcagaaatgtggttaaatttcaggcagctaattcaaaacctgtgaagtcaagttgaagttaggatgcaagctctccgcagatacagaggttttgttgaaaaaaaatttttgtgtttgcttttgaacaatgttgtaaacgacttcaagtctcagaaaacgctttatttttaaatcaaaatttttccccttgaaacattttgcctgttttttctctcctctccccaaaaactgtaccataaatatgcttgtttctaattttgtgaaattcttttgatctaagttaattttatctaatttaaaaattaagttactttgattttcccttatttcatttagaaattaagttaatcaaattccttttttagtttgaaaatatgattatattttttaaattaaaaaatgtttaattctatagaggtgtacaaaaatctgtttttgcaaacaagtccttttaggatctcccaaatgcatcagtacaagaaaaaaataattcttataaagcaggggaaacttgtaccttcagaaagacttctttgagttatgcagttatttcaagaaaatgtgatggaatattaggactctagtatttaatggtgttagtctgcgtagtctgttgctggaatgcagagctaaatatcaacagaacttgttactgttgtttgggttgcttttatataccagcttcaaaatatgttttgacactttattatgttctgaatcaagcttcagatgtgtgtaatgaaggatgaagtctttatcagactcgagtgtataaatagtggagaagagcagtttggaaatggtctctctaagagaatggttgctgaagagcttcaagttgtgatctggcaaaagccaatgccaccgtaggtgtccgcaaaccggagcgtcctctctaaaggcacaggctgctgctgcatttccctctctttcttttctctttccatcttttctttttttcatgtctcatgtcatttctgtaatgttccctttcttagtttataggttgaaccttttgagaaagtctggcacctctgatgcactttcccttgcagaccctgtaatttttggctgtatttttatgtttttcagattcaagtcaatctgaaagtcccagccagccaagtgacgctgacattaaggaccagccagaaaatggtaagtttagcttgggactctagctgctgctttcagagtccacagcagccagcaggccgactaagtgtgaggatttgggggcctaccctataagtagcccacagtaggaacaactccaaagactcggaaaaactcaagtagattacttttaatagggcagcttcttgttctcgggatcaccccagcagcctcaggacccccggccctaaacactattagggtgcccatgagaacctgaattcccaagaacgttgattacccaattaaactatgagaagtggggttaatttaccaaatcagatttttttttaatagcattaagtgaggagtcatggctttttcatttcattttagttctttaatgtggcaaatgccccatgatcatcttcactagtgatttaagatcattcattcacaagcagttttaagccttttgggagctcaacactttgccaattcctttaagaaaaaaaaaaatatctatgctttgaaggatttttctaccttaaattgtctaaaataaaatagtgaggatacagggcagcattaaattccactgctgcataaatatctaaattttctgttgcagatgctttattaaaatagaacatacattatatatgaatatcatagtatctggtaaaatttgaattcgtggcaggcactacaagtatgaaaaatactgtcatgggttggagttttatattgaataaaactatcggtttcaataaaaacagagacttcagtgaactagcagtgcctatcatataacaaacattgtgttacatactttcacagatatcatctcataaaattccaaaatgttcttctttgctgatagcactgaggactctggtggaatgctttaccttgaagggcctgtggggagaatatgccattgtgattaaaagctcaggctgtgggctgggcgtggtggctttcacctgtaatcccagcactttgggaggctgaggctggcagatcacgaggtcaggagttcaagaccagcctggccaacatggtgaaatcatgtctttactaaaaatagaaaaattattcggtcgtagtggcatgtgcctgctgtaatcccagctacttgggaggcttaggcaggagaattgcttgaacctgggaggcagaggttgcagtgagctgagattgcgccactgcactctagctctgggcaacagagcagaacatctcaggggaggcggggcggcggaagctcaggctgtgacctgcattcaaattctgcctctcctatttcttacctgtgtgatactgaataggttatttaacctctcagagtattgatttattcctctaaaacagggtaataatattacctgtttgttgaagagttaaataagataatatgtgtaatgtgtttaccatagtatctttcatagagtttatgctttaaaaatgtcagctgtggttcattatgacttttattatttttcttgtcaatataattctgtcatactttgtttttcacccactttgaatgaccccattgcttgagtctcttccttttgttgttctgtacattgttccatgttgatctccatccaatcttttggaaaagataggcaaacggaattatgttggtattgtggggtgaaggatcaagtttaccacattagctatcctatcactgatttttcagaatatgtttcatttcctacccatgagaaatttgattacattgctggattctagcattaaatatggactgcctggcaattcctctcctcatcctggtattttggtgatattttctttatcaaagttgtctttttaaagcaggcagttaaaaaaaaaaaaagagagaactctggaggtttgtttttagtgtcatatacagctacatcttattttttgttgacattttaaagagtggtatttatagactagtttcgttctttattttccacttgacttgtaggtgatgtcttcaaagtttcacttttttctacatattgtatttgtgcataatctccctaaagatgtctccagaggtataattttattttcatcttcaaaaatgtgtggactgtacgggtgtgtagttcgcgtatttaggtctggccgcccctctagcaggcctgtgattcatctgtcttcataaaatggccaacaagctgttcacatgcaaatataaattgagagcatgagaggcctggcatgcctttctggagctgcctgcaatcccaatattgtgtgtttcccattccagaaagcaaccaggattgagcctggattttttggccaaaggcagagagatactagccaagttcacttttaacctcagatcacttgatgctactacctcaaggatttacactatcattttggggaaatcatgtgagttcaaagaaagaaagtattaatatctaggagataaagtaataaattcctatctttcagttttctatttgtttcaaagaaaaagtagtagaagctggcttatcttagccccagttgaagaattatcagcctactcagttttctgcctcttgtcaatctcagatgaagttagtggaggaaaaatgatttttctcttttccttaaagacacgtaatcccaaaaggaataaatgaagattcagggctgggtatttacatgcattagataaggttctactctctggtgttgcgttgatcaagagaatgtttcctctttttcattacctcaggatatgaagatgaagtgtgtgtttcgtttttgttttgaaagagggaactctcataggtgtatcaacaaagctctaagaaattttggaatcttgctgattgaagaagtaacagacttgattcttcaaataaaatgggaattcattacttcacatatatgtatgtgtgtgtatatatatatgtatgtttgtatgtatgcgaaaaaataatattctttttatcctagctcttgagaaaggtaatgggaaacgaatggtatttccctagtaaaccatggagaatgaatagacaaatggtaacacgctgtttcatcccaaaccgtaaactgggccatgtaactttacataaagtggatgcagctgtttcttccctgtccaactagtctgctttttctgtggaatttttgctttcttttcttgtactcccttaagactcaactgtaaaagaaaacaaatctttgtccaattagagcattagatgggaattttgaaggaattatctgaagcccagcgataaaatatcagaagctctgaaactcaaaattggtataatataatgggtaaaaactctgcctctggagtcaaaaagacctgagttcaaattaaataatagctgagtgactgagtaaggtacaccccaatctcagttttcttaccagtaaaacagaaatactaaaaggaggccaggtgcagtggctcacgcctataatcccagcactttgggaggctgaggtgagtcgatcacttgaggtcaggagttcgaaaccagcctggccaacatggtgcccgtctctactaaaaatacaaaaattagccaggcatagtggcacatgcctgtaataccactactcgggaggctgaggcagcagactatcttgaatccgggcagcagatgttgtagtgagccaagatggcaccacttcatccagcctgggtgacagagcaagactccatctcaaaaaaaaaaaagaaaagaaaagaaataaaatactaaaaggacgtatctcatgagtggtaaactgagaatatgcatacaaaatagcattctgcctggttcacagtaaggactcaaaggaaggttaccattactaccttccagttaaagcttgtcgtatttacaacgagtacgtatattcaagaggtccaaagctgggagccttggagtggaaggggatggcgtcagaaatataccaagacttttagagacatctttagtgggtacttaccctgctctgaaatgtcagacatgggtttcccaaatccccacaatccccatggtgccacgtctgttttcccattttgttttatcctcacaatctgttcatctcccatgagtttgagaaccagggaattgcaaaaaggattcagagttgctggaaccttcagaatgagtgctcaagaaggtgattctggaaagaagagacttctcctagatgtctttaattttagctgagtttttccttggcacaaaccaaatagaatctggcttattaaaaactataagctgattaagggtaggatttatgacaaattccttttaaaaaaaatcctgcacagcccgtagatctgtgccttgaacttaatgggtacctagtacttatttgcttaatgaataaaattaataagtagatgaatatattgtcattactcccaaatatttttggagtatctgttcactcttgatttacctagagattttaagaaaaacaaacaaacaaaaaaaacaaaaacgctctggagaagctgaaaacctaatttgggtgtgggggaaggctgtcctcagacacatggacagagattaacagatataactagtaggtctaggaagccaaagctgagggctaggtactaatgggaataggacatcaagttgtccctctccccttcctgcccgcccccacccccacttcaatgagcaggtgtggtcagatgtttgaaacatcaccatttcagtttatgcatgatgcttgattaccgtagggaatgcagttcagacaaagttcctagctctgattggtatcatttaatcctttgttatatcactgaatctggcttttccagagctcctgaaggttttaagccttatttgttggactttgacttagaacatcgatttaaacaacttttgtgaactcccatgacatactttggttactttaaacatatttatgggacagagcatttaaaatgcctgcctgatatttacagggcctgtgaacagtcctccaaagcttgcattctgtggtgtatcaggtcagtcattaatgaggataaagctcatgtgatagccttcttacttaattcaaggcacacttctgtagggctgcactgagtcagtgtctgaggcaacagtataggccagcgttggcactctgaaaacacacccccactggctctcactgttatccgtgaaagcatccttaactaaaaaaagaaaatgtggggctcccttgccagaaagtaatgctatcttcacctggttatttttcccttctatttgccatttctcatcacctgcacagactgctagtaataactttatcatagtggtttttaaaatgtgatatttataacaagaaatcagaattggtatttagatgatttcctttaggtttaatcatgtttgttcctcctcatttatctggtagttgcacatatgttggtggcatcaaccctcagatgggtctttgcaatcagtggaagcccattaatcatgatgcttgccccagattttgaaaatttccagctctacctgccaatttgaaaattaccctgtggagtattggttgaatctacctttcatgttcaccatcttcatttatgtcgttcacatcctgaattgttaaaagaggtatcattgttaaatgttgctaggtgaacaaggaatgtacttcttttcatccgtaattgttgctatttcatgcattattatttaactcattgaatttttaatgtttacgaaataagttttagtgcaactgacttcctgacttaagatttatgtgtagggctggacacagtggctcacgcctgtaatcctagcactttgggaggccaaggcgggtggatcacttgaggtcaggagttcaagaccagcctggccaacatggtaaaacccggtctctactaaaaataccaaaaaaaaaaaaaaattaaccgggcgtgatggcagatgcttgtaatcctagccacttgggaggctgaggcaggagaatcgtatgaacccagaaggcagaggttgcagtgagctgagatcacaccactgcactccatcctgggtgacagaacgagactctgtctcaaaaaaaaaaaaaaaaaaaaaaaaaaagatttatgtgtaggatttactttgtaatttggggctgagaagagaaacctataaatttctttttctcttttttgatgaacatttttttatctgacattattctctttaaaaattgtgggccttcttgtttaatgttttaaattgtttttactacctcctcacatgtatagtagatatattacaatattatattgcaatatttatatatagtgggaaggcaaaataaaattgataattcaaaactgcaaaaatggtcactgctggatggactgcttgttttaggaactgttttgatgaatgtgtcatttagttgggtgatttaaaaaaatttggaggcaatgcaaccttacagtttatgttttactgggaaagaaggagcattctagcaccattgacttgtaaatgcagtttatcaatatttcataatttgcatgactttcttttacaattacctagcaacagttcttctctgcagtgttccttcaaaaaaccccgcagggacagacacagtagagtgaccaccaaaatagcagcaataacagttatgatcaatattctaaaatatgtaaaggtcccaactcagggagacattaaaacctaaatgccttctggtttccagatctgtataattaaattctgactgatgaattttcagcaatgcaatggagctagtctctcttctttaagagattagggaactagaatttggtttcatctgaaatttcattctgaaactaggtgaattttgctttcttaagaattgttagcaggtgtgacccatcattgtttgcaaaggctcctcagaaatgcctccagacaaaggaaattcctgagtctttctctgtgaaagatgaggtgccatcctaggctgggggcttccccaagtgcatgacgcagtggaggctgcagagcttaagccacgggatccagtgtacttaaggcgccttttcaactgaaaaatggggggtgtggggggagatttgtagccattttaaagtagtcttatcctcacacattatgagtattttattgtcttcacacagagaataactagctgaacagactttaggttagttggctagtagccaaaataggaaatgttttagatcctattcccctgattttcaggttctaaaatggactgactgggtggtctgtttcagacatcttcccctccccactccccccacctccaacccttcacacacaaagagttacacaggaaagaagaaaaaaagggatttcttgctggtcctcaaattcgtttgtgcctctgactcttatcccaggagagacccagaagtgcctattgaatgtaacgttccaagtaggaaagcattttaaagtgtgtatttagaatgtatctggaattgcgtaaatatatacatagatctagattctaaaaatatgaaaatatgaagcaatacaatttatgcagtatttgaattgggctcaaaaaggaaatcaaatgaggagccgtcatcaaatcacagtgcggtagaaggtgcacctggtgtttggctacagctccatctgccattgctctgttttccctgtgatctaagcctggaactagtatgacaggaccctttgacagagatatccttagaaggaccacttctaatggccacttttcatacctccccatcaattaaaaaccagcgtggtgaaagatcagaggggcgagctggggtcaggaattgggtatgagctttccttgccacaaataatagggtcacttctgcttttaaatttgaatgtgaatttgttgtttttaagcctgtacattattttttggaaggaattacctatttgtggataatattagtaaactgaatgtaatatacataatgtatttggggatttggagtcactaatccagattgattagttgcctgctagaaaaattcatgtggccacaaggatttttggcaccttttctccctgcagcttcctcattctttttctcttcttcaggttttactcagctccaggcaactcttttccccctggcattagcttgtcgttaaggaaatctagtgggatatctcaaataggggtggagggtagggggcactatttgctgcagattactctgccccatctcagttgtgcatttctatacttggttgattttaacccaaagggaaccagggagtctcatatggcttatccacaggcatcatatggtgaatatccaaaaagagaaatgtaaggatattgtggcaaggctcggcaaaataggaatagcttttcaacaatctttccacgaaggaaagtcagtgttttcttagatctctgtaggtattttacaaccagagagcttctcagcaagtagcacttgtaaactcagagatgaacaagaagaagccaaatcacagcttccgaataggtcaaattagcaaaagagacttgccattaaaagcctgacactgagcgtctgttaagggaaaatcagttgtccaagtcacttaaagacttgtacctcaattttctcataagtaatttaacagatcattcttaagaattgctggataggccgggcaggatggctcacgcctgtaatcccagcactttgggaggccaaggcaggcggatcacgaggtcaggggattgagaccatcctggctaacactgtgaaaccctgtctctacttaaaaaaaaaaaaaattagccgggtgtggttgcaggcgcctgtagtcccagctactcaggaggctgaggcaggagaatggcatgaacctgggaggcagagcttgcagtgagcagagattgcgccactgcactccagcctgggtgaccgagcgagactctgtctcaaaaaaaaaaaaaaaaatagaattgctggatatatttggactaggtattggatgtgttaagggaatacagagatagagcagacatcctgctcttgagaacctgatagtctagtaaaagggaaaagacaccatttgttcgttcattcattcaacaggtatttatcaaatacactctaagaaccaggcatgttctaggcatcacactgagcaaaacagaaaatcctactcttaatttagcttaccttcttggggaaggagacagacaatcagctgattaatacacatgtcacatgccaagtggcatcaaacattataaaagaaaataaggcaatataagggattaaagaagggaggatgtgggtactgtcttataaagggtggtaaaggaaggcctttctgatgtgttgacatttgagttaagtcctaatgaagtcaaagaagtgaattatgcagatattagggacttttattctaagaagagggaacattaaatataacagccctgagacatgctggaagaacactaagggggttggtgtggcttgaagggtacaaacaagggagagaatagttgcagatgagtagcaggaaggcaaatcatattggatcttgtaagccaaggaaaagatatggcacatccttgaaaagccatggtatactctggaagaatgcacatatgagtccattcatttcttggtacagtagatatgtcctgatcccctacactgtgatagtcactgttctagataatgagtgttcagtgggaagcaaagtagacagagtttagtgtggagttgtacacaaagacctcattcatagcattgttaaggaatgagactctgatttgtcatggcagtatcttttagtacctccaaaggttttccctcgtgcatattactaaaagccaagttacttgcatggaataatatttggtttcacatacccaattgtgtaaacaattatttctcaaaatggaggtcgaaatctgtggagtttcagcttacccctgctctcgtgaccccattagattataacccccaggtctcacatacattcaccatgaaggtggattttgttcctaaatagttgccagatgtagcacaatggtggctcacacctgtaatcccagcactttgggaggccaaggcaggtagatcacttgtggccaggagtttgagaccagcctgggcaacatggcaaaacccgtgacagagcaagactgtccccaaccccccccaaaaaaaacaagatgccaagttaaatttgagtttcagataaacagtgaataattttttagtactgcgtgaaatatacttacacaaacaaagtattcattgtttgtctagaccaagttttgtattttatctggcaaccagttgtaattctccacatattcctgtggaggttacataggcaatagtaacagcagtgtatgaaaaggtttgattagtctgtgatgatttcactgatcacaaaaggtcaaaccactggaatttaacccactgaaaatgaaatctgggaagagtactacaaagttctagtgacttggctgcttaaattccattccttccgcatctgctggtacctagcccagtagttttcttggaacaataaaccacttgtgaggcacagtcaataggtacaatataatagttgagagccactcagcccatgcaagtgagtgtataagtttaattagtcgtgtattaattgagtaagccactgcgacactgtgtgagcccatacatccagttactggcagaccatttactcacgaaagatgatgaaaataggaaatcagtcaaataatagagcatttggaattcgcacatccaaaggtgaagtagagaaatggcatttctgataaacttgaaaatagaaggggccatatttttcatgtgcaatatggaatgataaatgtatatgttttcatctgtaattgggacaactttgctaggtatgacaaatcttgtttgaacatgttaaagaaatatagtgtaacctttgaatcctcctgctttaaaaaagaatagtgttcacagattcaaggaaaacaattttggaaatagggttaaactctattaggcttaaagccagataataacaaaaataatgatttttggtgataataatcataatagtagctcacaatcattgtggactttctgtgtgccagtatgttagtttgggtcctccaagaataatatgtcctgataggacaagagatttattggggcaatacctatcaaatataaagggggacagagcaagagtagattgagagaacttttaggctgcagtacagttctgacaggtgggaaaggaggagggaagaatgagagattgggttggaagaatcccagagctctcactcccattgcctaggctggagtgcagtggtatgatcatggctcactgcagcctcaacctcccaggctcaggtgatgctcccacctcagcctaccaaatagctgagactataggcacacgccaccaagcccagctaatttactgtatttttagtagagacgagggtctcactatgttgtccaggctgggttcaaactcctgggctcaagagatccacctgcctcaacctctcaaagtgctggggtcacaggtgtgagccactgcgcctggagtaagcttctaagaaaattttgaccatgccaatggagagtccctgagcttaagtcccctgttggaagaattctgtgttttataggaatgggtctgtgttggtatcctccccctcagttattggctggaaacagcctggaggaagtgtggcctttaagcaaatgtggtggtggattcagaggagcagccctgttaggcaaccatgttccttgcaacaggtggtcagggtggaccatttttattcatggccaccagagccatgcactgtgctgagttctatattcatgatcttatatcatcttaatataatcctatggaggtaggtgctattagtgtgcccattttacagattaggaaactgagacacaaagaatttaagtagcttgtcctacagtcaagaaggcataaagggtattcagactcaactctaagtccagagtcttaactgcttaaccatggcattctattagagaaagaatggaattcaaactctggttctataatgtattgattgtataaatttgaacaagttatttaaactcttaaacttttattttctaatgtataaggtgcgatgtcatcaccttcccaggaaatgtgttttcgttgctgttttgttctgagcacaaacaacgttagttccttttccttcctcttgttttgctctcatctaggattgtcatctcttcctttatttcttatctcatcttcccaggtatctgcctcagccttgttcaggcacccacaggcttaactacatcctcagaactaacaggactgtttctgtgtggattatatgtctggatgtagatatgtggaaagtgctgagcacttgcaacaatccataaatagatactcaataaaatgtagctcgccttctctctcatccacctcattgcctcatagacatgaactaggtgccagggacatcttctttttaagtttcttttttttttttttttgacaaaatatacatctttatagaaaaattacattcttatttttttatgaacactttgttctttttttctacagtctcaagtattatgagtatatggtactttaatagatatttttaaacaatggactgagttttcatttgatttttctgctggaggtggagactataaaatgaggttagttgcaaggtatttataccagatgccattatgtttgttagatggcataaaacaattatgattgccaataaatttaaaagtgtttccgttgcaaaagatttaggagtatagttttactgaaaacataaaatgtttcttttcattccccattttttgtgcagtacaatagaaatttgtgccccattcctttcattttagatttctgaattatttaaaagaattggttaattctccatttcaagtgagcaagacaaagttcattaggatatctgattcctagcaggtcccacattcacagatcatgttaactccatagagaggtttatcttcttttaaaattacaaatgctacccacactgaaagcttttcagtttaatgcattgttacagctttgaactcttcagtaggatcctaaacaatagaaagaaggaaaatgaagcaccttgttgtccgagcttgagccagttctaaaagtagcagtgcagaacgtctatgtcctttcaattctagtggatttgcaacacaatatcatgaaaggcatgcaagtaaaccttagcacgtgctccaccagtagttaccaactggtggtccttgaagggagccagaggaaaaatcttaaattatgcattttttccccttatataaagctgcactggctgaagatttttgcttttgactttatgcttgtgaactcatgggttctcttatacttacagagactctggcagttatagtttggattcatttaatgaaaggtaggggaatgatgaattatctattatttagcaaagatggtaaattaaatactttgagaagctggccttatgagaggaaatgattacaagttgtccttaatggtaagaagatacagaagcctgtgctgtagaccactggttaatagcctttaactttatcttaggaaagacgaagaaagaagagaaaagcaggtgctaggaatagccagtcaagactggttgttgcaggtgctgcccgtcatctccattgtacccctttccggtgttctttcagcagatattgttgaattcagttctatctgagcagaattgatagtgaggccgatgtggaaagcaactcagagtaggagactcaggtggtacttctgtatgtaaattgactaggaaagcataactttgaaacaaaagattctaacaaagtttcatagcccaatcacatgtaagtgtgtagaacatttgagttttggactctgatctctgtggatttttttctgtgcattcataagagaggcacaaaaattgactgtggtcaaataatactatgtactgtaaactttagattgtttgaatatgttaatttgatgtaataattctaagatatagaggacaaggaaactgaggcttggaagttgaggcacatgttcatgatcaatagcaagtgagtgcctgcttcatctttcttgggagagctttgagaataaacagggataacggatagtggtgtgctttgaaatgttttgtactcagcagctataatctcaaataatttgtattgttaggttttcaatgtattgactattctgtccccttaccccagggaaagtatagacttgaggtcagggaataacaatggcatatgacatgtaagtatggtgacataatgtcatatgatatactacataatatatgtattatagtgttacatgcattatgtattacattattgagtaaatatgtattatattacaatgtgtaatctgtagtccttataatctattaggactttgactgaacaccagtcaatgaaaatagtaaatgtcacagtatactgaaagcgaagccagtgagagagagtctgcagaattccacattttcctcaggatacctcgcagaccatgggtgacacatgaccacctgacattggtaccaagtgagggagaatgcattattagaaataaacttatcgtttttcaaagacgacttatttttaaaagctacagtataaatggaagctccagtgatttctttggacaccgcaaatttgtgttttaaggagaccactattctagactatgtgctccctgagggcagaaagtagtgtattatattccaaacaaaatggcactcagtaaatattttagggtgaatgaatgaatgggtaaatgaatgaatcttgtgttcaggagtttaagtcttttcaggggaaaataatacataatcataagttattcccctccttccaattgatctttcttaattgtacatatatttattaatatataatccctgtgccaggcagtgggcatatccacataaaagagaaaccaaccccatactccttgagtacatattctagcaaaggatacagatatttaggcagatagttgcataaaatgtgattgtgatctcctaaagttatttggatggtgtttggggcatatggtggaggcacaagtgataaaggctatgcaagaagcaacaaaagtaaagttagaagtgttcagagaagagcttgttaggtatttgacctaaatgctgaagtgtatacatgttcctagatgttacttagagctttcttgctccttaaaattagctcaaaccccccattccacaacctgaggaaatctaaagcctatcccagtatttctgtgcatttctggggatgcttacagcaaaagttttcttctagctgtcagttcctgcacctgctgagttagtttactttatagatcttcccccaagtcgtgcaatgctcttttccatgtcctgtgcccgtatgttgggttgagcaccttctctgtatttctgtctgatctacctgtagaaattatgtgtacagctggctttggtgaagttgtaggagggcgagtttgggcacttcagtaaagtctcagaacatactaaccgcatcacattgattttaaacaactctgtttttaagagcacttaggtcactctgccatgttaccattgccctctcttcctccctccctctcttctctgagcctctccttgttcttctttagttttccttgagccttgcaaatttatgttcttgggaatctcctttgtaaataagaaatgtgccatcaagatatttcccaatcaatggattctggcactcttgacaaaatgatagatggaatttgcagtttctgtgtgtatgagagggaagatgcaaagtccttgttaaacaaaaggaacattatgggtaaaggcctaggggcagaaaggacccagcatgtaaagctgcagcttggctaagacatagtgtttctgaacagtttcaaatacgccagtcatatcatgttgaattcttggatggccagtcacccagcgtgtttcccttggaatgaagcttgctgactgactggctgacagctagaaagcatccataaatgagagatggagatgaaattaaaatgtgacttctttggcatccacctttcgaacctaggccttccccactttactctaattcaatttagtagatgttggatggaaactaatacagttaaaaagaacttcatgtaatctcactaacattcttagaacatgatgctcaaggttttctggtcaaggatatttgcatttgcatttatagaatagttaagagccagaattctatgcatgtgagaagtccttgctttgagaatgacatttccaagctgtcaaaatctaatgtgctcaaagctcaaaccaaaattgctttttattctgtaaatattgaagagaaggcttagagtggcaccagtgaagttgctagccagggtactagcctactgagttggaatcagaaaaagtccatttgttgagtttaaattataatacaatccaagcctgagggatgcagtgaaaaagtatgaccagtggtcagattcccacattttcctgctgaccacttggtcactttgacacagtttactagagaagtttgatttgcaggtgtgtaagcacagtacatgcatctttgttacttgactcttctcatctccaatttcttaatgcttacattgaactacaaaaatcttcacatgaaatcttcccatattatattcactcattcaaccaatatttatttattaaacatctgctgtatggcagatactgctccaggcattagtcacaagagtgatgaagcacagaaaagtaaagtttcatgcatccaatagcagattcattgtagaactgagagccttgatgttcggttccttgtccagctttctttctcctacatttctactctgcttttcttacacttgctgtttcaccaaaaaaaaagttacttgaaaggcgattgaaatcattcttttcatttgccaataagttgtaaaggttattggaaagtcatttgtgtaggattttgaatcagtttaacacagttttcatattacatttatgtgtgtgattttctgaataatgcctttaaaggcagacattaagtggattgcgaactccatgaaagcaaggattgtttttcttttttactcactgttttctctttagcacagtgcctatcccatagtacatgttcaataaatatttactataaatgcagaactaaatgcatttcttatgcttcgctatatccctgttgtctggtgcagtgtgtgcagtgtgagctctctctgagtctgtcgctggtaagatggtgaacagtgctgtccgtattcagtggacttctgtatagagcatgtcattcccagtctatctcgatattcagtactcgatattcagtacttaagtgtccagtcaagcagcttgtagttttccttgctatgttggggtgggtactctggtacctggaggccccctggctgcagacacagcaagatggtttcgagcagggtgtgaaatgtttgctgccagtgagggagaaaggtttgccttggctaggagtagcaggatttcaggctccacatctgggtcttccgtctacgtcaccaccaccatcctcatatgcgcatagccatcagctgtcctaagtgcagcactctgacagaaaattgtatacgaggcagaggtggctgtaactagtcaaagtgtgagagaaatactcattccatggcaaagctgactgacatgaagagatctttgtgctgagagagattcagcaaagggaggccagagtaaactaggagtgggctccgggttagagttgaagcaagaacctgtatgaaaagaaaggcaatgtccacctcatatttcctagcagacataaaagacatggtgtctctcttgctcagtctttttcatcatcttactgggttcagaacatgggtaaagttcgaagtggtacattggataattctttcgggcagaactttgttgaaaggaagagtgtggtcgtctaattggagcttggcaagtgcaagggtgggagagaaagggagaccctaccttgactccaccgctcacctggctgtgaaacgctttaagaacagaaacacttactaattgtaactggccttaggaaggtacctgacctcccgtgcctcagtttcctcgtctgtaaaatagtcacgaatgcttcttgcccttctttgctcccaaggatttagtaaggatttaatgatatgatgtatctgaaagcactttatgaacaatcaagccatatgtaaaatgagctattgtaataattttgagtcattaggaattccttcatttccatcccaggtcccctggacaatgctgagaaaccagtggctatattgcatattttcttttcagcccagcagtactcattttcaggttgaatatggtaacaaagctgttgcataagaaatgcacactcctctcttagggggaacattctttacattcagcacaccagtgcacccccatgactgcagagtactgcagggtactgaaaggtgtctttctgtgtttaccgtggtatcactttcaccctctattctgaactgatctggcattctaagattttcaaacataatctttaaaagtataagcatccaaaattacctcaaagagccaaaacaaataaatacaacactgaataaatgatgctccagttgatccagaatacacttaagaaatcttttgactctgttaacctatcagtatttgacttcagattgactcgtttatttattcttaaactcccttgaatctccaggcttttttcttatttgcattgagtatgttctccccattgacattcagatcactttgaattggcttttacttaggcttttcttttttggagacaatcagctcagagacaaaataggcttaaaccacaaagatgttttagtaaatagatacatttcattagttgctgagggctgtaggaacacagttgtcccaagtaatttcttctttgtatttggtgatcttaagaggaaatattagtgtcctttttcttaagccactggtctaaaatatctgtcaagcataagatttaaatccctgacaaacaacttctaagattttagaaaaagttttgagtaccttgtgattccaactcttatctctgcttttgagcctcgatttctaccccctcgtcatagtccttacccacctgtaactttaagacatcaaagttcattttaaaaaagaaaaaaataataagtttcatagaaagaaaacctctcatatatattgggagggctaagacaaatatgtttctcttttcatgcatttttctggttgaactgaattctttcacctcctcttagaaaagtcttcgactgtgccagctagaagtacggcagaatgggtaaagtccagccttgctaagacaatttttttggtctgtggtacctacagaggaggttcttacttataatgtgaagtacatggcataaactggtggagaagagcttccttttgttaaatcgttcatttattccactggcctaatgaaagttatatgaaccacaatgagtcacaacaattaccagtttaattcattttttaccctgtatttatttaaaaggtttgctctataaatataggacctgtagataaaaggtttctctaaaaatcactctcttttcaagatgttttcattagttagtattcatttaagtgggttctactctgcataccattaaaggtgtgtgtaaatgtttttattggtttcttccctatcttccacttttgtatttcctctataagaggcagtgccattaaccttagcagggctgagtgtgattgtctttcgatcagccccatcattgcaaaccactgacccatagcttacattacttaaaccactggttcctaaacagaaaaatagccccattaccttccttggaatggtgatgggctgtctgaaaagtcctttcaaaaagaagagtgagcaaaaatactccctacttcctttgagaatagtcctttctttgatataaatgttgcggtagtagtacctgagtttcctattttaactctacatgaaacatttattgagtgtctgctgtgttcagggtgctgttgaagacacatggctatagcaacatgttttggatgcagtcctttaagagccatacttttttatgcaggtgataggcaggtttgcacctaataacaatgcagggtaaatatgctaagtgctctaactgtgaaacaaagtgctctgagaatgtggaaaagagaatgctttaattcagactttagggacaggaagcggaaagttagatttcaaccagcagagaagggtaaggaggatagagaaagaggttccaaaaaaataaaaaagcacccccaaaggcatagtgtggtctgaaagtttatgatgagcttggataatcgccaagtagtgtggtatggcctttgcaaggtaatgaggggatggaggtaaggcattcatgcttttgtataactgatacggtttggctctgtgtccccacccaaatctcatctcgaattgtaatccccacatgtcgagggaggagggagctgtaattcccatgtgtcaagggagggaagtgattggattatgggggcagtttcccccacgttgttcccataatagtgagtgaattctcaagagatctgatggttttataaatggtattttcctgtgctcacacacgctctctcttgcctgccaccgtgtaagatgtgtctgcttccccttcaaccaggattgtaagtttcctgaggcctccccagccatgcagaactgtgactcaagtatacctctttttttaaaaaaataaataaaataagttacccagttcttggtggtattctctatagcagtgtgaaaatggactaacgtactacccttttagataatccttgcagcataagacaaagaaacgatcagttcacctttggccatggactcactgtcaccagagcttgctttaacccaattctgtagttcagccagtcagaatgttggtagaaaatgcattaaatcaggaacccagaaaacaggcttctattcctggctcagctattcattgactatgattttggataaataactgtttctctctgagccttggtttacttccgtaaattggagataataatactacctacctcatggctgttgagagtcttaaatgagaccatgcctacaaggtgtttagcagggtcctcagcatatagccagtactcaaaaagtagaaacaacttaaaaagatttttatacttcattgcccatcttcattgaactggactttattttacttattgataacttacaacacgctgggagaaacgtcccggtgtttcaaagtgactgcgttaacttggaaaataagatcctatttatttccttccgagtaatagtcatcctaacatactgctcacttgtgtttgtagagtagttattttgaaatttttgagacctgaacttatgaaatgtactttcatgcatttctaaaataattgtatactagagctcttttccattgcttgacagttgttcatgagtgttccagtgagtttatagaagctaaaaagaagatgatcttctctagttacattctaagtgctgaatttttccttccttgacagattcccatccggtatcaagaggctctaaagatccctcaaatcactgttggcatttagtgccattccagcaattttgcatcttgatctttttattgattagaattttaccttccttttcaatcttttgaactctcttctgaactttgaagactcaagtgtttgaaatcttgatctgggtctgtcttaggctatacagaagagagctttaacttatgtttccaaaatgaggccactacctctttaatttttctttttaatttaatctcaatgtctgtagaagaaaagctttcacttaaagcacaaactttatgaaaagcatttttgttaaagggaaatcttaatgggaagaactgtagataacaaatttgaggaaaatgtctggcaacacagacttctgcaagtttgaggctcttggtgaaatctcaaacagtccaaatggaaaattacccagtctgtttcctcaagatagacttgtttgtacagcgactcaaagtttaaatggctgaacagtaggtacacacgctgtacttataagctgtttgtattacaatgctctgtttttaacctccttttagtttggaacacaagctggttaatgtcttagttctgtgcttcctggattattagtgaatagctaagttgtatttaataaacagaaagaaagtaacaaacaggccaataccttcactgagaaagcttctcatctctgagatttttacttctgtttgttatgcagaatattttaaaattagataatgttttatactcatgagatgaaagagttttcaaatatctgagggtttgtgagtatatccgtatttttgagagtcccagtaaaagtttctggaacttacaaaaaactcatccatgagctggccaggtcctctcaaggagcaaatcaactgaggatgacattaaaaaaaatttttttaacttgtttcaacagttgttttccgcatttccacagtaattaccatgcttaccagtaagatacaattcatctctggatcatattttatgtgttttaggcaatagcagtgatagctaacaattacactctagagttttacaaaacacttgcttatgcgttatctcatgaggtacctgacagatcttctaagtataattttatgatattccagcagatctataccagtttcactagagtatgagtaataagcatattgaatttttaaaaattgacacctgtctgaaatttttaagaacaaggccatttagaaaattagatttcaagaactctaaatacttacttatattatacaaaaatgttacagaaagtaccattaagcatggctatttctatatattcttcgatagcccacagaaatttatttaaaataattctccacaatgactaatccattacaaccaatattgttttagttctttctcatgaaaatagactactaaaattatagtctttctagttacccagtatacatatacacatatatatatgtatgtatgtatatatacacacacataccatatgtaagctggctatatatgtgtatatatatgtatatacacacacacccatatgtaagctcgatatgtatgtatgtgtttatatatgtacctatacacatagaggtacatacacatgtataaacctccatttttataaagattggtggcttataagaatacatacagtaagatagaaaatataaacaagtaaaaaatgagaattaggaaatacataaattaaagtagaaaggtaaaaatcagagaaaaagaattgaacaaaggttctaccatatggttctacatagttaataacattgagatataagtttgattctgagtttcctggcagccaaaggaaaaagagaaacgtatgattaatcatgtggttctcattacccatgagaaaatacataccagttcctcaagggaaggaagctttccctggcacttaattgtgatgtaaatttctcacgtagaacttcagcaggaggacaccgggtgatatgctaacagtcagtgctattcaagtagatagactaaaggatttggtaagatagcttcttttagggcccactaactagaaactgagaacctaatacaaaagtgtaactcaataaaagtgattctgagtgatccatgaaagtaacttgctgccaatccatcaggacttttataagagctggagaaattcacatcatgaaatttataaatcctgagaagcaggtaggtctcatagtccttggatgattttaaatatttctcacagccaaacttttgattaaagctgagccacagacagttcccattggtgttttttaagaactgatattttcttaaggactcgactttacagagtaaacaaacaggattggccttacaaggtaaaaactgaagctcctgaatataggaaaagcaagcatttacccttgtggttattttttaaagtgctttttaaaaattcctctcattatcttcccttgatagatttcctgaagatttatttaacagtataatgtctattgttatttaaagagaaatgaggtttagaatgcagagccttttttaagagagtatgaacatgctgatttagttcacctccaaacagaaatgattgacatcagattcttcctgaaagcagtttctcctgtggaaagaactttgggttcttcaaggggagtgaaatggtaggttctgtctgagccaggtcacctacaaaagcaaacaacaatgctgtttcctaaggtggttgttggcagcacttagccgctgctgacctggtaacctttcctttgagtctcatccatagctctcctctgagagagaactttcccatttacaatattacttggacacactactgttgcttaggaccaaaagggttatttacacaggggagatagtggtaggtgtgaaggtatgtgttgtgacaactgccatttacccatgcagtgggcagagtttctcttttgaccttgttcattcatagcagtgaagtgtgggctaggacctgtaacatctcctagttttaaatgctccggatgggtactctacaaaagtcttggtcatatagaacctatatggaatgcagtcatgttaagaaattgttaagctgttgatcatgatattatactgttaaacataacagtacaaaaagagggttttgttctccaaatagctaattcatagctacagttatttttttagtgtacaacctcagatttatttcatcagagagcaactgggaggtcccaggacagtgactaagtgggaatatgcagcaatgacgagtaaaagcttagtttctaagaatctcagtttttgtggaaatcccctttagactaatgatacaagagaaaacatgtggtgtgtgttgggtagatcattccccaacaggatgttttattttttgtgtttagtcttcgtccatagtaacaattataatgaatgcatcaaaaataaagcctgcagaccttgtgacctatcttgtaatcagcacaaattagttttagggcaggaaaatccagctgcatattagttttattagatgttcccaaacattttattgcaatattttggaaaaaacatccacaaacaaacctaagttttcaatgtgtttcctattcaatatgtattttgttttgaaggataattagattgtatgtttataattcctttgttcttaattcatcaaattgctgccttttgggaaaataatttcagcataggaaaattactctttttttcaccaacctgttctcagaaagggaaatgtatctttagtacacccccaactcccaaaaatgttctccacattctaaaaatgcttttaaaagttcaaaccattattcctcatttggttctaatgatattgaaatggttttttcctattttgagggtcacaattgctactgttaatctaatggctaaatgatctgtgcactgtgtctgcttttcatcttcattctctttttattggtgaggaaactgaggctcaaagcgattaagtaccttgcacaggtcaaatggcttctaagaggcagaatgtaatcattccttctctcaacattcaggaaatatttaatgagcccatactttattccagataccttggtagttgcacaggatacatcactgaataataaaatccctgcccctcaaggagcttaccttctagttgatggagacagataattaaaatatcaatgagaaaagtatctagtgcatgagatgataataagtgctatggagaaaaattaagaaagaaagaggaatagggagtccagagtagttttggtttgaaaggcaatgatggccacaaacacattgctaagaagttgacatttgaacaagacctagaaaaggtgagggagtgcgacacacagatttccttggggaagactagtgtggatggaatgaagacagcaaggtgagcaggagaaaaggaactcaggtaaaagcctggggcagttcatgcaggacagtggctgtttgacttcagcagcataagaatcacttggaagtcttattaaaacacagatctctgggcactacccttacagtttctgattcagaagtttgcattcctaacaagggtccaagtgatgccagtgccactggtccagggatcacacttgagatccactgaagctattgggaggctttggcttttcctcttaataacatgaatgccatttccaggaactgagaataggagaaacaaaatctctttatgctgttccgagtacactgtaggagacaagggcagaagaagggaaaccaactagggttctactatagtaatcaaaataagagatcagggtgacattggccgggcgcggtggctcacgcctgtaaacccagcactttaggaggccaaggtgggccagatcacttgaggccggaagttcgagaccagcctggccaacatgatgaaaccccgtgtctactgaaaatagaaaaattagctgggcatggtggcacgtgcctgtaatcccagctactcaggaggctgaggtgagagaattgcttaaacctgagaggtggaggttgcagtgagccaagatcacgccactgcactccagcctgggcaacagagcgagactccatctaaaaaagaaaaagagagagagagagagatcagggtgacatcattgagctatgctctctctccattctgagtttatttgaggttgtcctctaaagcaaaagcatactaagcattagttatgtcaacctaaaattcctttggttaaatcttcagtttaattagtgtatgaattccttttcaaagagctgcttgcccacaactttgagaaacgggtggaaaatatggggagtttatagttgggatacgtttcaaatatggctgacaaggatctgcctaggaacatggaactcatagaatatcctcaggaggcagtggggaacaggacactgagatggtccatggaagagaaacaacagttgttcttcaaattcctgccatttgatctaagatctgatttttttttttgtaggattgaagagatgaaagttcccctggtcccccaaaattttgtttatagtacatacaaatgctccctgagatacccagctgtatgaggaataaataaggaaagagaacaataacgtggcaccaccttttcctccttcctgatgtacaaaatgagggaaagtcataaacctccaattaataactgtgcaaccttgctcaagtctcttaatctcatctgaaaacaggaatagtaatagtgcttgtctcatagcaggggttaagggagggtactcatcaaatgttagctgcaactatcatgatcacaatgaaatgtaagtagatttctattctcttttcaagatggagacttactggtccctaaccaaaattcttactgtatacaaaaatagtgtagtataaagtaagtcaggggcaaaggagaaaacggtggaaatgcggtgggcatgggagtgtgaaaagcagtaaccccttaaaaggagagagaaggaaaagaagtcaggtagaaaatggagatatggtagggagcaggaatgattgatattaaggtagccagaggcaaatacaaaggggaaggaggggatgggaaggggtggcagaagagaaaaggaccagagttcctagaacctgttagcagggcagaggttaaccataagcaactcattaccatgccccccaaagcatcaggccagaacctccgttaaacacaagacggccattggctgcacctgcagaagtctctgcattttttatgaacagcagaaaacaagagaagtattagagaggttgcaagttagagactggagacacctggagactctacatagctgtggtggttttgcagtgtagacttatgaaatctgatacccccatgcagtcctgttaggcagataaactgagagcctagacattttataagcccccatgtaagcatttgaggggtaggattccttcaatgctcttccaataggatggaaacagaagggaagaccatcctgtcttcagggcttgccctcttgtttaatcctcagatggacaacattagtcccgtttaacagaagaagactctgaggcttggttagtaaaagaatatggccagaatccagacctggagcctagctccaaaggattgctttcctgttagcaagacactgtcttcttttgattttttttttttttttttttctgagacagagtctcactctgtcgcccaggccgaagtgcagtggtgtgatcttggctcagtacaagctccatctcccgagttcacaccattctcctgcatcagcctcccgagtagctgggactacaggcacacaccaccacgcccggctaatttttgttgtattttttattagagacagagtttcaccgtgttagccaggatggtctcaatctcctgacctcgtgatccgcccgccttggcctcccaaagtgctgggattacaggcgtgagccaccgcacccagccttcttttgattgttttcggagacttgtactcagcctttttgcttctctcacttctctggttctctacctgcctaccttttagccatttcacctatcatcctggagacccagattttgttctttttttttttttttttttttttttaagacagagtctcactctgtcatccaggctggagtgcagtgaagccatctctgctcacgcaacctccccctcctgggttcaagcgattcttgtgcctcagcctcccaagtagctgggactacaggcgcacaccaccatgcctggctaattttggtatttttagtagagacaaagttttgccacgttggccaggctagtctcgaactcctgacctcagatgatccaccaccttggcctcccaaagtgctgctagattttgttctcaaatagcagctgtaggatttggtgtggtattttttcccctcagctgttgtttcttgaatgctttctcttgttcacccacttcttctttaccacttaccatgattaataacaaggtacctgcaaagtaaggttttcccctgaatacttcctagatggtggaggtttttcagaagtaccacccaacctcaaaaacacatagtggtccacatactggccttggagtcctggaggagttattctataggaacagcaaatccatgcacagccaggcattgtctgtcttgacatatcagggtacggaaaactcttatgctgtaagaagagtcacactaagccaaagtttaggaaccagcctgctccagtatgccttttggaggacttttcttttctaattcaccttgccttcctctgtcacatctaacccaatactgtccatataggaaaaattcagaaagtattgggttggtgaatgcagcacagattacctatttaaattaaagctgtgtctttagggaaaaaaacttctgggggatgggagcagtggcatgagcttggaaggatttttgcattctacagcaaaccacagctgctatggccttaatgtttgtgtccccccaaaattcatatgttgaaatcctgactccatggtgatggtattcagaagtggggccttttgggagactaggtcatgaggctagaaccctcttgaatggaactagtgctcttataaagagaacacagagagctagctagcccttctgccacgtgaggatgtggacggtgtgatctatgaggaagagtgctcccactgggtaataaatccgttggtgccttgatcttgcactttctagcccccagaagtgtgagaaatagatttctgttgtttataagctactttgtttatggtgtttcgttacagcagcccaaaaggactaagagaacaccaccacccaacaccagaaaatgggatttgcttaaaccaatctgagaatcagtcacctggataagtgtgtcgagtgatccattgaatcagccagcaatgcataaagaatcatttccagtacccacatatgactgtgcttctgttttgtgttttattaagttgctctggagtaatgccactatcagtgcttccccagcacaaggaggttggcaattgagttacctgtttgtgacagctaaactttcatgaatctttaggagatccatttgctagcatcttttaaagactctggatttttctgagcattttgtgatgataactgatgcatctgaagtagaggtgggagcccttctttgtcaagagttagaaaatacaggctgtcttgtcttcctataaatgtcagttgttgttgttgttattattattgtgtcagcagtaaactgctccccagaggactaagatacagcattacagagagagcatgccttgctgtgaaaatgggtagtagaagtatgatgatattatttcgtggtaatgaatttacctttatgacagatcattatccccttctgtagctgaactggatgaaggacaagtctagcagaataacctggtagtacttggatttattggctttaaatttttaagctggaaaaatgcagtagcagccaggttatctctgtatgaatgttgcagaggaggacagagatgaaggaagtcacattttctttctagtaatggtagaaagcaggtgatgatgacagtcttttaacgaaacatgaatgcagttgctcatatgctttgccattttagtgcacaagtcaaggagtaaatgagtagaaaaaaatccataagatatcatcatcatcaataataaaaaattgcttaaggtctcattgagtgttacaccataggaaagagcaaagatttctttttaaaatgagttagacgagacttccctctcaggtgtgtataatccaggttcatgctttaaaggctatatgtgaaatagaactgttttatattagtgagctgttggggatagtaagttgcagttttgcataaaggcaaaccatggtacagtgaggatggtgcccctgtgggaagaagatgggcttggaaatcatttaggtttacatcctggctttgtccttttctagtagtgtgacctcaagcaaatcatttaaactttctgtcttagttttctcaggaagcaaagaagttagtacctaactttcagatttctttgcagctttagtttcaggtacatagtaagtcttcaataaatgatcactattgctgttcctgctgttgttattgctgttcttgtcttgattcagaagccctggtggtgatactccatgctatattccaaggagtaaccataacctaattattttgaatgactgagaaccagtgctgatgtaaagctccctaaacccagcacttctccagaagccgtaagaaatccatgccatcatttagtaacctacactgtagggctaagatctcaatccgttttccatttgcacactcatcagagtagatagagactagttgttcactatgtctgtgaatactctatagagttttccccagcttcctcctttcctccaattttccttacaaagcctttccttctttcgtctgagctctaacactttgtacgttgtagtaattttatggagcccagtgccaaacatctctatagaggggatgttgtaagggttgaatatgaagagaccctacatgtgacgtgtgtcctacgaatcttggagtcttgactccttctccagtgtcagtactcgttatctttaatttggggccagatatgagcaccccacacactttccaaaaaagcccccgatccacaaatgtatgcatgatttttccttacataagtcttttcatgtttctggacatattttatctcccttcctcctctaatactttttcccttgctttccacagtgagaaaaacaacaacaacaaaaaaaaaaacacaaaattcacacaaaggcttatgtatataaagacatggctccaggttctcatcagttcaaggagtaaaagcaaattccaaaagtatagaaatttaggtggatgtggccgggcgcagtggctaacgcctataatcccagcactctgggaggccagggtgggtggatcacgaggtcagaagtttgagagcagcctgaccaacacagtgaaaccccgtctctactaaaaatacaaaaattagctgggtgtggtggcatgcacctgtagtcccagctacttgggaggctgaggcaggagaattgcttgaacccaggaggcggaggttgcagtgagccgagattgcaccactgcactccagcctgggtgacagagtgaaacgccgtctccagaaataaataaatttaggtgaatgttaccttctccctttaattttctattttatagaatggttgcatgcaataaaagcagttgcttctcttttaactttttaataaaatggaagtctgtttttaaagccatttgctttgaatatgtaagaatacctagagtgttttaccatggtagagataatttacaaagtaagacccagttggagttgctcagttaagatgtatctcaggtgaaatgttaatcaattcaatgtttctttgtgttttgaaaatctctttagtgtgctgggccgatggccacattttctgctgtgtatatgtgatatcaaactttaacaagtctgttgcaacaaggataagacacagcagtaggaaaagaccactggagataaaggggctcaactctcttcccagtgagaactgccatgttatcttccatctgatcacattactggaagcttactactcttcaggaactcttcagcactttacccaagctccagtgaggaggcgatgctggtgcttatggggtacttggacaagtagaggctctccctcgcttgtcaaaatgcctggggaggaagcaccttctgccatttagtgtatggggggaaaaggaagagggcagtgagggatcttaaatgtctcgtaatgctctggatagacctgcctaagaaagaattaactttccccaaatgccagtcacgtcccagttaagaaaggcctgcctggttcttcagcctcatcagtgttcccagaagtcccagctccagccatcacaaaccaaacgtgccacttgccttctttcttttctcttttcctttcttcctccttcccctcccctctcatcccctcctcctgcttctccctcttttccttccttccttccttccttccttccttcctctgaatttcctgtatatcctctctgagaggccttacttagatgccacttgctctgcgcttttgttgcccctggcacacatgtgactccacctgggtggtgagcccactgtgtgctctttccactcttactcacctgtgcaagctcctgatgggcaggtcccagtctttatctctgtatccccagtactgacacagtcctggaacatagtaggcccttggtgtgttttagggaaatgaactaatgaatagtaggtatttagttagtattgcatcgcgttttctgaaagtaattttaaaaaaacacatactgtaggccaggtgcagtggctcacgcctataatcccaacactttgggaggccaaggcaggcagatcagctgaggtcggaagttcgagaccagcctgaccaacatggagaaaccccatctctactaaaaatacaaaattatccgggtttggtggcacatgcctatagtcccagctactcgagaggctgaggcaggagaatcgcttgaacccgggaggtggaggttgcggtgagccgagatcgcgacattgcactccagcctgggcaacaaaagtgaaactccgtctcaaaaaaacaaaaaacaaacaaaaaaaacatactgtagggagttcagtaaaaataaggtcaaggtttctcagcctcagcaccattgacattttgggcaggatactttggtgttctgtcacgtgcattgtcctatgtgtgggtcactgtcctgtgcgttgtaggatgttagcagcacccatggcctctactcaccaaatggcaggagcattccccagtagtaacaaccagaaatgtatccagacattgccaaatgtcacctgggggcaaatcaccccaactgacaatcatcaaattaagataaaagaagaactaacatattgaattccatttaataaacaaaatttctatatgttgtggcaccaataattcactaatccatttagtaaacacattatggaatgatcttcaaattaatgggctgtatagtcttaaccgttaatgtttgagtattctgtaagctcttaagaatttcagtattataaaataatccacccaccctttggaggcttgaagcacctccaccagtggtgaagagccctttggaatcacctttgcagtcataggctcctagaaataacatcaggagtattaggaaatggtgcccattgcattcctctcccgtggcctttactgggaactgtgctggagactgtgttatttcatcggggttggctgccaccaaagtgtggggagccatatgttagctattctgtgcagtaacacctgcactctatatcacaggcaagcttatatgcctgtaatgataagcctgcctatgtagacttgtgagtgcacagttgcagcacagttggcctgctctttgggtgtgggaagtagagttcatggaggtaaaccattgccaagcaagagatttgtactctccctcatgttttgtccatgtgaaacctttgtaagtgcagtgtccacatgcccaaggggccctcaggtaaaaacacagataacaacattgctccagggtttttctttattagaattctgtattgtctaacatgattggtaaaaccaggtgagctcctaaattgtggtttttagtgacattctataattcactgctgaccttctccccaatgttgtgacttggaaaaaaattcaaattaagacttttttttttttttgagacaggattagacaacgtggtcacccaggctggagtgaagtggcacgatcatggctcactgcagcctcaacttcccaggctcaggtgatccttctgagtagctgggactacaggtgcatgccaccatgcctagctaattgtttgtattttttatttttttattttttagagatggggtttgttatattgctcaggctggtctcaaactcctgggctcaagtgatcctcctgcctcagccttccaaagtgctgggattacaggtgtgagccaccatgcccaacttcaaattaggacttctttacaataagggttattctattcagaatctcattagatgttaaaaaaaaatcaaaccaaaacaaaaaaatactttttagtaattctgtcccacaccttttacttttaatttatattacttttaatttgttctttcccaccttttactattaatttggtgtcgctttatccttgcacatatgaacagaaatatagtaaattaagtagtaggcaaagataggccaagtcaaggatagtagtagggcaaggatagagcccagagggaagaagtagaggggaagtgtgttagcggtgacaaattgtattcagagagaatggcttcagtggtattgataaggaagaaacaaccttcccaccaggttgtttgatgaaccacactattagaccattcttgctttgctataaaggaatatctgaggctgggtaatttataaagaaaaaaggtttaattggctcactggtctgtgggctgtgcagggagcatgctgcaggcatctgctgggcttctgggaaggcctcagggagctttcactcatggcagagggtgacgcaggagcagacaggtcacatggcaggagcgggagcaagaaagagaaggggttggggaggtgacacacactttacaaccagatcttgcaagaactcactatcctgaggacaacaccaagaatatggcactgtttcattcatgagaaatctgcccccatgattcaatcacctcccaccaggccacacttccaatattggggattacagttcaacatgagatttagagggagcaacatccacactctatcagacactttccctggactgtaaagctggagttttggtttgggtaaaatctactgagtccatcatttggtgagaaaaaaaaatctatggtacttagatgtgcacatcaggaatttgtatgtacacattgattacaataatggttataatccatcatcatcttccaaacctgttctaagtgcttccgcctctggagtaggtgttcttactcgtgcaattagggaacagtgccttagttaattacattgcttcagttgaaatcccgactctaccagttactgtctgtgtgaccttagactgtgctttatctgtaaaatgaaattataatatgtaatagcacctacctcataacactttgaaaattacaggaaataacacatggcaaagctgaggagaatatctggcatgcagtgagcactcagtaaatattagctcgtatcactttattgttattgttattcttacaaccacaaaaaaactgtgtcactttcctgcacttcacgtcactaatcctgctggtctttgatgacttgtataggccatcactgcttccacaaagccttccctagccctttcactagtttaatgcccccctctgtgccctcagagcctgcttccactaccagagcccttaccacattgtattgtaatgcttcctctgttggcctgcctcccctactggactgcaaggacctgaaggtcaaagaggtacactctaatgcctaccatagtacctgaagcagagaagatattcaacaaaggtttcttgggtaaattattgaaagtttaattaacttgcttaaggtcacaaagctagtaattgagtgaaacccatgtctgacttataaaagtaaataataagctataagaaaaatattcctctaataatgataatgcactaaattatgattccacctgattattacttacagaatactctcaaaattacttgaaaccttccaaattttggctctatcatctcttcaaacctctgtctgacaatggtactcactttatactctgcctccaacatatacacttgacttcctatccatagggttatccttgttgccccccataaatttgacttgcactttcatctcctctcaagcagtcatcagtatttattgaggcctacattgcagcgacctgtgatgctctaaggatacagaaatgatatcagaaggtggtgacatttgaactggatcttcctggtgtgaatcaagccttccccactagctgttctttgaaagaagttttgactaatctgtgagcccttgatgacacgaaatattttgatatatgttctgagttcactgttcgtatttgtttataggttggcatcaatagatatttgttgaatgaataaatcaggctgtagagaaacattttaggtttataattaaagcacctgaaacaaaaaaaaacactacatttagcttctctctaacccttttaatggtagttggaacatcagaaattagccattgagcttactgactctttttctaacgatttactgtataagagagcagaatgctattggcttcaccagctgtggccagaagggctccatgttcaaattagctacaaatcatgtcccttatggcattgttgctaatggtgacactgagggtcagaaatgcctacggtagtgaaaaatatttcaagtgcccctgacagttaacatctgacaagaaagtgcttttctctgtgtgggttttcgagggagtaaatgaaattgaactcgcatacatatatgtttgtgtatacatgcataaacatggtactttgcatctggtctgtgactacgctgcaaccttgggagatttgatcgattttctgatgttagaggtaggaatttaactaagggagtattctttggtaatcgcaaagcagaaggacttccatgcaacctggtactgggtagcagccattggctcttaattttgtaaaaatgacagatattcaataaagtatcagaatgattagagggaaaaatattagagctggaggagctgccctacttctgaacaagcagttgaaacaaaggcactcattggaattcatggttggttgacattatgtagcctgttgttgcttaattttgtttcctgtatattttcagggttgtgttcatttggttttagcaataaggacgggtcattttggtgctgtgtctttttagttcacctgcatccttgagttgagagcagagaacagaatgcatatttattttcaatttttacatgttatttcgtatttccatagagtctgtggacttttaggtacaatgatgctgtcgtgaacaaataagatgctgtctgaatgttcctgagagctttagtgcagtgaacacaccttctcagcaacaacaaaaggagatcagggaggcttggccaatgtactctctcgtccacatacggactgataagccaatcttcaaaatcaagattcttccagaaagtccaaattgtcgagtttatatttatagaccacatgtctgagagtctcctcccaacccccctcaaccaaagatagtagtttagatataacagtttttaaaatcaagttctcactataaaatctgagttagatacttgggtaagggtgaggagtagagggtatggctgaggaagaaggggcatttcaaaagaattgtaataatcagtccctgaccttataagagtttatattctaattacagagaatataagtcagacagctcaacagtggcaagatcacatagtactaaatacctgctgaggtcttaaggcagtgtttatacactggagggtattttcctccagggaccatatggctctccttaagggtattcaaaaatgtgtgagggcatttttggtgctcacaaggaggggatgttgctggcattcagtggtgcaggccagggatgctgagcatcctgaggggacagggcagttctaaacactggaactgattcccctccgaatgctgataaccctgatgagaaacattgtagtggttccgagaagaacaagagcgctcttacttggagccgagtctgagatgtcctcaacacgttctgtgagtcaaaggttatgttccctaaaatcaaggaagtggcctggatcataaagtgcttcaatgatcaaagtcagtcaagtgaaatgtgtcgatcattctcctgcctaaaaggccaaattctttcagcattgatttaaagctataaggaatcaagaccctttctttaatgatgctttctgatgattctccatttgtattgacggaaggagctaaagtgtggaggctctgcactagagggtagtttattttaaaaagttatttctgcatttagtgttaatattaattgcttattttatatgcctttttataccatctgaagtactttcacatctaaaaaaatttaaataactttttttcaaaaaaatactgaaaaataaaatcagatttctaaattaaataaattaaattcagtttcctagagcaggcagcatggcatatttagttatcaacaggaattttcagcaaacgaaagtcttttaaaaaataaagtgaaactggaaaaaggaggccatttttaattctttctctatatacttctgtacattatttatgaaaaagtagataaaacttgatctcctgcaagtaagattgacctaacgtccatttctagagtattagtagtcatcatcccaaaaatataagaccaaaatttgtatccttatgtctagaataatgcttggcctctatagatattcaatatgtatttaaagaagagatggtgatttatatttgaaaatatttgaggaattataaacaattattttcataaacacacaaatatatatactaatatgattatatttaggaattagatttctaacatttaaaatagcttagagactaagtactgttatttctcactttttgtagaaaaatcaaaaaattctagagaatttatttttaataatttgttactagctttagaaaataatttttttactcaaaaattcacttaaataaaattacattatctacattttgatttttatagacaacttttataagaatacttgcattatttaacattccatgtgaaaagaatgtggttatttcttaattttttctgttaaaaattccctgtatgattgaagatctaagatataaagattatgtttgttatttataacagttatcattttttgaacacattctgtgttctaggttctttgctaagcattttaagtgtactatttcattattcctaatgacaaacttatgaagtaagtataatcattagtgtcattttacaggtgtggaaattgaggcttaggattttggaattataatttctgtaatactgcccctcctactttattgtaaataaataatatcttggaaatatgatttttgaaagatgaatgaacattttgccatatagatccctttacaagagaaaagacaagtacattgcaaattcaccccgattcatatttagccctgagtatttgtttttttcagatcacaaacaactaaaaactatgaaacttactatgtttgataattacatattttacattagatatataacttacttaagttcaaaactaagtctggagaaggtggataaataagtcaaaattaacttcattttaagggaagttttacaagcaatggtaataagtcgctgaggagaatggaccccggcatgttggaatccgtggttgcaagctgacactttgagggaatgttcttagcaaaacactcacttcaacggaaattaggtcagccttctggaacatttatcatgtatacctgtcaccagcaagacccagtccttaaagtgaattgagatcacaagcaatggtccctcctgctctgagctgcaaaggacactctaaaccaatagttctacaaatatgtgagcttggcagacgctcccatgaaactaaagccaacacccatatagttgctctgggaattgaattccttaatgctttgtttatagaattttgaaacagcaaatggatttggtctgttctgaaaaaacaatctgtcctgtggcttgtttggaataacatctagagttgctatagaaggatggaggcagatgacccatgtctgatttggaagacagtttcgccagtttcttctccttgtcctttattgttcagccaggttggtttttgcccgactcaaggtatttgcatagaggaaaggccaccttctaccgaagctaatttgatatagaaactagagtagttagcaaaatccagagctaaaagagttagcaaaatccagagtaatagaaggtaagatagagtgtatggtaaaaccaaaacaacgtaaatgagtcataacccagtgccctttcagtaatcatatggcatcattctggtggtttcagagcagtgtcagcaagtatggagtcctgtgtaggaatctgagagtgcatctgtgtcagtgtacatgtacttcagcccagtgaatataattcattgagggttttatgcatggaaattaccacattcaccaggtagcctgtatctactggactaagttaccttgccttggaaaggaagtaattactaatctttctcttgtgtttatgtttggcaaactacacctaaagacttcactaaaaaattggtaaaatatatatgaagctggttgaaaaaaagatgaaattatacatatgtttgtgtagtagcaggaatcttccattacatctcaagaatgaaaggaaaaaactattaagaatagatgtttcatttctgtgttcattcatcacagatatactgagtacccaccatatgtcatacattgtacaaatggtagaatcagaaagatgagagaagtaagatccccactttaactgagtccttattcaagctgtgtgtctgtgtgtgtctgtctgtttgcgagtgacagatccttaaacaaaaaataatgataacctatgtgaaatgccccagtagaggttattttaaaactcaaggagagaactctataacttaaagatattttgtctacaaaaaggagcgaaggttttattcgaagaaagaggagcctgttttatatgaaaatcctgaagatttgaaggggctgaagaagtagaatggatatggaagaaatccaccaatgatttcttcctggaagaattaaacacacacacacacacacacacacacacacacacacacacacacaccaactttcatgatcacactctattaagccaggaccaggaaacaatttctaatcagcactctgatctgggcagagattgtgcagtcttttataccaggcctcagatctgtgttctctattcacacatgctcacttccagctgttgtcattgaaatctcacataatcttccaaggtcaaagggcagtcacccatggctgctgcagttaaaaggttatgctgatttctgttgtcaaatattggcccttttctcttccaaccactcccattctacttcttttttttttttaaacaagaaaaatccagcctagaattgcattacatgactttaaagtcttaaaagtgttcctccattgtgctaacacgacatggcctgaacagtctaattcattctgttacatttcacaaagaattttctggtacttctaaaatactttgtgctaggccagcaaacttcaaagtattgtgacccacatgattgtggcctgccatagtatctgcagaagtgaataatacaggttccacaatttaataaacatggtgaattttggcatcgataactaattactgggtaaatgagcaagaattacacaaaaaatgacttttgaaaagatgaaagctctttgcattttgtggttctaaacattagctagttttattttatatttggagacgtatataatagtacatttaatatttggagtcttagaaaagtaattgtaaggatttttaaaaaatattattgcttcactccatccaggattttctttccatgcttggtgaaccaaaatcagtgttgagtatcttaaaattagcacatggcccctggctatctactttcattatcattgcatgtgtcctcaggtggtttagcaagcaggattctctgtaaatggtctgtctcacagccctgtgtataaaacctaaaaaggaagaaaagggagatgggccattacgattttttgctgtttaacgtccatgaaccagggtagccctcaggtgatccagtttcatgtctgtttcacttaagataatcagtttctgatgtattcagggaatacatttccctgttttttccctagtatatgtaaaagttcataagcagaaactaaagctattacaaatagcttgattcatttgcaaattaccagttgttactgtccaagtttagaggaaactttgatgcagaacataaaaacaataagtttgctttttaaaaaacctctttaattcaaaaccgggttaattaaaaaatgttaatttatagtgcattaaaaccataaaattaattttaaaatattaagcttataaaatactgatactatgctaattacagaagaccttagcttttctaatatgatgcaaaattctctgttttttaaaatggtgctaaagtaagtgtttaaatttttaaaataatccctaaagattatttttgtttctctgttcttgtacaagtctaaattttcagttgagtccgcttgcaaaacaactgtttcagcttttaagactaataaatgcataattctaaatgtttcggggaaatggggaaaataatttgttgacatgacgagagagagaaagggagggaggaaggaaggaaaggaagggaaggaaggaaggaaggaaggacggaaggatatttagcctggaagagagaaaattaggttgatgagatgtcttcagatatttgaaggatagtagaaataaagagagccaacatttgttctgcctataccagaggacaaaatctaggtaaattacaagttataggaaggtagacatattcagggaaatatgatttttttaacccctcatttttttattaaccacaatttttttgttgcaacatgacgattattactccactactagatgaactttaaggtcccttccatatccagttcattgtgtgatgccatggatctgatatttgcaaagatacaaataggtaaaaatcttttttcacttttatttttagatattttgatatctaatagacatagtcctttaattgctcaatcacttggaacttaaaactcatgaactttctttctatgaagtcattgggcaatcacatttagtttaattaaatgctacccttcctttattaactgcaggaattggtgaaaagatgtgacaaggcctttggattagactgggtaattaagtctctgatgctaaaaatcatggattaaaatgggataaaattcattatataaagagtggtaaatatacctgtgttctaatcctaattttgccactatctgtgtgacattaagcaagtcacttaacttctcatgtctagtttaaaagcattcctttgcagattaataatacatactgtactagcaaaatatgtttgtagactggaattggcctgagggctgctaagttgtgacacgttagattcaaaagggataagttagtagttatgtgggttagggtaagtgcttagctactataacaaagcaaccaataaaacgcaaaaacatacagtagttaatgtatattgaaatctatttttctttctgttaatattcccagatgagcagcctaagttggcaggatggttctactccacagtgtcattcagggtcccaggttccttctgtcttactgctctgctattccacgggtgtgtgcctgcatggtagaaagtgttttcgctcataaaaaggggtagagacaatgttcagggcaagaatttcctttcaggtacgtgggggtagaagttgattgtatcacttgcgttcactttctggttgtggccactcctaactgtaaggcagtctggaaagtgtgctttctggctatcaaccacgtatatgtgtgacaaacagcagactcatcacaggaagatattgcagtagtctttattagtttctaatgttctcctagaaaggtattacaaaaacatgaattttatataaatacattactgaaaatcttgctgtaaatatctgccttgactggggacataagtccccaagagtaaggaccttgtgttattttacctgttgcatcccaggtcctaggattgtggttgccatgtaatagacattaagtaaacatttattgaatggaagcagtaaattaaatattgactctgtctctatggctatggcagaaatcattgagtgagcaatgatggcaaaaacaaacaaaaaaacacagattaggtgtctgtattgagtaacagtaaatgagcagcacagggaaatttggagccacaaaagaaggccaacagtgtgtaagtcccatgacacatacttctcaaacctctttttgccccattcttcttttggtctaagagtacattatttccataatggtgacaatttcttaatgtgtcatgataaaccaaaatgacaatcatacccatgttacaaatgcatttaaagcaatccatgtattcatctgagaatctcaaaacacctcatccatattattagctgacaaacatttctgcattttgcaaattctcaggcacaactttctagatatagaagtgtttcagccttactgtcagtccaacaccatatgtcaaccttttaatgtttaccataagcacactaccaagtgaatttttctccactatcataaaggttaatctcacaaacagaatatatatgtacttttattgctcctgtgttcttttttagatatctgaatttttgcatttctttaaactataaggaattattctaaaaataagccgtatctcaaatgtcaccaatgagtggcagaacaatttaaatagtcactatacagtcagaaatcagaccagaaatttaaaatttggcattaatggatcagcagaaacatccctgcacctgactcctcaaaaggaaaaactgttttccaagataatctaaattaagagtacagaagtaatatcactgtaggtgagctaacaaaaatttacatcacgctttagaggactaccaaataacagtatcataagtcactcatctgaatcactaaataaatatttattacacacctagaataaaggcttatgctgggccctgtggacaatgtgagataatgagacccaaccctcccctccccggtttgttgtaggagtgcagagataatacatataaacaaataactgtccagtcaggtagaaagaggcaagtgccgtaagacaagcagagaagttctccttaattgaatagtgtctcctgagcacacctaaaatgttctgtgttggggtgagagggaagattaacgagccacattcccacaggtggctcataagccagtggggaattcacagaaggagaaattaaaattccaaggagggagtctggttgatgaggtaaacttttctttagaaggatgagaatgtaggttccctgagagcagtgtccccagggactagcacagacctgcacagcacaggcagtccaaaatccttctggaatataaacagcgtgagaaggagggagcttttcccgtcaagtggccaaggcacaccagcatggagaagcctggtaatcattggcctgtcttgttattagggatggaaccctatttaccaaaggaagactagaatagagatgagttctttttgatgaaatgactggggtattgcagtttgcctacatcccttaaccagacgagatttgatcatttagagctgacagccccttgatattccagcagagaaaacaaaaataccatcttggatataaactttccttctcagatgcaaaattaactctgtttcttggacctgaaaactttctttagtggtcagcctcctgtgtggtttgttcccaggtgtctctggccttgacctctgaacagctcttcaaggttacctgtctctcttcaaatcttaactttgttcctctcctgcctgctaaaaggcggatagatgttcagttcctccatgaaatgagatttagttcccatgtaatggcattttccataataactgctgatatcatcaaggtaaagagagctgcttctcctaactacccatgaaagaatttagctttttatatttctacctctcccatatagtttaatctctccccactgcgagtatgactgactccaaggtattgaagtctgtgctctaattgggaattcaatgaacaagacttcagtgaatgaacttttttagccatattatataaaatgaaaaaggatctgctcctcatttcaatctcctgtacaattgctcctgaacagtagtacagaattgtagagatagcacattgtgcaacctggctttttatctgagacatacttaatgaaagcacatgttttgcactttttttctgagaggccctattcaaaatgtaaatcttgggaccttttgggagtgtttaatgtgctttccaatggaggatctttcaatattaataatatctgaatttggaatcgcttaaactcacctttttattttcttttccacttttttcttactttgcagtaaagtggaacaatcagattagtgtcatttccctgcaagtcatttttaagatttggtttgtgttcatgagaatgaaatattaattcactcaggtttgcttagtagttgtgttagcaatatcactttttccatcatttcttaggtttcatttctcattgctgtcttcttacaaagttcatcagtgggtttccaagcaattggtaaaggaacaagagcagtttcatcaccatttaaagttacatggagtgtttacacagacctttccatggggacatattataaacataatctagccaaggctgtctgataatactgtgtgaagagatggttacatcaaaacctgccaaagaaggctaggcgtggtggctcacgcctgtaatcccagcactttgggaggccaaggcaggcggatcatgaggtcaggagatcgagaccatcctggctaacacagtgaaaccccatctctactaaaaatacaaaaaattagcagggcgtggtggcaggcgcctgtggttccagctacttgggaggctgaggcaggagaatggcatgaaagataatggcatgaaacccagaggcggagcttgcagtgagccgaaatggcgccgctgcactccagcctgggagacagagctagactctgtctcaaaaaaaaaaaaaaaaaaaaaaatctgccaaagaattatactctttatttttgtgattatagtgcattcacatatgttttaccttctaaattgcacacattccactaaggtaagccttgggaggcaagttgctggtagggaaaagggatgaaattgttatttttgcagtgactttctcaggatcacacaagatcttcttttaagcttgggactagatcctttttgggtggagggagctttatggccatgatggacaatgctactgccctttaactctatttttacttgaactttaaaaatatgaaccataaagggaacaataagacaatccccaggcatttatcatcagaaacgcctgaatcaatctgaccagaagcttcattgcctgtcctgtcctgatcctgtttagtttggagggaatatgtggatggttcattttcatagtttcccagtacagactgactcagttttagttaaactatattgctggaaatgagagaaagagacagaaataagaagttctgccaatgattttaccaagaggaaaaatgacataggtgagcccagtttgagtttcattcactctgaggcatctcaggaacactgaccccatcaggcagtgtgtcaagacctggagggccagaggcacagaagatacttcccctcctcagagggcttacagtctaatgtgagaaaaagacaaagttacaatcacgtacggcaggtcccaggtgagaaatatagagtataactggtcagtattcagaagggagaaaaaaagtgttccccagtggtgggggcagccagggaagacttttgtgagaggtgacaacaaagctgagttctaaaagacactttaggaggtggttaagctaggagtaggaagaacagatgtttcaggaagaaggagctgtatcaggggatggcagtgaagcagtgcaacgaggagcttgcagttcacttaggtcaagggtagggccagaagtgagagagaataaacaagaggctatatctaggtcccatgccatggaaaggagttagtactgtactctgaacgttctgtggggctcttgcaagcattctttctttttaaaagaaaaaaaaatatatatatatgatatgtatatatctactattatgatatgtatatatctacttatatataaatatatatttattatatattttttcattttaatagtttcccagtgcagatcagctcagttttagtttaaactatattgctgcaaatgagacagagagacagaaataagaagttctgtcaaagttttacagtatatataaaaatatatatttacatatatatatttcatttcagtgacctttggggtaaaagtgatttttgggtacatggatgaattgtacagtggtgaagtctgagatttcagtgcatccctcacccaagtagtgtaacttgtacccaatatgtaggcatttttttaatccgtcactccctacacagccgccccctcctgagtctctgcggtccattatatcactctgtatacgtctgcacacccatagcttaacttccacttgtaagtgagaacatgacggtatttagttttccattcctgagttacttcacttagaataatggcctctggctccatccacgttgctgcaaaatacattattttgttcttttttatggctgagtagtattccatggtatatatatataccatattttctttatccgctccttggccaatgggcatttaggttggttccacatctttgcaaatgtgatttgtgtggcagtaaacatacacatacagttgtctttttgatatattgacttcttttcctttgagtaggtaccaagtagtgggattgctggatcaagtggtagatctactttgagttctttaagaaatctccatactgtttcacatagagatggtacttattcttaccagcagtatataagcatacccttttcaccacatccatgccaatatctattattttttttttactttttattaatggccattcttgtagaagtaaggtggcatctcattatagttctaatttgcatttccctgatgattagtgatgttgggcattttttcatgtttgttggccatttgtctatcttcttttgaaaaatgtctgatcatatcatttgcctactttttgctgggatttttttttttcttgttgatttatttgagttccttgtcaattctggatactagttctttgttgtatgcatatttcttgtaaactttctgatagggcagggggctcagaacacattggatttgtctcagtgtctccaacatcttgctctttcctgcctcagggcctttgctcatgttaatcctctgcctgaagagctctttcttcttttcctatttggctccttcgtatctttcagatatcagctcttaaacaagacctgccctggccaccctttctaaagcttttgatatttttctccttcatatcatttattttatatatatatatttttttcgagacggaatttcgctcttattgcccaagctggagtgcaatggcacgatctcggctcaccacaacctacgcttccccgttcaagtgattctcctgcctcagccctcccgagtagctgggattacaggcaagcgccaccatgcccggctaattttgtatttttagtagagacaggatttctctgttagtcaggctggtctctaactcccgacctcaggtgatttgcctgcctcggcctcccaaagtgctgggattacaggcataaaccaccgcacccggcctataattttttttttttttttttgagacggatcttgctctgtcacccaggctggagtgcagtggcgcaatctcagctcactgcaacctttgcctcttgggttcaaatgattctcctgcctcagcttcctgaatagctgggattacaggtacacgtcactacagccggctaatttttgtatttttagtagagacagggtttcaccatgttggccaggctggtcttgaactcctgacctcaaacgatctgcctgctttggccttccaaagtgctgggattacaggcatgagccaccgcacccagcctccatttataatttttttctttttttcttttttttttttttttgagatggagtctcactcggtcgcccaggctggagtgcagtggcgcgatcttggctcgctgcaacctccgcctcccaggttcaagctgttctcctgcctcagcctcctgagtagctgggattacaagcgtgcgccaccatgcctagctaattttttttatttttagtagagatgggttttaccgtattagccaggatggtcttgatttcctgaccttgtgatctgcccacctcagcctcccaaagtgctgggattacaggtgggagccactgcccccggcctgagccaccatacctggcctatcatttttaaagtaatttttttttttttttttttgagacagagtcttgctctgtcacccatgctagaatacagtggcacgatctcggctcactgcaacctctgcctcccgggttcaagtgattctcctgcctcagcctcctgagtagctgggattacaggcgctcgccaccatgcccagctagtttttgtattttcagtagagacgggtttcactatgttggccaagctggtcttgaactcctgaccttgtgatctacccaaagggctgggattacaggtgtgagccacagtgccctgccgtaattttttttacatgtttttagctgtttctgtaaactccctgaaggtgggaactgtatcttgtgcccctagcatgatgcatggcacatagtaggtactccgtagacatttattgaataaatgagtaactcatcagatttgcatatctgtcagacagccctggctaaagggtggagaggggattggagagcaagccaagagagatgatagacagcacagttaggaggctttcccaccatgctggtgaagagggaaggtcctgagccacagtcgcaggagggtgatggagacatacatagagtcaggaatcacagaagcggtggggactggttggatgtgggtgattgtcagaggcaggagtcagggatgatgccaaaaaactagatgagtggccgatggttcattgaaatatggaattcaaaagagtaagaacgggttttgggtgcagtagaaaatggattcggctttgcgcatgttggttctaagaatacctgtgggctatctggatggaatgcccaacaaatacttagatttatgggtttggaacccaggagatagatctcagtaaatgataaagagttgagagtcattggcctgtagattcattcatctactcattcagtaaatattcacttactaacgtgctttgtctcaggcattaagtatacagtggtaaattaaaacattattttagttttcacaaatatcacagtctagactgctagttgatgacatggaggtagataaaataacttaggaaatagatacaccccccccacacacacacacacacgcacacatctgcacacacatacagggagagatgagcacagaccctggagaacaccaacatttaagaggtggacacaagaaaagggggcaaccaggagagggtggtaatttgaatgaatgaacgcaagggtcttcccaattcccaagtccttgcacctaaatcaccctagcctttaaaatatattgcttgcttttttggtggcaggattaaattgccttgtgtttacattcacgctatacagaaattcatgttagttcatccttaaaatgaggaatttcaaagattggaactgaaacaagtatcagcctgtaagtcaagtaaagaaggtagggatgagcaagagctggagatcaacccagattttcctattcatctatgaatttccttgttattgttctatgtgttttaagtcaaccttaatgtacattgtggttagatttcctttgctgtgatctgtgggataaatgtaatgttgatggtctccctataagaaagagatgttgtggtctgttttgccaagacctcattagagaattttatttatttattaattttttaacttctcagttctcttaatctaagagacagcatcttaggtgcttaccaaagccaattgaatacctgggtgtgggtggttttgagaggtgaaatttcttgagcactttgatggtaaaattttgccattttatttcaaaaagccatttacaattattgtctatcctaaaacttggaactgtttcatctcaaataccatagattatgtgtttgatataaaagttaactgaaatttaaaaaaatctcagtagaaatttcttatgcaaaaatccagtgtaacctaaaaaagacaagtaacttgcaggtccatttatactcctccaaaacatggcaactttttgcatgtgtttatgtgtatgacatttagtaaatttattggtggatatgcagtgccacaggtaaatttgctttccctcagtattgtatgaaatctagcttttattaataacaaattttgtttatggattgttatatattcagattggtctattttcttttattgcattttctcaaggtatgtttcttatgtcaaagaacaattatttcaaaaatcccttcggccaacaattttttgacccagattttaaagcagggaaagactaagctgaccttggagtgatctctcaactagactctacctgtgtgagagtcatagaatcagaaaattttagaggtagagtgggaaactacataccatagattatgtgttccttgtcatttataagttctatgtttctgaatgcatcataaaattaaatgagtagttggtgatcgacataataccaggtgtcttaaagggaattaattgcatccagcaaaaatgaagcagaaacaaagttcgaagattaatcactttttgaaccattgatttattatcttttctcaaaaaaatcaacagacacaaaaaaaaatttggggtgtataaataatctgaatttttatttgtgctcaaaagaatttgttttcctgttttgtgagttggggcttgctttttctattttgactttttaaaaattcaccctgtggtgcctctagaaaagaacacctttaaatcttgtttgagttaaatgaatagataactaattccaatcaaatgtttctttagagaataatgtttaaaaaactatgatggaatgcagctctcctagtgattcttagatatgctgtttttatcccaattgttaaggtcttagaggtcacccaaggtaactatttattgtaaattgtcttttgtttcatatttccggttgaattttttttaaccatttcaaaaatcagctagttgttgtaccatagctttgcacaaccttgaaattcaaaccaaaaatctatctgcttagctaaatgactgtgccctcccacataaaccccaaggagagcagagaatgagattaggcaccacatgtgttaatcataatgaaactaatatttaaagctctgttgtcaaatgtcttgtatttatgacactttgttttcttttgtttttgtttccccaggacatttgggcttccaggacagttttgtcacatcaggtgtttttagtgtcactgagctagtaagagtgtcacagagtaagtataattttgctttgatttggtacagatttgccttggtttgtgcttactttctgcctaggactcctagagaccaaaaaaagctttcagaatctccttttcattcacccattggaagaattttgacacacagtttgtttgacaaccaagaatttaaatcaggaaaaattaaatattattttgatgtgaggcataaaagaaagaccaaaatcctgagggtctcatatattctgaggcttccctgatttctaagaaattctgcattttaaaagaatttgtttttgacctttaaaaaatgctaatgccctcagtatgagtgacacagtctgggatgatcattaccagtttgtcaataatcactaacagtgaatgaagagtacctgtcaccatcttgctccattgatcaaaggcccattcaattgattgtagttttgttatgacataatctagcatgcacgcacacacacacacacacacatacacacacacacacacacacacatacacagttgccttcccttaggaatctgttttttcttatttaaaagcacaaatacaatgattatgatgttccaggtcccagtaagaagaaggaaaaataaataccaaatattaaaattttattttgttttactcctccaactacttcaaaataccacttgtaggtaaaatttacatggttaaaattggttttgagcagcatcagccctttgtggaatgagctggagtaaaaagaaacattttcatttcaggttcataccccccattcactgtgttacaggcttgcaagattgactgagtaagccagtccatctcagggcatgacgtcaggtcaaacaagtcaagccatcctggtcccaaaatcctggattttgtctgttcttattttagccactcataggctaggagagtcttgagagcacagaatgtgatacacagtgtgggaacaggggagaatctaatgactactgttcatttactgtctgccaggcactgtcgtaggccttagtgtaaggtacataagttaatccttgcaataagcttttcagacaagaaattaccccatttttaaagatgagttaaattgagggtctatataagttatttatccaaagtcaaacagtgaggccaggcacggtggctcacgcttgtaatcccagcactttgagaggccgaggcaggtggatcacttgaggtcaggagtttgagaccagcctggccaacatggtgaaaccccgtctcgactaaaaatacaaaaagattagctgggcatggtggtgcacgcctatggccccagctactcaggaggctgaggcaggacaattgctcgaacccggagggtggaggttgcagtgagctgagatcacactaccacactccagcctgggcgacagagtgagactccatctcaaaaaacaaaccaacaaaaaattcaaatagcggataaatcgttaagctaagtctctataatgccagtatccgtactcttagactggcccaaaggaacttgaagagatctatagcatgagactagacagggaaacagtgggaaggtaactgtcggggttagaattgtgggagtcaaggactcccaggttgatgctgaggtattccagtgtagaagagttggaaccctaagaaatgagacattaggagcagcaggtcataacttggaagagagaggttgctgccatggtattgaagcgtacttaaagtaccaaccggttaagtagacactacattgccttgttaagctggagaggatatgctcccctagttatagcacagctgattaggcagttatttgccatagacaaataacagtgcatctgtatatatcttttttttttaacttcttaggacttttgaacacaataaatatctcacattttcttgtaattttaataataaccgtaatatggggagtatttgtgtgtgtgtatatatgtgtgtgtgtgtgtgtgtgtatatatatatatatatatatatatatatatatatatatatatatatatatatatatgtatcagaccataccagtcatagtagcattataggaaaatacattcattgagccctcactgggatctaaaacatagccttaaagagtgaaatgaaaatccttttaagcgtaagattggagcactagccattttattctgccctggatgctgcaattcttacatttagtcctcattaccatcagccttcccaggcctgggggttgtatgagaaggcccacacagtacagaatcacccccagcctctcctcctccttccactccctgtctttccttttaaggtcttatatcccaaagcttatcagttccaagtttgagtagaactctggtcagtctaagatagcttggctgccaaatgaattctaaacctgccttcaagactgccagagattatggctgaacagggattgagtttgcagagggacctggacttgtttcctgtccctgcttagggggttgcttagccagtgcctggcatcatgaacatcctttggctctcaaatgctttttgattctgcacactgctgtgtaatcgctctgggactcactcacacatggcctcgtgctgacggaaactgtttggcaagagtgggtctgggctgtgtcagctcgatcatggcttcaggccaaactagtcgactgtagtcaggagacccctttttcttagagataatctaggtttgtcggggtatatttcacaagattaccttggctgcctgggtaaggatccccagctcaggtttcgtcacctacgcaccctcctgaaaggcttaacactcaagccgcatgctggagttgaaatccctcagcattgccttgcaaggctgccctcttccttgttcccccatgtgggaaaagagaagcaaccgtttcagaactatggtggatgctttttgcagatgagtggacctggggtgcattctgtatcctcgaatagaaataagctaactggccaggcgcggtggctcatgcctgtaatcccagcactttgggaggccaaggcgggtggatcacctgaggttgggagttcgagaccagcctggccaacatggagaaaccccatctctactaaaaatacaaaattagccaggtgtggtgtcgggcgcctgtaatcccacctactcgggaggctgaggcaggagaatcgcttgaacccgggagacggaggttgcagtgagctgagatcatgccattgcactccaggctgggtgacaagggcgagactccatctcaaaaaaaaaaagaaataagctaactggcacaaaaggtgattaaacacatgatgttagccctgttaggagtgtgatgtcatataatatgaaaaattagagtagctagcatttatcaagcatataccatgtaccaggcattgtgctgggtactttgtaagcattatctcattcaatcctcccatggttggtgttactgtccctttttatagatggagtctgtgatgctccaagaggttaagcaacttgctctttttcctttattctactcagctagctgactgcctaccttttcatcaaaacctctcctataattgcattatagaactaaatagaatccaaggattctgtgcttttattgaataatcagttcttgttgatttgatacacttttagcttattaatttgtgcattaaaaaaaggttaaaactattttcatgtaaaccaaagcaagtaagatacttaattaattttttttcctggatttgtttttaggtgtgagtttgtttttaattaacagactttattcttttttagggcagttttttaggtttacagttttaggttaacagaaagtacagaagtcccgtatacccctcctccaaaacagtttcccctattgttaacatcgtttgttagtgtggtacatttgttaaaattcatgagccagtattgacgcataattaataattaaagtccacagtttaccttagggttcactcttgtacattctgtgggttttgacaaatgcatagtgatgggtagctactattatggtatcatatggaatagttttactgccctaaatatctcctgttctccacctattcattacctcccactccccaccactgatctttttactctctccatagttatgcctttcacttagatgtttttgatggtctcagtgtcctacaatctctgactgttttgcagatttcttcttaaccttctgttatctatcccagccccatccagtcccctgcaattatacctaattatgactacttacatgggctgaaaatttcacagtcatcattaatgatggcttaggttgagatttttctccctttctggatctttagtattcgatttttaaatttgctaatacaaatatttacttacactaggtttccagttagtttttgtttttcattttcttccttttaaatgtaagagaggagggaggtgctatttcagtatttcctcatgtggattcactgaaataactatgtcctaagtgtgttgtttttaatagcgttactaccaaggtggcaatggcagagaaactcaggagaaagctgctggcttagcctcacaaattcagaggtgagggatgaggcaacaaggatgcttgccattgaattatactgatcagatacatgaacctgttggaatcagggactcctgctggccaactgaagctgcaatcttccgtgaactcccctttcctccttgcctcctgcctaccaccttttaattttttttttcattatcatctaaagtccacgaaaggcaagaatggaaagttctgcttccatggcaaagaaaatactgtagcataaaaatctatatttgttctcttgctagtttttcccccatgtggtaggaccatctgaaagtagctcaattatttattgccttgttccaggggaggaggaaaatacagaccactagatgctgtgccagagagagagagagaagtattctctgctttggggaagggggttttacaagtgttaacaatgtggttcagaatcactaaagttgttttagcataatactatgaggaaagagacaagaaccatctgttgaaatggctcttacatgatgctgcattttcaaacaaagccttctcaaggcatttttagattggtctctttcccttgaagttgctacaaagagagcccactctactagctgctaagtgatgctgcttagatagctctctctgtcagcacccactcttttgtttattttgcgctagtgttttcctcaaagtatgagtgctaaggctgtcaaatatcactcctggtaggaacccagaaagttctcctgaaaaatccactacttctgcccatttccttccaaattgctgactctattttacttgaagttggtggagtgacttcgaaaccctaactacttcactgggaaagaggaaaaccgcaaatacacacaggccattgtgactctggcctggtgggctctaattttctagcggcggtttgtacacccaagccggctgcaagggttaagtaaacttcgtggctaaggatgacttcatggccctggaattttgaaaagccaggattctcagtacactgtggccagccttagagtctttgggtgtgaaaaccactctcagttacccggactgatttttggttcctgttgcagtgctgcagaatctattaaaatccggcagctgaattgtcctggctctgccacaaagctcagctgccgggtccactacaggattcctgagttgtttgtcaatggagagtgggagtgaatggaaccaggcatatgcctcagcctggcatgaggtggcaccctagtggctgttttctgccttagaaatgtgcgctctttctatattttcacacaggaattgtcattaacatccaaattgcagttcatttctaaagttctttttgaagtctctgggtccttgttacgttttcaagtacccatattcagatgcttagattttcaggctagtaatttagtaagaactattggcaatattctaacctgacatggtggaacttctaagacagaatgaactcggctacaaggcacaacaagaaaacgaaactcttgggtaggaacaagcccaaacttgaaaatacaaaatgttcttgcacagaaggactaatgaggaaatgggtgtaggataagaaattccagacatccagtcatttggggtgccatttaaacattcgcagtactttagatcttaattaaagtgggatagatttaaaactttctttctaaactagtggcctgttggttttcctgtgttaagtaacacgatagctgtgatcattgcatggaaattaatttttaaaatagcttatattcttaagcaagatcttctttcaaaagaaaccatttgggctcgagcattaaaggaagaaacaaaaagaatataataaaaaatagattgcagccctagcatgaacagttgccgtgaccttgccttttgtttgccattacacaattcaatggcagtctactcaaactatgtgctcgatcaatatcctattaaagcagcacaaaaagtctccataaacttagtggttagctatgtttataaatggaactcggcataattggatggtcaatagcaggctctactagtaattttaaaatgaacgtcacacattttatatctgtagaagtcaatggcacctcttctagagtgaaggtagagtgtggagcagacaaaagagtgggtggccctttaaaaaaatcataatgtctatttccaaatgtagtttttaaagaaaatctaagttatggaagagaaaattctgattggcccctatatatttttattttgcctatctgaaccaccttcttctgaatatattatgactttgcaaatgttacattttctagttttaatcaacccctcatagagaggtaaaataataaatattgccatactcgtaggaagaaaaataacagtctggctggcttaattcagccagcttcctctactataattcaataaattttcaaaataaatattgaaattgaattagttcaggaggatgttttgttgtatgattttttccttttaattttcttgacatgtttggggtgaatatttgggtagtaaagctggcagcaagtgcaatggactggtagtaatagaaattgtcgtcaaactacgctttcttctgaatcctagctcacagtatgggtggccaagcttgatttttttcctatcctaccctcctcacctaatgaagccatgtaaggtgagagtatccccacccttagactgactctgtcctcagccgactcagccctatgaattaaaaggtgcatataccttgtgttcgatatgtgccctggctgttgtcatggaccactgagctgttgaaattagaactatggcaggaatacgcttatgacattagtgtatccttcagtcactgctctgcatgaaggtctagtcctttctcttacatgcatactcctacaatcttcctggttagagctggcagtgagagttctcatggcagaatttggggccgttttgatctctgttctcagctgaagcttctgataaatttaccagactatgaatactcttattataaagatttgaactggggagaaacacaacataccccttgatgtacatactaatgtgttgtcatggtctctattcgtatgttcatctatttctaggtcattcatcagttatgctttctatgtgtcaagtataaaacctatattcaagatggcagcatgatattgtaaaacagtacaggatatagagttggggaattgagctttgcaacttatcaactctatagctttgggcaatatttaacccctcttggctgtgttttcttctaggttacaatcatttattcattgagcaaatgtttatgaagtcctaactgtgtgctgagtctaagtccaagtactggaaataggaatacctctcaggagtgtaatgagggttaagtgacagatagtctagtgtctgccacatagtagatgctcaacaatgataaccaccacgattattgaacagagcctcagcccctgatcgttcttcactgtgtgctcagagccaatcttggagctgaccactatcagtaaatttattgaaaatgcatgtgtgtgtgcgtgtataaattaagaagggccaattttagaattcatgttctaacaaccaattattagaagagccactctagtgacccttacggagttagtaattccaatagagtaagagcatgccaatagtagacctcattcctctgttttgagcattgtttttcctcaaattttcagaagattctttttcctcaaattttcagccagagcctgtgtttctgcattattctagaaattgttctcctaggatatctcgtggatagcagaatgttttaaaattctcaatctaacactgacacattaacaactttttaagtggcaaaccacacctgggtcatctgtaccggcattctttttttttttttttttttttgagatggagtctcgctctgtcacccaggctggagtgcagtggcgtgatctcggctcactgcaagctccaccttccgggttcacaccattctcctgcctccgcctgccgagtagccgggactacaggtgtccaccaccgcgcccggctaattttttgtatttttagtagagacggggtttcaccgtggtctcgatctcctgacctcgtgatccgcccgcctccacctcccgaagtgctgggattacaggtgtgagccactgcacctggcccatgtaccagcattcttaaaagtagtacttagttttacagtattttaaaattttgctttcactcatattatgagcaaaaattccctatgaatggcagaagcatgctacaggtcattactgacaatgtggtttgtttgggttttcttgagacagagtctcactctgttgtccaggctggagtgtggtgatacaatcatggctccctgtaactccacctcccaggccccagggatcctcccacctcagccttcccagtagccgggaccacaggcacgcgttgccacatccaactaatgtttgcattttttgcagaagtagggttttgtcatgttgcccaggctcgtctcgaactcctgggctcaagagatctgcctgccttggcctcccaaagtgcctggattacaggcgtgagccagtgtgcccagctaataatgtgctttttaataaacctttatttatgcactcataagcctcaactttttaatggtggatattcatatccagtagtaacactgaaaaactagaaggggtttttgtgacctccaaagcttgagagaaatcctatattaccctgcagtagggccacaaatattattgagatttggctggagtacattatcatagctaactcttgccgagtagaagggctgttggtagtgaccatcttagcatgtctagaatggggccggtggagtccacattcagcaaaaccacacataggtcaaatactggaactgaactaatccagtgtgtggttaatatgagtacatgttaatacccaggatttttcactaggtggaggagaaaaaaaatgaaagttattggtggaaatattgaaaactattttttttttttgtaaacagctgaattagtcagttgttgggatgggactctgttgatacggtttggtttcctaatagctaatggtcaagtagtcccagtgcactattggttgtggggcttatgtttagcttagcccttccctggtttatagatcactgtggcaaaaagacctcttaggccatcaaatcccatccctgtcagagaagacttaatcccatgactgaggctgtatcagatactaagcaggtaccacatttgacctcaaccaaaagctaagacatgatgatactctaaaatgcagaaaatcaatttcagcccccaaagcagaaggcactaatgcagatcagtcagcattgctaacccctctgtggactgctctgttagaccaagtggcagggcccttcatccaatggaactcttgctgacgcttataaagtttaagacctgcaaaagcagagaggcgagaaggagaatgatgagatagaagttttgccacataagtgtaggcgataattattcttctatttaaacgtgttgaatatatctccttcataactgatgacaaaggaaagacagcaacactagaaatgtgaatttcactcctgtttctttgaacagatatctaggaaatatctacattcaagcccttcttctgtcacttacttagttgcatgatcttgaccatgttacttaactctcagcgtagtttctcatttctaaatgagaataatataaatacatattccatagggataatgcaaagattaaatgagataattcaggtaaaatacctagcacattgcctggcatgtaataaatgctcaataaatattagctcttagctatttttcattaacaagctcgtgtaattttagttcaactcagtaaacatttggtgcatatgtaatatatgaagcaccctgcactgtgtactgaggagaatacaaaaataagtaggagacagccttttcctctacagggtatatatttaagtttcttgagatctaagactgagcttattttatggcaataaaaagcctgaatacacttaatttacaaattaaactcacagtaattatctgtcaaagataaagtatcttcctgattcggagtggggtgggaaaatgtatcggttaatttttcctattttaatgaaacagaaacattttttgaaaaataaaaattcctctcttcacctcccttttctccttccgccaccatgtatatattccttaacatgtgttcacaagacagggatgtgtgaaaatagggctctgtctgtgttagcggatgcctttcatggggttaaaaaatattctactggcttttgtcacctaatagtacatttcgtaaaaagcattgcttaaatcttttaatagcaggcaagttcattttcacatagagggaaatccttgttttagttcattgcctttttttaatgttcctgtttggaaaaccatactcttagcctgcatttggtcagaccttttagaaaggaaaagtagaaaacaggagatcagcacagggtttacagaccagaaatctgcttggcaaaggagttgctgaagactgtggcgtagaagctgcagagaaagtacctttatgattgatttccattcaagtcagactgactgcagtgtggtcatttttctaacccataactgctcacactgcagcagtctgctatctgcagggtgtctgaattatagcagtctatgttcgtgttacctcttatacaaattacttacactggtttctttttccatgcaaattcatcagttttacagcctctcacagccacagtcaggaaactctggcagagagcacaaattgataaaatgagttaatttttactatacttattttttttctttctaaaagccctttctcataggcagtgttcaggaagcatattacggtaaaagggagataacaaaggagttgaattttcttgccataaattactttccaagttaattccctttaacgatgattccagatttgcttgagttttcatagcattgtgcgttttacaactgtgcctttgatagaaagaagaacaagtattttcccatgttcagtccctttgtgccagtgacatgaactttcttacaagatctttgccactggaatgcaaaacaacactaaattgtgctgggtccatagaactctgtgctgctattggacttttcccctcccccggtcttcaaatacaagttcccaaagtctcactgagtgttttagatcatgtaatcagaagaaaaatatctctccattttttcatatttgtaagttggaaattgagttgggttacttattgccattctttcatattcctcggtggccatacagatttgaagaagggacaataatggtcagtctctgaaatgtaagccccacaagggcaggggttttctatatcttgtccactgatgtttctcaagcatctggaatgatgcctggctcactaaaagtgctccataaatattgttgaattccattgaatacagcctctctgaggatatgtactattaaccataggctggacaaactagtcatttcgttaatgctccctgctgacttccgttgaacaagttggaaacttagcacactgtaatctctcaggcagagtagctcaaaaatttgtatggaaattttttccatcatcctctctttccaacaatgcaagcctgagcagcttgtctctggtggatggcagaagttcaataaccacaaccttatccaactactaatgtgtacagaagagcaggtcattaagagggttggctactaaaataacccctttcttccagtagcctacattactataatgattccttaatagcaaaccatttattaagaaatgacacaaagactacattctacttatgacaggaaagaggcaggggtagaggatgaatgacttggaagtaatatttgaagagaccatttccaaaagttaaccttttgagaaaaactcctcgatagagcaaaatacttcagattcgttaattacaatactacttaagaaaattgaggagccttcaacacaatttatatgtatttatagaattctgagtttcatttggtattgtttaaagtttagagggggcaaatagggagggtaattattcactcttcttaattcaaagcatatttattgatgatcaactgtgtacacaaaactggtcaaagggagctctaggacctgtaggattaaagtcatgtgtatcacctctgacttcatgacctgggagagttatttaacctctttgtgcctcagttccttcctggtggtatggtgaggatcaggattccccagtgctcaggctgcagactagtaccagtcagtggcctgttaggaaccggactgcacagcaggaggggagtggcgggtgagtgagcattgctccctgaactctgcctcctgtcagatcagtggtagcattagattctcctaggaacgcaaaccctattgtgaactgcacgtgcgaaggacctgggttgcagcctccttatgagagtctaatgcctgatgatctgagggggaacagtttcactccgaaatcacccccctactctgattcatggcaaaattgttttctatgaaactggtctctggtgccaaaaaggttggggacttctggtgaggagtaagtgggatgatgtgcttaaaacccttagcccaacttctggttcataaatgatgcctaataaatcgtgatggtgatggtggcagcagtggttagtggtggcagttcatttttgccataattattattagaattatgaggcccaaagagttccagtgacttaatcaagtaaacaggtggtgattggcaggattgggaatctagacaatctctccccgtcctatactagcattttttatgccccatgacatctctttataaccttcaaaatgcatctcaacctagatagggagaaaatgttacatatgagacaaagcatgataaagcccagagtcaattacaaatggagcaaaactggatttcacaataaatggaacagaaaggcagtgctgtgcttggtccagtcctacctaacatctccacatttgattggcagcgactgcatcgtttttatagcacaccagaaggcagttagtctttaacctcaaaaacccaatgtgataacctgggcaggccagaatttatgtgacattggacaaatcatttaaccttccacaacttttattagtttcttaattttcaaaagaaggacttaatgccattattagttaaaaagtatactgtgttacatacatcttattgatattttatatttgttagaagaatatgatcatttatttatgccctttcaagtgcacaattgggaacaggtctttgagacctgtttgctctcctggaggaggtgtcaaatttccattgtaaaaattctattttctttcccagcagcagagtcttggcctccattcccttctgctgggacacttgcatcaatcttctgatttccccacctccagaatcttagcccccttccatgcattctgaatatggttgctgtgttagtccgttctcatgctgctatgaagaaatacccgagactgggtgatttgtaaagaaaagaggtttaattgactcacagttctacatggctgggaaagtctcgggaaacttataatcatggcagaaggcacctcttcacagggcagcaggagagagaatcggtccccagcaaagggggaagccccttataacaccatcagatctcgtgggaacttactcactatcacgagaacagcatgggggaaactgcccccaagattcagttatctccacctggtcccacccttgacatgtggaaattacaattcaaggtgagatttgggtggggacacagagccaaaccatatcagttgccttgtgattgttcccaggtccacagtgatcttatcacttccctattcagaaactgtcctggatcccacttttttttttttttttttttttttttgagatggagtcttgctctgtcgcccaggctagagtgcagtggcacgatctgggctcactgtaagctccgcctcctgggttcacaccattctcctgcctcagcctcccgagtagctgggactacaggcgcccaccaccacgcccggctaattttctgtatttttagcagagatggagtttcaccgtgttagccaggatggtctcgatctcctgacctcatgatccgcctgcctcagcctcccaaagtgctgggattacagtcgtgagccaccgtgcccggcccactttgcttcttatctccaaacttatgcacatactttgtctattgccaagaaagcctctcctgtgtcctgtgcctctttaaatctgaactatcctcgaaggctcagcttaagtgcccactcttcctggaatcaaacctttttctgatctcacaagccaatgggatccatgactcctttgaactttcctagcacattctttgcattttttcctatgaaatttagcatgttcggcattgcattagatattcaggtattattttagtattccacttaggttgtaaaccttttggggacagagacactgtgtatctttttatcatttcaagtttaagacaaatactatatgtgggagtcagtgtggcgcagtaagaaaagcccaggttttgaggtcagtatccttacattttaaccctgactctctctttttgtctttttgtaatcgaggacaagttatttaatctcacttcaaggcttcgttctcctcatctagcaaatgcactttgaggtttgagaatgaaattaagtacagtaagtacagtgcttatcaaaacatggcatcatgggtgctccaaaaagcctgcctaaagcccacctcttcagttcttcatgacctgccaaaagctctttctgttctccagattagaggtactgagaatacccaacccaatgcaaggatactttgatagggactgctcccctcaagtgtgaagctttctctttggctgtgacagtgtcactgagtcagaatccaacccaataagccaactgtccatgtgattcatacctacaggcagttgcagggggatgttcctttataagactcttgaagaaggcagagtttgggtctgtgaattactaggattatttaactcagggtgtgaaacccattctcatttcagaaacttagtgatgttttaaaattcaagacacacataaccagtttgccaagctctcaagttactcatcagaagtctgatagacactttcgggacgtgccaggccacctggtgccatttgccacattacaattccagtgtacttaagtggttcacaggaagtatatatatgaccaagctaagcccgtttatgtgggcttaattattttttaacatctggaaggtgggcacaccatgtttacacaggcttttctttttcttcccctattctggctctcttgacatttaaaaaagataaggcaaaagacatttttctaggatagataaagtattaaatttaagtgcagctggatgttcaccacgagctaggaggcctcttcttctctccgtctgatcaagtccctcacattcacactttgctctgtgttcctctccttccaagagcgagggagtgagggccagacagtgtccgccatgctcaggaatgaaacggcttctccacccagttgagacctcatctcccttctgacatttgtgaaaaacatctaaatccagagctatgacactgatcagccttataacccttctttggttaatgagaggtgtgaatctctaatctccaggaaggcacaaagcattaagtacctactgtatgtcagcttgctgggagtgaggatgagtgatctaggctcatatttgactaatctcccccacccttcctccatagcctatttcatacataaagattacctaataaaagaggaaattatgcaaataaatttaatataaaaagcaaattagggaatgactatcagaattattaattagaaccctgtttacacttattgtcaagcctcaccgtttttttttaaacgaaaggcccttagagcctgttactgagagatgtgtttgaatttcagaaagtagatgtgaatttcagtcttccattttttttagcagtgactgtttttgtatattgacagttgtgattaaggtttattcattggtattaatcaaataactaagtatttattcttagaaattgttttatttcctcataccgtccctcgattccatagttccattatggcacctcaattcacctggtttcccaagtgctaatcgtgggagttatcccatactcccctgttcccattattacgatagtcaagaagtcagcatgtcttctttttatttatttattttccaagatttttattcgagatgggttctcactccattgcccaggctggagttgtagtgacatgatcatagttaactgcagcctcaaactcctgggctcaagtgatcctcccgtctcagcctcctaagtagctgggactacaggcacgtgtcactacacctagctaatttaatttttaaaaaaaatattttttttttctgtggagacatagtctcactatgttgctcaggctggtcttgaacttttggtctcaagcaatcctcccacctcagcttcccaaagtgctgtgattataggcgtgagccaccacacgtgtgcccagccagtcagtacatcttgattctaactcctgaataacttacatcaggctcctcctttccatcctttgagtttagtccccatccccactataccttgcataaatgccccagtggactctctggtttgcctattatattcttcaggcgccccccaccctttcacctccatgcctaccctcatgacagactgatctttctaggtgataaatgcaaatttgatgatagcattcccatactttgctggtccttctttgactattgaatacaactcaatgcagcaacccattccattgaccagtgtttactgactgcctcctggtgtcagggactatattagatgctgacagtataatccccagttatagtggggtgaggtagatgctttaatagcttataaacttgggaatctgctgaattcaaatttatgttccttaaataaacctgccagatcccaccgggcacatgttggctcatgcttgtaatcccagtgctttgggaggcaaaggcaggaggatcgctttagactggaagttcaataccagcctgggcattatggtaaggacccatctctacaaaagaaatttttaaaaaattagccgggtgtggcgtagcatacctgtggtcccagctattccggaggctgaggcgggaagattgcttgagcgcaggagctggaggctacagtaagctatgatcacacctctgcatctgcacttagcctgtgtggcaaagtgagctcttgtctctaaaacaaagaaagaaaaacctgccagatccttcataacctcaccttaaccatccttcctctttcccgtgtattctacactatgtcatcataccaagctatcagaaatccagtaaacattttctgctctcttgatgctgtttcctctacctagaagtcctccatccctttcagttgcataattcctcctttccttttaacattgtttccaggcttcacgttttctgaggccattcccttgaacttcttatccccaggttgggttagataacccacttctttgcagccacttcaatttaggaatgcagatggtccccaatttacaatgattccacttaaaattttcagctttacgatggtgggaaagtgacatgtgttcagtagaagtcatacttcaagtagccatacacttattctgtttttcactttcagtacaatattcaatcagttacatgagatattcaacactttattataaaataggcatattaagtgcattttaagctgatgatatttttaacttatgatgagtttatcaggacatagcctcattgtaagttgagcacctgtagctctatcagatgacttcgcagacttttaaaaaattaatctgtcagactttcttttccgtttaagggtagggaccatgtctttcatctaagtgccttcctcactcatcatagttcttggcagtagcaggctctcagtaagcattcattggatgtacaaatgtccctggttcatgataacccttattgttatttcttctgatggatactaacctgtaatttatttattccagtatcaaatcatgtgggcttagctctcaaaccagtgcctcagtacagtatctattgttcctgctttgacataacctttcaaaaagattatttgcactaataatttacaccactaattttacggagttgttttatagaattggtacttgttatttgtccattggaaaacatgtattaaactactgtcaaaaaggtatctaaagattcaaagacagaaaatgcaaggaatcagtctcacacaagggtcatttctgaaaatcacaaataatcaaaattaaatcaaaggtcagaaaatcattttataagaggccagctaataaatatgttaggctttgtgggccatatggtctctgttgcagctactcgtctctgatggtgtaatgtggcagcagtcatagacaatatagaaatgaaaggccatggctatgctcccgtaaaactttattcataaaaactatgggcctgccttaaattacaaggttggacaaatattcagttaaggtgtatgcaagatggagaggtgattcagagtaaagagaaaccacacatttcatgttataagaaactgggaatggacagcttagaaagatgactttgttctcaccaaagttcaaaacagaattccaaaatacagatgagtagaagctgtcaggatcagataaagttagaaaagtctaaagagtgttttggctggtcattccagaaaagtgtaagaccaaaatgtggggaagtatttttgttaaaagcatccaagaatgttgcaaccttggtgacaatttactattacataaagagaaaagatgaaaaatatattagaaaaaatatgcctttcctgtatagactatttttagtcaatattcctttggagtcatagtttattactgattattttcgattcgcttacatataaatgcaaaaagaaaatgtgctaaatgcaacactgaggatgctgtcattgatttttttatccacagaatttaactgatttttgtttgttttcttaattctagcaccaatagctgcaggaactggcccaaatttttctctctcagatttggaaagttcttcatactacagcatgagtccaggagcaatgaggaggtctttacccagcacatcctctacgaggtaattttattggcagctcttgaagaaattatgctacatggttgcacaccttgattttaactctgggcccactatggatttagcaatgcgcctttagtaatagaagataacaaagtagtgggttcagccccaaaagactgtcggtctcgttggggagataaagcaaatatgcatgtggcaagattaaatacacacacacacacacacacacacacacgcacacacactaaaaaactgtgaactaaattgtgtgacacaggctaaaaatagttaaagagagctttatgcaaaaagaataccttgtttccagctctaaatgttggttagggttggtgagatagaaaggaaaaggaatggaattctgggtggggtgaaaaatgagcaaaggcttggaggaaggatggatgatgaacataacatgttctcaggaaatgaaggacaaggctggactgcagcaaagggcatatgttttggcttgtttggcaggaagtgaacactggtgacagtctcagtgtcatgcccacagcagacattacagctcagtgccagctcttttcccaccgagcccccaaagctctcaatatccagtttactggagttgccctaaaaggtgaaacccatttgatatcctggtgtgaggttatacaaatggaagtagtcacttgcataacctcaagtgagggtggggccagaccacagaccccattgtattgagagaccttaaaaacagtaaagctagagtagtgtaacctgataatgattctggggttcttgctccctttaacgtcacaaagccaaaatcaaaatgaagcatttttgcaagatcgtgttgtctctagataacctgtaccagagggaaagggattaggcattaaacccacagtattcttttacaaattggctttagcactggactgtgacaacaaagaatagaatggtacagaacgatctttaatgtttgtgtactttgcagaaaaatgtctgacaaaggtatattcctcctaaagcaagtacctgagtcttatgatttaaaacaatgcccaaattatagaacttttccttggtgcacactcgttcttaccttgcctttatatattttaaacatcactactttaaaaaaaagatcaacttagtcatccctaataccttgaagacagttaaagaaacaggtattcccttaatataactatcaaatcctaccatcatctttcatgttgtttaaatgttccctttagttccctgtagtatcagctcctcagggggacaaaaaagtcacacatccaaagtatatttataatagaagaaagagattgtgaatatatttgggtgttcatacattttgaggattttgaatgtttgctgatgggagagaccttgtgtgtaactgtactcagtcaacatgaaaaagctttgcaaatacctgtgggcagtgattaatttaaaagtttatgggctgtttgtttttcatgtgtgtgctgtatgtgtaccatgtacctcccaaacagtgtttccccctttttatgttttcacacaattctccagctatgttttattatcttttgtgactctctgagaggaaagctcattatgaatgtcatttaaaaggccagtgtcgttctcatattctgcaaataactaaccctgataaggagctaattataacctgcatcagtagttaataacccggtaatatgtttgttttactctcattaggctcttcctaggatgatttttaaaattctttaaatacatagattcagcagaattaacgatgtacaggttagaaagtgtgcccagaagaatatctcagatttatatatagaaatgttcaccgatcaatatgtcttcctgctgtgccaatattaatgggtcattttctctgtggcaggcaccatattaggtgagttgtatacctgttctgatttattcttcacaataatttgacaacacacacagtgttttcatttaaacagtggagcaacacaaagctcagagaagttaagtaacttgcccaaagtcacagtcctagtgaatagaggagtctccattcacactcaggtctgttggaactttaaaaatatgctcttttcacacagaatcctcttgagaataggactgactcttttagtaaggaacaacagaatatgaggtcctaaaaaaggagtttctagcatctctattcctccctggcatttagtgtttgccgtcttgagttattcttaaccatctttgaggccaacacgtgtgcagcctccccatctagacagtgagtcccttgaacgacagcgtctagctcttcccattcagcagcgaacgttattagtaagaaacaaggacaccgtccttggcaccatgggtgtaaagtcaaataagaggggctttacaatctagtggtagagactgagaagtgggaattttcagttcagggtcctatgaacactcaggaaagttaaggcattttgcagtcttaggaatgctaagtaagacttctaggccgtaattacacagagtaggaattaagatatttggaattagggtaatacttttaccttattttttagatataattgctagaaatacaagaaaaaattccacatacaagaagaaatagtgcatcactccttaggagaatattcatccttttcgtgtagatcttacagatactttcctgcttccctcaagtgtttctgggaaaatgagtgtgttagaaagagcaagaaaccaaaatcaatgactgattcatttcaatagatagataggtaggtagataatgtgatgcaatggtactgactgtaagttctgtaccccttcagggtaaacatcttcaaaatcatagaaagagcagtgtaaaaattgggatacgatacattttttattccaaaaaactttatcaagataaaccagctgtcaaaagtttgtgaagtcagagtaaagttgtctcggaagcctccacctgtgcttcctaacttgcttcattcctgatctttttatcttttccatgctccctccagatgttaatttttttttttctccaatagagacagagtctctttctattacccaaggtgagtgcagtgatcataattcactgcaacctcgaagtcccgagctcaagcaattctcctgcctcagcctttgaagtagctaggactgtaggcatctgccaccacacgcggctgatttaaaaaatatttttttttgtaaagacaaggtctcgctatgttgcccacggtggtctctcaactcctggcttcaagtgatcctcctgccttggcctcccaaagtgttggaattataggtgtgagccaccatgcccagccctcttttgtcaacttctgaaaatccttgctttcaaactaaggcatcaaccgatagctatagaatctttcaactctaggatttaatactggcttggggtatttgcattttattagaggatgccaaggaaatcaaaacctttaaaaactcagaaaagtatcaataatgggagaatgatggacaatggagttggcctttggggctagatctaactgaattatacttggatgaatccatgtcacatgtatttgtatggctgtttctaagtcagtagcccaattcagcagttttttagtatcttctgttagccagacactgtggtaggcactagagattaaaaagtatatagtcattttccctgaagatcttacagccccatcagaacatataggcttctcattttatttgccagagtacttcagggaaatgtttatttttttctaacatgtattctttctgtttccaagatgatttccagtggctttccattttaaaacaacaggtaatattaaatgtagaaagaggccagaaaccatgtggaaaaaaattgttatagcaggagcctgaaccaagagttatgccttaagtttagccctgagcttcctggttgccaaggcaaaaagggttatatagtttgcatttctaataaaaggatacaagataaatttgttcaaagagaccatatttttctgattatgttttgtaaggaattcgctgtgtatatcgtcttataaaggactcccattagatgtagttttacataaaatatagaaaagttcttcagtggctatttttcattgaactttcaaggaaagcccagcaaagaacattaaataagcattaaaggcatttcctttgagtactaagctagcatggcacagttatgttgctttcctgtggtctggctttaatgagaatagaacttaatggctaagaatactggaatgccaacattaataattagaatttcttgccataaattggccctccacattttttcattcagattgctgcaatagcttaactgtctccctgccctaggctccattttcctgttttcccctttgcctttctaaatctatcatctgcacaattaccaaagtaacttttctaaaatataactcccctgtcattccctgtttagattatttcggggagtctacattgcttataggagaaagtccagacgtgcaatatcttctataacctccacccttctcactcgctgtgccccttcttccccacctcagccatcctaaacagctggcagttctctgaacatatcacacttcactcacaatgtggcttcttcctgataggctcctcccttctgggggttatgttcgaaatatctgataacctgtgtgacatgagcataccaattagaacagacactgccctgcttgcagggctttctttggctaggtcctggaatgctcctgatctgcaagacattaaccctttagatttcggactgtgagggtgtctgggacaaagaaggggaggcaaggttggaagaaatgtatggagtttaagacaatgacagtttgcccattgataatatttttaataccaaatggctgcctgagtggtacatcagctgtagagcagccctgcctctgccctttccttcattcttccctgtctccttgaccctcttgaagatagctcaggagccatttcctccaggaagcctttcccgaacccctggctcatcactgtctccattgtgtgacccactgtaccctgtgtgtggttccatcataactcctatatttctcttttgcacagttttgtttgcctctctgtctccatgtctgactcatctctatatcccagcactttgcacagcacctggcatgtaggatgcgcacagtaggtatttcatgaatgaaacatacgaaaacttctgtcccctgaaacgtgaagaagagatttcccaacacgcactcccagtagatatgaaatctactcatcctaataatatgggtagatttgacagttttatcacccctgcaaacttcctgattctgtggcattcaattaaaacaactacagcaagcatagcagcaggcggcatttcactacgttttcactcctgaagcctcaaactggggagaatattcagtccttcaactggaaaaaatgagatatattctgaaagtttcttgaccgtacctctccaaaaaatgaaaatccctaccctgatggaataaaactttgttttgataatctttgcatagagaaagcacataaaagtcattgggccactctttttttatgtctcttgttctcaggggacagagcactccttcttccttcctttttatttgttttgttcactgatttatttctagtatttagagcaggacctggactagctgtgcagtaaatgtttttttgaatgaacaactccaagtggaagatgggaaaatgtggcaaaagaaaaaaaaagcaatccaaacttttcattttcttttcttttctttctttctttttttttttttttttttttttttgagacagaatcttgctctgtcgcccagggttgagtgcagtggcacgatctcggctcactgcaacctccacctctcaattcaagcaattgtcctgcctcagcctcccgagtagctgggattacaggtgcctgccaccacacccagctaatttttgcacttttagtagagataggattttaccatgttggccaggatggtctcaaactcctgacctcaagtgtgatcagcctgccttggcctcccaaagtcctgggattacaggcttgagccaccatgcccagcccaatccaagcttttcctgaaggatcacgagccctgctttttatcctttctgaggttccagcagggattaaattgatgcccaggttcattgctgatggccaggccccagccaccacctgtggagataggaaatatgtggccttactcccaacacttccaggtggaggcaggagctagagccagccgcttattcctcaaaggaaacaggaacaggatgtggcagcagcagcaacttgattgacaataaaaatcaaactcagacacttggaacaacacagacccaagactttgttctacatccagtgactcaccagactgaacagaagtttaaaaggagtcctagaactacattaagttgcccaattgcttcctcccttggctttctttcaaccagaggtgcagtgtccaagagaaaggtggttgcgattgcttttaaacatgcacccatttgttatttcagctccacaaagcgcctcaagtctgtggaggatgaaatggacagtcctggtgaggagccattttatacaggccaagggcgctccccaggaagtggcagtcagtcaagtggatggcatgaagtggagccaggtaagcagagtggcggcacgggcatgtggctaacactgtgaaactgaaaatacgtgtggggtcccatgccacgcataaaagtgaagaaagaaagctcaaggtagttcactttttcaggatgagcacttgtttgtattgtaatctgattgccacattcataaaaggatggctgtgcaaagcagtagtaattcaactgaaatgcaagactggtgagatggtgtatgattttctgctcttacatattttcccctacaccacaatccagcatttgatttgcttttggtttttttgtttgttttgttttgtttgtttgtttgcttttttgagacagagtcttgccctgtcgcccgggctggagtacagtggcatgatcttggctcactgcaacctccttctccctggttcctccttcttctgcctcagcctcccgagtagctgggattacaggcacctgccaccacgcctggctaattttttgtatttttagtagagacggggtttcaccatgttggccaagctggtcaatttttgtatttttaaaagagacggggtttcaccatgttggccaggctggtctcaaactcctgaccttgtgattcacccacctcggcctcccaattgtttttgtttttatactatcttttggtttagtttttgaaattatcttttaatcctaataaaaatctatcaactttttcagcaggatcgataacattcgaaagaagaatgggttccttgcgatagtttagactcagatttttatataataaggacactttgcaatatttttcctattactggatatcatcatgattatttttctatttaaatggaacaactctctttattctgatctgtactaaactgaacaaatgatgactgctggtctaatctcctggggtagtctaatcttggctctggagtcttgggagtaatatggataagtctgattgcaaaaactatttgaaaccctttccaatgtctaacacgtggtttagagggaatcttctccaaagcttcctgaatatggcaagtccaatgggtataaaggatagagtatgtgccttgaaatcagacagttggagtgccaacctggcttcaactcctgctggctgtgtgattgtgggcaagttacctagcctctctgagcctgtgtctccctttttataatctgacagtactaatagctatttcctagcatagctactacctagcatagagtaagtatgaaaatactgttctatggccatccttccccagcttttgcttcagagttaattccctgcaagtacagacgagcaccaagaaaatttctgaaccaacctcttcatctataaatcctagctcccttgtctcctcccttaattttttttcaaaagacaatgctcaggggatgtgactataaaggtgtagcacggggaaaatgttggggtgatagaaccattctgtatcctgattgtggtggtcacagtaatctatacaatcgttaacattcacagaagtacatacctccctgctcaagttaattttactgtatcataattaaacacaaaacaaaaacacctcaggcccattggcggtgtcttttatcttgcccctgctattaaaatgcaaaaatgtctctttgctttgcttctgcctagtctttcattcattcactcattggatagtcttcactggggactttctctgtatgaagcactatgccaggttctgggaactcaaggatagatgggaaggttatggcccctgctctcaaggaattcacagtcagaggtgggaaacaaacacataagcagatcattatacggtgatatgggaagcgcagagatggtggtgttagtcttccgtgacttctgtttctaattagtaccaaccacagcactcaaggtgtggtggttcttctatgaaggtcacacatcatcttttctccgaattcgtgttcacatcagtttgcctaaagtgcctaagaaatagtcccagccctaaatgagaaggaaaatgctgactctcactgccactacccgcatcatcagcatgacctctatatagtgccaatgaaaagtttatgtgctattaaaaaattaaaagatggaaaacttctttgaaccctttttcaaaggctaattagagccctagtcaatttacctgcttcagtgaaaatcagaattaaacatataggtttggtacatttgtgcttgattattgtgtagatgcatttttgtgcatattgaagctgctttattaggttgaggtactcagagctcccccatcatgaggctgagctctaggtccttgcatttaattcctctgggtatattgggggctgtggaggttgattgataattacagaatattttgacctagtgactcttttattcagggcaattcctattcctatctgtacattatgattcaaacgatcataaattttaacatttgaatacctgaatcctttgtagtcattaaataactgaagtttaatggctgaatcctttttggtaagaggtgtgtgtgtgtgtgtgtgtgtgtgtgtgtgtgtgtgtgtgtgtacgtacacatatatattcttagagaatccctcacagttgtattcctggactgactctccattctctatccccatttcattacagaaaaatgcagtttcatggtatatgtttatagggagtgatagaggacagtggataaacgtacatttggccatactcagcaagcgcagaaagtcataattgcaacaaggcctgaggggacattaaaactcaactgaaggatgttgcacatgttcttggtgactttggtgtcattaactcacaccagccattttaaatggataatttatgctgccagatggtcctttttggggattttccataaagcccaatcccctttttggcacagagagcacctttatgttgttcccacacttatgcaggcctgcatagcttttccccaggggtacagttaaattgagtaggaggcttttagtagttcacatgtaaattaccttcagaaatatgttgggagttatgtatatctgaatgcaccagcagcctcttggttgcctacatttgggataattctctcaaacaagtactaaggatactgtgtttaggcctcagatgtgacacaggaagcaaggcctgtacctgctcctcactcagaatgctttggtttccgtttacctgccttaaaatgcttttccaggactccctggccaaaagagggccaaaggttgccagaagagacaaatttcctagagcaacaggaagattgtggaaagtaaaacaaaccagacatgcagtaaattacatgggctatttcaaatgtcttttgtagtatcctgttccccattagtttatctcagcacttttagtgcacagctcttattatctgggaagaagggcataggagattaaagatgatgttagtttaaaaacatcagacaacttcagaatgactttcgcttctcttacaatgctgcatttgtctctcgtacttagttttgtttcccagttatctcaaaactgggttagatacgaagctttgaagcaaatcatgaattgacaaaacgagtcctatgaaattctatcaagcacaaatgcacatatcatcaactcttgtttatctgtacaaatgaagaattacagagaaattgataatgcagataaacaggaaagaaaccaatacacagcgcccacattgggtcagacactcatgttgctttcaaatatatggaaaaattctagttacaattgagtacctactgtgtaccaggtttttaaaaaattaacctcctttaaaatatgcaaaatataatgatcctgcctctaaagagataaaaactgagactcataaaaggtcaagtgacttgcccaagcccacacagatagtaaatctgtggatccaaaatccatatttgaaaccaaatctgacttcatagtctaagtttatcttctacactcagtaacctcttttaccataaacatttggagcagcattttagggtctcatgtcctggactggtactttagttaaaacgttataaagccgggtgtgatggctcacgcctgtaatcccagcactttgggaggccgaggtggacggatcacctgaggttgggagttcgagaccagcctgaccaacatggagaaaccccatctctactaaaaatacaaaattagctgcgcatggtgctgcatgcctataatcccagctactcgggaggctgaggcaggagaattggttgaacctgggaggtggaggttgcagtgaaccgagatcgtgccattgcactccagcctgggcaacaagagcaaaactccgtcaaaaaaaaaaaaaattataataagaaacaataaataactcatgagagagacctgaaaaatattcgattttccttatcccaaagccttgtaatacaacttaatctagagaagaaatatagattattaaatatacataggacacaatatataagcaaagagtattaactgttaacaaagtaaactatcgttttcatttataaaatcaaataaccctcagcagttaggtctttgttcaaatagtagctcatcacacaggccctcagtgatctaaaatagctgctgaccctcactccatcatcctataactcacaacactgttttgctttctttacatctgcatctactattttttttttttttctgagacagagtcttgctctatcgcccaggctggagtgcagtggcgcgatctcagctcactgcaacctccacctccgggttcaggtgattctcctgcctcagcctcccgagcaggtaggactacaggtgcatgccaccatgcctggctaatttttgtatttttagtagagacagggtttcatcatattggccaggctagtctcaaactcctggcctcaagtgatcctcctgcctcagcctcccaaagtgctgggattaccagtgtgagcccaccacgccaggccatctctctgctattattgtctgttttctctctctagaatatatacttcatgaacagtgggacttagtctgtcttttccattgctgtatctctaacatccataacagtgtctagcacataataggtattcaataaatattgattgaatgaatgaagcgataaagcagagaatttggggtgctttcaataaacttgaaagcagaatttgctatcaagaatactctcagaattggtgtttactacactttcaatttgtaggctttcagtcaaatccaattactagcaagtcgtaagcagaacaattgcttaggctcagccaaggacctcttgacgagcagcagtgcattgactttattacaagtatccctcacctgaaagtgtgttcctttaagtgaatcaaaccttttttaaaaaaacaaataataattctgtattatttctaagtttgttgtttagtattagctccgtattaagaatcccaacagtgaatcctttgtagaacattttatgtagtatagacaacctccctgacttacctgtgaaaaattcagatttccataccaaatgttctcttctacaagtgtaaggagcacccatatgagacacttcagacccttgctgctccaagtgtggtctgaggacctgcaacatggcatcacctgggggcttactaaaaatagagaaccctggccgggcatggggcccaaggtgggaggattgcttgaggccaggagcttgagatcagcctaagtaacatagcaggaccctgtctctacaaaaaaaaatttttaattagccatgcataatggtgtgtgcccgtagtcccagctacttgggaggctgaggcaggaggcttgcttgagccgaggaactcaaggttacagtgagctatgattgtgccattgcactccagcctgagcaacagagtgagaccctgtctcaaaagaaaagagaaacaaacagaaaaacagaatctcacgccccacctagaccaacagaattttaacaagatctcccggtgatgcttgtgcatgttacactttgcaaagcactgatttaggctgcttttttgttcctttaggtgggttctccctactcagtacttgtctggaagccaccttaactttaaatgtcacgctctccaaccgttctctctatgttaaagtaggttctctttaaaacaattctagataggtagaaatctagcctattttcaaatagattagaaaagattggattctgggtgactctagatacctcactataagaaaaacaattctcttgtctccctctctgtcccatattcctccagtttagggcctgctgcatgaaaaggaatggctggtcttctaatcattatcattaaagtcaagccaagttgttgaatccttattaagtgctgattgtatgcagtatactagagtagatacagagaggactccagcaagtccctgtctccaagggcaaacctctgaatttcctcaagtgtcagtcactacctgtaaggtgggaactgttccttctgctccatctctgtcacaaagttatgacagatgaggtaatgaagtccaaagtcctttgtgaaaattaatattctctaatcacgtgaaatatcatcattaggattactgaggcagccaggcttacccagctgagggtagttgaaagcagacagggttaagtgtcacaggagtaaaagaaaagagctgttaaatctggagaataagggatagtttccttaaaaggtggcaattaaactggatttagatggaatcagactgagaaatgttcaagtctcacttgaaagtgagacttgtctcttagtcttttgattgttagtatatataaatttaagtcttcttcctaagttgaaaggcagctctgtggctgttctgtgagcctttctcaggttatatttgtccccgaagttaacgatttataccaggggtccagtgggcttcatggatgactgcgttgcaccactttcagatttgagaccgcatctgcattaagtacagacatatcagtaagttttggcagacctaaaaagtaaagcaaatttttttattgtaaaaaaaaatgaaattacagtacttttcagtgaagttcagtactgtgtttcaaatatatgcataagaagctacttaaattttctcctgtagaaaaacattcaaaattccaaatgccttcaattatactgggattgtaaaacaattaacagacacagttacatccaccaacatgttgaaagtttcaaaacagtttagtgaaagttttgaagtcaaatttgataaggaataaatttagttttatttttataaataacttttggagatacatttctctgcaaagagtaagttgttctcatttttgaaggtcaaaattaagtactttaggccgagcacaatggctcacacctgtaatcccagcactttgggaggccgaggtgggcagatcacttgaggtcaggagtttgagacctgcctggccaacatggtgagaccccatctctgctaaaaacacaaaatttagctgggcgtggcggcgccctcctgtaatcccagctactagggaggctgaggcaggagaatcgcttgaacccaggaggcagaggttgcagtgagtcaagattgtgccattgcactccagtctgggcgacaagaacaaaactcctgtctgaaaaacaaaaatgaagtattttaataacatgttctctgttcctatcacaatgattaagaaacacagttttaaaaaattgtttaaaggcatctgtcaaagaatatttcggtaaacatctggtcagtcagcgacccagggcattcagaactaggggtcagtgtcacaactactggcagcatagttgaattttgcagacttatgttagtcattgtaattttaaatatcacatattaggttcacctggattcccaactctgctggtcctaatttgactgccaacagtcatttatcaattgtaagagtggaggaagtctaccaacttagatttctagctgagacacaggggaaacccattatcagtgccagtaaaaaggcagcgactggtaacaatagtgctttgatcatggacactccactgcactagcatatattagagaaaatgattaaatctcccatcatctcttgctggagtaggaatagtcactgctacagaacattgccatgggatcgatgtcttggcttttcttctgcatttatggagcagtaggaaagcatcatctgggaccacatcctcttctatgatctcatattggcacctgcccattagagactggtacaccaggggacattggtacagtaacaaggggcctcttctttacgaacccttctttatcagagaaatttcacccaaataaggggttatgacaggaaagctgtattaccaaatgagcactgtaaccacccttcaaaaatcccttgccttctttatcaaggctgttttttcttaatgtcagaaaagggcctaaaacagctccttgtaattggagtctaaaaggttacctcttagaggaaaagaaatattcttctcatacacacacacatatactctgtgtatgtgttatatacatatataataaagcatgatccagaaaactgtttggattcctgaagcctctagtacctggcgacttagtagccattcaatcaatatttgtttaataaataagtaaataataagatggagatcacacacgtctcactttgtccttcgagtaggatcaagcgctcagaagcagagcgatgtatacgtttgtcgaacgaatgagcgttgctccgcttgcatcggagaacccagatgtacaattttgtgaatgcagaagctctcaggaaaacagatgctgcatttcagctggtcttgtctgaataaataaattacccaaatctccaaatttttaatttcatgtttgaaaatgaagctgtgtaaatattctagaaggggaggaagaaggagatgcagtgtatacattaggtttatatgtgaaatcctcctccctgtgcctgtcaccatcctcagtacagcccccgtggctcaggtggccaactcatggtgtggcttgggtggagcatactgtaaagaggaacattaaagcaaatttcattccaaccacagcaatcttcataggcttgctggggaggaagataagtgagaaatagaatgtattttaaagaggaaaaagtacaaattaagaattttaaaagttagtcattctcatattctgccatgagcaagcctgagaattttagcaaactacttctctgaattttcatttcctcatatgtaaacattgaggacaataaaacagccttgccttcctaactcatagctttgaaaagatcaaatgagatgataagaacaagagctgccatttattaagcatcagctctgtgtaaaagtatcgtgcagggcactatacatatttttaatatacgcaaagtatatttaataaatcaaaatgctgtaaagaaatactgtatatcctttttagggggtaaatactttgaaaaccctaaacttactgtatgaatttaagatactgtgaaatttatttgataacatatattacacctctgcatctattatatgcaaagcactgtgcaaaaatgatagaagaagtatgaaaataagcaaaacagaacttgccttcaaagagcttacagcccagtgaaggaaggaagggtaactggttaaataagtacccaatggctgtaatagataagatgtagagcacagcaagcttcatatgggtgaggagtttattcagcggcttagaccacagtcctctgctgtgcctgcttaaaatagctggtgcatcagccatttcatcgttaaaggagcagcagtgaatactggcccgtttccttcgtttcgtaatatcagagtcgaatcttactccatctctaagaagcttctagagagctgacatactaggaagtcctcaagaagtgcatatacaaaaatacagtttatcatactatactcatggacccaaatctcccctgcctgaaacagacagttttctgatttgtagataatagattgggtagaatacaagcaaataatttacttggagggaacaaaattaatctgaatggagattaaattcaccagagggtagaataaccagaaagtgtagttggaagaggaggaaggaaagaaaaaagacagagcgatcattgatagaaagataatagatcagacttacctaagagtataccatgttttcctatatctaatattatttaaatatttatagaacttaaattgaaggtagttttaaccatagatataaagatgaaaatactttagtgatcttacttcctgcgttctatcatataaacacagtgtagctattttatagactcaagacaagttgattaacaataaatatatattggcttgtattttgtcactgctgctgaaattttaaatatataagcgttttataagtaatagcaataactgatgtttattgagcacttactatgggccacacattgttctaagctatatgcacacatatataaatatatatgtgtgcatacatatacattcatttaatttgtaaaaaagtgataccactaatactattgtttgcagacttatttccctctctcatagggtcttatatttttcctacatactgatgattctctttaaacgttaaataacctaatatagcaccatcagtttatatggaaataaagttctgtggtttttggccatcaatgtttttaacaaagtagtttgttaacactccagaataagtggcttttacatggggaattggggagagagggaagaaataagtccttggtctgtgcagatcccagaagtcaatcaatagtgtgtgcagcacgctgctgtgcagcagtttctcatgaggctgtgcacatcccaattgctttctgctcagcagaggattacaataatgcctatttatccagctctgtccatccaaggattttagatacatcataaactcatcaattaatcagagacatggcacccatttcaaaatgctgggagaattacatcctggaagattacgagaaatgctcacgtcgacagagtaaatcaagaactatttcctgatggattcctgaatggcacaccaagtactgaaatgaagagggctgtctccagcactgattcacaaagtatatctcaagtggaagaaaacttccggaataaaacgtcactttactttgaagcatctgttaaacttgaaaaattaaactgaggtagaatggcaaagctcattaaatattaatacaattaattggcttccctcttcagagtaaagtatcactgacctccctttcttaacaattaaaacccctctgaaacctttgggttttttaaatacagtgtaactttggttcttgattctctggtctttgtcaagtgaggaattcttcctgtggtccagcacgctcagcccactgtggggaactggctttccagacagctgtgaatgttcggtatttattcagacaatactcccacactttgatgatttactgtggtccaagcatcttgttcctcattttgaagaaacattccagtctgtaggtatcgtctactttgtatgtaatgagaggtagtttaaagttttcatttgcgtagctggaagtgcactcacgtcattagaaattcaaggaatggcaactcaatatccatttctaatctgaagggtcttccctgcccctgccatgttagccccacccagaaatcacttaactatgattagcttccaagattagtgaattctaggatagcaggattacttatgacttaatgccagtcagaatttgccatctgcctttcagccatttcatgaacccagcagaagagagcatttatcaaaatggctgtgcaacacccctcatgtcttaacactctttagggacttatataagcaacacttcatgttcgaatgtcaaaatccacgtgtaaggcttaaaagtagtatgggatgcttaagaatgcttttcagggccagttattctttgatatttatcacttcatggtgctgacacctgcttctaattttaagagttcgttcttccagtggatttttttttccttcagaaatcttatcctcaaaagacttaactagcaatttttctttttttgatgtgcttgatgttttgatgagtttgtctatcagcattgaaaccttaacatacctttcatttagaataaaaaaaaatctttgtgacacacatttattatattggatcacataaatttttgccctggcagtacattcgaagacttttgcagagatataatttattagaaatgtcattatctgccacttggcctacttgatagttgtcttaagttgacaaaagctatagacatagataaagtcttccttgagggagcaattcagtaaataactttcacccaatacccttatttggttgtctttcacacccaagggtcaggttggtggcaattgtcatttgagagttagtaagtggaaagacaaagacagagaggaacctagttttgtctattgagacacatatggaaatagtcctttggtttgggtgtagccagcctagttgtagtgcccaatgtggtttgctttcttgtttttatcttgtctaaagacctttccctcacaagtttcctcacaagtgctggataaagttcattgcatgagtagaagaagccgcaaaagatgatatatagctagcaacccgttctgattggtctatgaagagttgcctgtataaaattggatccttgtgttcggttccaaaaaaaggtgtgaatgtgaagaagaagtgttaaatcatgactccagagaaaatgtcggccatgagcagtttttagtttaagtgaaaaccaaactttaggatttggacaaataagatgaggagaaaaaagggtgaatcattaactccaatatgaaaggattatggtgatcaagtttcacccaacttgaataagaaacccaacaaagactatgactgatggaactaactcatttacttaattgatatgccaaactctgccaagcatttacccttagtgtcaaataagtaatttttaataaaatatttctaagatatgaagacagttaagaaaatagcatgctttttaataattgtactcataagtaaatggatcattacattgtcacaaagaatgacagtgagcagaaacagcctgctaatccctcttagataagtatttaacataattagacagacaccatctcttctgttgaatgtagcattaatcattagaagtgcaactttacacagcatacttgtttctgatatgtcattgttgttaaaaaaaaaaaagcaaactattttgtcagatacagtgcttcagaaaatgactcatgtagttgtgtgatttacataaatacagttatttccctttttattgttttttgtttgctttaatagtgtttaatagtagtgtggtccttttacatccatgaagctgcatttgaggtaagtggttcatacattttgttttgcaaaatatcagtatagtgaacatacttgaatttgaagtatttttaagctttgaagggatcttttggctcatctacctaaactgaaggcacaactctttcagagaaaggttttcttataaggaatgggctagaagttttctgcattaaataagagctgaagagagaacctctttctattaaaaatttgaggttaaaatgatggaatgtattgccctcttccagtattcataagcactacctttaaaaaaattcattttcttttgctgtgtagcttctagcttgaactatgaactacggaatacttataaagtgatagcagctcaattcattgcacaacgctagcttcccactttctctgtgattcaaaggccttcgaaggcaaagaatggggttattgaaggatggcaggcagatttcactaagtaacaggtggaggtcaaagcagtttatttgtgggatgaacagagtgcagagatgaaaaagcaaatgctttgccataataagatttagcaagaaaatgctgacaacacgaagccttagattctagctgacagaaccttttctcgtgttcattacttgatttcacagttcaagcaatttgaagagggctaaaattttctttctttttcccttatgaaatgtttcaatcagtttcaaatttttactttagctgggttctctgcttgtatccaaggaacactggaattaatagagctccagcacaggcgtatcccaaacatggaccctcacagactatgcatctctttcaaattaaattttatccataggacccttaagctctagctctctatcatgttttaactgacagaagagagtatatttaagtaaatactaaagttcacatcatcaaggctaatgttatatgccaacgaaagtattcataagggtgttaaccaagcttgaacactgagttacttccagcttgttggagatggagaggaaaagctttcatttttttcccattatacagttctatatttgtacagtgaatatgtttcgcttttggaagttaaaaaaaaaaagactaaacatgctgaacaatacaaaataaggtttatctactgttgtacagcatgaccaaaaaagtaaaaagttatttggtatcatatcatagagaccagagctgtccaatagaattttctgcagtgatagagatgttctgtgtctatactatccagtattctaaccatgagccacatatggctactaagcccttgcaatgtggctatgctgagcaacttaatttttaaattcatttaattttaattaatttagatttaagtagccacatgtggctagtagctaccatattgggcagggcagatataagccaaacatatgtatgattgagttttttactattcagctggatatctaaggagaatgaataaaacattatgctattttatactatatgtattgtttatgcaaagaaataatttggttttctcagaaatgtcttctttatcctcagtccttctgtgaatgcgtataattgctatgttgagctaaaatcagtcctttcctgaacacatggggggatgggatggctagggggcagatggaatgggtagggaatctccaacctcttgtaagtatatggagcatgtaacacaattttttttatttcagtcctgtcactggggtgtctgtgtttaccttgaaaggagaggaaatcccccaactagtcaagagattttatttttggcccagaaaccagatttttatatgacattttccttgtgtctattctttactctctctggttgtaaattttcactcacaaatgaacatttggaatatattacagaactcatcgtttctttccccctgaataatccatgtaatttttactccatactcccattttttaaaaactgaagaaatcactgatgtccccaagccatttaaattacctgaacttctttatgatgtgataattctttgggagtccttttagctcattttcaatggctacatatagagtaagaaggataaacctcagaagctatattaactttcatttatgctctctatcataaaaatgattttaaaacatttttattgactgaaaaaggctaaaagtcaaaatagtctattttacctttttatcgttgagtgtgctaatcataaaaaattatattagaatgaactctaatggattttatcattaggacacacatctaacaaacgtgtggtgtcttcaacgacctccttgtatcacgcagcctgtgtttatgctcacaagaacagaatggtcccttaaccgtgggattcttctgttcagtcacagcctttatttggcatcatggttagagataatctaattacaaggtatactttaaatggttctagaaaggtcttgttcctgcctgtgggggaattactagagtgcagtatagctctgcatctggaagagatgtgtctgagtgtaaatctgatggtggatgacttgcaaaagatggtactggtactcagcattcatgctgggcttgagaaatgtcactgaaatttatgtggacaccattagtctgatggacatgactgagctgtctgttccccacacttagatctagtggagtaggggaatctgaatgcctgagtgtaaaaaagagtcacaaagcagttagcatcattaagacttggaatgtttgcaagaagaaacatgttcaagtgtcattaatagttcagatttaaatcagctcatgataggtttgtattgataagatacataagtagtactcccccgcgccctcacccagaagtagggatcttggtagcatggtacactgaaaggagcaagagctttggtttcctgggttcaaatcctggctcctccactcactgattgtgtagcctctcaccttcttaaggactgcactgcctcaggcaccctctcttctctgagtcatggctttctgcctgtctgctggaccattcccatcagtagacaagcatgctggactctctcccaccttcagaaagctatcccttgcttccctccctcttcctgtagccactaccctatttttctgctctcctgtgcagattcctccttcgtttcatggaagttgactacaccatttcccctgtttcttcacttcccattgattttataaaccatgctatcctgtcttctatgtgcctcactctcctggaactcacttttcaagactgtcagaaacattcatgttgccaaatccagtggacccttttctgtcctcattatacgtgatctctcagtggcattcaactcagttgattgcagccttctccttgaaacacttcttagtttctataaagatatactctccaatgagttaaatgcctcaacttagttgcctgtttagatgctgactttagacactcgggggccttccttgatttttacacattactgaattctaaataattgtgtgtgtgttatagcctctggttaagtgagctatttattactgcattgtaatatatagtctaggcttggacactatcaacaagtcttaagagaagaatttttgtcctttcttgttatagatagataacatggtttgcaggaggctttatagaaaaagcaacttgttgaataggcaagaggcctatagtaaatataaaacatttatatactcttttgcaactcaacatctggggtcattatcttcttctaaatctatgtgatatttattttgtggaggttctgtgttagaatcgctgataattcattcagtgtgtgtttgataaaatcttaactgatccttactaaggccaagagaaaactttgatatataagacaaatgattcctagtatacttcagagtgggtttttttgcatacacttttgtatctgatatacccttcctttttttccccctttggataaccaaatttaaaacttcagctataaatatactttattgacttaaataggacactgtttttatagtatactagggaaactacatgagggttttataaaatgtatgcacttgagaaccagagagacctggatctgcagtaccatctaatagctgtatgatcctagacaaattgtttaacatcacttgatatctaatttctgtaatattaagttattggtagaaaagataataatacctacctatctcagatgaaaatgtaaggatttggggatggacacggtggcttatgcctgtaatcccagcactttgggaggccaaggtgggtggatcacctgaggtctggagttcgagaccagcttggccaacatggtgaaaccctgtatctactaaaaaaaaaaatacaaaaattagccgggtatggtggcatgtgcctgtagacccagctactcaggaggctgaggcaggagaattgcttgaaccagggaggcagaggttgcagtgagccaagattgcaccactgcactccagcctgggtaacagaccgagactccatctcaaaaaaaagaaagaaagagaagaaaatgtaaggatttgagatatttataagtacatggcacatagtgggcacttcataatttgtagcttttattattttcagcctggtttttggacgtgatcgacatgcagagatttaatctctgtagctgcctcctgcctctcttgaggccacttgatggatgaaggcttccagttgcctttaagcctttaagtttggtgtaatcgttgttctggtaataacagttataaaaataggttgttgggaattagatgatgacaatgaacaggacactatccaagtcatgaacaattaaacttgtaacattttggggtcctctctaacctgcttattgtattggatttaaaaactaaagtgctgaggttgcttgctttcagagtttctctccgtttgtgactataaatgaacattattgaaactaaactttctattcttgactttgtcactttgaagaaaagaacatacaccagttatatcttctctgacaacttgaattacatctcccaaactcctgcgacagacaagataaggtcctgctgtcccgagcagcacttaccagggatacttttaacaggagaatgaatttttggataggtgctctaacaaagtaagcactaacactgagaagttacagttccttttgaaaaatccagcatgttgttcggttgtcactggaataattatagtttatggtgatccttcccttctcttccattcccattaatgttgtagctcctttgactcctaaaaatctcccctttaagaagatacctaaggaagaaaaaacagctttgtacttcctaatgattcctgcagtgtttcctttactattgtcactatggagttcttggtcaaagtgtctgaaaaatatcataacttgggagtaggggagaggtgaaattaattatgattggttttcttctttttattttatgtgatatcaaattgcagtgaaaaattccctaaaacaaattttaacttcttaggggagaccccaagaatttgagtttttttcccacgtcactcaatctaattttgttattgatgtttctcgaaagaatcaggagaagtagaaattttcaaaagtatttatgtccctcgaaaattaccactttttagttccctttctaagaatacgtcttaccgttttctctaggtgactaggctagtgaaagactatacaacctagggtggattaggtaaaaataagggaaactttcagaattatagagagtaattattgtacagtaaacatctttaatacacacatgtctagcattgcagtcgtcttatatttgaatatcatgtttgttttctgtactgcagaacaaattttcacagagttagcaacttgaagcaacacacagttattaatattatctcacagtttccatgggtctggagcctggccacggctgaactagatcttctgcttaggtcatacaaggctgcaatgagaattttgttcagactccatttctttctggagctcaagggcctgttgctgactctcgtgattgttggcagaattcagttgcttgtggatgtgggactaaggtccctgctttctgaaagctgtcagcaaggggccccactcagctcccagaggcccctgcagttccttaccatgtggctgtcacaggccctttcacaatatggcagctgacttcttcaaagcctgaagaagaatctctctgacttctaattccttttatacaaggctcccctgattaggtcaggccctccagggataatatatttttccttaactcaaactcacctgattggggaccttaattatatctgtagaagtcttttgcaatataacataacctaatcaatataatcacctttgcggtataatataacctattcacaagaatgacatttatcatattcacaagtatctcacacatgcaagaggagaggattatataaggcatcattatacaaggctggaaactaggaagccatcttagaattctgagtaccacaatttttttttcaagataaggtctctctctgttgcccaggctggagtgcagtggtatgatgatagcttataaactcctgggttcatgtgatcctcctgcctcagccttctgagtagctgggactgtaggcatataccaccacactcagctaactttttctttttcttttttttttttttttttttttttgagatggaatcttgctctgtcagtaggctggagtgcagtagcatgatctgggctgactgcaacctccgcctcccaggttcaagcaatcctcctgcctccacgtcctgagtagctgggactacaggcacatgtcaccatgcccagctaagttttgtatttttagtagagatgcggtttcaccatgttggccaggatggtctcgatctcttgaccttgtgatctgcccacctcagcctcccaaagtgctgggattacaggcatgagccaccgtgcctggcctcagctaacttttaaaaattaattttttgtagagataaggtctcactatattgtccaggctgctctcgaactcctggcctgaagcaatcctcctgtctcagcctcccacagtgctgagattatagacatgagccaccagcccagcctgactaccacaaataccaatgatgaatttgaaggaatctttgtgaatagtgcatttgacctgtattttcaaggttttcttgttgaactttgcacttataagtgcctccagagatgaaagccactacatgactagaatcccatatatgtttgcccttgtctactgaacacaatttggaatgactcatatagcttagaaaaaaatggcagactagagggaaattgaaaattcaaaaattctggatgtttagaaaaccagtgacaagccacaggccttcttgacatgtttctccaattctatttactctcattgggtttttttataccaatcaaaaggatgaaatgccccattgaaacaaaacattatgctagatttctgcttctcattctacaaaagtctttatttttctgcattgaactttgaagtaacatttcatttcctccagaaaaagagtaggattacttcatccgtagtctttttttaaaaatctggtacttctagaaaatacattgaaattaaagttttaatgcattgaaagaaagccaatcagtcattaatccatacagtaattttgtaacagttgtgcataaataattggcaaaagagattttaaaaaggagtttatttttaaagtaatgtacagaaccaaatttgatttcaaaaataaaagccaacattaatgttttctagcttttaacagaaagcagtttactagcattttggaatttcatctggtcaattaaatatacaaaacaaattaaccaaaacatacattatgtatgtagagaaaatattaaagtatataataaggaaatgtgctcaatacgaactctttaaaaattgaaaacacaaagtaattttgagattcatgacagccttagggttcatattacttgactgtgataaatttagaagattatacatagtttggctggttgttcctgcatgctgacggtatttcttccgtctttaacccttgcaaagaagatttaaattttgctatttttgaacttgtttaccaacttggtcattcttgatacttgttattgcccaaattttacttgtaattccttttagaagcataaatagtggatttcaatcatgtcaatatttctgcagtatttagaatggcatgaattagaaaacatgaatttttcaaagaaatcataactttttcttgagtccagccatttgctatcatcaataagattagttaggatactggatttcatcagtgattccattatctgaaaaaaaaaaaaaaatctgccacctttaaagttttgatttttgttttaattatctgttctgcttctgttttatgacatgtagttcaggcattggactaaatttaaatcagtggaatggttggcagcctataaattggtctacacaaaaaggtttaaatgagttgggagatttgtttacattttgctagctttttatttctttcattttttttatttgaaatctcctccttagtggaattacatgatgataaccttaggttaggttatcttacagtgaatgttcacccaaaatctcagtgcatcctacattagaactttggtatggtgtgactggttactgattcagcaagcaacaaatataactaaagtcacttaattacttcatttttaattcaaatcacatggatgttgatctagaaaggatctgattcaaattgtcaaattagtatgaaatcacataccactctatgttgtacttatatctgactatgcaaatgtgtttaccaattttcaatttttctttcttggggtgaaaattctaagctttgctatgtttaagcatctattcatgaagctacagataaagctgagacctgcacaagtagtttaaatatcttttcagaccatttgggtgtttcagacccttggaggtcttggacatagaggggaacaaagcagacaaggactctgtccttatacagtctgagtcacactcaaaggtcatgttgtagaattgcattaaggaaatctgtgatcagaaataacagggacatatttagatacacgcaaaactagctaaatttctggaaagatctatacctataaagtgcttggcacagtacatggtactccataacagttacatgttaatatcattatgatttttattacttttccagttcatccaaataattctctggtcatgggcagaacacagcacatgtaaacatgtataagtaaaatggaatttggttcttttaacatcagtgcagaccagttttgtgctacaaccttaagagagcccaaatttgtcccctgatgcggagactaggagtcatttcttttatttttatatccaaattttcattgttttaattggcaccctatcaaactgatagatgcctccagttgggtatgtcagcgtggttgccgagaacattacaaatccagtaattacaaggaactgtttctccattattttcttcccaaagcattttctatgctggaaatgctgtgaaaactttagacacaataataaaagtactatttttaaaaacaagcttttattgtattaacatgaaagcaatatatgttcatcatagaaaagacaggtaagcaaaacaaaggcaatgaaaatcacccaaattcaatacagagagagaactaccattatagtttatgcatattgccttccagttctttctctgtgcatagaaatagccttttcaatggtgtcatagtataacatcctattttgtaattgcctttttcaattaacattatattataaatgttttgccacatcattactcttttacagtattgcttacattggttataccatacttatttaaccagtccccaattgtagggcatttaagatttttttacttttcttttttctttttttctattctaaagaattcattgaatgaacaactaagttgccattgttgagggtattcttatgttaaaacagccaaattatttaaaatatggagaaagtgatttggtgtcaaagcaaggtaaccaacaagatgaaacgattgcatgtgaagtcttcataagcatacatggtttcctttttgggagtcacagaggtcacagacacaagcagcaacttttaggaaacactggaaaagttgaaccctgtattattattgaagaccaataacccaaaaatggactgtgattaattagaataaattgaaatcaaatacagaccgacttatcaggggactattctgtcacctctttgtttctgtgacaaatgcaaagcaattcacaacatctttttcattcacaggtggatttctctttttgtttgtttttaattctttaaatgttatcttttaggttgcacaaatcattgttccatgaattaaagtgtacttaccagttgatccttcttgccaggaatgccatctccaaccacactgaagaagtcggagaagtctggtttcagcagcccctccccttcacagacctcctccctgggaacggcgttcacacagcatcaccgacctgtcattacaggacccagaggtgagctgctccacaggcacccttggttgtgcttatatcatggcctttggacccaagtagcaaaatgagaaacaatgaggactccccctgaacactcgtgaggcagtgagtgttccaatttcttacccttgggggcagccttggaattttagagaccaaagagatttggcatcacattttttgtcctttcctaaggcaaaaagagaccaaatctgttttttgttggccagtgagatttttgcagaaagatgggaagtaacttgaattgaaccaaaatcaaatctgttctacaagttgtgtgtgtgtgtgtgtgagagagagagacagaatgtgtgtgtgtgtgcgcacatgcgcgtgcacacatgcatgcattgggtgagtatatttccatgtggtcaattacctgttttcaagtagtagctttttctcatccctgctgactctctttccataaaacctgatttcaatatgtggcattttgtgttgaggttgtttgcatcagggtgttgacgagcagtcttcattcactccttttgaagtggtagatagtttgtctggttttcattgcaatgttttcattatttttgtctcatatgcttttaagtttattattaaaatgtgtccacgagaaatatgatttgtatttcgcattaaagacaagccttaagcctcaagagaatgtcagcaaatcacttaacttgatcttattgcaagataaaaatatttattattttgtttatgaaactcccacagtagaagtatgaataattgtagccatgtttgctttcctttatcagattttcttttaggtaggtctgtgacctaccagctggtttcataaaacatcctagaaaattatgatctcttgtctgctttgacatatacctggggaaactgatgtttcttgcattaatctcaatgttagccccaccaatctgaatccctttatgaatgtgctctgtgtgcatctcagggaaatgtggcaggtaagagggctgtccggtgcacacatgggagtcatattgaagaaagtaagcattttgaccactgtgggaatgaaacttacttgtttcatctttaaacatcttgtgatcattggtagaactttctcaagatcccttctttcatttgtgtattatgtgtggtataatcagagaggcttactatcgatatataatttgaaaacctgcatcagaattagattataaggtcccagaatgaggcttattaaatagtattaagatattatcctcatagttaacactcattgagcatataaactgtagtgggggatcagagatatgaagcccttttagtcagaatatttatggcctgaaggagatgaggcatgtgttgtttttcatctgtttggggtcaagttaacatattctaaatgctaactgaatggtaaaagttcctgcaggagctcagtattggggggaccgtggaggttcattcactctttaaacaaggatttactgagtgcctctatagacactgggaccagtggttcctgtcctcatagagcatgttatctactgcagaagagaggcacacaaggaaataagcaagtaaaagatgatgggccgggcacagtggctcacgcctgtaatcctagcactttctgaggccaaggcgggcagatcacttgagctcaggaattcaagatcagcctggccaacatggtgaaaccccatctctactaaaaatacaaaaaaaaattagccaggtgtggtggcacatgcctgtaaatcccagctacctgtgaggctgaggcaggagaatcacttgaacccaggaggcagaggctgcagtgagccaagatggtgccactgcactccagcctgggcaacagagcaagactccatctcaaaaaaaaaagagacttcaaagtataaataacattgaagtcaaatcttaaaagatgcttagataaatggagggccatcctaagcaaaggaaagatttgtggtgtagtaagttagtaagaactgagaagaacagtatgccagcaatcaggagagctgggtaggctccctcttttccttcccactcaccttctgggttttttaatgtcctcatcaatatagtgggtacaatactaataatgaccatttcctcccaatcttgtattcttatacagaaacaacaataaaacagtatttgtggagattccatgaagagcataatgcaatctgtatatattatcattagtcagtaaatattaagagtgtctaatgtgtgtcttgccttaaaactgtagttctagaaattactgtcatgggcacttccctatgggtacaggttgagagcttgttcatgctagatgactaagcacattttctaaaatgacccacgctgggttgaaccagagtggacctccttagctcacagcataacaagttgcagtctattcatattcattcataaaactgtgtttgaggaaaagagaaagatgcctagtgtaagaattatggaataccaaagattctttgttttcaccagaattcaagatggctcccagcatcctcggctctcctttctggaaagtctactcaggtacccgttcttaccgtgtcccaccccgcttagtggtctggtgaagggaattggagtagttgagatgaaacttcagttgcctctttgtggtaagaatcataagaattgagataggctaacgtaagacatttttctggctaagacatttttaaaaggttggaattcagcctcattatttatttgctgtgggtactgtaatttccttcatttctctctgaactagttggaaagctaatgcttggaatgataccacatttgggagtaagacgtggtgttttaggaagatgaggccaaaattgaggaggaagagtatagctgcaagagtcagtgtggaatcgatgtcacatgtgcgcataaaggagatttcaacctctgacactccttgtattgggcaaagttgccacaacccaaaatagtaaattattagataatccagagaatcaaactttaaaaggatcttgaagaaaagaaaagaatgtcctttatcaggtccccagggcatggggcagggatcacggaggccattgactgctctctggttagcactaggttgtgaggcttctgctgccttccctagcatttatcacgggaatgcttcaactagactagcaccagttagtaagcaataactgtccaacacacatccacgctcagaatggagatgagattttacagagctacagcaaatcaaggtcacctcactaaaaacacaagggccttacttttggctgcaaacataagctacatttggaaatttcacagccaccttttacaaagaaaatctctctcttaagattgcaaagcaaagggagaaacacagggcgttgaagggaggtagcgtagcacagcggttgtccttgtctgttttgactgccagaacagaacaccatagactgggtggtctataaacaacagaaatgtattgctcacagttctagaggctggaagtccaagattaaggctctggcagcttctgtgtctggtgagggcccacttcctggttcatagatggcatcttcttgctgtgtcctcacatggcagaaggggtggggtcgctctctagtgtctctttcttaaaagcactaatcctattcatgagggccccaccctgtgacctaatcacctcccaaaggccctgctacctattaccatcacattgggggttaggatttcaagatatggatcctagagggccacagacattcagcctatagcagtggttaagcacaaaatctcagggggtcagataggctggtgtctgaatctctgtccactacttggcacattgcttttctctctgaaccaaaggtttctcatctctaagttagagattatcatctctaactcaaaagaattgtattatgttaggagcaaaggaaataatgtatttgtagtcatttgcacagtgcctggaagtacagtatgcacgtgggtcatacaattaaataatcctttttcacccaggctttgaaagtatcatgctgtccctattgccttcgcccagcaacattctgcccatcccccagatcagctcaagcactttctttttttttttttttttttttttgagacggagtctcgtcaagcagtactttcaaagtgaaacctcctctcctccacccagcttgccatcatctcacactgcttaagctcctgctgcctttcatgtctgcacattgactccaccaacctcatctggccttgttagttaatctacatgtctcctggaggagaacctccaaagggaaggatctctaacttagacatttcactatctttgttgtgcctcacacagtgggttttatgctcaaatattggttgaatgaataaaagtagtcaaattgcatataaatgcacacaggagacatttatcccctctctgaccctgatgagttttcatttcttcagataaatgtgtgatagttcatgcagtacttccttgtaagaaatgtccaagacatggaagaaccatggcgttgcatccaaagaaaacctatgcaagattctctaagtagagctttgctattaagagctatgggctttctttatgttgttctaaccacttccctatttatagtgtaaaggtagagacatgtggtttcttaaaatgaatcccctctctgatagtggctttctttatggctttgataaatcacttaaccttgtcgcctcagtttggccatctgtaccatggggacaatactttaccacctgtttctctgtgtggttagaattaggtaaagaggttatttgggaatatcctatcgatagggggaagatattaaatttcagtagaggcatttgtacatcgttatacgttagtataattactgtgcactttaagctgaaagattgagctttcaaagactttcttttaccactacttaaaattgtaaccatagtaaagtatttactcatgactatttgtcttattcatgataattgaaaaaagaaatctttcttcatccctttgccttttcaagaattgtaagtttgcctggttgatgatctgaagggtctaacttgttagagaattatttagagtaatcatcagttacatcttaaagtttcttgaaggtttagatcttcttgaaacttatctttttgcttaaaatctttgctgttttgaagattaagaagatagtgaatgatactttatttaaatactctgcactaagtaaaacaattctgtgccttagagatttaggaacagagagcagcctacacgatccacattgggcagcacaattgaaagtaattgaaagagttatggtctgggaatcttttggtataatgtgttcccagtatcagtgaagattgtttttggctgaaagtaacagaatatctgactgaacaatggcttaagaaaataaggagtcacatttttctcatacaaaaacaagtatgtggctaggtatggtgactcacacttgtaatcccagcacttcaggaggctgaggcaggaagcacttgaggccaggggtttgagaccagcctgagcaacacagcaagaccctatctctacaaaaactttttaaaattaggagagcatagtggtagagacctgtggtcctagatactcgggaggctgaggtgggaggattgcttgagcccaggaatttgaggctgcagtgagctatgacggcactccagcctgagcaacagagaaagaccctgtctcaaaacaacaacaacaaaaaaaagcaagtatgtgattcaaggctgatagggtggcacttgcagtgccatcagggattgagatttcttctcctagacatgtttcagtgggttgtttttatgaggtcacagcatgggcgctgccccctgccttatgtctgcatgccaagcagaaagaagggaaaaggtgaaggcaaaaaggacctgtcagcttatcctgccactttttcataggatcttctgcagcacaatcagactgtgtcccatgatcacctgtagctgcaagggaggctggaaactccaaatttttagctgagcatatggccactctctataaaattaagcttttatcagtgggtaaataagggataaatatgctggttgacagttagcaacatattccccattatttttacagatgagaaatctgagctagccagaaccaagaccagaaatcaagtctctagttcagtgccttttttgccatatcagtagtttctacctttttctcccccgactgggagaaattaactgcatttatttaaacaattactttgttttcacattttttatgagtcaaagtcataacatatccatctagatcttttgataatcataatataacctgtgccatcacactgagttttttttttttaatagcagccataaacaaatcacttagccttttttattagtccataagtccttgctactggtaaatttgtggtttctcttaggtgcacgccactttagagacagtttttgaggtcagtttggcttttttcaatattgtattagtttgcagatacctattactatctggggacccattaatttttttccacaaatatttatcaggctcttacagtgtacaagatgctctagtagtagagtgaacaagagaagcatggattctgtcctttgagtgcttgcctcctggaggacgagaggacaaggaaaccagcagttgcactgctgtgctagaagcacagggtgcggtagaaaatgaggggaaggacatccttgtggacaactacagtggcatctggcactacgcaagtccagacacacaggagacccaaccgctattgtcaaacagtttgccttcgcattatgggcatggaaaacagaacaacagcaaataaatcatgctcttagataactaagtaccaaagaattcagacatacgaaatgcaaacatgaggttaaacccccacctctttatgagtcaaaaaaaaaaatacacgatgggagtttagaagtaaaattgcctggattctgaaaatacgcctaagatacactaaagcaatcaccatataaaccaaagatttattgtgcagctttcaaagaatcattccagtttctgtttggagaggtagtcagaagtttatatgctctataaacctctctaagtccatgatcctcctggcccaaatagggatcttgctctcagtgatgaaacatctgaaggtctgaagttaacaatatctcccagtttggccaagaaaaatatactgcagagaattatgagaattaagatcacctttcaggaagttggggtcaccaagaaaggttagaggagtgtggattcataataggcatagacaataatagaggagcggggaaggagaggtaaaataggagggtgacagtcatcactagatggcagggcctattagggcaaggaccacacctttatcatttatctctgaatccctccgccttgtgcccggcataaggaaagcactcaataaataattgtcaaataaatgaatgaatgaatgcatggatttgattgaagaaacagaaagtttgagaataataggaagttctttccttctccactgtgtagtagtataatattcaaatgcatatattcagcagcacgtagaaagaggcatggcatgtttaagtgctcagtatatatttgatttgtttgtttatttgtttgtttgtttgtttgtttgtttgttttgagacagggtctctctctctgacacccaggctggagtgcagtgacttgatcacagctcactgcagcctcgacctcctaggctcaagggattctcctgcctcagcattccaagtggctgggactacaggcgcatgccactatgcctagctaatttttaaaatttttttgtagagacagggtctcactgtgttacctaggctggtctcgaactcctggctcaagcaatcctcctgcttcaaccttccaaagtgctgggattacaacagcaaataagttatgcccttagataactaagtactgaggatttaagacatacaaaatgcgaacacaaggttaaaccccacttctttatgaatcaaacacacacacacacacacacacacacacacacacacacacacacacacacacaggcagtttagaagtaaaattgccttgattctggcaggcgtgtgccaccatgcccagcctaatatatgtttggttttaattaagatctaccttgatagaccttaagagaaatgagctcaaaattatttggtcccctatttgtagaatatttcctgtggcattttaagtttttctctccaaactaaggtccctccagaaagaacgtcccctggcgtttcactactactgtaattgtggcaccccctcccctggcctaggcccccaagtgctaggtttgttcatctttctcctatcacatccacaaacttctttgcctcttaggaaagcttttaacttagttggagaacatgctggtgatccactgaatctaatttgtctctcctggtttagtgcaattgaatcatctcaggaaaatgagaagcaattaggtacctgttgctaacaaggcactgaaataatctgccaacagacgcacggtgtttatttattattggagtatgtcacttgagcaaacattacgttgcctttctccaagaagaattgccagaattgattttcaaatgcaggcctcatagacctaacaagtaccacctttaaggagcatggaacagagaagcaagagggcttgtgagcctcgttcagggttagttcaagtgccagtgcctagcctaatgggcagcgttgtggatgggatttgaagttgcaggacactaaagaaaaagcagcttttttcttttttttttgcagaggtcctttaagtcccagttcaggaaattattaaattcattagccagatacttagaaccagctattactgcccagccaaaggaaaaaaagagtgccagcaaatgttttaaaactacaactaaacaaaagtcaggaagcgtgtaattaaaactgtacctttattgtattgtaaagagtttcactgtgacatggaaaatatttaaaggagaaggctgtttagctaatttgtctgcaagtgaactgcctagtggaactatcctaaattaactgtaaggccacccaccgagccaccctcataaagagccatggctgctcagcttgggtttgtgtaacgttcaataattactagataaatgcacaactaaaagctctattacactaataatttgtactgtgatagatgtgtgggacaccctgctgggttaatttgtcatccctgcagcaaacttctaaagagagctcttccgtagtggaatcatgttaatatgttgtccctgggaggacaggttagagcagtgagaccacttggctccttaatctcttaaagaggcaaagggcctccagggtgagtgctgaagagaatagggtgatgaacccaggggacctggatttaaactcatcttcacaaaagaagctgctttcccttggaattcctttgcccctttctctctgtccctctcagtcacacgcaggcctatgtgtcccagtggtgcatgtgtgcgcacaggcacacacaggcatagacccacgtatccatacatagtgaaggcagtggttctgagcaaggtttcttagaaaccccctcattttaagacttcctggtatcgtacgcttggactgtaccttgcgtagtcagataagccccgttctttctggtttagcttaacctaagttgattccatgtatagactcattatttattttccttttttcagcatagaataaaaaattcaagattgaacttgtatctcctctttatgtggaatggtttcttctgcctcgccctctccctctctctctctctctctctctctctctctctctctctctctctctccctctttctctccctctctccccgtctctccccctccccaaccccacccgcacccaggtctgctattctctgtgtgagctttgtgcttaggctaaatatcctcagactgtggcccagatagccacagtgagcagctccagccttaatttccaccaatttaataatcccaagagaaaaaagagcagcttttcaacaacagatttagggaagggcctactcctgcatgcttatgattctgattatctgggtttgggtcatttgctcacttttaaaataacccttatgtttaaaagacaatggagtgcctcattggtgtgacccggcttccctgtccacccatggagtcagcgggttaagtccatcctaaccacataggctgaggctgagggacagagagttccccaaagaaacattagagctctgtttccagaagaaggggtgaagaactgctgggcaggcaaaaataatagctacccccaggagataacagcaaagctggcctgagcactggccaatgggctcagcttactcactagctgtggcttgttcctgcagttagtgtttgcagagcacaagaaaaacccaggcctatttgttcatgccacagacccccagggtcacttgaaaacagttcggctcttgattctcaattagctggtgttacctcattgcattgtataatccagattacttttcatgtatctctatttattctaaaaacaatcctaagaatattaaataacccagagtctagcatgctgtttggcacacagtagattctcaacacatttgttgaatgagtgatcctactatgaatgaggcacctgtgtacattaatgctaatcctcagaaaagcctttcaaattgcgctattctttcttacccccctctgccccacccaagacagagtcttgctctgttgcccaggctggagtgcagtggcacgatcttggctcactgcaacctctgccttccatgttcaagcaattctcctacctcagcctcctgagtgtctgggactacaggtacacgccaccatgcctggctaattttttgtatttttagtagagatggggtttcaccatgttgaccaggctggtctcaaactcctgaccttgtgatctgcctgccttagcctcccaaagtgctgggattacaggcgtgagccaccatgcctgaccaattgctgctactatttaaagataagaaatttaaagataagaaactgtaggtttggaaatgttaaataattttgcccagattaacacagggagtgaatgattttacaaccagaagagtcaagctcattttgtagtagaggacactaaggaatataggaggctggcgtcttgctagtcaatacccaagctgacatgaaaacttggtaccctgactttaatcactagactgattattctgttgcttattccattccttgtgtgaaatttacccacagtaggattactcctcaaatcctatggggtgaattcaggaagatacttcaagttcaggaggatgccttgaaagtagtctttggctgggagcggtggctcacacctgtaatcccaacatgttgggagaccaaggcaggcggatcatttgagttcaggagtttgcaaccagcctgggtgacaatgaaaccccatctctactaaaaatataaaaattagccgagcgtggtggcacatgcttgcagtctcagccacttgggaggctgaggtgggaggatcgcttgagcctgggaagcagaggttgcagtgaacctagattgcatcactgccctccagcctgggcgacagagcaaaaccctgtctcagagagagagagagagagaaaagtagcctatgctttagtaatcatgttgcacagaaatagaggcttccatttcagtataaatctgacaatttggtggagagaaatgctgcaaaataacccatggctttatgtttgttatgagatttgcttttctgtctgcttattttctgtgtgtgtgtgtgtttttttttttttttaatgcaggaaaagacttgcaacagcctagatccagcacttggtcgttacgcaagaagcatctgcatggatcttgttttttgaagtcctctttcacaggactgcagtttgtaattccatttcacttccaacaggtcattggatgattccctccctttttctgttaatctctggaatcatccaatctatggtggttagttttcttctcaagtaattgttttgatttgtttttcattcttcatttagtctcacagtagtatcgcttacatgttacgtaaaagttcaagttcccttcatgtaactggattcttgtcaactttgcctattaaaccatcactctaaatatttccaataatcacagctgttgcgtggcgtttgaacacatttcacatcagccatcatggaagcttaggcaattagtgtgagaatatggtcaattttgattcaaagaggccctgtcaggacaaaggctggggctgtatttcacagagcttaaagtagcacactcaggtttttttaaactctaaatattacagtctccccaaagccaaagtatcttaaagactgagtctagatatactgtacaacttaatatcccataaacatttttaaaatcatttgttttaaaagccttccttatttcaatttttagattttaattttatttttatggatcagttgtactatttgtaaatgtaatcccagagactgaattctatacatccactagagcttaaactagatgagcttcagagagtatttagtccaagctgcttactgtgagaagagagacctagggagagagaagccacccacatttataatatgccaggtagtggcagaaactaagttaaaacccaagtctctttatctagtctgaaaatattcctaaaaaatgccctagatcttctgaaaagcatttgtttttgttactgtttttttgtttgttggttggttttttagatatagggtcttgctctgtcacccaggctagagtgcagtggtgtgatcatggctcactgcagcctcaaactcctgggattaagcaatcctcccacctcagcctccaagtagctggaattacaggcacctgccaccacacctggctacatttttaaaattttttgtagagatgaaatctcactgtgttgcccagggtggtctcaaactcctgggctcgagtgattctcctgcctcagccttctgagtagctggggttacaggtgtgagccatcacacccagccgaaaagtatttctagtagtcaatatgtattagatttctgataagcaaactcccaataactaacacgatgggactttcaagggaaatgatagagatttccactgtttccatgttttgggaggccgtggggaggccatgctcagattgtggtgtggtcagaaacgtgcctgggggccaggcacagtggctcatgcctgtaatcctagcacttggggaggccgaggcaggtagattgcctgagctcaggagttcaagaccacgctgggcaacgtggtgaaaccccatctctactaaaaaaattcaaaaattagccaagtgtgatggtaggcacctgtagtcccagctactcgggaggctaaggcaggagaattgcttgaacccagaaggtggaggttgcagtgagccgagattgcgccactgcactccatcctaggtgacagagtgagactctgtctccaaaaaaaaaaataataataataatgcccggttggcaggggcctacgtggtgaagagggaggtcagtatggacactcaaggattgtaggtctaagtgaaaaatagcatctaaagggagatggccccatagttctaagcttctgggttaaatctcacagtctgaaatttaagtaaaggcaggaattcacagtatgtttggtcagcaaagactatttgtctaggtctttaaagaacttttatctttacttagatatctatggtatctatgattattaggtcaagattgttgctactgctgttgttgcttttacttttcattttgttgtttgtggaattattttcaaggccctcatgtcatatccatgctgatagtatatactattttatcaatatttatgtacttttttgtccaagagacaggcgagcaacaagtacctcttgttccatcactcctttctttcatgtattctacaatcagaacaggtcctagcacacaggagcaaatttcaatgtattcattgcctatcccattcttgtctatgatagtactatcatactacaaaagaagctattgatcacttaattgtgtgatcagaaactgtgccgtgtgccttatatacattgtctcatttagtcttcacaacagcgctatgaggtattattagccccattatacagatgccaaaactgagttgtagagaagctcagcaacctgaagcatagctcgtgatagagcttagaatttaaactcatgtctatctgactccaaagccctggtccttatattatactgcactgcttttctgagtcgtatgtttaacttagaattatatacgcacacacacggatgtggtcagccagcacagaccaaggcatattaagtaatggtgaagacagacaatcaaaagtctaccgtggagagttaatgagatatcaaaggtgaccagattgctttggaaagcttcagaaagctgaggtggaattggtattgactgtcaggggtctgactcacagagcacagcaggtgcttggagagtgaacaagaattttgtgggtctacaccagggactggaaaactattgggcccacagatccaatagccctttgcctgtatttgaaaataaacttttattggaacacagccgcgctcatttgtttatgtaatgtctgtgactgcttctgcactgtagcagcggagttcagcagttgcaacagagaccatatagcctgcaaagtctaaactatttagtatctggtctttacagaaaatgtttgccaactcctggtctagtcagggccttgagcaacaaaggtcttgaagtagctaaaattgatctagataaaaattttaaaagactttggccttctgttttcttgtgtgggtctttctttttctttctgtttttccaaaagacattagaatttgatctcttagaaaatcccctgaattcaaatggaatagactctatcaaccatcttggaaactaaccgtggcataaagttactttgtctggtagcagtaatacaaaaacactggtgttttgcaagctgtcaagccatgtcatatatttctctcaattgacatatctgggtcctttcacgtgcatcttcgtgatgttaaaagatatgtaccatatgttttgaaaaaccttggctcacctcgagtcaaaagctttgttatttagaaaaggcatcacctcttaaaggtttgaaaagcattgccaattcttctttcctgtatctctgttaaaataaatcccttaactccaaacttctcagctttcatcaatggcaggcctgattcatgcatgatttataaattagggctatggaccattaagatagatttctcagctttaggtggggtataatggtgttatatagtgtggttttgaatttctgaagaagcaagatacatagtagttgacaacccaagccatttttatgttctatttacccttatggaaagcttcttttgttttttaagtgggatttttttcttcgattttcttttccttttgaagctttgccgtattacaaatttttacttctaattatgagtagtcaagagttcttaatgccacccttacgctatggaagtggtaactttcatctaaagaacatcttatttctgaagacagataagaaggtttttcttataatggcgctaacagagaaaaactgtttggaatctcacctgttgccactgcctttgtattcattaacactaagactgtgaagttttgcagatgccagggctcaggagtgattattcgctcttgtgagggaagaagcctgtatataacactgccttaagagcacactgtgcctgaaggaggattatattttattgtttgtgttgctctcttgacagcttttctttggagcctcccatagaagagagactgggatttaaaggctgatgccagaaagcaaaagctaacgtgaaaagaatccaagtctctgtccagtgtgtgagaatctgcaacggttcatggacaaggaataaaacaattaaggcaatgtcagggttataatacagaagaacatatttcaacccataaaattttggtttgagggaaaatgtgtgagagttattagagttcttggaggatgagcttgagaaaaactactggaaatactaagagattactttcttcttctatctctttttcttccctaagacttataaaagcagaaaaatgcaagattccaagcttgtctggacacagctccctgataccatcctatttcatatggcccacgcttagattttctaactagttctgactcctcttaagagcactcttatgtgtctacaagacctcctccccatagtggactctcagaccaagaatcactggttgtattatagaagtcttgcaacatatccaataatacaataatgatcctgaccttctcctttctcagtcttaataaattctgcttttaacggaagaagcatttttgagttaaacatgtatatgtattttttcaattgtttgaatttttaactttttctcctttaaactaaaaccaagagaggatttttaagaactggtgggctgctggactggtggggagggaatgaacaagtaaaccaacctgactgacctgctttcgtttttcaaagtatccagtaatatgatcattttgtaataaatagctgagtattacaccctttgggaaattgtggctctctgtttcttttcgttgtggctactttgttcaggatgtgtaggcagtgccattgcagccaaagaaacctgatcaaatttccttccttcccatcttatttatattctttgtgaaaagcccaaacagttgttttaaacaagtctggccactcgttaaagtttaaactagtagtgagatccatcaggagtgaagtgtttctgacactctctgctgctcctggcctagggtactaagagtattagatgccggaagcagccaattttgtagtgtcttttaatacacaaaattgtattaacatcaatgtggatacagatggatgcactgcaataaactgtaaccacttgagaaaagcctttattgactctcaagtaaataatgcacattttaaaggatctaaatatgcatttacataatgtgctataattttttatggtgtcaactactcacacacacacatccataagacatgtttttcttcgtcaaaaatctggactcataccattcttcgtgcattccattagcatcatgccaaattcataatggtagtttttttctataaagcctgatctggccacctcaaaatatagttgatgaattttactctttaattgatttaaccccagtggctctttctaaaatgatttgagacaaataaaaacttaggtacagtaaaaacatccaagatgaagagagaaaacaagaaataggagagaagagaaacaaagttaggcaggcattgatgacatcttaattctgagtttcagtgggtttcattgtctggtagaagaggaatagcaggttatctagagaaatagcatctatttaataataactagagctttgtgatgtcagtaacgtaactattttctgtttgaagaaatgaaggttcaggatctcgaatgatttctctccagttgcacagtgaactgatgactgaaccagaaagtccaaagcatgagaaagtaagggttgcaaaggatgaccctttaaaatgcagactcagcaattgcccaatttgaaactacaggctaaatgatttcctggtattaattaagaattaattgattcttataaatcagtcattgtagaattaattccatatagtaccatatgttcttgtgtttgtgttaaactctgttccacaaggaaatggtgaataaattgtttttagtaaaataaaaaacgaaggtctaaatttaagttgctaatgattgtcttttacgtatttaacaacaacaaaatgagggaaaggatgtttataacagttaatgaggagatgacagggtgcttttgagttatttcttctatctcatttctttaaagatcagctctgcttgatctttgctcaagtgaatttcttttttgggcagcattttctgtaggccaccgtgatttcataatctaacaattacccatcactttccattgagcacctgaggcagcggcactttatcttcaaggtcagcctaccaggggctcttgtcagcagaattggcacctttgtgtttggcattctgcaaaagttgagtgtttcgttttgttaggctcagtatattctcagcctagtttgggaaatatcacattctgtccttaactagtgactattccatcagacgcagggtaccgagtacaagttttttgccaccagcaaggaggactgtaccatgttggatgaaaaaattcctttgattcttgaaagccaatggcataatttgcagagtaagagatgaccagagccatttaactttttagcttgtgggttttaacaagcaacaacaatagatcccaagatttatcattcattgcaggaagtcctaagttttactcatttttcttttttttttttttttttttttgagacggagtctccctctgtcgcccaggctagagtgcagtggcgcgatctcggctcattgcaagatccgcctcccaggttcatgccattctcctgcctcagcctttggagtagctggaactacaggcacccaccaccacacctggctaatttttttgtatttttagtagagatggggtttcaccgtgttacccagggtggtctcaatcccctaacctcatgatccgcctgcctcagcctcccaaattgctgggattacaggcatgagccaccgtaccaggccagttttaccgatttttctaaaagctccctggctcttgaccaggtggagaaaccaagttttggttttagcaaattttattctatgtttaacggtatgattatcttattaacctctgtttattcagtcattcactgcacattcaacaaatatttattgagtgccagactcagttctggggatattgcagtgggttgaaaaggtatttacgaagatggagaaggctgggagaagtgtaagcttgagaggagaaggtaatgaaaattctgattcaaataggttatgtttgagacatcctcaattgtatgaccgatggcaaaatttcatctgttttggctcagatttgtttcttgagcccatagtaggagcctatgaatatttattgggcagattaaagattgcataaattaaagggttgcaccagaccacctgcaagacatggattggaaagttgcttcccctccaatcgcccatttccagtctttttgaaaactacagatgtcactctgaaccccatagcatgagccatttcagtcattagtcagaaagtgccccaatcatgaggagatcccggtagggaacaaagaacctatgcccagcaactaatacagatgcattctttttcacagcctttagccatgcaagtgggatagtggtagaagtgatggcctgtcttactgagtttctcttcagtattatgagtcattcttggtattggaaaggtcttattttccaaaatgtggacattcctgtgattttcagtttaaagatttaaaccgaagaaaggaaagataaatactttcatctcctctaatttgggagaggtttctctggctctcattgagaagcaagagctgctgctatcttggcttgacttggtttgaatatctgcaaccttcccatgcactgctcttatcctccagccagttttatcaatcatccttctaattcaagggcaaaagttctcttagagaagttattaggcacctcacataagtttttttaatctaatgtaatcttcttgttcacatgaaatttaccagggttcaaatgtaagggagcagtagttgtctgagtcttttatcagtttttatgggcacagggccaacattttagcaggggtcactgcctgcttaccctgtgggttcccctgctgtaacatatgtgcatttctgagtttgtctttgaaatggcatctgaaggcgacataaaccatccgtgtaaagtgaggcacccaaattgcatgggctcattaagtgatcatttactacatacttcaaaaaattttcatcctgaattagtccctagaaatttccttgaaaggggtataagaggtttaacaatgaattattgtctatggatagctcagcgtgaaaggggatccatatgtgcaaactagaatttgtcatatgtaatgtcagttaagtcaggtctaatctaccaaatacattttttattgcttgcttcattaaaaaggctcttaaggtaatgaataatcttcagcctcaccaaggattattaatgcctttataactcatgtccactgaaaatagaaagacagcttgaaactctaccctaatctaacctccgtgtttgtcttagagccttaaggaagaaaatctgtcagacctatccagtgttaaattcagtcacatgagcaatattgtgaatcgggccaggaagagaaataaaggaggaagttgaatcgggttcagctatgacaaagcaggtctttcttttcataaccctgatgttttcttttcctgcagcaagtccgcatgcaacaccatcgactcttcatttcccgacatcacccattatccagcagcctgggccttacttctcacacccagccatccgctatcaccctcaggagacgctgaaagaatttgtccaacttgtctgccctgatgctggtcagcaggctggacaggtggggttcctcaatgtaaggaaacctctttttttccatttctttagaaatgttagccgaatataaaaataacaaggggagaccttatgatcatgtgacgttgtgctctaatgttgtgctgactgactgcaggcaaatgtcatatttattctagattgtgggaaagttaacttggtctaagagtgattagtcagggtttaaaaacagtgtttgtgttaagtttgcaactgtcaagtttatggatataaatcagctcaagggtgaactatataaccttctaagttctgtgggctgatcattccacctcgtgcattctaaccccagggctcatacagttaacaaaatagaaagaccaagtagttttaaataatgatttggggtggtagagaaaggtagggagatgaaggggacagatgtttcagatcaactaagttgatatttttgaaaaatacagtcttgtaacactttagatcaagttgaccagtacttgaactcaagatgctgaaagtacagtttattatggtttgttatttctgcaagtcattatctttcccacttatcttggtataaagctaaacagtgttcaatagcttcacatgaatgtttttatttttcctcaaataaaccaaataatcacaatttgaaatggcattccaaatgtaaaagtgatttttaaaaatcagaaattttatttcaaatataggattagatgtttacagtggaaagctgtatctcaaggccaataataataaacaacgaccagcataaagccaaatttgattttccttttctactaataactgtgcatgaagtcacagactagccataattattactggccaatttaggatagtatgtcacaccatcctgtcaccgatttttttcacttgcagaaatacctgattctgcatatctgcgccagaacaggcagctttgactaatgtctggtgatgtgttagcagatacatttctgtctagacaacaaatcaatatggtgcctcttttctttttgcttgtacattcatttgcttggcttattctaaagcattcacttatggactctcagcccactcagaaataacgcaaaggcaaggttgctggcaagaaagcacagcattctgatcgtcagacgaggtagtctttgaggagcaatactaaatatataagtactaaatatataagtaaatgttgatgggggagtgagactgcctctgtagaattattaagcttaaatgtaaaagcctgggacagcagaatctccttcaaccgaattttgattggggactaaatgtgaactgttgtcgttggttgaatagaggcctcttgggaaacaatgaaaaaactgagctgatcaccagcatcaagcatctgacttctaaattattaaccatttttgtaatagtcctgacaccctatataactgtcaaatgcccagttttgcattttgatcagaattttataggacttaaggcaggtctcttcatgaaactattttgaaaaaattgaaaataaaatgggttttattgctctctttggaggggaattttttgttaaagagctgttatttggttgttttaacatcaggcagcaaaataaatatgactcttatggcatatgcttatataatttaaatcaaaattagaagtgatatttttccctagcagacttctgacagctgaattctaaagtttctgtgcctgatgttatacaatatgtgaacaaaattttctatgttcacttaacacatttattaaatgttatataatatcaactttgaagagtgaaaataaaatattacttttttatctcaagtgcatatttaggaaaatttattctatctatgtaaagaaacatagtggaataatgccacagtccataaaacacttagatattaaatatttaataatcatgagaaagataatgaaggtagcagttaatacagaaaaatacaaaagattccaagcaaaagttggttactcaggggacaaatccaaagtgataattggcaggtgattttatgaaaccagatgcaaagaaggacaatgtagttcaagagataagtttaggatgcatggagcacatgtggctaagagtacttttgtgaaatgccttaagaacagaacccaacaatggacatttccgtatgggcttatggaagaattgaagcagctagatacttagtaatttacattaaaggtgcctgatgaatattttgttttcagaagcagctaatggttgctgtctctttcttctttttcttgtacgtgtgttttctgccccccccccccccacagcccaatgggagcagccaaggcaaggtgcacaacccattccttcccaccccaatgttgccaccgccaccgccaccaccgatggccaggcctgtgcctctgccggtgccagacacaaagcctccaaccacgtcaacagaaggaggtgcagcctcccccacgtcaccaagtaagtatggctgcgacaaggcgccggtcacttctaaagctgtatgcactggaatccacacttaggctttgtccctcactgtataggctctagaaagaggcacagatccccagtgatgttgtagcatgagtttgccagaccgagaatcaaagtgaacatgactcttgggtactccaccagatgaggaaaacactgggtgttgggtggatgagatggtgtagctacatacctaggactgaagtcaagttatgagctattacattttgtatattatttgagggatttcaaatgctattcccatcatcaagcagcagctacttacatggattctgcttagaaaaagttcctcattcttacagacagccctgccttccaggaacttgcagtctaagagaaatgcacttgaaagttatatacctcatacatcaaataggagaaaatgtctagatcaaagcaccaactcaaaggtgtgtacactgaccattcgctgagagtaagagcctggcagaagatcaatgctagtagccctggcagtcgcatggtgaggtttggcagaggttggggtaggggctggggtacggagatagaggggagagtaggatggaaggaggagagaagtcttggctcttctctgaacagtctgagaacatttaatcaaagaatataagatttcacaacccttttagatgatgggaatgattacttgaactagagagagagtaattctccagatattccctgatgttttagatatggcaaggggatagaaatagtttgaatgcacaaatgtgccttttattagtgcctggaataatgacaaaaagagtgatggctggagttcctaggtgatggatgccctagccttgatagatggtgtgatgagcaccttccctaaagctgtaaagaggcagcaaagtataagagaaggataggagctgtggcagtgtgaccctaaggaaagccttcaagggggttgtcaaaagaagtgagactgaggcaaggaatctacagaggaaaggatgtaagagcagcataggaaaggagtgttaaggccaagaacttgaaccacagtaataggtgtagaatggaacgggacatggtggggagtgttttgtagacataagcatcgggattggacagtcctctggatgaatgcggtgaatgaagattctaggcctctcagcttccttaccttcagtattggaataataatgatagtgaatacaggagggaaagagacaaagaagaaaactgagcccctgtttatgccatgttcatagaatttgattctgggggcacggaatccagatggctagaggccctcatggacacatcagagagtgagctttgggttatccagtatttatgcattttgataatatatgcagaaatgagcagcactgtgcatagattctgtatcaatagccaaaagattgaaggttcaggggcaatctagggaagacctacttctcttggtaagaggtgattcaacacttgtcaacaaaggagaaaaccctcagtgtccaatgacagagaagcaagctgggcttggcccatggatcttagaagctcagcttagaaggaaagcctctgcttctcagaggtttgaggcttgttcaaagatgtcacataaatacacaataagtgccctgctcgttgtgtatttatgtaacatctttaaacaagtcagagaaataactgccccagactctacttacatctgttccttgaggatgttggcttacagattatgcctactgtgccctgtccatgcctctgcataccattttctgctcgtcttctctctgtctgtgcaggacattgccacagtcttttaaaagctgcatagtaatatgcaatcaattccgtggaaacagatcctcacctccactctcaatggctcgtgtgtcctaatgagtttttcagtaacgggaatgaggctctgctgaggcacagcagaagagtggaaatagtaatgtgtggctgttcaagtctaaaggatgggggctcaaatgcccacctttcaaattactaactgtgtttctctttgaatcaatttcctcttctataaaatgtagatgataatatctacctggcatgtttgttgtgagatcagttctgatcattggagtattttattatctgcccaaactcttacatagtggaagactccaggcttgggtaatggtaaaatatatctgtaggacttggagaagctactcaacccctaaattgagttgatgcctttgggtccacagttctagactccactccgtggattgaaccaagtgctatgtataagatgatacctatcatcctcttgtgcccagcctcaagcatcttgtcagcactaaggggcaaagggcagaaggagtcttggcagatccaactcatatggttgcatgttagagcagcacttaagatttggggtggggtgggggtgagagaatatcaggagaaagagtcccagagcttgatacagataatttgatacttactttttgaatcatgggattctagaaatatagacaaaacaaaatgttctaccgatgacacagaaaggtttttatcatcattcattttagcccttgttcagctaaaggcttttctagggtatgatgaattcatagtaatatgtagtttcacagcatactattgcttaccattttctgctttcttaacaagatggtgttaggctgggagagctgtaatttatagcgtaggagaagcctttcaaattaaaaatcttgaagcccactcatccttatttggaggggatttaagggccctcattttaaaatatcgtctcccatgccctgatttctaaaccaattgataaataaaatatttttttaaatcagaagacaaaatatcacctttattatgagagaatttagtttataactgtgggcagggcacttcctaacactgaacccccaattacatcgtcatagctaccaggtcgctggcaggactagaccacagcagcccttcctacatatggtccgccctagcctgtaaagctgatggcatgaaggtgcgggtggcagtgtgcttcccaccagcacctgtccccgaagaggaagagacagggtggggtggtagggactagtcatgtccagtttttcctttgaagcccttacaacctagagagtaacaggtgagagggtggagagaagccaagagtagatggaagggaataaatatcaggagtgaagtagcttctccctcccttaacattcatctttgatgactgcctttttcattcatttattcagcctgcacctatcaggcatctgtgacacggcatggctgtgttagtgtgtgggattcagagatgatggatccctgctctcaagaaatggggatctattgagggaaaggtaaacaggcagtttacacaggatgacaccgggataaaggtgtgtataggtgccatgtgaagacatgggagggagtttggtccagtgtgggcctccaggtaaaggtattttagaggagttgacttctaagctattcagtagggatgacatcctggtgtcttaagagaagatagaacttttcttctgaaaccagctgggggcctaaaattggattaccactagataaaaatgtagggcaaaactatagtttcagaaatcaggtgctttcttagaaattaaacacacaggttgagtggattctgtttatcttgtcagcttatgagagctcaactttagcaagaaggagcatcatgacagggtattcagtacatgtgctcagcatcccaacagtttgatgtctgaaatggaggctgttctcaaaaatgtaaactgtatgatgtaaaacagccttttctatttaggagtttgagatgacttgcaataaaatacaattctaaaaataaatatagggactgggcttcgtggctcacacctgtagacccagcactttgggaggcctaggaggcggggcagattgcttgagctcaggagttcgagaccagcctgggcaatgtggtgaaaccccatctctacaaaaaatacaaaaattagctgggtgtggtggcgtgcacccgtagtttcagctacttgggaggctgaggcaggaaaaatgcttgagcctaggagcttgaggctgcagtgaaccaagatcacgccactgcattccagcctgggtgacagagcgagaccctgtttcaaaaaatatatataaaaataaataaaaataaaagtaggaaaatatgccaagtgtcttctgtattatcagcttttctagacctcaactcccttatgtattgatggaataacactaactgctctactcactctcgtagtcagattatcagaacaaacaggagtaacagatgtgctgtgctgtagacggttaaaagtccaaggcatcatttttaatatcttcttataatgaaatacaaatggatgccagcctggagcagagtatgtattttttaactaatcagttgcctctggcactaatactaaactttgcagctgtggccagaaaagcagggggaaggcagatgtgggggaaaaaaaatcctgtgaaataaatacattttaatgggaaaaatccttaccagcgccctaagaagtagggaagtgggggtggggcaagaataatttttataatcttgatttgtttggagaaagattgatagactgtgccaggtctctttaggatactatgacaaatggaagcataacctgtaagagcatttcacaaccaatgtgctccattcccacagattaactacctgtgtgggttttgatacctactgaaaaaggaccacttctttcatttattcaataaatgtttattgagcatcagctgtgtgccaagcactcttcttggtgctaggattcagcagggaatccctggccttatggaactttgattctagagagggaagaaagacagtgaacaaaatagtgagtacgaaaggtacgtaggatataagatggtgatatgtaagtgctacatagggaaatcaagccgagaggggagggatgcagctctaagcagggtgatcagaggagggctacttgcgaagggcaaatttgaacaaagtctggacaaagacgagagggtgagcaaggatgcagtaggaggagaggtttccaagcagaagaaccagccagtagaaaggcagaccaatgtggtgagatcagggaatgaaagcaagggggtgaggtcagagtggagtgaggatgcatttgggaccttggggatgtaaattacaccggttcttataggctcttataaggacttcagcatttaccctgagtgagatggggcagagaggtaatgccacctagattttaatagatacatcctgaaggttttgttgaaaatagattgtcaggagcaagaattaaagaattaaagcagggagttaaaaagctggatttttccaataaataaaatgagcgtcttctacatgccagccagcattctaggtataagggatataaaagtgaacaaaacagacaaaaatcccttgccctggtggagattacattttagtggaaggggataaacaataattaaaatataagtaaattagcgagttaaggaccagtaagtacaatggagaaaactaaaacaagcagggttgatagggaggggcacttattgcaatcttccaggcaagagttgctaatgacctgcaccaacgtgggagcaataggggtgatgagaagtaagcgggttccaggtatatttgaaaggtagagctggcaagatttgctgacacattagatgtgggttgagaagaattggtgatgatgcctgtgtttatgacctgagcaactaggatagagttgccagcagctgagatgggaagaccacaggaggggcatctctgggtgaggggtggagatcagaagttcggtttgaccaaattatgtttgagatgcctattagacatcttactgctggacttatcataataagctgcctttcacagctctttgcaggtgactgggtttttctgtgtgtatcatctcattaaattgagaagggactcctttttgaacatgtagtacaatgaatgaatagacctaagagtcctgagaacagctctggcatgggacaaagctttcattatgtttgggtctgtttgtgctgtggtaattcaaaatacacaattctttctggtaactgtactttaagttccaatttttatattgtagattggaatcaatatactataaaaatggacttttccagaaaaaaatgaagattggcatcataatctagagatataatagaaagagaaaaaacacttttgaattatgatggaagataaaacatgcatatttttttaattaagtaggaacacaaaaactcaatttaaaaatgcatgaaagacctatcaatatgtttctccatgccttcttcactatgaactttgaattttttcaactagaattctattaaaatagaagcatataataagttacctttattatttatttttatatctttgatgaatcttgtatatattcattatacaaatgaatatgaattcgttagccaagaacctaacaataatctatgactgggatttaaaatttctcgtataataattaacatgtgttcaatgctttttggttaacaaagctctttttacatatgtattatcttatcccatcttctcaacactcctatgaggtcaggatttcataggcaaggaaactgagattggaagatggaggttacattcccaggttagtttggtagggagtcaaatacaggcctttccatgctctttctactacctcatactgtaactgaacaaattacaaacaatgtcactagatttctgattctggggggaaccacagctgtctgctactgtcagaaattaacaacaacaaagtattttgctttttttttttttttttttttttttttttgagatggtgtctcgcttggtcacccaggctggagtgcagtggcattatctcagctcactgcaacctccacctcctgggttcaagcgattctcctgcctcagcctcctgagtagctgggactgcaggcacccaccaccacacctggctaatttttgtattttttagtggagacagggtttcgccatattggccaggctggtctcgaactcctgaccttgtgatccacccgcctcaacctcccaaagtgctgggattacaggcatgagccactgtgcctggcccaagtattttacttttacagatgtgtcaggcacttcacaaattgtttttttgtttttttgtttgtttgtctttctgcaacagagtcttgttctgtcacccaggctggagtgcagtggcgcaatctcagctcactgcaatctccatctttctggttcaagtgattctcatgcctcagcctcctgagtagctgggatgacaggtgcgcaccaccacttccagctaatttttgtatttttagttaagacagggtttcgtcatgttggccaggctagtctcaaactcctggcctcaagcggtccacctgcctcggcctcccaaagtgttgggattataggcattagccactgtgcccagcccacttcacaaaatgtttttatatatgtattatcttacttcatcctcagaataatcctatgaaataaattctcttgttagccagattgagaaagacaaggtatggaaagataaagtaactttctcaaggtcattcagccaggatgctagagtcataatttccatccaattcaccttcaacctagagctcataggcttggctgtagcatgaggatctttgctttagcccaaagcttcttggttttttggttttttgttttgtttttttttttcagtgaaaacccaatgggagaaatacagaggaagatgttagtagttgtttatacttaagtatgaattggtttctgttccagagagtgcatcttattagcaggtaaaggaagagagcagaaagtttgaggggaaatataaggactgtgtttcctctgtcagagaagaagcagtagattttaagaaagaatgaaaaaaaaggagttagtggcttccattcgcggaactgttttttttcattagtgacgcctggactatgttactgttctttttcttaattttaaaattttacattcaataaaattcactctttagtgtacagctctgtgaatgttaataacattcttgtaaccaataccacagacaagatacggaacaatccccaaactctttcattgttctcacctactcttagtttaaagtctgatgtcacttagtgccagggaacttattttactttgcttgatttccatgttgattttaattcctctaccagtgctgctgctatcccattatgtttcaaaaattgagagattatgaaagagacttaaatacgtacagtattttaatctatgataagagtggcattttatattagagaagcaaaaggggttagtgagtaaagtatattgggacagtctggaaaaaataatgtttcttacatcaaaacaaatttcagccggaatcaaaaatataatattaagccataaaatagcacaagaaaatacagggcaaatttttatactattggagtaaagaagggctttctaaataatgccaaaaaaccagcatccatgaaaggaaagtatccaaaatttatgcatggaaaaaacaccatgaacaaagtcaaaacacaaaagatagaaaaaaaattgtaacagacgtgacagggctaaattatctaacatataaattatttttaaaagttagtaagagaaagaccaacaatccaatagaaagacaagaaagggatataaacagaaaaggaaaacatttgaaagacatctcattcatgtatcatgagagcaatactgattaaaacttgagtgatatttttacctattagattagcaaagatcaaaaggtgtcttaacacaatattggtaagcatgtggaaaacagacattctcttgtgctactaaaggactgtaaattggttcaacctctacagaggacattttagttttttatatatataaaatgtaaatgtgtgtgataaagtttataacacaaaaacatgtttacattttgtacctatattagtacatatataaattttacatgtaagccgtgcatacatggctagggcatatgaacaaaaatgtacataaagtattgattgcaacattgattacaataagagactggtaataactgaaatacctaccaactgagtattgtacattaggagctctttaaaaataaaaagataggtctgtctccatgaattcatggactaatccttgagttatattgttacattaattcagcaaaggagagtgctaagaaatatgtatggaatgctgcatgggagaggggatgcatgtacgtatcagactgtatgtggaaggatagaaactaatagtggtttactccagggaaaggggcaaggttgttggcagacaactttttggtgccttatccagtgagaaagatattgctaagttttcagtcctccttttatatcaaatattatgatttctttattcttaaaaatatttgtctagtgatctaataatcttgtttatactaaaatgatgacagtgatcaaaaccacatactcacacatgggggagttcataaaatccttggcaatttttatacatctagcttttagctgtactaacctgaacttttggagtgattccaaaaatgtgtgatttttctagtaaaaaataatactcttttccccctcacagagagcatggggttcagtgtaaggtgagcattttcattcacagtagctattagttggttgcaggttctgccttacgaacccattaaatataaatgtacttgtactatcttataacataattggttataaatactttttagagtattttaattttgtgtagtctaatattttggtgtttaaattttttaaatgaaaagaaaaagaattattaaaaatcaagcattttgataggtattttcatatgcattaccttagttgcatttgttattataaatctgcacaattggaattattagccccttttaaagaagatgaaacggagcaaaggttcagatcccagtctgctggactccaaagcccagtgttttctactctaccaggacacatactatgtttagaggtgtaatatcatgcagctttcctttgaaaatcttaaaacaccccattaaaaatcttttacattacgtcaagaataacaccatcctgggtacattgaaatagatgaaaaacatggaaaccaaagcaggaaaaagattaagagataagcattacaaagaaggaataggaaaaagaacagaacattggatgattccattcatttgggtcgtcataacccagtcaactcttgtgttcaccttagttttttattatttcagatgacagatgagtttaagtctttctttataaagataatatatggcattttaggaaatttgcaaaatatagaaaagcataaaaaagaaaattatattctcccattatcaactattaacattttggttttgtttcctcatctttgtgtgtgtgtgtgtgtgtgtgtgtatacacatataagatgattgtgaccatactgaatataatatctagtatgccattaattcacattttatgccttttcgtactcaaaaaaaagttaagaaataggattttaaataatttttacctatattcttactataggacataaacttttcttctaacctatggagtatgctccagcatatccttagacatgtatttttgtccccaactctaataatttttttaggatatgtttctagaattggaattgctaatacaaacagtatgaacattcctcttgatacacattacttcattgctttcagaaaggttgtgccaatttacaccttttcaaattgtgtacgagtatgatcataacattaacccttgagaagtttgggtgttatcttttttaattgttggaaggcaaatgtgttggggatataatgtcccttatcagatattggaatcagtagtccctgatgaaatgattttagtgtttttctttacttgtatcaattatattaaaattggaattttagggatttcccatcctatttgcaaagcctctccatagggatcaccctttggactgttcctgtgaagagagtgacctgttggatatcacagaggggtaaagccttagttaaagggctgggagattggagtaatgtccattatactggactctatatagagaagttcagagaggttaactggcttgccaagatcacatttctaataagagatctaatgaattcaatccaggatttgctggtttttaaaatttattttctatttactatgttgcactgtctccaaaaaaagtattatttgagatttttaggttccatttgtgttttatttaagattaaaaattactggaagttatttaaaaatcatccataatccggctgggtgtcatggcacacacctgtaatcccagcacattgggaggctgagacaggaagatggcttgagcccaggagttcaagaccagcctgggcaacataatgagacagtgtctctacaaaaaataaaaatttccaggcatgtggcacacacctgtggtcccagctactcggtaggctgaggcaggaggatcacttgagcccagcaggtcaaggctgcagtgagccatgttaaagccactgcactctagcctgggcaacagagcaagacccatctcaaaaaagaaaaaaaaaatcatccataatcccagtcttcaaagacaatcactctctgtgcatatttcccagtcattttctgtgcatattttaatcataattgatcatgatatatgtgtgtattatacagttttgtaaatgattcttattttgtcttataagcacattacattattattttaagatattattaatggctgcaaaatattccaatgtatggatgaagcattaacttataagttggttccaatttgttgctcttataagtaatgatgtaatgaacatcttgtagcataaacctttatctgtattattagtatttgtggaggataaattcctgaagtagattccagagttgcactgccttttgagaggctgcagaagtctttcaagagggagcaatccaatatattgatctaagtttctttttttagcaaactccagctgaatccagggtttattccctgtggctatttaatataactttcacctgtccctacccatatacatggttgcttctgatcaataaacattttctgtcaattgagcaacacacagcatacacataaaaataaatgacagtcataaaatttggatcagccatcagaagtaaatttaaatgaactgaaacaaagttgtattcttagcctttaaaaactattatgagaaagaatgttacaggcagttcagacagacagactgtgggccaggtgtagtggtttgcccctgtaatcccagcactttgggaggccatcgcaggaagattgcttgaaaccaggagttccaaaccagcctgagcaacatagtgagacccctacttctacaaaaaataaaagtaaaaaaattagctgggcaccttggcacgtgcttgtagtcctaactaccggaaaagctgaggtgggaagatcacttgctgcaatgagctatgatgacatcactgcactccactccagcctgggtgacagaataagaccctgtctctaaaacaaaagattggctacaggaaacactcactgcactcattgtaaagtgccttcttcttgcacagattttggtaacataaggtcaaagcgtctccagttgaagggttactctggtctcctctctgtgtgcacattataacatgaattctcttgcacctccctttctatactttttaccccaaattctgatatagcttgacctcctactgcccttaggatccttaatacaaacagaaatactaacagagcaaagccatctggccagactatttcttttcatggtttttgtgacttcttggcaccttagacatgccatgcaaatagttagcatacacgttaagcattgctaatatatttaagttagaattcattagcttttcaggaaggaagcttgtgggtatgttgttctgtaattactagcgataaggaggcttttattctgtgccctgagggttgtgagtttttgttgttgctgttggtaacttgtttgtagagacaaaagatttgcagaaataataggacgaggtagctgtacagatgtgatcagaataatagaaattcggcgtagttatcctctagatgctaaacatctggataaaaactacaacatccattccatcatgtgggggtttctaaatctctgaatattggatcatgtgtaagtaaggcctgtagatttttaaaaggctgtttctctagctatctaataatattactaatactaacccaggccctgtaaacttgtcgataccaattgatttctttgaaggagaaacactccaatactttctagcatttcttttgtgaccttgtaagaaatagtgctgttcaaatttttaagtgagttcagttgtaatggtttcatatagaaattagccgatatattttctaacagtttctgcattatttttagaaatgaaagttttctcacaggaccttttttttttttaaatagcatgacagtgcagttaaaagattcgggacattatttcaatgaggtatttagccacctccttgtttcagtttgcaactgaatgcttcttaggcacgtttcctttactgccaggagtcactgataaacatttaataaaattgcaatttgaatacccagggttctgtttaagtctatattcctgaacttgttttgattacttttgtctaataactggcaaattttgagcaggtagtagaatcatatagtaagcctattttgaataaaattgaattttcgactagctttagagggagactcccacacatgaatatgtctgagtttctgaaaacgagggaacacatgaaggtgcatcttgatatttgagatgagaagggaaaggtttagagtggaagaatgtctagttgccttaacagtgtttagaattgaaatttggtgtctgtttattttgtaaattatttcctcctcttaaaataaattcaacaggcttcttgcccgtcattttcaaacatttagatccctgatccttaaaatactacctttccttgctgtatggcaaaacgtaatttgcaatttctctatcttctcctttccctccacaattgccagctccgttccctgcctctgttcctccaattgtgctgtgcccttggtggcctcagtccactggaacctgtcaaccaacacatctttcacagcccatcccagaggcccgctccatctcccctgtaaggcttgtcctgttcctcctgccagtgtcacttttctgtcctttacaccctgcagagttttatttatattactttttaggcactcatgtttccatcctctgtacttatctctccccattaggctgtaacatgttggggatagcagcgtgtctcactcgcctttgcatcctccatagtgctcagtacagagcctggcacgtagcaagtgttgaaatatctcttggagagagagaaaaaaaatgaatctattaaaatgtctctatgatgcactgcggaagctagacttggtagatcgagtttaagggaatgaagagggggtgaatgtttgctacttccgtatatttggagtatttgataaaacagaagaccagtttctcttcaaacttcatgtcggtttgtaggccaggctgccagggtttagggtacctcatcgcttcctgcatctggaagtaaattcagaacctcaaagctcaccctgccgtatcttttctgccaaggtgcctcacattttcctcctagctgcggccagaggagctggctgtcactcaagtaggtcagcctcaggtgaaaccagccacttagcctccttctgggcaccctgtgggtatatggaggggtgtttgttcaaagagcagctcccctttcaggtttaccctttacacggaagaaatctggctaaattttctcccttttctgcctttctgtgattacatgtattttagtgattgctaaatttgaactaaaccttgaaactaactgcctgctttcaaaacaaaccaatgtgaactcacattttctagtttgtcagatttggggaattttattaatattatttttatcttaaagaaacatcaactggctgagtgtggtggctcacgcctgtaatcccagcactttgggaggccaaagtgggaggatcacttgagcctaggagtttgagaccagcctgggcaacatagggagacctcatctccacaaataattttaaaaattagaagggcatgatggcacgtgtctgtagtcccagctactcaggaagttgaaatacaagaatcatttgagctcaagaggtcaaggcttcagtaagctgtgttcctgccactgcactccagcctgggcgacagagccagactccatctcaaaaaaataaagaaacctcaactgacgttggcatgaatattttaatatcttaatatcttcttcttcagtcatattttttccaaagacaagctgaaagcatctccactcaaatcagtttgaccacgttttcaacaccatgttcaggtataatggttgagtgaaggctattacaaactcaaaactaattcatctggaaatgccatggttcgtttttgcagatatatcccttataccttcccatttggaaaaagaaaaaaggaaacctaccacaggaacaacaaaaactggaatttgtttggctagcagtcagtaagccacattcatttctgaggacgtagaggccgttcagtcctctcagggacatccgccatgataaacagcagtgcttggtcccagcaccttgggaggccgaggcgagaggattgcctgagcccaagagtttgagaccagcctgagcaacatggcgagacccccgtctctatttaaaaaaaaaaaaaaaaagagcagtactgatggatgattcccctactaaccctctccaccccactccctcatgtccatgtaccccacagtgcccctagagataattcctagcatcctcagaggccctgtcaaactattgttcataaagagagaactgttcttgagccattccccgactgatcttagggaggcaggaccggtattgtctaagtgaaggattatataattagcaatgcctaccataagggggtaacacagaaagaatgcaaattttctggatatgggatcaaattctggtttgggattttgaaacttactgctgtagtgcaggccaaactaagactcttggataatgtgaagaaatacattagagagagagagaaaatatggtcagattagtgcaaatgagatctggccagaagcttcttataggaacattcttcaatgttaggaaaatggttcatagcgctattgctaatataggtaaaatggctgctaaaaaaaaaaaaagcaaacactttctgtttcagaagcagccaaataatcaatgatttgatttctaatagtcatgtttgccataaggattcttataataagattaggtagccaagttggtttccctgttgactttatcagtaagtcatcaagtacttctgaacctcccctccagaatgcccaaaaatgtcctacaataatctccccagaaaactattttctggattttattatttttcatagttctacctacagctttgattattgctgttgtaaataaggcaagaattgtaattaagaaagatatgaatatgatataatatcatagtatacacagttgtatgtaattaattaccttattgcccctttgcttgattttatattcacattgtaagctcttaactgtgcatgtataattgattcactatggtaaatgtggttgttttaacaaaaagtttcaattaaggttttattcaacagtgtaattcccttatccaattgtttctgtaggaaaatcaaattcaacttatgttatatcatttttgggactatatcctgttataggtaactgccctgctagaataatggaagatgagtcagaatttctttcttccttcctttattttccctgtgtccttttcccagaagctagctttctatggaataaacttgcctgggcaccatttgtcccattctttcacttgagtactcaaagactagtagacttttgtagctgttatatatgaatatatatgaatatatatatatataaatgcaaaccccctagcacctctcttaccattgttctttttcttaaagaactagaatcaaatttctagaagctctggtaggctttgatagcatgaaaggccttctgggatgttctgaaactaagactgcaagttttgtcccatgattgaagaagagaaaatatctgattgttggcctcatagaaattttgtgtagctaaagtatttgcatgctaaatctttcaaatggagaaattgaggttaagcaaaaataggtgatgggatataatataaatacctttccagatttagcaagcttgctatagtgaagctatcttcacaaaaaatgacacccccccctcaacccccagaatggcttctgtgttgggatcagttagcatgcttgttttggatgtccccagtatggtaagaatgtcataggaaatcctgctatgtgtctatgatgagcagcaggcgagtgcacactgttctatcagggccatcaaacatggactcacgtttcagcgtctgtcatcaatcactcatagacttcataccttaatatacccttcattcctttttgttccttctcaacctacctacctattcatgtgtgaaagaacacttttttccctaaccactaacaggttcaacaggttatttcacctcctagcttcctctttatccctcccacatcctctttgtgctctaagagcaggggaacacactatcagataattatagtctctccttttcaatataaaaactttatgttgctgtttctcaaagcatatcaaagtaaagccatggggtgaatggtacacttaatatagattattttactgagcttttaaaaaaattaaattacccccataccagtaagtgagaggtacaggcagaatggctaaaggcagaggtatttctcaaatctgttcaaattagtctggcatagcatgggctagagacaaaatcagtagatttacattgctagacagtatgacatatcatacatttagatcattttaaataaagtcattactgaatagatcctcctaaaacaaatactattaccacaaaaagtttcttatttaagagacatcagggaccctcatgctcagcctctgttcagtgccgttttaacacagccatgtccacatccatgtgaccattgcagatctgtttgggtggcttagctcttaccaaagacaaccaacagggtctgggccagatggtggaaattttatccctagatttgtttaatgagagaaacaagaagtatgagcaattttctgtaaaacagaaagccagagtaagaggagcagatgatgtcaataaggaaaaaaaaaatctggcaggaatttgatatcatgccctcaattatctgtgttttaaaaagttgcatatcctgattgtttcttagatggtgtttgtctagagttagcttaaaaacctagattgtttcttagatgatgtgtgtctggagttagtttaaaaaccttaggcctttttaattattgttaagacatttgaaatttttaagtaacagtctaaagattctagtacagaggaagaatgtgaacaaatccttggaggtgatgataaagaagtgaattgaaggacaccaaaaaacaaaatgtacctttggatttatgagccagtgaaacaacaaagccactgaattttttcccattaaagtagaaagaagctcttaagtacagatacaaaaaccaacaacaaaacttccatgaaccaagaaaggatagtaaactgaagtgtggtacctgaggttccagtgtgatatcttagttgataaagggtcttgatagtttatgcctgaacagaaaggttctaggatgggaagactacaaatgttaatatgaaaagcatattttgtgcatcataaagattctagacactacagggcctctaaagacagcttattctgaatggttttctatctccttcctggagaacccattagttccttctataaagattcctcttcgatctctagctgtagaggcacaggaccatttcatgattttttaagagtgtaacggtgtgaaaagcaagcttgtaaaatgaactgctttcctccccttcctacctaatttctttctccctctgctctaaagaataggatatctctttctgactccagagctcatgtttaactcagaaagtatactttgcaaatgtcctgcatgttctaatttgtatggtagaaggagaaaatagctcgtctgagcattagtttgacatcattttatcccaacagtctttggaagccaatccctcttcccccttttttgactgtctgaaatgcccttgctagccagacccctttgctagctacagtgtttgcacatttccttgttaatcagctgcgtcggctcggagactgtgtgttttggtgttgtttgtgtgtgcaatctcgtgccgcttcctgaacgcatgtgtcccttcccttcacagcctactcgacacccagcacctcccccgcaaaccgattcgtcagtgttggaccacgggatccaagctttgtaaatatccctcaacagacacaggtgggccgctctcatcttttctgtatgtggtgcagcttgtattattcatcaggtgcattttaacttgtcttttgcacaaaaggccacattttccagaccctgtccagtcttccctttcctcctgatcccaccagccacatttccatgtgttctcagaaatcacagaaaattttgcctgcaatttttgcttcttgtattgagtgggtagaagaagaactgttttagctatggcacaaaaaggtttcccagtgttagctagtgtgtgttccctcttataggaattcatggtcctctaaatgcaagcagacagaagcaggcccctacagaacctgaaagtaatatctggttgccagtgacatcagagtgcatgctgggcatggagggaccagccactcctctgtattcattagagggtccccaggcacctggcaagctttctaaaagaaagagggagaaaagggtatatgagccctattaagttgctggtgttggtccagaaataagacgtgtttattagtggttactgctgaccactggggagcaaggtgcggtgggtggcaaggggtgtgtatgagtcatatctgaagcaggtgattgagagaagaggactgctcagacatccagagcttgtctgcccatagacagttgtgttttgtgctagtctaggtcaaggagaagaaatatttttgaaaagttttggaatggctgctgtatattgagaaacagtaaaaggctttttaagttcaaagttagtataggtagaggcatttagaggtttgtgaaatagaattagattcacgttttgaaataaactctctgatttcctaattagaacatggcgatattttatcataattaacataaggaaagtattttctctgtaaggttcttagcgcggtgtttgaaaacattcttggagcaattttgtgcacatgcctgtgtgtggaatctccagatgcctaatttataactatttgcctctgtttgtaaaactatggccaggtgctatatgaatgggatagatttgccttcctgggtccatttgccccctctgtaaagggctttggtttattgctatgtcgacagcacaggttaaactgcattgtatctgaagccttcctcacactgaagcagggtcacagaaagtacagcatcagcagagaaggcagctgggaggacagggggagctaaaaggggagggagaaggttaactcttgaatttcccacctctgctgtttcttcttaaactggcctgcatatggcgtctgatattaaaatctcctattcagtacctctcacaaaattctttcagttatttgcttattctcccataccttcaaatattcaaacacttttctggtgaatttgaagttgcataattacctgtaaagcattaaaacagaagaacataatttaattttgtacatttggcgtaagtgtccaagttcaatgagagggggaaaactggagatggtggctctatattggatgattgcttttcccaaagcacgaatgtcctcaagttgcttcattaagagcctttaaaatgcagctttgaaatgtcctgtttgtattttacatagtattttttatataagctgtgattcacagccctgaaattgtatgctgtgttcttttcaatttatttctttataatcaaaatgtattatatgccactgtggctttccttcacaaatgccttacttaacccagaatctgagttttcataatgctgaccacaaaaattcaattcttaaaaatccagattttccacgcatctggatgaatgatgtcatgtaggcccagtattggcatctggaactgaattttttttttttttttttggtttctgttaaatatttggcgtcatggggacaacagcttaaatgtttcttaccatagtgacacctgccacatttggcttgaagaaagtcattcccaattgtctaatgagaaactatgttaatggagttgtcatttttcccccaaaaaaagatatcttgaggtaaaaattatgtgttctaaatattttaattttaaggtatatatattaactcttcccttaaatgaggaactattttctgggaccacttaaagtgttagatatacgtagatatagataataaaaataataatataccttaaaaaataagttccctttcaagaggacatcagttcagaagaggaatttttgacaagaatttttaaaaacataattagaacatggtcggcagatttcctaggcaaacttgtgtttttctatattgatacccttgttacaaagcatgacatttatattaattgaattacaggaaaagttatctgggaaaacaaaattttgctttctacctatggagaaataagaattgaagagtcacccaagcagatacttaagctttctaaatgtagaagcagtatcttgtacataaatctataaacagatgcaaaataaaatgggctttctgctcccaaaggccagtgtccagtggaaatctcttaaaatgcctgaagcatcatcctgtagaagatggaactgatggggtctctgttttttcaagtgggtagaaattgaaccaatgcagacattataagtaggcagcttcagactatcataagatcttttttaagaaaaagagttatttgattgtatatagcttctactgggcattttctatgtactaaatccatcaagtatgtgatgcacctaatctttatagtcacctaataggatagagctctactttatagatgtggaagctgagactaaggagattgttgattttcccaaggccatacaatatagtcaggagtggagcaagaatttgcacccagttctgtctgacagcaaggcctgtgctctctaaccactgtattatgttactgccttatgagctggtgagctcttttccctggggatattccaacagcaactgatgctcacttctcagggatactactggtggagtccctgcttttgtccctaagactgcattaaaatataatctttagcgtatacccccaaaaatggcaagcaaagtttcaaagagatatttgttcacttgtggttgtagcagcattctccacaatagccaaaaggtggaagcaacccaagtgtccattgacagatgaattggttaaacaaaatgtggtctatacatagaatggaatattactcagcctttaaaaggaaggaaattctgacatatgccacaacgtggatgaatcttgaagacattctgctcagtgaaataagccagtcacaacaaaataaatactgtatgattctacggatgtgaggtacctagagtagtcaaattcatagaaatgcaaagtagagtagtggctgccaggggttaggggcagggcagaatggtgagttagtgttaaaggggtacagagtttcagctttgcgagatgaaaagagttctggagatggatgttggtgatgtttgcacaacaatgtgaacataccaaatcccactgaactgtacactcaaaaatggttaagatggtaaatgttacattgtgtgtatttcaccacaatttttaaaacgtgatcattaaaaaagttctaaagtccttttcacctcttaggagtaaaaaattctgtaaaacagtcagagcaagtggactgttgatcagagtaattgtgtgctgactgctcagaaaagcactaattatcatgcccagcacatagtgggtactctgcatacattggctgagtctaaatggttcagaaagaactttaaaaatatgactttttcttattatattcataatacatgttaattgtggaaaatacagttgagaaaaataataaaaatcacttgtagtcctactgttaacatttctgtataaatccatccagagtgtttctgtgcatacaaatatattgcaaaaagtgagatcatattatatacgctgtttggtagcctgctgtttcttccccttaacaatatattatggccttctttccatgtaaattggaaaaattgaatattggcttttattgcatctattcatcatctgtaatgattggtggggaaagataacgtggataattgaaagccatttttcctcctctttcccttgtagtctgtttttttctccagagaattcctcccttgactgaagcagaattgccttctctttagccttgccttgagctagttttctttcaaactgccttccaattgcattgtatatctggccctggctttcggctttgttcgaacattcctgccgagttatctgtcccattcttccacctcacttgtctgctacctctgctaccatcatttgcccctcatttttttcctccttctccatattgtaactgatcactgagatgagaggtggccacctccctacagcctttagaacacccatcaatactgagaaactgtggccacttgtcccaccttgaatctcttatttttcaacgttgtcccgtgacagctgatattaacatatagaaaggtctctggggcatacagtatttacttcactttagacactattaacgtgccctgcatgcccaccgaatggtataatgtaatgatagggaacctgccattgtttcaaatagcagaaagccaatggccatttcaattgcatcccataacttaatctgatccctgaaaatgagaaccattaagaggaggcgtttacttaaagaaaaaaaagttaatatttcatcatcaggtagtaaatagaaataccagtttccacacaaggggactgagcaaagaactcattttgatacaggttctagtttaatcaaaaggtttaaataaaatgcttaatctacagaactccaatgaggactaattctttaaaatgaaaaatgggtgcaaacaatattaaaaacaggcatttcctccttaccacccaaatctatcactgttttgcatcaacagtatcatggtacccaaaatgctatttaaaaccaaattaccatttggactattagaagaatcacttggcatggcatgggcctgatttgttgacaaaaaggcacaggtgctataacctttgcttaataaatcatttagctgcctgacttgcaagcagtgtgattgcctttgcctcatgaaatttacaaatgtatgcacaagccacacacttcactgtgctggaagctggctgatctggagaggtccctgcatagccaaattatgggcatgacacccgttgtctgcctctggtgggggtgcacccagaatgggagaggtggagatcatggagagcattttgagctgttgccattccgtgtgtcatattcctgaagctctacctgagaaaccaaagcttagaccatctgtggaactcttcataagttcctttcttcagtcatttagtgtttacttaattgcttaatagagcctcaacacctacaaagtacagggaataaaaactctcctcgagttgttcaaagtctagcagaggaaacaaatgtgaagaaataatggtaatgacaacaccaacatcaaaacagtgtaatcgcagtactataaagatttgtctaagaggctttaagacaacagagttgggtataggaactttccaaagagtggaagcagcagaagaggctggatagtttttctgtccttgtccttgtctagcttgggcctaatgatatggttcttgtacacttttccctatttttttttttttttttgccaatcagatggtagatcgtgttctaacccatcccaataagagacatgttcagttctgtcttccctggaccagataaaattagactcctttactgctgcacaaggctcagccagaaaccccttcacccctcatttccaagaaacacctcctcctggtggtacatcctcacttgcccacccaagctcacttgagattgcatttcagttagctgacgccattcccgggctcctgcccaccctgacaggagctgcctgagtgtagaaggttagttaccacacagaagttcaaggagcagctggagagttacaaagacaagaaactcagatttccttagagggaaaaatatatatgtgtgtatatatatatatatatacacacacacacacgtacacacatatatatacacatatatatacatatatatacagagatatatatacacatgtatatatcccaccctgcaaccctacctcatcttctaattagaagtggatttgagcatttcagtttcaagccctcacagctgcaaactcccaagattagagaggaatggcagataaaattccactttctcctgactttgagccaagttaaaagtcttattggccaaatgaatattctacagcacccgtgcatgctaggttctgtgcctacactcgctgcagtactcgagagccctctaaggtgctacatctccattttacagatgaggaaaccgaagtttcagaagagtacatttgtcccatggtaattgaagtagctgagatttgaaccagtctccagaacttctgtttttcacaaatacttatctgcatccccagttgtttgtagtgataggttactgaccattttctctttaaaagagtctaagattgactcacactcttatatcaaggaatcagaagccttgaagttagtcccagtgctccctggctccagtgggactgtgctgaacttcgttcttctgaagatctgccccggtctcctgttagttcatgtctctgtaaaaccaagactgaattcattctctcatcctgcctgggaagaagacctttactaatgatattagtctgcatctgtgggaacagctagcctttgtccagagaccagatagcagagcagctaagataactcctttattttcagattttagttgaagctttattccatcacttagaagcattctgtgtgttttatttttgttgttgttggtttcttttttttttcacagtaattcaatttatctagcctagttttttaactgtaaaatagtgaaaatagtgagaaataaatatgtgtgtgtatatatactcacacacacacacacacccttatggttttgggtcttaaattctgttagtgtaaaaaaagtgtttaacacctaatgaatacctaacaaatgatagctttcattgtttggttaataactaaactcttattttctggattacaaagtattttctcatttgattataagagttacactttgaagtaggcagagctattgttattattgttatccccactgtataggttaaaaaaaactgaggtttaaagaggggaagtgactttcccagaaccacatatccagaggtcagtagagtcaggacacaaacccacttctgattccacgtgtcctatgaaggaaggacttgtgtataagccattcagcacctgctgctctatggtcagaacctacttaccaaaagcaaccgtctagcaaattaggaagcctcctactacccactgcaaaatcctaaccctgtaggttgttccactgagcatcaaccttacaggtgcccaaaagcctgtttaaattgggcacagctattcttcccttgtacaggcagcagtctaagtgtaccattgcttctcttacgctaaattgtgcctgagaagggccttcccaaggggagacaatgtctctgagagtggtaaggactggcaggaagtgaatgcacccctcagaatctaaagggaaaggaggtacctaaatcgaggtggtgcctggtcattttttctcgtatgttctcagctccagtagcaggtgttgaatagtaagcaacacctcgcagagatgagttactcatgcaatctgcttcccctccctccatactactgtgggcaggagtgaatcgtcccagcttccccagctcccacaccaacctgtaagttcttgacacattctcttcacatacacttggcggctgactcactgacaggctatgagacactcttaaaataaatttttcaataaacagagtctttgtctttcaagttttaatttggcagcatgtcgtagacatccttggccacaaacttcacttctggacaaagttcgagccattaattctagatactggtcaccttttctctcagttcctgttcttcctgtcacctttgctccacaaagatttgggggatcttcttagttgaaacaaattgatgattattgtaataattaaggtctctgccatagtatctggcacacaataggtgctcagtaaatattgcttctcttcttgcttccttttttttaatattaaagtgagaacagtggcaatagagaaggggaaggtaaaaaagagatttcacaggaaattttacattgtatgggagaggaagggaatagaccaaaaatctgctatccattaaattagcacttggaactgtgggaaaagggggacagaaaatgatgtcaggaaaagggttggaaaaaggagttgtgagttggtggacagaactgacaggaactagatcaaaagttgatgatagccatgcatggaacttagaaaaccatagtgccaagtgcagaaatgccatcaacatttctagcttttaggtgggtctccataacaatgcttctgatcagtgacattccagggtactaagggaaatgtactgggtactcaccaggtttctctgggggaacaggaggaaaagtcatgattcaaggagtaggacagacctgttctgacatcctggctgtgccatttatctcagtgatcttgtgtatcttaccctttaaaattcagcttcctcatctgtgaaatgaaggcaataatagtatctacctcatagaagaaaccccaattaagtgtggtttaagccagtcaggattattttcctcccgtaacaagaaatctgtgagtgagtggttgttggcattgtttcagcgctgcacgaggccaacaggaacccatgccgttcctaacattctgctctgtcttcctcagtatgctgcctcttcagcctcatgcttagagcctctgacggcaagatggctgctgcagctccaaatagcatagtcatatcataccttatttttcctctaatatcagggaaaaggccctgctattcctcctgtgcaccctgctagcaaatttctttgtaggtctcattggctaaatctgggtcacattttaatctctagctgcaaaggatgctgagaaaaccagcagaagattatcttgattggctcaaatcatgaccgtcacctaggaccagtcacatttgcctctctaagcaaaattgtcccaaggaagaaggcgcaataggtagtggatagactgttaataggatctgccatattcttttttcctattccctgataggtttcatgcacttttcaactccagtagttgcacttgaccctcttgtctctgaatgcttggcttattattctgcctttcctccacacactccctatgtgtttaggagatgtagatgctatgtgcgtgactgtgcagaggtcatttcttttcagcctctgtttgaggtccaggatttgggcagaagtcctggcgttttgtgcagacctgctcccatggggctgggtcaccgtgtgctggttaaacatggactctgaaaaggctgagttggaggatatgtgcctttgtggttgcaggggagctctgtgaaacagtgccccctgggtgccctccagagtgcttaccaaacaggcagcaataggttctgggtttctcttttatgacttggaaccagatgcttcctttgcaaaggaaaagagcctggttttgcagagcttgagtcaacacaagttcagagaacaggaaaatgagttgactggccctgctgcatgaactttgaggagagaactcaatacaggtggtgttctcgctgtccacaaagtccttgcttgtgaaaatcctatgcccaagaaattggccttaccgaatatttctacactctaaataatgactgttcacatgaggaaaggattcagcattaggaatccttttggacctaggctttcccagggcttctaatgagtctaaggccttgaaagttccactgacacacacagtttcaagcccagagcttgctgtctaatgtgagatccatcgaagatctcacgtgaggtctcagtgattcttcctgccacttttctcacacccacctgcttaccttcctgtttgtttattgaggacttaggcacattctttgatctgtgccctgtctttttgggatatagcctttctattgagtctgttcattgagttacattccacagcacacacctcccccaaaatatttgcatgagaatttttcttaaggtctcacattgcttcctttacagcagagatgaaataacttagcacttctaattggcttttcactttccaaacgctttacacatttaactaatgagtcacatgagcttgtgataagccggatcccttgtcttggagcagggacactgggttaggacaggctgttctggccctgtgtttctcaccctcaacaccctccttcctcagagtctgaatgtgttgagataatggggatgccaccaggcacagttgttctcagcacagggcaacctcggaccctcacagtgctgccttaataatgtgggaagcaccctttgctgccctccagggctggactatgctgcatatctcctgttgccttgactagtgaagggaagcataaggccagccctcatgacatacagcttctgcccctctcaagcgcagtcttccttccattggtccctggcagtgtgtctgtgcatatatggggaaggagtggtactagggggatagaagaataacatagtaggtctaataagggaactgaccataggagggacctatggtcttggtacacagagaaaccctggactaggagtttttctacatcttggtacacagagaaaccctggactaggagtcaaaatacctggattcctagctcatctctcccacccgccagctgcatgattgatcttagagaggagaaagaagccagaatttattgagcacctactatgttcctggcaccatactaagctggaagggaggctaaagatgtacattattcaatccctgccgtacatagctcacagaaagaaaagtaaataaactaagatgtgatcgatgaagtaattgaaataggtataatccatacagaagagtcagtaactaactctggggagaagcatggagctcatggaagatatgccagaggagaagacacatgagtggttttgaaggagacagatatacttggtggggagaacattccagaccaggcaggaggaacagtgcatgcaaaggaacagcagtgtgtgtctgaagaaccctattctgtttggtgtatctgtcagtttacagtagacggcagaaacattagatcagagtctagtcgtgaataaatacatacctttttccaagggtagtaaagcacttggactttattctgtgggagatgggaagcaggtgatgggcacagtgggatctctatatgtgaagaaacctctgccttgcttggttcaatcctcctgagatacaggattttataggcaatagtagcattgagacctgtggtcatgaggtaccttcctcttctgggcagcataatgtagtggaaaaaatagaagctttggagggagacagacctgagtttgatctcagtatgtgaccttggaataatttttagcctttctgaccctcagatgtcacatctataaaattataaatgaatgcctgcattccacttagagttatgtaaagactcagtctagttaggatgaaaagccctcagcaccctgcccagccagtgtgtggtgctgccttttcagccctcaggagggaacctctgtgagcactggaggcagggtgctgctcatttatctttaggacaaggggcctgtgaccacaaagaagaaacagaaatggtaatatgatgagcaccccggaggtaatctggtaatgttctccctgagctaaatctcttctcaccgcatcctcccgtgtccattttccttaagttgtgccattaattctctcattacccagtggaatgatatttatgtattaagatcatacttagcatactcccaaggagcaagttaaagttcaactaacgtcgccagtttctcgttgtaaggataaatacactgaggaatccatacggagagcttctgtgtgtcttataatttcatattaaaaaaagattaaattttatactggataagagagggaaggaaaaaaaaatcccagtgcaaaaacaagttgtgaacctaggagcacagtttctgaatgtttattttgtcagatacacagctgacatgattagttctaatggggtggtgatcctcattgaattgcagattggtatgagtgactgaaataccgcagggacttaaataagtggtgcatatggtattacttaggctgcatcctttagccaaggtgaaggcttcgttttctgtccattcctaacatgcatgcagacacacacacacacacacacacacacacacacacacacacacctgctacatatgcgtccatctagtccagaagctccacactgaacatcaattacctatctagagtaaggctggctggcctttacttccttccctttgccctgtgttacctgagtgcacccccaagcccccacactctccagtgtagataatggtgtatcagattagtctgccttgctgctgcatcaagacccagatcaatttattgactctgccagagtggctggtacagtaattgttacaagagaagaatagaaagtgagaacgtgtacacatgaaaaataaaaatgacgttttgttctctcctgccccctcccccgccttttttttcctcatagatctttatgtgtttacacagcagagagcactttacttaagttaatcagctccttctacattattaattgtgacagggtgccacatgacaggacgagtattatgggaaacattgatctcactccgatggtgtggacctgagcaggtttggtattcctctccctatctcgctgctttggggtcccatcaaatcacatttccctgattgacaacacggaatgcctcccatcaatacgattgattttgtgaaaaggacaaggaacatttttcaactggagagagatgaattgtggttatgggaaagagagcatctcagaaatctttcaggttagaagcctaaattgggaactaaggtattcttgtcatcccaaacacaagcataatttgtaccccctgaaaaatggtattaggagaaacttattacaagtgaaaaatagacttagtggaggccagcaatgaacctgaggacataatggctgtttttaaaaggccacctgctaatttttttgtgaggaatttttggttaagtgcacatctttgaaagacatttcattaaagttcagctttcatggcttatacctgtagaccctaacataaatcctgtgtgaacggacaaaactgagtgggtgtcatttgtgacctggaaataaaaggtcaaccattgaatttatagcttttttagtgaaaagaacataaagattcctgccaactggagtcaatccatattttaatgtttcctagttaagattataaaatcaagggattaggatcgtgctgctcaatgaaggtcaaaaattaaatgtgatgggctaagtgtcattcccatggggcagaagttaatatttcaaaaaccatttctaccactggcagtcaagaaatgaattgtccatgatcattaaccaagttaaggggaatcccactatcattactaaatttaatgatgattattatactaatcaactatattattaaattactctgctgttctgtaatgtccccaaacagtaatagtgaattgattgctaccaagtaattctcatatacagttgagaacaagttgagatgcaggatcatggatgaaggcctccttttgaagaaagaagttgtggctattttatggataacagtgataacgtagaacgttcttttaagatgaagagtgagtggcactacagacctgttattaactataattcattagtacatgttttttaagtacaaaaaaagaacacgtatttctctttattgtgtttttttttctctttcagatttttgtatcctcctcccgatgcttttttttttcttttcttttctttgggaaaaagaacatctattttgccagattcctttttccacaaatttttagagctctggatactgtctactttggatttttatgaagagggaagaaaggatatttaaatgtctttatatgatgactcagacacatgtgccctgtaccattttcaaatccattttaagatgccagtatttttcaaaagttttagaaatttccttaaagctggtaatttccttaaagattatctactccagactcccatcatttttcagatacaactttaagaatattttggaataaagttcatatcattttaataaagtagcacctccaaataagaggggccaaagcctggggaactgaaacaacttgcaaggccccaaagctaatcagagacagagcaggactgaaatgcagggacctgttatgagtgaaggaagggactaatggtttaatatgtggcttagaaaatgggtgcatggtttccattttacaaaggtgttttataaaagcccaatatcattagactgactcaaacgcattgcaattccaaggaacaaatgcatgtaattcagaagttcactttgcaggatttactttcatagactgccgtgcaggggtgtgtgtgtgtgtgtgtgtgtgtgtgtgtgtgtgtgtgtgtctgtctgtctgtctgtctgtgtaacctgtgcttccgtctatgctcctggacagcttttttttgcatattttcctatcttctgatcttcacagtgcagacaaaggtcaaaattcccatctaccttcacaggcaaacactttaaagtgcttctacatgaggcaggttgtagggaggacctttgatttaaagttcagcatttacatttgtaattttgactaatttctgtgctagcattaattaaattgaaattatttaattagaataaaactgaaattgatcattaggattaatttaacctgatagactttgtgtgcctttctagacaaatattatgaaatatagtgataatgaagtagtgagaggtataatttcacatcttataatgattttagtatccagttgttctctctgatatctagatagtgctgaatattgctctttgttacatcattaccatttagctagggccatgctgtatctcttatttggcctcttcccaaacatttttttcctgtcttgaagtctgaagatgtaccaaactcccttcacaccacccccctgttaacgtcattgttccctttcccccacccccaccgtcttccaggaaggcggtttgcttggctcatcccttgggtcttgcattgcagtgacctttgtaagccaagaactgccggatgaaactcattatggaattcgctaatgctcctcagccctggggtcaatactgtcaaatctggactatcccctcgcaccccttcctggctgcttgctttgagtcagaagcaggcacggaatgaagccctgacgagggatgccaggcactgagtaggtaactccaagggagtacaggagagaagcgttactcctcccggtgccagattcgcttccaggaaatagtttcccctcttcatcccacaccttccacatagtttgatcaagcaaacacgcttccaaagttggtgccctctgtttcttaaagaaaattataggtgaatgaaactactattttaccagaagaatcagtataaatgaaatgagattagatctgaatctacctacccacacatgaacaagtataaaacactttgaactatcaactattaaatcaactatcaaattattttgtcttcaaaaccattaggatccacatgaataaattaaatcctcaggaaaatgtgcaaaccattttaagtttcaaatttctcccattcaccattttgtcagagttgcttaaaaaaaaaaaaaagtaacattagcagttatgtttaataggcttcctgtagcagcccttattggcaggggtccaaaggacagtggaaaatgaaccaaagtttgatagatatttatgaaaaagaaagaagaaaaaatacacaaaagaaagaacacatgattttcagtcatttggaattgactgaccaatgagaaattatctcttatgcaaattatcttctttctggaaatcaaccaatcagtcctggctaaaggctgagaaacttaagattgtaagcccaaattccacccaatcactgtaactaaactgctgctcccaaagaaaccagttttatcatccatttctgcagaacgtcatctaaatggattccgctttcattcatgtccttatccagtaagaggaagcttctgatttttccagcagagggttttatttagaagcatattcacatttaatttggttttagaaaacccttaatgttttttaatattgagctaggttgagttcaggggattgagaaaaaagactaaaagctttgcatatagctagcatgctcgtgctattattgaacatgcaagaaaagtgacggctcaatattgcactaggttaagaaaaggccatgatctagcacatgaagatgaggtttctgtcttccgccagacagagaggaatccccttcccccaccccaacaactccaaagataaaaaagcatcagttacagtcctgttaggagacaaaacacaaatattagttcatttcatcctcacaagcaccatgctagctagcaaggtggtcttcatcctttcttagcagaggtgcaaactgagatccagattcaccacacactcctagtccatccacccccagccatgcaattgcttctctgaaccccaccacccccacagcagtgcttactcttgaactatttatctgacgcatcacatgtcactctgcagggatgcagctgctgaatctgggtactgggaatgccacaacctgcagttttgccaggtatgctcacctatcaggaaaggactgctccagtatgaaaagatgctataaagtaactcttgagcattgccctgaggttacagttactattagtatcattgatttattactgctgtacccacttgcttgctgttatagataaactccaattcagagagaagttgagaaggagagtccttggtgctctttctcctgtgccctttccatttctgcccatgaagatgatggctgctttctctgaactccttgacccttgcttagcaacaagattgagtcttaatttcaataagccaggaaatcagctctctccagattggttccctgtgggcatctgagaaccccttcaactcttcctgcttctaaatgaaaaatagccatttcttcctctctgatgcacctttattggctggaaaatccctgagatctttttgacctcaaaaacctcttaggtttaggatctcttttgggctgggtacatttctcttcataacttaatcttcaaggcagaaaaaccatttaagcaaacccttgttttaatatttgaagagaatcaacgtgcattgaccatttccacagaaagctgaaactcattgcacagaaattttaagtcatggccatgagattctagaatctacatctagaagccattttcaactataatgttaactagaatgccttttagggaaaattaagaagcaaagttctcctggcccctgccctgcctttctctctgtccttctttgcctctggagtagacctgaggaaatttttaatactaacgagaacttggtgctgcgtagcctctgagtctgaaatgcctgagaaagcagtccagattccaactgtaaaacattccttcaccaagccttggaaactaacatacagaggccggcagagttcagagggagcacatgtaaatgaggctccgttataaactcctgaggagtgttttatttagtttaaacctgaacttgaacttgtaaacggtgttccttgagaacaatacagaaaggttgatgcagtagaacaggaagtcacattttagctcagacattttactcctttaaaagaaggaaactatcttaaagtatttcttaattgaactgtcttctagaatagcacaaattggcatgtctgcaagatttttgggattgcagaatcagaatggaagtgtatatgtatatatatcatttgaacttaccaccattcttgcaaaataaacaatagaatttcctatccatatggcgatttaacaagaggatatttaaagagcctgtccacatataacagtcatgccatctgtaattgattttattaattgataataaagtgacagtagaggtgtgggaccgtttcaaactagcactgtgtgtgtgtattgagagtttgttcccaaatctcagttgctggtagagcactaccaagtggaatttatccgaaaacaaagtgagaatgattttgtacgcatgctcaattttataaaacacattcttgaatcagtcttcaataatctttgcttgcgagatctccatctcagaagtcactactaaaaaggtaaaaaataaattaaattgtctgtgttagaatgatattacctctctccaagaagcatagatccctgacagggaagccaagcagctctgccaatcacgtatgctatgtacatgtccaggttgttggtaaggcccttcacggagactgtcaatgctataggatcttcaccttgcacaaatcccaaccgcagccccatcaagaagcctccccctcatatcccctggaaatatttgggaggaatctaattgtttgtagcaacgaatattgcttagttgtaaatttaatctacaaatttagaaggaaataaatctgaacataaaaagcatttgctgtttcagcattaaaaaaaaaatgctatcatttgaaactgcaaactctcccatgtgggtttgttttgcaagtcacgtcttaacaaagacaagttttgttgccataaaaccctaaatcctaccacatcctcagaaggaggagaaaagtattgttcactggttccgggtttgggctttcaggataacacagagctatgaccgcgcacagggaaattgtttggtatttatccagagttgttggttcaggtgaaaccctgacacacacatacctcccatctagattatatcagtgcctcatgtaattatgctccttacattttaggcctgtgtctgaaagtcgttttgtatttttaactttattttttccctcaaatgatgtgataactagtatcctgaggcctgttttgcagaaaagttaaagttggacccctgactccctacaaactaggatttagatctctgactccatgatctgactttttccatagccaagctcattctgacctcaatgaaagataggaacagttttacctctcccaatatcccatctaccctgtgaacgattagaaaaaaaaaatgattcctggcaccagtgatatctaaaagcaggtgttcctagaaggtaaagaaaggcatagcaacaggatcttgtagtatccttagagagatctggtgaagttcaggcccctcagcaagccagtgactgaactgggacttgaaccaggccaccagacccgcagtccagtgcttaactatcttttctcatgaatctgaaaacgcagatgccacagtttcctttgcattctctccaaatgctgcctgtatgtcttgtttctttggctcacaacagaagccttccaggggttgtggtttgcagctcaaggccttcttcacttcatcttaatccttagggactgttggtctgcatggcctgggagagagtaggggtctgtcatgattcctgcacagggattaaacacaggtggagagggagggagacactaacttgaggggtgggaggagatagagaatggaactagaaagaccaggaacagtggacaggggagaattaaagaggtaacgagcagacctgtgccagggcttgagcgtggaagtgcctgctggggtggagaagtccaaaggtggcagatgctatccagtgtctgaagggcttcttggctggaaaggttggtttgggaattcatttctggcaaaaggccagatcttctggcatactgttgcaggatgtatctgggagaatttttgaaataactggactttttacttcaatgttattttctctcttactggactttatcttcctgcacaatccacactaaggtctccttgattgattggctctcaacctgagtcatgtttgggaagagcaagagcgaggaggcacggagtagaatgattattacaatgtggccacgctctgctgagctccggcctccactcccacgcctctctttttaaacaagaaaggttacctccctgggccaccattgggccaaccccaagtgtttctgtctgcacttgttagacaacaggcatttaattaaaattggaatccgatgtgtagaaaacatacattttttcatttcatagctccccaggaagtcatattcccttccttccccactctcctcaactctccccctgccaaaaaaatttaaaaaaaaattgtgaaggaaaagattattttaatgtgaaaatcaaaaattacaaagggctaggctgcttcttcattttttgcctttgggggagacattagccaatcataaagcctgtattgtgtcttcagaccaggagccagcttttttatggctaacttcccatatggaaaagggtttgtcccatttcagggcattaaaatacagcctttaatgaatttgtaacttaaatcttttatcttgctcttatgcgatagaaagtgtggcctgtcttctgatatttgttggactttgtggaatcaacaaatacaaagaaacagataataaacatgaggcccaagttgaaaaataaagccgcgaaaccccgtcgccactgcattttccgcagcagagccatccactgcactgtctgggctccacccagaaaatccggcagtgccatcatgaccaaatagataggaactctggacaatttcatcgggtcattgtccccttaatctccacgctgcacctcagatctcaagcagcttccgtggcgcaggctcaatttaatggatagaatctatttttcatgaaaaagcaggaaataagctgtctctttcataaaaagatttacaaaatgtaatcattgttgaaatattccctttgaactgccgtgtccacgggggtctccggctcccagagtcgtgcttcattagaaccccgtcataagcggctccagaagggcaggtacgctggtggtgcccggctttgatgtcttgaatgaatgaaagaaaagcacaataaaaaagagctgttgatcaagcataaaatactctttaagctgacagaatagcagcgttaacacaccctaagctgcttttagtttttcccttttttcctcacattttcctgtgctttgtgtacagtgggggtttgtattttataagaagtctctgatctatgtagtatgccattcgctaacaaaaaccaaaataggattgtttctgtcccacttggttgcctgactaccccctcccttcctccccttttctcctcacccccaacctccaaggcgtgcagtttagccttgcaaggcaagggcccaaatgcctttcataaacttgagccaattccttttgtgttgtgggtttcaccgctctgattttaatatcgcaattaaagacagatttttattttctcaagaactttctcttgcaactggggaaatggaattgacgcagctgctacttttaactaagaaattatatcattaaataagagaaagccgccttgtagagtgatttgctttcctggggacgttgggtctcacgtggaccctaaggccccagaaaccgttcacagtgagagaacccagctacccctggctttctggctttctgtagtagcccctagccaggcatttaatccccacaaaaactgatacagttgttacctccatttcatggagtctaaaactgagacctagtgatgctaacttgcctaagattatctaactagttcataatggtgccaggatttttgtcattcggaccccagagtcctggctcttacggctatgcacacagctctctagtaggatcttggagcaaatgcggtgggccggagtgcagtttttaatccagcagtctttgatttcatgaggtaaaaggttacgtgatgaaaaatggaaaggaagggagaccaaaagaaaaatgtacttggtggtaagagagacactagggcaagctggaatctcgtgaaagattcagactttggatgaacagtcagaataattggattgtgtatgcactctcaaggtttggaggtactggatggcttattgggtaaaaagattagtgttttcccgtcttgaggtctgaaccaaacggaggtcttggctgggagcagcacagtcattctccagggattggtggtttggacaacttctctgagcttgtagtaagtaggcagcagtccatgttacaaaactattgcacatgctactgacgcagttggccgcaactggccccgctgcaacaactctcccgtcggaactgcctggagtggcttgtggagacttgtgtccctcgagggagagtgtctgtcatttggggagacatggtcatgtggcacgagcatgctagaagtcatccatccagatgccttgctttgccctcattggggtgactgacaccaggctttggtaacctcggatacagcttgttcttccttccctcctttatttatttaacagtatttattacatgcccaccctggcatcccttagatagccagcttgcctgggatgaaaacaggtaattaaagtttagcaactgtgacagaggagaatcctgagggtaaaggccccaagaaagacccctctgaagaagggacatctaatcttagaacccaaggactagtaagcattagcaaagccaaggagtgggacagcctgtgcccaggcctggcagggagaaagcatttggctttgggggatccggaagaagtttaaggcaacaaaagtgttgaggacaagtggtgaaaagataaggccacaaaggtgccggggccaatcccggcccattacggttttaatagttttctgtacaataaacaagtcttggttcggagttactgaaaacagactttctttaattaagaaaataaaatcaggcaagaaaaatgattacagagatcaaagcccaaggctggcagtaccagtaactaacacctgtgtacagcatgacacccttttcagaagaaaccagtgtaaatcactgctgcctctcatgaatacagactggtcctcacaagactctgagggtcccaggacagggactggcttgcttgaagtcacactgctggtcagtggaaaaagtgacaccaatcctgagtcctttggacactggatactgggcatcgttcattgccagaagtttataaaatcctattgggagaaaagcaggctatctggtatcatgaagggtctagaatctagccactgcttcctgatagacaagaaagtcctacagggcagggactatattttactcattatatccccagagccagcatacatagcacctagcacatagaaggcccttagtgcttgttggatgagtgaataaatgctcccaaatggtttatgcgaatgtgagaaactcagagtccactgagagacctcatccatttctatcatattgagatgggcagaagagactactgggcttttggctgatttgccaaggacaactcatttgggctaaacagtaggctttagtccatccacagaagtgcgggaagccaaaaatgacccactggagtagtgtgaagtagtagtgcaaagctaacacctccccaagagagaatgcacaacagcgacagcagctcctggagtcttggcttattggttggctgagtcctctttgggggctgatgaggagctgggcctgcagggtgcggggaggccagcctgtgtttgcacatttccgttttatgtgtgtgaatgtcctcaaataacccaccttgcctgcagaagaaagccaagtgtcacacccagttctggattccacattaacaacctccttccgcagtgttaaactttgcccttgttgaggccttttgtttaagtttttaatctgaaaaacagattctgctgcatcacagtccactctgccctctgcccctgccaccccagcactctctgctccttttaggggttaaagtaaaatacaaaatacaaaaaatgtttctcagacatttttctttttcctctagaatgtgcatcctgccctcttagtaaaaagaggatgtaaaaagccttttaaaaagttgttgcacacattagagcatttgttgctaacgcaggggttgaggccatggcccgcatcagctgtgtcttcagcagccccatgaccacattttggaagacggcccctgtgttctgattgctctctgtgaggcgtacgaaatggaagagattggcaccgtcagaggtaccttctgccatttcaggcttcctgtttaggatgcagtcggatagatattgtttatggttcataaaacctgactactgtgagtattccagaatcccagcggaatgggattcgaactttcatggagctgtaaattaacgggcggcaagtgtgataaaactccttagagaactgtgaggggaaaaagtcgtgctgcaatggttaaatgaaattttataagcacattcagtgtggagctgttttgcattacatgagttgaataccttagagacgccacatctgcaggcactttattaaatccttagtcagcacttttccaacctgatgagattacttcttcatttgactggagaaaaggaaagctgagctcttgtcctggactgcagatttcttttgatgtttcaccttgaacattgaaagaggacagtcaccccacttccctccccactcccgctcagcacatcccaaactctagacattgtgaatgttaccgactaattttacgtaactggagccttggtgggagtgtggatttgtggacctccacaacaactatagctgaaagtttctgaggaaaaaatagatcaaagctctgtgtttacttaatgtaaatgtatcaagataacatcatcctatattgcattgtaataatgccactcactgcacatagggagggagattcctttgtagtccatttggatacagtagggtagattaaggggctataaagtacgaaggcagaaagcatatgaaacctaagcttatgtcactaaatgtctgaggatagtttttgtttaatgtgttaccattttcccagtgatttgctgctcaaccccaacgatcgaataagctcagatttcttttatgtttttcctatatgacccaagaagaaaatatgcagaatcattcttcaattaatgttctaaaacttgtactgcttgcataatagaaattataagaaaatatcacaagagaaaagtaggcttttacaaacattatattgtccatctggtgttactagcagctcatggaagtttctaggaattgactggcttacacatgtgtgactgtcacactcatcccaatgggattatgagtgtctttacaaactgattaggagaaaattcagggagatgtatgaattattattattattattattattattagaactatctgccatctctgcaaataaatgatttaatcagagacttcaaaaaagaaaaattccctgtgtggttcccctaaccaacttcctgttctggaaaaccttggtcaagtagctgggttaattgtcatgaagattagtgtgatgttgaaataagtactaatggtcaaattataggagtgaacaagtttaagaataggttttggtttgggcctgaaagggttaattaaggttttttcacgggttattaaagacccccaacctctgccttcaggagtcatattgacaccccaccacagggcagctcagcccctctgttgacatgttgctggtcagagcacaatagccttctgtgtctgcaaatcattgctaaaatcatctcaaggaaaaaaaagtttgaaagctttaacgttagacaaaagcccaagagttgcagcgtgcagcccaaaaacctggagtcagcaacttctattgattaaaaactaacctttaaagtaactctgagagtgtgtggttagcatttaaatttaaacatgtcatgagttgatttgtgttactgaataccaactcagaaggagtaacattcacatcgcattttttttttctaattcccttaagcagctaaagtatttcatgaaatgtcaatagggcaaaaagaaaaagaggtggggggctgatgctgggccttgtagttttctttcccatgcaaatatccaccccccaaaagaaaagtgtgcagagtgaaacacaataattagtcctttgtctaactttcccaagtgccagagaaagacagattaattaaatatacaacaatgttggtttttggagtgggggtcttgcttgctgtgtaggtcataaattaggcagaataaatacttcaatgtgtttgcagtgggcctgctacgtcagaaccactggaaggttggtgggaggagagcagagggtttcttgctaatgatagtcacgtctgggtctgtctggttgctcttagcaaccagacatgatgtaacaccaggatgaacttgaacttgggggacttgaaaagagaacaatagaccagagcaatcaataaagcctatttcagtgaaggattacagagctgctctggggtaaccttgtcggcaaggcacatactgaatagtaagatgtgtgaagaaacttttttttttttttttttttttttgctttgctttttaagagaagtgcagaggcactgcagatttttgtagtgccctgaggtctcgtccagaaactgtggtgtggagaactgctccccctgctgactcactgggtgccaggcctttgcttcaagaactaccttagtgtcagattgaagaagtctggaatttcacaaccgacttagaaagtgtgaaaacagaaatagtaagcattattccccgcacccaaagtttgaacctgttttgtagaagggaggaagcggctctaacgtggatgagagtcagctgttaggtagaggcctactagaaacacagtttggggtttgctttctctctcctttctctccccctcttctttcttttgtccagctagatttaggccatgtgtatttgccaggctgatttcctttcaggacacaagaggctttattgtgttcctcaaagcatgtggtcaaagaataacatctgaaagtctacaggatgcgtagtttttcggtctgggcttaagttttttaaactcctctggaaatcaaaggtggcttgtgtgactaggaaatcttataccaaactccatgtagctatcacttagccattcatccctggggaccaaatgagtccttacattacctaatggaatctcttccacagggatgatccttcacctgcctgaagcaacccaattagaaccctttctgataccgtcaacttaaagaattcagaagcattggtttttgttaggccttggtaatttttctgtaaataatgataaatgtagtgaatttgtcaaggtatctctagagaaaagtcggcaaaagccacatacttttttatttcactggagaaactaactctgatgttagtccataattgctcattctgtctagctaacagaaaaagaaatgccagcagataaagtgatatatgaccagacaattgctcaaagctaaccacctaaggatttacgaaaggaaaaggtaaccagtaactgggcctggcaggcacacagaaggctctaaataaatgctgcatggacgcaagcatgaatgaagggtacgcagtggcctcatttttcctttggacaatgtggtacttaatagagtaaaatcttgatcctacttagttattatgtttcatgtttgaaaataccattttagatatattgggctgaaaggagcatcttccctcataaaatcctacatatgtaaggaaggaaaaatactgtgacttgctcaaaatcacccaggaagactgggtccagcactttttccaccttacctccacttattcttgtgtcgctattgaccatctgggcctgttaggagagtgtcacaatcatggcttcagtgcctgcacctcatttgaaaggagatgttgaaaatcatcagagtagccattcattgccacatgaaacccctccctttacccattctccattcattcaactcttcttcattaagaacgttctgtattccaggcactgggctaggcactgaggattgaatgataaacaagatggtcaagtttcctgccctcctataactgcccccatcagttaacaaaacccttatttgtatttcaagtgaacagaaatacctcattctgtaagatatactcagaatgttggaaaaccccaatgaagacaatgaattataatttcagaagaataagatcagtttcagtgtcacaggattttttattgtctgtcgtgcctttacttttcccagcgaatccctcccgcatccctaacgtagatcctgatttcgtggttgaaaaggcaacttctaaaacacacgtttttacaaattgtgattttaattgtatttttccttttgtcttccagtcctggtacctgggataaaagttgcagcgtcccaccatccaccagacagaccacctgaccccttctcaactctgtaacatggacgcaacctcaacccagcgcagttacaacttcactatcagcggaaggggagaaaaaccgattcaaatcaacttgtacatggaaacagcaagcattatggtcaaacagcaaaggccataaccttttgggatttttttttttttaaaatactttagggactgttgtaatttctcatatggtgctggaaatggttgggctttgtaacatttgaagtgtttccatggtagcgtgagcattaggtgacgtggctagcggaggactacccttgctcactgacttcctgttgtaacacactttccttacggagcctggctgtttcacagtatttcatgaatttacccacacaggtgtgatcctccttgagcattgaggaggcacatggagaactaaatcttttgtagtagctgagatctgcaatatataacgggacagtcaaagggcaatgtttttctgtaacatattggaaaaagaaaatgcagttatattccttttttatttgttcctttagtttgttttggttcagcagtcagcagttaagtatataacatggcccgcaaggacaatgaatccactcacattgcagaacaattccgaaaatggcaaactactactactactgttcagttttttaaaagttttgaaatgctgcacttacatttaaaaaaacaacaacaacattttttcaacaatttcaacaatgacacaaaaattcacatggaaatggggaagatggtctgttttgacagaaactgacaggaatcaatcaaaacaatcgaattttgaattgagtaaagtgcaatttcattggatagctaaatatctttgtaagatagagattgttgaaaattctatttttgtttttctagtcctttcaccccaggactctaaattattggggtaaaaaacagccttgcaagaaaaaggggagctatttttgctttttatgttttttattgttaaacttgtatccctttaaaaactgaaggaaattaaaaaaaaaaaacaaaaaaacaaatctaatggtgcttttaccacaatatgttaactacattaaatgctaattaattattttctgttatcaaagcacatgactaaaatgaaatcatggtatctgttaattttataagctagaagtcactataatggattacgccaattctaaaaaattttacacctatctggcatcataggatttatcagttatcagacacctcattgtaccagagattgtccagaagttttaaagacctttgcatccctgaactgggctatgggaaataataatagtaataataataataataataatgatgaaaccaatactgacacaaatgctggtgcccattcagatcaagggtacttgttagggaaaaaaaaaaaagtttgcacccccaaacgtcctgtatcttatgaaaaaaaaaacaaaaaacaaaaacaaaaaaaaaacacaaaaaaccacagaaacaaaaacaaaaaaaagtgcaagtgatttttctaccagacagcgaagcacccctttgcttcccatgcgacttcaagaaggtttcctatactatacatatatatacgttctggttggcaagccctgctgatcagagaaagtctctgcatgttctagtgttagtaactaatttttatatagttaatgtaggataaagtagagtgcattaagacacaatattgtaatccctactctaggcacttgcctttaaactatgtttttcagcccttcagaagggttctactactgtcctatacaatcaagtaactgaaattcttgggaagacactttgctcctcatctttctccccgaaacaatgttgttttgttttgttttttttccttaatttgcacgaaaacaaaaattccatatcaatgtgccttgccctggatagcgattatttgtggaattgttgcacatgctcctctattgaaaggggtttttccctagtcaagcatttggagacactttttgtaaatgtgacttttatgtcagccatcgtcagtttcaacatctagaactaaatagaaagctagttgttccgcagataggagtagtctttattgtcctgtacggtcggtggcagtgctattctgagatctgtagatgcttagaatatcagtattttggatgttgctgcattttacaatttatttggagtcttcctttattttcccccagatatatgaaaatatgcaatacctgcttatatcatgtagaaaagcttagcaattattaatttttcttttatttttttttatttgaccaaagtcggtgctgcacttgacgcagtgtgttttaggtgtttgtctttgtacttttttgtgatttttgaatgcacgtgcgcaggaagggctcctcttagagaagcagtcaaactgtgaagcactaagctgaccctgcttcaagcaattttgtttttacaactgttcctttcacaagcaagccttaaaaaaaaaaaagacaacttcctttttcttcagctcccacaccccatttttcttagcagactgcagtcaatccacattcaataaaaagtatataatgcccatttttatatgcacgtttttaaacttccaagttctgaaaattgtttactggttatctctatttaaggaaaaaaaaataaaataaaacattttggattttcatatgtgtctgataagtggttgaatagtcgtttggcgctgttgtatggtgtgattgtcagtgtatggtgtcacttcctatagccagccagcatactttgccttcccctatagcacttagctgggcattactttattatgacatatgtgcactaaaaaatgaaaaaaaggaaaaaaagaaaaaaaaaaagaaaaaatagcagctttcagtgcttcacagtgaagggaaaaaagcctagacaaacattttgtcagaaccttgcaataagccaaggtattaccagtaaattggttgtatatacaataaaattgcacccttttttaaacaaaacaaactaagcaatagtttgggcagttttagttgtttttagtgagcatgttgtagtcatgactgcaaagagagagaataaactgcccgctcagaagatatgtaatttgtattgttgtatagttttattgattacactgatttattctaccctattttataatgcaggacttttgtaatgttgtttaaatgaggaaaaatttctgtcaaattagcctagtaaaatttctgatcgttcattataaaggcagcgttcatagaattgcttttctttctttttaccccccctttgggaactggatttaagtttaaaactttcctgtttcctttttttttttttttttgtaagtatttaaatacaattatttttttctctcaatggtatagcatattcctatgcttgagaagtataggtctactgaaaaaccattgtaaatggacgttacaggtatgctgtatttttgaaggtattttgttgtattaagtttgatgaagctaaaattagggaactctgaacagatttgcaggaaaaaatgttttaaaggctttaaaacattagggaggcagtctagggtgataacgaacaggggttaagtattaaatacacgaagttacatttttgttcatgtttcattgtccagaaagcagcaggaaactattcagttgtgatcaagcaggaaaaaagaaacaccaacagttgccagtgtttttgctttttagcttaaaagcatagtgaagatgcttgaggaagactttgctacctggggtgtgtagacagacagactgagagctatcagcatttgaaggcccagcccttgactctgagacacatttgaattttttctttcccatcaaatggcattaacaagattgggcaaagatgagtccctcaaatttctgtgttttttgtttgtttgtttgtttgttttttctttgggaactgaagtcagaggcacgaacactaactcttagcatttttctgtagactttttcttctggcccttgtccctgccagcaaaacgccccttttctgatcattcgtgcgcagagggcctcccagtaatgccacgctctccatgctagagagccttctctttcctctgaggtttgaactgatgttctgtgtcttcacaccctggcatgacagttacgtgtggtcagcccgctccccaggcccgtccctgccgccgccaggtgtgggctctaggcaggccgacaaggttacacctcccagagcttgtgatcttcattttctgacagtcaaagtgtgaaggaacccagacttccccgagccacggtgttcagtcagcccacaggaatatgcaagacccatctccaaaagtttgtctttgattttttccaagcccttagccccataagctttgaatcctgtagttacagtggcataaaggactgacaaaacctggataaggaaaaaccttttttttctatgaattttttttgttttttaggggaaagggattctaagaatgtcatttaatgtactttgcatcatgtctctagaaatatctttgtccatagtggtggtggagtctctctctctctctctctttttgtttgcttctgttttctttcttgtcttcattctttcttttcttttttatttctggtagcaggcctccatagaacaaatctaaaacacaaccaccatagtaatgtaaggagagcttcagtggcacctcaaaacccacccttcgagatctgtccaaagacagtctcagaaagctgcactgcccaccggctcagctttcattcaaaaaggcttccaaggccaattctgtcttgaagtcaatgcatgtatttactgtttgacagtaaacccgctctgccttctccacgtccaaggctgtgcattcgtctaattagcgtcgtgtatgttttccttttattttttccaataaaaaagcagtgggatgaaaattgctttgatatatagcaggtaacattgaagctattccatagcacttaactgtagtgaatactgtgtcaccaattttgaaatcaatttaatgtttaatgcaaatccattacatggtgctattataggctgacaaaatgatttacacaaatgtgacaacttgggctcaattcactctgctttccaacagtgtaaatgcatagcagtgtttatctgcatgagaactatgcactaatctatctgaagaaaaaaactatatcaactttggtatctactttccgtttacttcaatccttgcctttttggtcattgttataatgccagctttaggacagaaagaattataagaaaaccagcataatacctgatatattaaaatgtagtgcctgtgaaatctgtattatattgctcttctgaagtaagatttttctacaccggtagccttcgctgtctgtcagtcaggaccttctggtataggtgatgtaaaataaccgtacaatattaatgcatgcgattccataatgcttagtgaactgtatgaatattactcaaagttatgttagtctttttttccgacttggttcttgtcagctaggtttaaaggtatttcactgagaacgcaaattctgtcttttcttgatttcggctgttttcagtattttggaggtatacatttacttaaattcagtattactcgtgttttgtttttgtttttgttttttgttttctttttcctaggggacaagcatgggtgtttgatttcagaaatcagtacctggcgagatttttgtctcaaaacgactatttgaatttcaagaactgtgctgcgaagacactctgagaacatttgcaagtcaggggcattttccttgacccttgactgatgctatgcggagactgatacattttcttaatggacaatgttcaagccaggtacccatgcttgatctgtcttcacaccagacctcctcatattaaaaggaaaaataagaaaaaaaatgtaagaaatcacatggctatttagtttcatgcacagttgcaatattttcttcaaaaataaaactctgtacaaactttgggcccgattcataagaaaaagaagtttgctattaacacgggatttttttaatatactttttttggtctaaatttgaaattacttgcttcccaaattaaataaatttcatctcatttttttccctaaaccagcacccatctgccttttattccccaaagagttacctttcccagattagggggatggtatgtggggagcagatagcggaaatgcttagaaagataagggggaccacccacagctggtcgtgagaacagggagacagtgtgtgggggtgggacctcatctgtgtgcctggtatcctgagttttacatgtagatgcattcgcctatttgattcagaaaaataaactttcccaaaatgtgtctgaaccacaagagcatacagtggaagtgctacctctaatctaaccagagcaccttcatggtggaagacacccaccaggtcatacaatgtgaacttttgtatctctgcagtggtttcaaggacaaatagtgtccaatgtattgggccatttttcctgctgtttttatactcaacttctcaaaatgaaaaaagcttttatttttcctttgacttatttgtgttgttcttattttttaaatttttattttttgataatagtctgtaagttagcctttttgggttttttttttttttttttggcttttttttttgtttgtttttttttcttttgacattgcaaccgaaggtcataaggccgctagctccgctgggacagaggcttgagagaactaacggctcggtgccttctccctggtctcagaccatcgtctctgcactgcgaaggcatttggtagcctcgccactgagatactaactagacctagactaggagctttatcaggttctaggaggtcctttaggaagactctcaaaggcaaatccctgatcccccgccccacccttagccctgccctctcaccagagcaaaattcactggggacttttcccaccacacatggaaatctgtccactcggaatacctctgttttccatttcaaattgtagggggaggggatggaacacttccagtgatggtaagagatctgttatgaaacgaaacaccccccgtgttaataacttggtctgaaatctgtttttatgagccgggccccctgtgcctctagtatacttgtattgactctcatagttacccttttagttttactgtgttctgtgaaaatttgtaattggttgagaatcactgtgggcgtccattcttattcaactaaatctccacaggttttttgagctggtgtggattagtttaactcttgtattcaaccattagtgctaccaccttctcacattacaatacaattactggaagcaagtactgcatttcctatgcaacaaaaaaggaaaaataaaaaattgctaatgcta

SEQ ID NO: 2054 - DNA, 385516 bp, Homo sapiens
cgtacaatccaaagcacgcaaggcaaaaccagagcgaatctgagaaccagccagcccgggttggatcgctttcaaaagagagagtgagagcgagcgagcgagcgagcgagagcgagacagtgagagagggagagagcgcgccttgcaattgcaaaagccttctgatttggagttaaaaaaaaaattctccaagaagcctgcaattggccaacagctttttaaaaaatctcttccgggttttcaacggttccaagtttatttagatattttttaaatgcaaaaaaaaggggacaacaaatgaagcaattcgtctgagcattttaaagtttctcacgtactctttttacattgcaatggtacgtggtacatcttaaactttctattttgcatttatatgatatgcgttttataaacaatggtagaatgattttgtttaatggctaagactaaaatttctctagctcgcatatgcacttaagtgattgctgggtaaatgtctattgtgatggttttgttttaaagatgtagctttgttgatggtgtttttgctatgtgcatcagagaccgggttttctttttcttttttttttttttcgggatttgaaaaaattgctgagcttgacagatttttttttcctcctagcgcttgctcggttccagaaaggggtggggggaaatcctgtacgtgctctgttctgtaaaagacgtctggcctcagcagtcaacctaacccgaaaagaaatgtctggacccggagaataattgacgatttgatcctctaatcaatgggacaacttgggagattgacaaaagctttatccaatcataaggaagcttgggtgtacaatagttctcaatagccagagggggcggggcagaggagatctgaagttctctgcagctctgaaggggatggtgtggttcaagctgtcaaagctacaagcgcttccggatttagcaagcacaataggaaagaattttcgcgtttaagaaaaaaaaaaaagctgatcgggggagttttgcatgaatcgtgtgccttcttccttgtcttttggaaaaagaaacattctgctagagaaataactttgtattgttattaactttgcattagctattatttttatgctcagggaagctggtaacttgtggaatgtgaagttcaactttaagaaacgtgtggcttaaatcttgcctgaattgtgggactgtagtgagctttgggaagtaatatattgcgtattcagcattacaaaacttcttactctgattatcttagaagctttggcatttcaagtactttgaaattaataggtaaacctctcttcttgaactctaaacaacagttttaaaggagagaatgtttcacatgtggactagcagctgtcttacacacttgaaagaaattaggggagtgttttttcttggctattcttgaattctgctttttaagtatatggtcagtaggaaataggacgttaagactggccaagttcacgtttctccttgttaccacaacaacccccgtggagagtgtatggaagatcgctgacttgctaactgttagttggagtctggcctcttggacaagtgcttgatacaaatccagtggaaaccaactgcagtagcttgtcttggagacagtaactggcagcctctgactaaaatatctccatctcctcctctctgagcagcgtagacacccaattctgttgggaagtgaatggaaaataatatgggctctttcccttctttggattaaattcccatcgagctatttcccaaggctttaggccttccagtcaaatctggcttggaaatttgatgtaagaattcacttggacactcacttcagcaacatgattcaatttaggattatatgcacataagaaaaatctgcacagaagtgaccagcaggtcaaaaaccagagaagaaaaaatgttgaaaaatgccagttaataaagttagttttggtaagaactacagagttatggtgttgtcgcttatgaatcccagtcctatcttcactgctttgggtattaaaatctaaatcatattaataagatctccctattaagtaacctccaaaatgagagctatttgagatgtacatataagtgaaaccttattgacgtaatttatatatctaagaggatttcactaaagctggcaaggtaacgtttctgcaaataaaacacagtaaatgcaaggctgggctctgtgccaggaagaatatggatagcagagagcatgacaggagcctcctttgcgcagagacaatcccatttcaaggcagcctcctaccacttggaaaataaatgattggagaggttatttccaataaggggtttatccttcctaacaatgggtcatttatatgattgcagtgaactagtttccatacttcacctgcgtttcctccactgctctctctactatcctttctttcttccctcctcctccatccctgctctctctcaagtgccttagtatctttgtgaactctggacaaggatttacttttgcaacttgggaagaggggagagggttggaaatgttttttacccccagtctgccctttgaggaacatctgtttctttgtgcgtgtgtttaaatttatgcctgttggagagaaagttaccagaagcctttctgtaactgtaactcttctactgtatttttctcagtcttgtttccaaaggctgtagttggaactgtgctttgtagtgttcccccgcctccccccctccctccgcgggggagggagcgggagctggcggagataggagagaaagcaggagcggatgtgaagggctttggtgctgaacttggatccagcccttgcctagagggcgcaaacaatcgtcccatatccaaaagtcttacgaagggcgccaaaagttacttaagataatattgctaaccgcagaaagctggaaatcgcggggcacatccactgctgcaacaaaagaagtttttaaagtagaaatatcagcattaaattacttcccccattaaaaaaaaaaaacagggcgacatgccagtcctttttaaaaaaaatcttttttttccttgagactcaaaagtaagaatctttgccgttttgaaaataggcagatgtgaagtgtatcttttaatacaccaaaagaaagattttaatctgctctggaagagagcttcccgagtacacactctgaacaataacttttcactgtgcctcagttacatgttgggaccgtcagccagaaacttctatcgaggaaacttggagcgcattgaagttatagatcccagcaaaggttctcgtggccagggatgttgtctctgtaacacagcttggcttttaggacattcctcccctactaaaatctgagaggaaccaaggaaaagcagtgggttaagtttgggaaaatggactctctcattaaaggctgaaatcattatttctcctcactccttagtaaataatcttgagagatttccaaggatgttcaggagggagggtgggagagagaatggttcttgagcattcgggaattattttggcaataaagtaactaaagtacaagcataaaataactttagacagatgcagaattatttcagaggttctcttttgctctttctccagtacagtatttcctgccccttgctttgaaaagaagtctgaatgagagtggccttaacacatcactcaccctcacttgttaacacatcacttaccctcactttcctacaggaatgtcccctctttagagactctctggttatgtcacctccaccgaagggcagattcccctgtgtgccagtgtctttcaacatgatacctacctctttccttttggaattttgagaagggttgtcaaatgcagcattttgcaaaccatcatgaggaagagaagtaaaataagggatgggggcttagaagaggcaggtaggctttcccccctccgagagaggagagcctagagagaaaatatgaggttaaaaaaaaaaaactggaaaagcaggcttactggcaacttgccaaaccctaaaaaccacccccctcttttctgccaaaacaatactttagcaaacctaaaataattgcaggaagctcttttccattttaagaactattacctgggggagggaaaaaagggattcttaaaaggcacccttccagaggtgtcccagaaactgggacggtaatgatagcctatgtccagttctgggcacgcgtttgtggatcagaatatctcccttccctaaggggacatccctttcacatatttttttcctcctaaaaagtaaaagatgtcacagctaaaccactgttgtttctgaacgtgatagaactttttctatggcgtctgtgttcaaacccactagtttcacagtcctgggagggataacgctcattaatctccgccttcttttctccagacccccgccccccaaatccggtgaatcttctgtgggcactgattcctcaccacccccgcttctgaatgccacaggaccgaagctgcacaaagtttgcaggattgtgtgcataattacctctgccgacgaatctattcccacagaaagcttcgctggagagattacaatgctttgagccttaccgcatttcagtgggggaaaaaaagttacctaggaggtctgatttttcaaagaaatttgcatacatgcaaatgtgccgcccggcctcctcctcggttctctacgtgcccacgcggtggcccggggggtgcggggcaacctggcaaagttgcccaagtcctccaccgaggtccgcggaggtctgcagcgggggtggggggatggggacgaggaaaagtagttttgtttgcttaagcacatcctgtggcagcctatagctgcccgggagtacagactgtaactgctcctcactgcgttacccagtaatgcgctgatcgggggagggggcgggggggccggggagcgagcgggagagcgagcaagcgagcgagcaaggagcgagccacggagagagccggggagcgagcgagccagcctgcgagcgcgagcggccgcggaggctcgggacccggctggccgcgcggcgccgcagccgccccctcccccacaccccctcccccccgcggcggcggcgcgagcgggcggcggctgtgcggtgcggtgcagagcggaggcggaggcgggcgcgcgggcagctcgcgggcacccggccgggccggcgcgggagcgggaaagggtgcgctatgcctttaacacccgcgtacagtaggcatgtatagtggagtgtagggaaactctaggcggggttaaagttcagctcatggagcggcaatagcgctggctggctggctgcagttgagccgacttggaaatgtgaacgcaagaagcaggcttgatttttttttctccccccttctctctctctctctctctctctcttcctctctccctctttctcctctctcacccacactcacgcacacctccaaaccgcacacccagacgcacacgcataccccagcgcccggcagttatgtattctccgctctgtctcacccaggtaagccgcggcgtggatgcggagggcttgggggccggggcgccgggggcagggctggggctgggtggggggcaccggggccgtcgctccggccgggcccagggcgtgcgtctcggtgtgtgtctgtgtctgcgcgtgtttctgtgtgtgtgcgcgcgtgtgcccgcgggtggggggggggatcccgcttaaagaaagtaactttgtttccatgcgggtgcattcctcttgcacggccatttgtgtgggcacatggctaatggcgccctcttattaatgcgttaattaatatcggggcgacggactgcggaacagcagtgttttcggacaccccgcacgtgtttcggcggggttgcagtccatgacacgcagaaatctggctcagcgtttctgctgccgggagcagggattccgtagtgccgcagcgcccggggagggggccgccgacggagcccaccgctcaccccgcacgctcgggccggctgcagtcctcgggtgcggggagacctcgggtgcctgcgcccaacggcccgctccccgcagcctgcgctgccgcagccccccgccgtcttcccgaactcttacttttgtttattgtttgtcagccttcggggtccggccgcggaaaggacgcgggctcccgtcccggccccggcccggacagcgcccctcggacgcgggcaggctgcggctagccctcggctgagcggggctacgtggacgcgcgttcccccgcgccggccgggtggagcctgcgtcctcgccgcgcgccggtggcccgttggctctcccggagtgaaagtttcggggccgagacgagcccacgttgtgcagggcgccgaacgccggaggccgcgggccgcgggccgggtagcgccgggcagagttgggctcctagccgggagccggagcggcggcccgggccggacacggctccccccgccgccgccgccgccaccaccaccaccgccaccgcgcgactccggccgctccgcgcgcaggacgggggcaacttttcccctccgactcaactcagagcatggggctcttgcgccccaccgcctctcctttccgtgcccccctgtccattcctcccttgtctacccacccccaggcaaaatattgctacttcgagacttcaaatccggtcccctttgaatatgttatttgttttccttgactaaaaggcttgaagtcaaagtggttttgcgctattttttttttaagcgtgagatttcatactgctttggtacattaggatctgaccattaatcacctacatgaagttatatgcttcacataaaatgtttattcacctctcccttaaaaaacctaccacttcttgccttcatttagtaggagataacggtttaaccggaatagtttctggaaggctaaaaagtatcagtagttttcgctctcctctctagattctggatttatttcccacatgacatcccttcttattgcaatatctaacagtaataataccgggtatttgatctcagaagactcttaaacgcatcttttatgttgaaatggtctgtttgggatttaggcctagcattaataatggatagcagttacttttagttactgtaaaagttttttttttttttcctaacaaacttccaaagttcctattttagtaacttgtggaagtatggaatgaaacttttccaaccacttctggcaaggttcacaattgcatatggataagatgcaaagtgtaagataatttgaatgaattacggactatagtgaaaatgctgagattcgaaggctgaagttctagctggcagaagtttgcaacacacagaacttgtagataatatcagcgagctgcaataaagggaaaggaccctaacagatacattagtgtcttctcaattgagctctgaaaagataaatttatatttgggaatggtgcatatatgagggcacctgtatatccatgcaggcctagggcacagtcaggtatttaacaaagttggcctctgttggttcatgaggtattatgacattaagagagtttttttttttctttttttttcggcttacatattcagcagcgttgattgatgcattcactaggccttcttctggaaacaccactaagagaaatgcttatttagtgtaacagtttgtaaagaaaatgtacaataaatagtgaatgagggctcatattttatgggttctgcttttaaaaatttatttacaatttatttaacttgctgggatatttataatgttttagagccagttttaggaagaagaacttcggtagtttattgctcattaaaaaaaatcagtaagcacagtgatttctatcactatactctaaatgaaactccatttaacttgtaggcaatttaaaaaaaaactttaccaagaaaaacctagacatcttattttaatcaaatatgggcatataatcaaatcaggtactgtccatataatgataacccagcagaaatttgtaggtgaacttttaaaaaaagtagtttccagaaatatcagcattcagtggttcttaaacttggctcactttcaaacagatcaatgtttaagatgctgattcaaagtaataccacttttgaaacaggttttcaggtttgtttttattggtggcctataactttctcactgagtacatatgtaaaacgttctttttttcctcttgaatgttatgaaatagtacctagcttatagcgatatgttcagcaacatgaattataagggcacactactttttttttttaactaatcatttatgctattcctggacatttcttgcaagctaatgatactctttagttttgatattctggaatattttaaatcatgacttgagaaagatacattagaaaaaatcaatactttaattgtgcatatgagtaaagttatacaaaatattgtggacttttactggcaggttcttaacctttggggagtaatacattgtaaatacttttgatgcaaaattggggacttaagttattcttaatgactaattgacatagttgttcttgtttaaggatttttatgatgagatatatgggcatttggttggcaggtaaacagaatcctgttggacacgaatgcatgcatgcagtttgcagttttttgaaaagcatattgggagtatctacagacacttaaaatgccatattagaatgtttattttaaatgcttattatcattaatcaaacttttaaataagataacattttaacatagatatgaatcgtttggagctaagttatactttgcattataaaatggggatgaaactttaaaatgaagtcctccttttggtgaaagctcacttggtagtttaaggtagactccaggagttttttgcataatacaacagagtcttggtccctagcatgtcttgtatatataagaaaatcagtcaatgtgaagttctgtttcaaacctaaaatttatgtattttagatcatttcaaggatgagctcagaatttagtaacgtttagatgctttgtggtttggcgtatacctttgcagataaactgtgacttgccccccatgcctgtcacctaaagtatgagaataagaaatattctcaaacatcagaaattttaaaaatgttaatggtttatggcaagaataacaattcctgtatttttttctattctctctctacttaaagaatgcacacgtgttacaaaagctgactacttctcttttggattcttttattgaaaaagagcagttttgaaagctaaacttgaaacatagaacctgaaatttgtgcagagaggaaaaaagtcagttattgaagtaatttattatgtattaatatatacttacttttaaaagctcagtcatatagagtgtttaaatgattgattataatttgctaaatttttaaacaacacgactattaaatattttaccttatcagttcacatttgaacatttaaaaatttagtaattgtgttaataataatattctggacattactgctacctgtgccttgaaagtatatatttagttagatataacaaactgaaaaagaatgcattttataatatttgtctgtcctacaccatttagcaaaaaagccatcgaatctttctttggtttctaatcctcatttatttgaaggtaatctatgttttggagagggggttatgtggcagagagaagttatgtaacagtgtggattagttaatcaaaagttagacgtactccgaaagctttgtggaggttactgcttaattttttaaaaaatatatttatatttcctaagaaaatgtcatgtataaggatcaaacattttaagcaaaacagaaagaaacatttaaatatttgaaactcaatttttttttcaattttaagaggcatctatgagggttttcccggcatcttgtaaatattgaaaataccaggttctgattccctatgagaaaaatcctgaaatagtatttgcaaaaattaaataatctattttttaggtatgattattactgaaagcacttcacaatcatattagtaaattaaatgtattcatgtatgcttttctttgtttttttttcctctttcttccccctttttgtttcattcccatagtattagcaattatgtcttgggcatagatcttttattttagcctaataaatatcaaattcaatccttcttttgtatatgaacctcccaaatttgtcctagtttttgactaaaaaaattatatgtagttataatatttaaaaggggaatttagacactagcaaaatgagtaagaaacatatcagaatctacatgcaatatttttagggggaaagcctttgttttcattgattgtagagatgattttttgctcctagacttccataaacattgactggcatctaaatgtttaggatttgccaatctggcggctgggccctggctgtactacaagtggtgaggtcaaggctgggacaaaattagatatgccttccttgaaatagggttaagattatacattgttataagcatttagataaacttcacttactatctaaaggatggggagctaggcccgacagtagtagctggtgtaccctggtgaacatattaaaacagttttttaattttcagcagtttttttatttccgatcataagaaatgatactgatagttttctctcccaccttcccagacttcccataggatcctgtgtatgattttggtaacagaatgctctaatcaaatttcaagtgaaatgaggaatttctttcttaaggtgacccgctgaagaaaagttgttttcttttgttttcattctacttatatttttctttttgttcattttcctaggatgaatttcatcctttcatcgaagcacttctgccccacgtccgagcctttgcctacacatggttcaacctgcaggcccgaaaacgaaaatacttcaaaaaacatgaaaagcgtatgtcaaaagaagaagagagagccgtgaaggatgaattgctaagtgaaaaaccagaggtcaagcagaagtgggcatctcgacttctggcaaagttgcggaaagatatccgacccgaatatcgagaggattttgttcttacagttacagggaaaaaacctccatgttgtgttctttccaacccagaccagaaaggcaagatgcgaagaattgactgcctccgccaggcagataaagtctggaggttggaccttgttatggtgattttgtttaaaggtattccgctggaaagtactgatggcgagcgccttgtaaagtccccacaatgctctaatccagggctctgtgtccaaccccatcacataggggtttctgttaaggaactcgatttatatttggcatactttgtgcatgcagcaggtaagtgcgatggtgagaattcctcccactttcttgtgtgtgtttctttcctgatggcctccgcgttatgccggattcttcctgagctccccaagttgcaggccacgtacatgaagccagtgtggtttcaaagattgagagaggtgccaccttcattcaggtgaaaaagcatagctttgagcgaattctcactaagttcagctcttttggtaagtagtgttttcagaggcgttggtaatcagatatgtgatatgtttaaatcacattttttgatgaggggatgagagaagcctcgtgaaaacccttttaataaagagtatattttaactgacaaatgatctagtttaaaagcatttattttggtattgaggcaatatttttagttggttttctgctgggagtgtttttaacctactgaggcctcttgaaccccttgccaattaagaagttggaggtagattactatcaaattgctgatcatttaggaaggaaaaataatcacattaatacgcagacttagtagctttgtatttaggaattcttagtgttgtctcagatagctaagggaaacaaaccagctctttcagtaattgatggagaggttaatattaaaaataaccaacctgtatattgcatgaacacattgaaaaattgctattgataattgatgtagtgagttgctttgattgtaaaatcttaaattttttttctgttttttcaaggcatgtcttacctgtgcatgtttcagtgtttagaatagcatgcaggataaaactattgaggactggataaaataatgcatttttactttgttcctttcgtcttgttttagacaaaaggctcattgtgctatgtgaacgctcaggtcttgtgtaacttgttgactttatatatgtacatatcggtcttgctagattaccttcatggcagttacttgagccagatggaagaaagagggttgtggaatcctaccagtaggttgttttggggttcaaatatttaacgtttttttttctttttttttttttttttttacaaaggagagatgttacctgtaaaaacactgcacttttcttcaaaacatttttaattctaaaaatgttagtgagtttttaaagaagccagctgatagcctgttctctattatttttctcaatatatgttttagaaagagaacttttgttatccatctgcccttacataagaaactggagaaattagctttgcaagcatgtcacatcatcatttgcattctgttggcaggggatagatgagtattttagaggatgtgagctgtaagtgtttcaaatatttgggttttcaaaaatgtatacttaattataagaattgccttttgctttagccaattctgggtagcaagaatgaaaagtcagcacctctcaagtgacctctaagcaggaataagtagcccttttttaacccactcttaaccctgttgttgttcatttgttttgtttactgaaaaagtaaagttaaaatttttaaaaaatgtgtctgcatatgttaagcacagcaaaacgcaaaaaaagtataggtgttacaggtgctttcaagaagcactctttaaaatcttgtttttaccttttagatatttagaaaaatataacctataaattatcccgaatagatgaccaacatcgaaacttgaaagtgccaacaggtgatgcagatcatgatgtgtgcttccatataagataacatcaaaatgaaatacctgtgaagtttttgtcggtgtaagcagtgtccattctaagttttcgtcttaaacatttctctgttatttaaagaaatgcaatcttttcgctgttctcattacgtgccttctttttcgtcgttggtttgttactgtgctattgctcccaatccttgaactaacacagttgttggttgttgcaatgcctgaaggggttatgttggtaaaatgacatttagaaggttacttaggagagttagcatccttattgcttatgaaagatttattgacagcagcatagatcagactactcttcggtttggttttcctgatgtatcccagaatcccttgttatgcctgaatgccagccaaatgtttggccattggttttcacgggaccgcagtaatggctgcttctctgtgcgcgcaacaggaagactgtaaaagaaaatattaagggtcttttgtctgaaaatatttcaaatttgatttaagagattcagagacctgttatttgtggaagggaagctgccaatacaaatatgaggtagatcggtcaacttacatacaactgatttgacaagcatctgttataatactgaagatttgtaaacactaaacaatgtttttacctccttaaaagttttgagaacttgccagtattggcaggaggcagagactctgaaacgtgcttcaagatacatgccaaaaccattgtggccttttcacctataatgcgttttttctcgctctttcttttaaattgttatatttttttcctttccagaatgcctttttttccccctagatggtcatagaaattagatcttcttttccttctgaaatttgtgtgtaataattcttgctttatgtgtccacctttctttggtaggaagttgaaatctcagaacatacgtgagaatactagaagcaaatgcagaatcaatctttttttttttaaagcggaggtgatttattctaagacttattgacatgctaaaatataatacataaactacattccagttttttccctctaaatccagtggcattagaactgtgaattttgtggctgataagcagtaacaagtgtaatgaaattggagtgatttcataagcctgagaatttcatcttgttaaaagaacaaaaccattttatgcccttaatttggtctcaatttgagttgtccttcccatgtatcatatgacaacttggggatactatggtattgtggcaaatggttttctttgtgggtgtgtaacagtaaagctaatttatgaccagtctttaccagatgatctgtatcagaatctacaatatacccggcacgtggcaaggtcacaatttaagttgttaaggtcataaccttagccaccaggcatttgaccttttagataaagttaacctttgttcattagtaggcactcaaccgagaagtttctggagagttgttgtttttttttttttaaccacttctgtataaacttctggtaatgtaatcagattctagaaagattctcagtcaaattagttagattttgtgaaaggttatactttttaaggactcatttcttggatagaggcaggttgctatttttaggccatagaatgacagtttcacaatttatatttgatattattacctgccatggggtagaataaaagcttggaggcagctgtgtggggacatttaaaatctaaaattaaacaaattaatttatgtttaattcaactaaggcctttgctaattttcaagtgacattaggcctaaaagctaaatcacagtgagccatcttcactttttgcagatgaggaattttctaacattagaagtatttttagcagtcttaaaattcagtttgaaagattaataagtgaccacaatttgtcaggtaattgctttaattgttaattagccagtgacaaagcaagttgctgttgtcctaatggcagcagtatgagtacttgttagttttaaggtagaaagagaacacttttgcacggtaatcttttagtgcagtagttactgattgcttccatgctgctaccattattacctttacttaattttgcttgcatcaggaatagcaaagatcctttcaatcactgaaggagctgtttcagtgtctcggaagcctgatacctgtcctataaacctactcaacagtattactgattaccacattacctgtaccatattgttcacttaattatgctgacatgaatgctcatttcaaattatttagattcttgctagttttgttctgctgtacctcatattattccatttcagccaaaagagagctactcccattcaggtgcattttagttttattttggcttcgtgattgccattccttcatatagtaatagagaaagccgtgatatgcagatagaccagatggtcatgttgacagattgagaattcacttcctactgcttcagagcaggtgtaagattaggagtgtctgtgtaggggcgtgtgtgtgcttcgtgtgcatgtgcgtgcacatccaggctgcacagagtgctgtttgagcaatgggaatgatttcttttttgaaatgctagtattttaaatacagtgtaattatacagataaggttttcagtgcatatagaatattataatttttataaataaatcgcattagattgttacagtttataattttatgccaaattaattatgaaaattattttaatttttaggtaacttcctacattagtttgaggcaacattgcatatccaaaatatattcaatatattcttttagcagctacatgtatgtgtgtttacattcaaatctaggactatacgtttttgtaattaaactttttcagtaacttaataaacaccctagtagaaagttgtgcagttacttcctgtgatttgtaattattaataaagtgtgtttggaaaaagaatatacactgtatattgtatacacaatatacacaatatacactgtatattgtaaaactaatatacagtgatatttaaattaggagagtaaggatcaccctatcaaactctagctttaagctcaaggtggattttttggctgatcaagctattgtaaattattgatatatggcatatttttagaaattttaatttatcttttaattcttcaaaaaagatagcagtagcagtcaacaaatttgagataaatattgattttacatccttgagtgttttctgtgtaacttgaggatagtaacaatatcctttacctagaatgtagtaacaaaatcctttatctggaatgtagtgcaaaagatggtagttctaaggcagagagtgtacaggaatagggagaaatagttgttctggagtaaacctttgaatggaagtcagttcatttatggctaagaggttgagtgtgttggtaagaaaatttcccaatgcttctggcttggattttccttgtcttcttttccaccctgtgatgaatagcattaatttaaacctatttaaggctagtgtgggagaaaccacagcctttgttgtggtcactgctgtacacagtaggactgggtgtttcatttggttaaggcctcaagctgcttccagaggacacgggacagcctgtcggcattttaaatcttgcacagaagcagcaacaattctaattgctcacaaatgtcaatatagatttttgaaaccaattttgaggattagactagaagaaaaaacataaaatgcagattgagttcagtgaatgtgctaaacactgatttattaccattttagtaataattttcccatggttatttaagggttagagcttgcttttgaattattataaattgtaaacccatgggggttgagtaagggaaggaagaagtcaggtggaggaggaagagaatgaatgaactcgtatgctttgttaaagagaaacataaaaccctgaacttaatcacaaatggagataccgtaaaagtattttggtttcagtaatgactgtaaagcagtcttgggcagtgagctatcaagtggagaattttataatttgtcttcccacaattttttgcatagcttttttcagactaagacactatttagagctttgggagtttttattcaagtttttaggaaaaggttttgcaaaaattctttttagaatttaggagtccagttagagacatcattgcacacttaagctcagaaaaggggccatggagatgtttattctttttactattttgctttctaaggtggcagttcagagtattgtcaaatttttggctctttcccagtaggcaacggtaagatactcattattgatccaaacttttgggtccctgaacttaacagaattatttagttgctgcttagacagaaatgacttttttccttagattttccccaaaatattagaaaacaattcctcatgttttgttttaactccacagcgtaaagcatattttatctaatggaattagtcctcccgttagtgttctagctaaataaacatggcttatgaagtgaagaaataagtccaacaaatgacaagttgcagcaactctgaagcagaagatatttttgcttttctgtttgtaaaacaagctaaataagataaaactgagaaaaagaagttcatttgtattgtgtattttggcaaatcttggtcttctttaaaatgttgctaaccctaaaacaagaaatgatgaggataattatgataactagagattgaagtggaataactgtaatgttctttgagaactttaaacttacttcttttcatgtctttcaaatacttccctagtggtagatattttggacctagatcaattgggagtagagaaaaggagatggaaggaaggaaaggaaataacttttattgaatgtctgttctgcagcaggcactgagtaaggtttgtcatagtcatatattgtagcttgctgtcgctttcatagcagtattatgaattagtaatgcactctctatttgaacggatgaggatagactcttcagagtggccaggttacatgtccagagcaagattcaaacccaggtcttctgatttcaaatcttatgctcttaaacaattcaaattcattttgtatccttctttatatcttattgtttagggttggatgtcgttttcatggtatcacacacctgtcttgaatcaaagggaaagtaaaaagtcaaaatccaaacccctcccattgagatatttcactgtcaaattcagatgttagccacagaatgaggccacacttgataaagagagaaatgatgttacacttgtcactgttagggtcaaaatctgaaatgatttgttcttttttgtttttataatgttgaaatttagtgaatagaagcattatgacacaggtttaagatttttagttgttgttaagacaaagttaaactaattcgttctagatgctttgagaagcctttgtgtattaaactaagcactattttaaaaactaaattgcatgtaatttttactatgcagatttttgtacatggttttatatgtacaagacataatatatatttctaatttcccctatacattacatatatttttatatatatatttacagacagagaaatatatatctatttctaacttcccctaatgattggattttaaaatgtaaaattcactttgctctgaaaaaatcctttggttatggctgtgtgtgtaattatttaaaataaagccaaaatcatgtttgagaaaagaatggaattttattagtttaaaattaaaaaattaaaataggaaaaaaattgaagatggacatgtttcaatttcgtgcccttaaattagtgaattagtgagcttttttttgttgttgttgttgtttgagacggagtttagcccttgttttctaggctggagtgcagtggcatgatctcggctcaccgcaatctctgcctccctggttcaagcgattctcctgtctcagcctcccgaatagctgtgattacaggcatgcacccccatgcatgtaatttttagtagagacagggtttctccatgttggtcaggctggtctcgaactcctggcctcaggtgttccacctgcctcggcctgccaaagtgctgggattacaggcatgagccaccacgcctggccatgagctttgtttctaactctttaaacttagtcaagattagttctttttttttttttttttttttttgagacggagtcttgctctgtcacccaggctggagtgcaatggcatgatcttggctcactgcaacctctgcctcctgggttcaaacaattctcctgcctcagtctcctgagtagctgggattacaggctcccaccaccacgccaggctaatttttgtattttgagtggagatggggtttcaccatcttggtgaggctggactcgaactcctgactttgtgatctgcccacctcggcctctcaaaatgctgggattacaggcgtgagccaccgcgcctggcgacaagattagttcttaatgatttcagtgcaaaaactcaaagcctcactcaacataatttttataattgtaaatagaaaaagatgaccaataagtataatttatactatattaagtcattatacatattaattcttctaaggtttaatttaaaaataagcagctgaactgaacttacagcaaagaaaataaaatagctttctttttaagaaatattaatgaatcttaaagttagggttgtgtagcatcagttatgctagaaagggaaaactgagtttgaggcatgtgaagaaaagtgattaaattggttaaaaaaatagtactcatatcctattgtcaactgtatctagttccatactgtatgtatttttatatctctggtaagtgcttatggtggtcccaaataacttgtgagtttccagacatagacagttctcagagcatgtgtattcatataaatttttaaatggctattgctgtagtgctctacaggttaaaaaaagtgaggcgaaattgaaacatttaaaaaatactgtactatttaaaaatttgtatgaatgtctgtgtagcagctgccattttcaggctgtctttgttgctatggtttggttgattttatttccttttgtaattttgccagccagtgattgggtagtacattgcattcatgctgttggggaagatatatctgtggtgagtcagatagcttgatctgagtagtaatttttagtagggaaaggtatttgtcagtgggtaatagaaactgtagtgttacattacccatcttcatttaattttcaaatttacagacatgtcacttaatatcagaaattcagaaccatctcttttgcagtgatatgtacttgcctctctccttttgtcctgtcagatgcacttagaattctgtgtagtttaatcttaaagggattagttatttaattttaagctcctacataaaatgaatattgtacatacagggtcccatcattgtcactttcaaatattccattgcctttcaaaggagctgacatgacaagtccttaggttgacaaattctcatcaacttttatgaaaatgttggctgcagaaggagtaaagtcaaaggagggccatagacagatggctttcagtgttgagatgacatcaagcccttcttcgtggcattttttaacattccaaatgaatgagggatggagatgcttaaagagcttactatagaataagtaattaagatattgtgtatctgcatgtaaacccctgttgcatactattaaacagagttgtgcaggctcagatataatagcagattaacaatgacaattgtaaatatcttttatgctgaatgtaactcataaataatattacacattaacatgttgctgatggaaaactgtgtacctgagaacatattttcaacattagataattgagaactaacgataagtgggttaccagtgtttgaaatgaagcaaagattctagataagaacttggcaaaagcttatttgcataagaaattttgcgtctttatatgactatgacaagatttttttggatggatgcacaccatataaaaattactaagttactaaagtttctgatggattcatttagttggctttcctccccctcttcttttaaatggtagaggttctcttttggagagtagtttcaagtaacttctgagaatgaagtctttgtaacgatgctgttcaacagcgtaactattgttgtgcattcctgtcagggaaagatagtcattgcagtacttttattgtatggcctcttaatatgtgacaaggacttttattaagaattcttttcttaacatacttttagaagtctctccttttcccacattcaatcagtaactacagttttaaaaaaatatttaaatgaacttttattgatttcttagcttactgtatagacaaaaatcttacgtttaaaaaaggttttaaaattaatgtattttagagtttcagtaaaatgaagtgggaacaaaaattaacaaaaaagtgccatctcattggatccaggatatgtagtaatacacacacacagttctatgtctgtgtaaccatatatatatatgtatacacagttctttggagaatgaggatatttcagtccaaaatgttatggttgaagaactaattgttctaaagatatttgcccctggccccagaaaagacgacaaacatgcaaaatggataaatgtaatcctttgtacttttaccacctacatttttaaactacagtaactctgatttctctagaaaggtcagaggtttcagacagaaagctttgtaattcttcaaagaaagacattttcagtttggctgtataaagactgattatgcatagctttttactttatgtgcggttgaatcttggaggtgctggagtggggtggggacgatgaataagtgaagctgtgttttgagacattagaattggagggaaacagacagattggagaggaacatagattcatatttttgggctttttactatcaagtcacccagtctaaaactcaggacagagcagcattaaccattcattttgctttgtgatagagcattcgattaccaactctttaaactcttttggcaattcaaggaggttgcctatctgggtaccatttcttaggatttgctttgttggattttctaaattgtggatgtgagtttctttggttttgcattttttaaaaaaattttttggtcctttttaacttttccaagttttggagaatttttcatgttgggcggtgttggagaagtagagattgtagatgaccttcgttgtggcttactcctgttatttgggaaatagacgttcagagagcatctcacttgaggccacaccaacagttaagaggcaaagccagcatttaagccaactcccttagatcccagacttttgccctaaaactatattatttaaattatcttttcttatgtgtttttaaattagcccttcatataaacttcaaattttaggtaggggagcttttatggttccctttatgccagtgaggaaacagccagagaggttgagtaacttgtccagggttatatggttaataagtggttaggattagtaactaggccagacccttctatggcctgtttttatctctaagatgatccccagtatgttagacttgaaactatggatggagtgaaaaatattctctgcaaatacatcaacactctgaaagccattgttttctctgtttagaaagtagttgaaaaagtagtgagaaactagagctttttcttttctggtgttagtttcagcttcctaccttgaagggaaccttaaggcccaaaccttcttttttacatttgaggattctaagtccatgcatctcggaaactatggagacgggaacttcttgtgtgagttggagagcagttgtagaccgttatcatttccatcggtgcggatgctctttgggtggtggtggcatagaagatctgttttggttacctttattgacaagctctactgtgtgactggcagttcagttcagcagataggtttccagcactaatcttaggcactgtgatagattcccgagatgcaaaactgaagaaaataccttgagacaagtcagtgccatctcagatataatttcctcagaaatcaagattttagagcatttgatgtttttaaattagagtcctttcaactaatagcctgtatgaagtttttaaaacacttataaaaaatttatggtgattattattattttgagacagggtcttgctctgttgcctagctggagtgcagtggtgcagtcgtagctcactgctgcctcaaacttctgggcccacacaatcctcctacttcagcctcctaagtagctgggactaaaggtgaatcccaacaccctgggctaacttaaaaaaatattttgtggagatagagtctcactacattgcccaggctggtcactgaactcccagcttccagtgatcctcccacctcagcctctcaaagttctgagattctaagtatgagctgccaaacctggcctatatgaagttttaaacatttgtagaaccagttgttaacattgctttttttttttttaccataaaattggtatatgtcgaggaattctatcgtttgactatatttctattgtgttaaattttttgttttcttatatcaaaaatatttttgtaaatgtaaagaaaattcaagcagacagaagatggtgcaggtgctttctattatttaatagttcacctggccaggcacagtggctcatgcctgtaatcccggcactttgggaggctgaggcaggcacatcacctgaggtcgggagttcgagatcagcctgacaaatatggagaaactccgtctctactgaaaatacaaaattagccgggtgtggtggtgcatgcctgcgatcccagctactcgggaggccgaggcaggagaatcgcttgaacccgggaggcaaaggttgtagtgagctgagatcgcgccattgcactccagcctgggcaacaagagtgaaactccatctcaaaaaaaaaaaaaaaaaaagtagttcgccaccatagcatgttttctctaaagaaagctggttgtgcacagaaaagttctattttttttaaagggcatccttctagtaatgctgaaatataaaacaaatagcgttataggaaaatgaaacagcaggagaacgagagagtagaaaacagaaaggaagcgaaggccttggagagcaggcggtagtgaattcatttggcagttcctaaaacacagccaagtcccagtagcatagccacctaaattccctattttgctccttcttggaaaaaagttagcagtctcgagacttttacgctgaagtggattttaagttgtcagaagtgtcaagctgatttgcctttttttctctcttttattaaaagaaaagagatacatactacattcagacagaaagcatgtaaggggtcttataagtgtgagcatgtgttagtggattaatgggacaatgtgtgtggatggtgatagaaaatatgagagaactattgcttggctgataaatgaaataacaacaagaaaaatctggtggcccaatatatattggatttgttgttattctctgttatatctgctggttgttcaatctgaaagtgaaatctgtttctccattcattaatacgtgtgcttttctttgtatagagcacagaacaaattatttgttccataattatttttaaaaagcagaaaatgtgtttgtaacatttaagaaatggcatgggattgtcatagaaactcattctgaacactgtaaataaaaatggttggggattagtcacagtaacatgtaggacatcatgaaattcaagacagatttctttgtctaacagtcagtaagagacatgaagcgaacttgatatagttcatgagatattagcagttcagttccttcagagaaagagaaaaccatgttgcttcatattaaataagccatctgtatacaaatctcacaatttacttgatgattttagcaatatttgatgtttcctttcagagtcttatttccaaataatgaaagcttaaaaaatttgaaaatctctctgtttttgctactaaatctttagaaccatatccctccttttcttctttccctatcttattttttggtaatcttgaatagcattttaaaagttttagctttattctgtttcctttagttttcccttacttcatataatatgaataaaactgaacacattaatgataaatagccttcaataatactatatatttttaaatatttcaggttagaattatgagtctgcagtattaccattaacatctttttctgtttttcttttaatccagtatttagaaggaaattgtttcagggtactttttttctccaactctgtccaacatctggaagaacgattgcctgtctttaaatttggaattaatctccaattgcatactcctgctaggctgatgtttcagtaaattctaacgcatcagcctcagatctttgattccttgagcttttggaagtagaagttaaagtctgagagggtgtttcaagacttaggaaacttagtgctgtggaatgacctgtgcatctgacaaggcccctttaacaatgttgtgtgtcactgcatgttcttatttgtaatcaaaacagtaggtacaatatttcaataagggtaagtgtatttagacaaatgtagcctgataaaagtggataaattaccttttgtggttgagttaattagtgaacacaacgaaccttgaaactggtgggagcatgtgcaaagacatatgtgaaaatgttggtacatggaacatatggaaccatcttgtcttcctgcctgtgtacacaggttctattgtagtacaggtatatgcacgcatatttttgttttattccttgtagtagtcctacttgggatgtcctcacccacctttacttggctaacattatttatactttaaggctcagctgtaacatcatttcctcaaggaagctttcttttccccccaaggttaggctaaggactgcttccctgcctgcccacagcatccattagcagcatattagtacttgccattagcacttcctttatcataataaaactatttgtctacatctgtatttccagattgggctgtgatttctttctgagcagggactgggttgtattcagtgtttttgtacccccacataggggtgcatagaacctggcacttaactgtgcactcagtatctttgtttagctggtgactagatgagaaatctggattgaacaaaacaagaacttgagaagcttataatatggatcttaaaactaggtaacatataaaatagtttttgggcatttaccttaggactgaatttaagcctatgttttttacagaatgattttcctttctcaccctaccatgtcaatggatttctatttcttcacccaaatccatagtttcatattaacccaaaggaattattgacatgtaagtaattataattctgaaaacaaaggtctgatgatgctagacaattgatgatgctaaaccatttaggctatctgtttttccctttaagatcctggtcttgacttttatttgagctttttatctagaaaagatgatttggtgatgatggagtaatatagtaactgctctagcttatatgtgagggtataatctttataccaataataatttatcaagtgcctactatgtgctgggtaccctgctaggggaggaaataaaggatttcaatttaatgctattgcatttttaaagagcacaattttgattaaaaattgacccattctcttcagagtggacactcacattttttgtgggttttgaatcacatagtgtcttgctgtgcaggaaaagggcctgtcagtcatgtctttatttctcttgagcatttgtacgttgtatgtctgtcctcacttatcagggtgtttttggcatggttacttaatcctaagctctgagaggcacaggaagtaaaagaaaagttaaagatgacaattaaggtgttgggcccagttagatatagtgaagtcagaattttccctcattaaaactgttagaccaatttcattagacggaaatgcacccacatatgtaaatcttctttgtttaattggagacctattgattgtaggtaacataagcctctctaagggaaacagaacccaactgaagataagagtttcttccccccaacacatacagcattcatgattttatttctctaggcgtgttcattatcaaaatcattctactgcagactttcccataaagtgtttctgtctggccctgttttcatatctaaaagcttctagtggtttcagcaagaaatgatggaaacattttgacagaatatatatttctttttttaaaactaagatcttaaaattaaagagaaacaaaaacttacaaaatcacatgaaaatataatgctttaaagagactgagaataattgtcttcttttgtgctttcatagaatgctaaaagaaaccaaattctgatcttctttggtgagcaatcaccaaaaatattgcagtggggaatgaaaaatagaatggatttttaaaaaaacttacattctaattaggtctcaatgctgcagagaaaatagtgtaccagtgcaaactctacactgtggtataaggcacaggattttcccgctgcgcttccaaggatagggtcatcctattataactgtttaataataggggattgtgtgtattttcttatatatcttcttgcaattccatgtttctgaagtgtgagattcaggtcaaggtcaatgtgtggccagttgtttataaagtattaagaatctcatgaaggagaaatacagtttagatgtagattttcttacgataactcaaattatgtttaaatgacaaaaactaggtaggtattgaggaggtaaatatctctatttttcatttcttaacattacactacaatatgtgtaatatttagaatttgaattaggaagaactttaacttttttattccttagggtattactgatctctaaacaagatgtttaattagcagaattatagcatcttagataaaattggttatttttaacttaatcacgtagttgatgctacagaaatgaattcatggcctttcttgtggtgctcgtctttttcttgtttgatgttgctagttgaacacatctcaggttgtgagaagtgcatatttagatgggaacatcttggagagatcttgattggtagagagtaactttatatcagtgagtataatgcttatcagtgaaattctaactcatttaattattacttaattttctgattatgtttttgtatttgagagaagattatttccattatggcaaagtatggatggatggacattgctattgccatttcttgacttagcacacctaggaaggcattttgaaacatactttttaaaaaaagaattgcatatctgtgcacctacaacagtgggtgtgctgaaattctgacttgggttttgatgaaagaattccccaattcagttaaattcatccttgactgtcgtgtgccactcatgttcacttggttaaaaaaaaattgttttttggagattatttgtagaatctcggttctgtaaccagatattgaatattaccactggagggaagctttgaactcatttatcacccttctgccaaaccacaaaaatcctctctctctctctcatgcatctatctatctatctatctatctatctatctatatcttactgatttattcatatatatatttcttcatatatatgatatatgacactgtatatttacagcatatatattacagcacagctatttacagcaacctggatcattcattcttagccccttctcaagaatggaagtttattttaaaccagacataaacaggacataaaatgaaatattaaaagactggataatgcattttaagtcagacatacatttggatagctgttgtttgagtttgtccatgctggagttacctcctcctcactgcaccctccctgtttgcatggggagctgagattagattttaactacaaattattcacattagtcaaataaaaaagaatgacatttcccccaaatttgattattattgtattttcttggagaaaaagatcgtgttagtaaaataattcaaaatggaaatccaaatgtatttcttttaaaatttttcaaatctgttgctaaaaagctgtagaatatcgtggaaaattcttttattgtaacaaacattcctggtttaatttcttattttcactttatttttaatataaatatatatgtaacttataacacatagtatgaactgaaaatctgtgaaccaagaaagataacaaccaatacctttcatttacctgtgtgttcttttcctctcccattaccctgaaattcctcctattatcctgaattttgtgtttgtaattcccctcctataaaataaatggtttatcactcataggtactaaatatattgttcagttttgcttgtttttttaagttttataaaaaatcatatatacacacatacatatacatacatatatatatataaatacatatacacacacacttctgggaattgctttttttcactctacaatatgttcataatgtcatatatactgtaatttattattgtttcttgtgtaatattctgtgatggatctatagaaggtttccagtttcttggtcttagcaagtgctatgaactgtaacatgtcttctagagcaagtgtgtaaaagtttctttatggtatgtgcctaggacttaaattgttgaattacagggtgtgtaaatgttaagtttttttttttaagaaaagatagtgatattttatcttactaacaagttatgcctgtttatacgatcactcgctgtagcagtatacaaaaaattctgttgatctgcattctctccagaatttggcactgccagatttttctttttgccaatcttgaggctaaaaaagagtatttcattgtgtttttaatttgcatttataatttgattactaatgagactaaacatctttttgtatatgtatgagccactttactgtggaataaatgtttttgtcatttattcatttttttctattttattgcttattgtttacttattggtttgtaggagttctttatagattctgcattctaatttttggccagtgtacgtttgccaatatattttcgtagtttctggcttgttttaaaattttcttcatgttatctttgatcaacaaaaattcttaattttaatacagtaaaatttatcaatctttatcacatggttattgcttttttgtcttgttgaagatatccttttttactccaagtttagaagtatatggtattttttgtatatcttttaagtgttcatctcacattaggtttgtattccatccggaatttgtgtatggtgtgaggtagggatccaatttcattttattctgtatgaatggacagttttcactttatcacttattgaataatttctctattccccaaataatgtaaaatgatacctctgtcatttattttttatatttgtgtatgtctgtttttggattctttgctctgttacactgatcaacttgtctgccctataccatcaccacaatttttcacttactaagcccttataatgagtcttgataaagcaaaatttcacacctctttttgaaataaattttttagttattctttacccctcactattccatatatatcatggcattactttgtcaagttttgtgaaacatcctattgggactttgtttagaaatatattgaatctacagataaaggaaattgacatctttttttaactatcaaatattattatctatgaacatggtatgtctcttcatttatttagatcttattcttggttacactgaattttatttttcaccaggttttgaacacttttgtgaagctgcttttgtaaattgtttttaatattttgtttttaactctaatttctagtatagaaatacagttactttgtgtatagtgatcttatattcagcgatatttacatatttttagccaataatgtattggtaagttcttttttgtttactatttcgataatcatatcaaatgcaaacagtgagaaagatgttcatttctattctatgcttttatcttccttacccttctcattgcactgagatctgcaactcagtgttaaattaacctgtgatagtgggcattcttgatttttttttcttgatttcctatttatttttaatccctgaatgaatcagagttaatgccttaatatttaaatattactttcgctgctcacattttaatcagagaaaggacaagacctgacctagttttgttaattttcctcttatttttaaaaattttatggtttggtatatgctaccataattgaaacctcagattctcctcacaaattactttatgccaagtggtatagtatctgttaattagtgggtaaatagtgtttttaaagaatgcagtcatctaaaatttcaaaatataaggctcatttgtatgaattaattattttaggtatttcagggaaaagaattaccatatttcatactgatgagattttttgatactgtgttgtgtggctcagtctcttacgttttgatttgaactatagaacccttaagtagcattctgttttttacaatttaaaatgtctggtttgcatgggtttactttttcctttttcctcatgtaatttttgttaagacttgaatagattactcttctaatcttgtgagcagactgcaggaagacaactattaagagtagaaagctattaagcagtcaggggtttattatgctttagtgttttgtttaagtctgttcttaattggttgattaatgtacgagaagtccttttcccccctccatctctacagatggcaaatggtaggtcccaactgtcattgttcacaaaaaaggttatggttcaaagtcaaagattcagagataccacaataatcaatcataggaacttgtctcagagtgcccagccaggcaaaagttaggcagagtaataatatttactgagaatctcttatgagtatttttttttggtgtgttctttattttatttagaaaatattatttaattaattgaaatgcctctgaatttagtgacaagcatttaaataaatatgaaaaataatggtcaaaaagttttctgtttatcggttttatcagatagtgctagaatacataattttaaaatgggtgtaacacagaaaataacattcttaatatattgagattaacagaacattttcaaaggaatacctttttaccattttcatgtgaagattatttataatagttaacttccttttttaggaggaagagtagaattatgttctggtattgatccacaaagaggatttgcattttattcatactataaaagtacctttaatggagaccttgtggtaattgaatctatactgtgtatcactatcaaagtatctttttaattattttatgttatacaatttaagtcatggaaagggggatgactgtattgtatcttttaagtataatgtatagcctttaatattcttaaagtggatgttagttaaggacaatttttagttgagagagagtgaaagagagagagataaggggggcagagaggattccattacattcagcacagtatgaaactaagtcaaaggagttttgttaattaaattcaattgccatccattagaccagtggaatgagatgactctgcctggtgctgacacagcacaggtatgcaatttggctaaatggccatttccaaaccatagcacacatttgtctacttgttcacttttttttttttttacatgagagtttttactcttagaaaagtcaaagagtaacccagtgcttgtcgaggggtaaaggtatcatttttatgcagcatattgtgaagtgattaattttttaggtgaaaaatatatagttcacatagagattatttgggagaaaatgattttttaaaaaatatgcagtatctgcgggcaagcatacgaacaaatatatatacacacacacgtatcagtatagaaaaatgtgtacttttaaaattcagttgtcttaatctgaagctatttgagtcatattctctggattttttaaagcatcctacaatctgtatatataattaggggaagttgtaataattgcaggagttataaaagcgaaatttaggtggtgggtaagtgtatctacattttggcataaatcactacttttagaggatttatatgtcagactgataagtttcttaccatggtgaaatgacaagaataccactcaggcattggctgagacataattttgacagccagcaagcttgcagtgttgctgagtgcacagatttccacttcctgccaagattaaaattggcaaaaaccaaaaaggatattagggattgtcactttaagaagaaataacatgttaatgttctgcatttgcttaagaaatgtaagagtgatctcttgaactgtagtctgttgaaacttacaagtttgcaatcaatagaagagtttgattaatatgagcatcaaaaattaaaataagtagaggctctctgacacttgttagaattaagactcattataggtttacttaataggacataattactttccttctatataagatgaattcttcacaaaagctatgaaatagttttcctcacagtccctgaagaacaaaggcctactttaagtttgtagatttgaagactgaatgcttgctttacttcctgaattttcttattttttcctgtgtgagcagatggtttttctttttataagttgccagatctttcctataacaataactgccattattgagaacctactgtgcgcttattctgtactgagcactcagatcttcagagttttttcttacttaggactttttgtttaactctaggtgtaaaaatgaagaaaaaattatatctcatgttgtgaaagagtcagactctgaaatctgcttatactttgctatttacagtaagtacttttgaaacagctgtagacgttcaaatgaaagtagcaatgtggagtggggaatgtgggaacattcatttgtgaagactttgcatttcttcagctttatagccaacagaaaaggagattgttgtgcattctattaaatactgccagtatgattaatttaaagggttacattttattgaaccctggtgtagatgttctttgtcaacccacattcacagctagttagagtgtgtgtagcatttatcaaaactttctggagcccctctcacctcattagcatctgaatctctattcagcagttaatgtccgttactgctagagtgctcaattcttgttttcaataagccagttgtaaaatgtcagactgtcacttacaatataaaaaaccaaaaatgatggtatttgtaaaaatgttatcacctcataaaaacaaattgtaaagacatgaaagtgatcttgctatgctggtctttcagaagtgagttagtacagctactttaaataccagttgtgtagattcccacacttttctaccaatggagaggtttacacaagcataatttaagttacaattacactaattaacatctcatttgcataaattgttgaagtcaaaacaacaaagaattgtctaagaagcttaatcctatttgtccaaaatagaaagattttttttttttaaaaaaaaactatgctctaaaaattggcagcttaagtatgtctttagtatgttgagctgtgtccttttaaaaataaatgttttcaattttcttaataatatatttctctattctttttagaatccttcatttttagtatacttttaaaattgaacacacacaacactttggttcctaaagtaatgataacaagaaattaaaatcaaggtacagtatcatttatatgtagtagtacagagtaaccatgacttactaggtgttatgatgaaggtgtatgtgtgtgtatatgtgtgcatgcatgtagataagtgtgtgcatttgcacacataagagttttaagctgctcctgtcatttattgatggtcaaaggtttcttttggctattgctggactcttaagattgtcttgtaattgtctttttgttgttgttgaaaattaagggtgtatattaaaggtagtttttacccagatcttatatgtgtgatagctcacatctgtaatcagaaacttactgtttaatggccacccaattgccattagcttcctagagggtgatttaataaactatcttctttaaaactcatttaaaattagagacatgtttgcatacaatggattaatgacgttttcatactaacccacaaaagtctgctgcactttcttttgtaggcctaacattcatttcatatgcattgattattattgttgaacttgcattaattacatcgtgcatatatggacatacaatgtcatctgcagaatttaggattttttattgttaatttttatagtgactgtggattgaggaattaaaattagcatgcttcatttataatagtatttctagtgtttcattagccctaaaaatgtgataagatcaggaataagattggaatgaaaatttctccttaaaatggtacgtcttttgaaaacattttgtttataatatatagctaatcctaatttattacagtctttcaatatattctttaatttgattctataaggcttataaatcactgtctttgagataagtttcttaattcacaggtttgtatcagttgtactaggtttggtgaaggatgtcatcctagatatacagtgtagacgtgctttatgaaacatacttcttcttagggacatttttaaataccaaatgagaatatgtttggtgggccaggtgcaggggatcacacctggaatcccagcactttgggtggccaaggcaggtggattgcctgaggtcaggagtttgagaccagcctggccaacatggcaaaacccagtctcttctaaaaatacaaaaaaattactaggcatggtggcaggcacctgtaatcccagctactctggaggctgaggcaggagaattgcttgaaccgttgaggcggaggttgtaatgagctgagagtgcaccattgcactccagcctgggcaacaagagtgaaactccatctcagaaaaaaaaaaaaaaaaaaaagagaatatgtttggtagaaatctgaaagagaatttatgctgaattgagaccatttggaaggcttcttgggtaaaactgatttgagttgtggatgaaggattgtttggaaatgagagaatgagcagaggccatggtggagagaagagttggagagcaggtgaaaggcgtgagcacagctgcagaagcagacatatgcacgatttgtcctagagcaggtcggttggcgagtttggttagaatggggggtttacatagcggagggtattgaatgccaatttaaagatctaggcagtaagaatcatgtagggtttttgaacagggatatgacatgcttcaagaggttttttttgaaaggattaatcatgaagtccaaatgtagggagcattgaaaacaagagtagagtgacagacagtggaacagtagctttgtctcggcacaaaattataaatcatgatggtttttatttcctgtgccctgagtaatatcataaacaaaatatacaaaatggcaagagcacttttgagataatacatggtttctgattctgagtagtacttgaaacttcaaaaataacattatacgataaaacacatgttatttctttgttatcttaaaatagcaacaaattctatatacgtagaaagacctatgtagaaaaaaaatgaacattctagcctggacaacatagcaagaccccatcttaaaaaaattttttttttttagtcagccaggtgtggtggcctttgcctgtagtcccagctactcaggagactgaggtgggaggatcacttgagcagggagattgaggcttcagtgagcctcagttgtaccactgcactccagcctgggcaacagagcaagatcctttctcaaaacataaagcaaaaaacattatttcctttctcctttcagaggaaaattatttccagattattttttcttatatttttttaaaagttggctttaagggagcacgtttctctttgagggtggcctgtttcattgtcaatatttgctcttcattggaagctgaggtcatgtcagagttactcaggagaaagacctggacttttcttcttatcttttaatggtttatcattgataagtttggacatggtatgcatggtgacttttttcactcttgtcacttttctatatttaccttgttcatagtatgtaatctgagtgccttcaagacactagaaaagatttgatctcaaacaccacattttgggtattttaatataatcaggagaaaagtggatataatattcagacaggaagctggaatacactggcataggtagaagtattcatttcaacattaagtgaatatatatatatttgttgttgtttgttttgttttgtttttgtttattttggttagaatctcactctgtcacccaggctggagtgcagtggtgcgatcttggcccactgcaacctacacctcccgggttcaaactattctctttgctcagcttcctgagtagctgggattacaggcaaaggccaccacgcccagctaactttttgtatttttagcagagacggggtttcaccatgttggccaggctgatcttgaattcctgacctcaggtgatccacccacttcagcctcccaaagtcctgggattacaggtgtgagctactgcacccagccgcaaatatatattgataacttactggaagtaaggtaacatggtacaggttggtagaagaaatatagagaaaaacaggaagctgggcttcccttccagatgtccctagattcaaaggggaagaggcaaaatgtattaaatgctgtcttacacatagactacaagggatttacttggccagggagagaacagggttgattctgagctggagagaatgaggatggcttctgtgaaggagatgacctaaagcagggcctcgaaggttggcaagggacttgcagggacagagcatggagatgggcatatgtagcgtgtgttctggacacggcacgtggaggcagagcacacatgcatagagtgtgtaatgcttcacttccatccttgttccttcagcaagcacccgtgctttacctcgtgctgacccttgagcaaggctgcccgtgagaaacttcccaacttcatgggcaatgttgaaaacatttgtccacttgcccttgccccagagagggagaaggtccacatatggtgcctttgacatgttatcccttggcataaagtttggcccaaatgtacatttgaaacctcacgttccctcgataaatttaaagtatgaaacttttgaaactctaaaaaggtggtgaagaccacagttctccctgttctttttcttctttcactctgcagctggattctgcctttcctccagtggttatctgaggagtgtctgccatgtcttctgtttttttttttttttgccttgttttgaggagtccccttttttcctcccctgggagagtttaaatatgatgctgatttcttgtcatcttagggctcctcagctacaacaaagttaaatggtataaaagcaaagcccaaattagagaccctaaaataaccttggagaaggagagttctcagttatcagtagaattgtcttaggaatttgaggaagcccttgtatacagtgaaaatgagaccctaagttaattaacaaaatgaaaataacttacagtacatatctgccacttccagtactgctataaataattgcaagtgtaaggatttttagtgcaaatatgcagaaaacatgggcatagaaagtttagatgaccttaatgaagaaacagagttggctctgaaactgtgcttagcaggaacaacgttttgtgcacttgataaacactgtcagttgttaaggcatcttctgataggtgaaaagcggttttttgatgcagtactgcctggcatgcatcttctcgatggtctgttatcttgtgggaatgacattcgttaagttgttttctgtgtgcatcccacccaaataaagaatgtttcatcagcaaagtgaattgccgtatagtcatcagactctagaaataaattatcaacgatgactgcagtgggtgaggctgtttgtttatcacatcacttgagaacagagtaaagtgagtttcatattttcctgagtcttgaattctcattttagacatctgttcagaagctttctaagccatggagtattctaaatgagcattttgttaaatggatgaaggaagacttagttttccattgttaggtgaaacctaattaaaaattaaataatgaccttgtgttggcttgtaaattccttatttcctgcatgtgtgagtgtattttgttagaacattccattttaaagcatgccttttttatgacaagaaatacttttaaaatactatttgcttttgaaattacagtagggaatcaaaggatagtctcttgttgagaggaaggtattagaagcatgtagctttatgaactatattttctgtgaatatagcagaattagtttaattgttcaatttcaccctctccagcatgattgcacccatcagggcagttaacagagacaccgctatttgtgttatactaggaattctttataaacttaataaatgaaagctttttctcttataggcccgattctctagtggacttctggtgaaattatgtggctaccttccattaatgttaatggaggttatggatataaatccctccatagtgatggaagaatgagccccagagagaagaatgtttctaatgaatcactggattgtgatataggattaacttggtgtccctaataccatttttttttcctcctgaaagtttaaggtcttatgtttaggaactagtttctctccaccttaatcctttattgtcaagtctgcaataatgttaagaacaggaaaaaaaaatgtagattcctggataggcacagtttttatattaatgtaactatataggcatagtttttatattaatgtaactatacagcacctatttttgtgttttactattacttggcagacatcttgagtgttttacaaggttatcgtatatttcactaataatcgttgcttgataatttggtgtcctgacagactgcagtttattatttagtattaaagctctcaaatgtatttattgagcacctgctgggtacaaggctttgagcttagtgatgaaagcatatgacatagtctgtagcctcaaattttctataatctcgtgataaaagtaggtaccagttcattagttgctttccagtggggcacaaattatggaacatcgtctggctggccgggcgtggtggctcaagcctgtaatcccagcactttgggaggctgaggcaggtggattgcctgagatcaggagtccaagaccagcctggccaacatggtgaaaccccatctctactaaaaatacaaaaaatgagccaggcatggtggcaggcgcctgtgatcccagctactcaggaggttgagacaggagaatcacttgaacctgggaggtggaggttgcagtgagctgaggccgcaccactgcactccagcctgggcaacagagtgagactctgtctcaaagaacaaaaaaaaaaaaaagaaaagaaaaaaaagaaatattgtctggctaaagaaaggaaaagaattcttattcagaatcagcatgatcacttctgggaatctgaatggagaaaataattctatatgtaatgatgttttcaatcaatattattttaggtggtttatttattcagccaactgttgttggctgcccactgtataccaggcagtgtgctagatactgggagtacagcagtgagcagcacagagacagccctggtctcatggagtgtgcactttgagtgtgggaaacagtatgtgggtacataaacaaaataatttctaatgtgatagatctctaaaggaaacaggcaaggtgatagagaataactaagaggacctgctttagatgggaatgtgaaggatgaggccgcattcatactaagcatccaagtaaggagaagaccaagtgcaaaaagtttggtcgggatgagtgtgtgtgtgtgtgtgtgtgtgtgtgtgtgtgtgtgtgtgtgtgtgtgtaccagagactgaaggccattatggctggacagttaagggagagtgacctaaataaagttcatattggcgggagagcagcttgccacagggttacacagaataggcagtggtggtaaaggcagcatttgaatccaggtccatttggctttggaatgtgctgttatagcagcagagggcaagtgtgaaacataattcaaggaaataattgctgtagccatccagaccagaggaggatcgctttgatctaggaaaacatctcagtagtctttgaaaaaatgtacagaatatgaaagatattataggtcttttcctcctataatacaaccaggaaattattcaggctaattttttcagaaaaattattacaataaattatgatctccctttgaaaggtataatgtattcaaacctttttaattagctaatcttttcctgtgaaatcttaaatatttgcacgtataattggtaattttagcttttatgtaggtatgtttccccctggtgttacttacaaaacctggcttactcaaggcccaaagtccaccccactagtaaactctctcgtctctgttcctgtgccaagtgctcttcctttgttaccaggtccacataattaatagctttatcatatgaggtaattcagttactcagcaaaacaaatgatatacacttttagaaatagctctagaaagtaaacttgaacgtaaaattgtttagtaagaggaaatttctgtttgtctttaattaagagaaactgtatggaaatgtaagctaaggatgcattaatcagagaagttggcattgcactgttcttcatttttatttggcatagattgcatgggtgctcattaaataatttgtatgactgaaataacttgtgatagttcttgctaaagttttgcatggactcagactaaagaaactttaaaatttgaattaaaaaacattcaattcttaggtttgaaggtttgagttacttattataactgaaaatctttattatcaaaatgtgtgttcattatagtgtttgcttgccttcttgggtgaagaaatacttattatgagagtatgtagattttccgtgaagaattagtaatcatgcatcaggttgatacctggtgagtagatatttgtatttaatgctcttaaattttaacagccttgcctctgtatgccctgctcatctgtgtcttaccaactttgatattgtttgaaaaataaacatttgaaggaagaagtttgcatatttagagggttggtagttcattacctgcatgtaggttatgcccacatcgcaaagaaatctgatctatatgggtaacatatttggataatcaaggccaaggtaaagggattcattcccccttcttgaattttatggtttctgtatgtcaaaccagatttcattggtttaaatcttgtggtgtacacttggccattgatttggtttgagctctgtaatatttgtaattatgtgagatgacaagattgaattaacttaattgtagagttttacatagtgtctgtatcaacatcctaataaaataatatgaaattcaataagtaatgccaagtgggacagtgagccactcacataagcttactaaacttgatatattcttatggcactcctccagaatgtagaagaaacacatttatctaggtgattagtattctttctgtctgccagatttaaggattgtttggaaatattgttagaatcaaaatcaacgtttgttactacacagggttgagcattccaggcacactctggtcgttttgttattctaatgtccacttatttcatgtctgccgtgaccgtgacagttttcagtcacacagagctgccatcaaaagagtgataagcttgtaagtgaagcctttggggaagcaataaagtcatttttctggtcccatctcaaaagacattattggaaatttatttaaaagtgatcaaggtagcacatacgaggccttctacagtttgcattttggaagttattaacaatctgcagttaagtccatttaaaactgaaagtggctcttccacaaactactttttaaatagcttgctggttctaaatttaaggagaatggaaatattggaaattaaaagtcaaaagaaatttctggggcataagatcctttcaagtttacaatttctcactttagatttaaaacttgaacacggccatactttgcattttatgatatctaattagtgccttgtaatatattttgtgaacagtatctgttagccataatatcagggacagtttaaaaaatcttcagtacatttatgataaaagtattagcattgtaaggtcttaaattgacatctaggacattaggaaatcaaatttaaagcattgcattgtctgttactcaatggagtggactgaggacagcgtgtgacttgtgtactgcaaatgatgcaatagctaaatatcctagtgtgagttaaggttgattaagtgatcatctttaactctgcttttcccagggctctttgaactcttgttttattaggtaatatgctatgctgttattttattgctgtttaaaaaaccttctcttttgggaaagaaaacatgtgaattctttggtttctagatagaaattagcaatcttttgctcggaatgtaaaagtatgctgtattatcacaaactgaccctcctcctccccaagaattctagggagtaaaatgcgtgcacaggaaatcagaaatggatcaacagagttataggttttaaaaaaactgccttgcatttttgccctggaattaattttcagtgaaaattaaaatattttttctgttcatctggaatcagtttttacttcattagcaggaaatggtaaatatacattcagcacaaatagagttttctttatgggacacaggatttgtactccataggtagatgtgtaacataaaagaatctttctgctctccttgtaattttctccctcttaccctcaataagttaaaagaaaggaaaattttttaacctaacctgttaggaaccattttagtgtagcctctagtattttgataaaacaaaatgttcactagctggaccctggtggtgatagcatgaaggactggggtagaactctctttttcattttcttttaatcctgaagttacatcactgtgcagtcagctcaacttgtgtcattgcagtaggaagatatgtaggtggaaagctattccagaaggaggctggagctaccttccctgacaagaaaaaaaatccaagcaaatacatacataaaaagacactcaaagcatcataggatgttatagttataagggaccataggtttcatttaacgcacattttagcatccaggtcctacataaaatgtatattttgtgattgtgaatgggagttttccatatttaaaagttaagtttattaatgtgtcattttacccatcatgtatttgtggccatttttttaataccacgaatgggaacatactgtatcatagtttctttttatttgtctggatgcttgtgtatgccttttagtctactaatatgctcacatgtgcaaactaacaagagaagatggcaatccggtattataaactggtaaagagttatagtgcagtaagactggattaactgtgctttcagcagtcaagttgctgtaagagttatattgtaaagttttagactaacttgcatgtatcccagagtttgcacggtgttgctgagtgtctcgttagacatacaccctacctactattctctcctgacataaaaaaaggtggtaattgagctggcatctagaaagtggtggtagcactacagattgtatcactaatcccaaacaaaggagttgcaaaacacctttctttaaatattttctcttcatggtgcaactggggagggccaaattccagccttaataaagttttaacctgaccagttggtagaaatggcagagtaatagaatgtttggtccagaaaccaatgtgtggactgtgtctaggattagactctgcatttctgtctgttccagatgagctgctcatttcttttctttttttaatttaaatttttaagttctggagtacgtgtgaaggatgtgcaggtttgtttcataggtaaatgtgtgccatggtggtttgctgcacctgtcagccatcttctaggttttaagcccagcatgcatttgctatttttcctaatgctctcccccacccagcccaagctcttcatttctactcagtacgtatgtccatgtatccaggagaaatggagagttctacttttggattcttctagagagattccctgtgggacttctaacccctaatcagtattcttccgttgatgataatctacttaaatgatatcctatcatcagaatccctttatggaattatctttgtattttgcacgttcttccattctagcttctaaatgtaatttttcctcccttaaatcatttttctaatggagacaacattcaaatacataggacagagcccacagccagggcgggaaacctgcatagtgaggctggttttgatacgcaggccatcctactggcagctgttttgtaggcagcttcatgtaatagtgcagagggtacagagagagagacctacactgtgatttctttcgtttgtatattttgtattgaaattgtagattttttggttggaatttatttgagatgattcaagacattttgcatagtactcaaatataggtgaaagaatttcaagtttgctcattttggcataattctaaaacaaaagtgttactgttggatctgggcatgtgatgggtgaatgagtgtttcagtgaaatgacataagtctgtataatttggagggtaatgatgccttagaacaagaataaatctggagcgatggaaaggctccatattctagatgaatgcatgcttcctcttatgactctgaaaaataaaattaaatctttatttatacaaatccagtgaggggggaaggctacatggtttggcttaatgatatatttcagaacaggaatattagccttaacctctttcctcacattgcatatgatatttaatccatcatctttgttttaaacaaacaatacacaagctgttgctggcattggtataaagctgatggtccatctggagagcaggaatatagatcaggaaaataagagaattgaaattgggtgcaagggcagatttgcatgtgtaaaaacctttctgttttaccagcttttatcaaattatttaatactgggcaaaacagattcctttttcttgaagctgagaaagatacctcctcctagaggaagagttgcttcagtgttctaggaagaacaattggttttgaaagacaataaaataatgagccattaggatcatgttttgtaatatagggagttggtgtggaagaggagagagaggactgctggtgtagtgagttcttgttctagctgtgtatgatcattggccagtcgttcagcttcttggccttcagtgcttcctttgactcaagtcaattcagcaaccatttattgaggcaaatgtgaggatgttctgtgggctacctatttagctaggcattgtggatccatagacaagtatgactgggtcctatgcttatgaaactccaggtcttacaatggaaacatactgtggttgaacgatgtagagagtgttgtatatgagatatgggtgcacaaaaacaggaaaagtcaattctgtctggtgtagacaggaagaattgtattacaaatccttcttaaggattttctattttgacatgcaagaggagcaggcattccaggtatttgaatactgagagattcaaattatcagcaaggttctttccagttccacgtttgttgtgttatcagtgtaaaattatttgaatagctttccactgatgagttattagctgaaaagtgtttattgtcatggttgaaagaaaataataatgaaagaagaaacgattacctttagtgataaagttggggccggatgggacgaagcagtgcaatttttttctttataattattcccctatttgaaaaatcaacttgtatatgaggcagcaaacaccttgcagagcagcattcccttttagtttcaggacgtggtggtggatggaaccactgtaacctggcctccctccatgagaggagggaatccaggtggccatgttgaaatgtgcctgtgtgcagcaaggcttctgaaatgacaagagagcccagcagcttccaaagcagctgtgactctggatctcacccatcatctctgcttctcactgttagaggagtgaatctgtgctgccttaggaggcatggaacctgggacttttcttccttgtttaatgtttaattttattaaaataatttgtaagtgatagatgttgatctcgtgacaaaagagagattccctctttataaaactattctaactaaagatcttttgtaagcccatgtgttagaaataaaacttgaatatccccttttttgttgttgtttatgaatggccaataatttattcacatgtgacatttgagctggcattttttcctcctgagatgacagtagcgtccgctgtgttgtattctaaagcaaagtcagaatagccctttgcttttgtcccgattagtagttctgttttgccttcttgccttttccatttagaccttatggtatttcctaaaccttagactgttttgaaaggctttgattaaaatatgctgataaaagaattcgataaccaagttaggaacgacaaggctatctggagaagaccaaatgacttggcagcctaacaaattctattcagagcacacaaagagatcctggaacgttttatagggactcgtgtgtggggaatggtatgaactcaggttacctgcaaaatatggtgtcatatggaaacatttaagagcttatggaaaattctttgaaataaagtggaatgagctagcaagcatattatacctaagaagaaaaacaagagcattcattctggttttttaaggtagctgctcaaggaagggagatagatgaaagtaaattgttttctactttgtacacataatatagaagagatcacctaagcctagttttgctaaccagaccctagacttaaaattagaggtcatgatgtctagccaccttcctctgtaggaacctctcgtgataccctgaaagcctctgcttaaatacttccagagaaaagtgaggaaggtaggggtggggatgaaggtttgcaggaactcgtgttgagtacctagtatctgcaagatactagagtaggtactttatcgccatctcatctgacttatgtatgagtgcaggttttataaccctcaagtttacaagtgaggaaactaagtttatataagtgtcacgaaacttgcttcagttcagatgtctagcttgaggcaaatctgaaattagaacctaggtccatcttcttgcattacactaaactgcctctcaggatgagggagagctcccttcatggctaaggcaacctcttctgtctaataatgcagattctttaaaaattctttcttttatttaactgaaatctgcctcccattaacatctctcattggtcctgattcggcctcaggaggatcacagagctgatgcaattctctttccttatgcaggtatgtttgcaaccactgctgccaaaatggcctctgccatcttttacctagttggttttttttgaaaatgaacacacacacacacacacacacacacacacacacacactcacagaaatatcctcttattgactgcaatccatctttcaacatatggagttctttttgaatactagaggtatagccttaaagaatatgagtatcagaagatactttagtttcatctttccctgcctgattcatcagccaattgttagtatgccatcagtcaagccattaataaaaataatgaacaaggtgaacaggataggttaacttgtagtctatgtataagtttctgaagttgcatgcagaatttagcctatatgtgaatttttctggaaaaatggtcagtaactattgtcagattccttttttttttttttttttttttttgaagacaaagtcttgctctcttgcccaggctggagtgcagtggtgtgatcttggctcactgcaacctccacctcccaggttcaagtgattatcgtgcctcagcctcctgagtagctgggactacagatgtgtaccaccacgtccgactgtccgactagtttttgtatttttagtagagatggggtttcgccatgatggccaggctggtctcctcctgacctcaggcagtctgcctgcctcggcttcccaaagcgctgagattaaaatagaatcgcttgaacccaggaggtggaggttgcagtgagccaagctcgtgccactgcactccagcctgggtgacagaacaaaactcccatctcaaaaaaaaaaaaaaatgccaggtagagcagctcacgcctgtaatcccagcactttgggaggccaaggtggatggatcgcgaggtcaggagatcgagaccatcctggctaacactgtgaaaccccatctctactaaaaatacaaaaaattagccgggcatggtggcgcacacccatagccccagctacttggaaggctgaggcaggagaattgcttgaacccgggaggtggaggttgcagtgagctgagatcgcatcgtgtcactgcactccagcctgggtgacagggcaagattccatattaaaaaaaaaaaaagtattgagaagtactcagagtagagaacttactcccgaatgaatatactaacctctttgaggagagctccccaaatgaccataaattcatatagctcagccatcactagaccgtgtatttcagccagaagatatggtgaatggtcttgtaagatgcctgactaaattaaagtattaaagtatttcttgaattctcttgatattcctggactttgagaaagaataattatgcccttaaaaatggaaaaagagactgcaatattgttatacaggccttttaaaaaaaaagtatccttaaatttttagttacagagttcacttttttcccctacttttctttgttttagattataagcccaggattgttcaccagaaggttaccctttagtctgcaggaacctttgaaaacagatgtggtattgaagaatatctctgtaagcccagaacttatccattgtataaagaattttattttccccagtagaccgggagctcctcaagggcagggacctttgcaagtctttgactccctagcactgaacccagcatctggcaaatcttatttcatgtgactttattttggctgaatggcctaaaaatgcgcttgtactgagcacctaatacatttaatttaatttttaaatttttattcaataatgtagacgtggagtccccctatgttgcccacgctggctcaaactcctggcctcaaggatgttcctgcctcagtctcccaaagtgctgggattacaggcatgagccactgcaccaagccctaatacatttaataaattgtaaggaggaagaacagtggaccgcagtgagatatggtctacagggaaaatgaagaacctcttcaaaaatgatgatcttcaggcctgtaatcccagaactttgggagccgaggcgggtggatcacttgagcccaggagttcaagaccagcctaggaaacatagcgaaaccacatctctaccgaaaaatacaaaaattagccatgcttgtagtcctagctattaatacgtgggaggctgaggtgggaagatggtttgagtccgggaggtggaggttacagtgagccactgtaccccaacctgggtgacagagtgagaccccatctcaaaaccaaaaaagatgacctttattatgtttgacatttaaaaaaatgtagccaaagtaaaagtgttgattagcataaccccgatcacatgttgttgttgaaaatgagcactggcttgcataaaatggacattcatggacatgaaatggacattaatgattttacatatgttaagaagagaattttagacttgagaccttagggagatctgttgatagaattccctatgctctacagataaggatacttagtgaagggactttcctaagctcacagacccagaagagtagtactctttccagccaatggtgatgcttacttatgtttttttttttttttttttttttttgagacggagtcttgctctgtcgcccaggctggagtgcagtgacacgatctcggctcactgcaagctccgcctcccagattcacgccattctcctgcctcagcctcctgagtagctgggactacagacgcccaccaccacgcccggctaattttttgtatttttagtagagacggggtttcaccgtgttagccaggatggtcttgatctcctgacctcgtgatccgttcgcctcggcctcccagagtgctgggattacaggtgtgagccaccgcgcccggcctacttatgtgttttagaaaaatctttaaaatgttaaaagatgacaggtaatttctagaccatatgaagtagcccagttgtcccaggattagtttattatgtgtatatcagccattattttacagagtcatctcacataaatccacacaaccttaaaggattaaaggatggtttctgtgcaactgaaacatatgcacagaatgacaatagtcgtgatactttctttattctttttttttttttttttgagatggagtctcactctgtcgccctggctggagtgcagtggtgtgatctcggctcactgcagcctccatctcccagattcaagcgattctcatgcctcagcctcccgagtagctgggattataggtgcacgccacccgcctgggtaatttttgtatttttagtagagatggggtttcagcatgttggccaggctgatcttggaactcctgacctcaagtgatccgcccacctcagcctcccaaagtgctgagattacaggtgtgagccaccacgcctggccagtcatgctactttataatctgaagttaccagttctttgcagtgtttcacattaggggcattctccaaagggaactttagagataacaaatatgttaaaaatatcgaataaagttagagatgtggggagacattcctactcctacagagagcaaccataccttcctatagactgtgcactgaagaaagggcggaggggatgcgcctgttagagttagaatcttggcttgataggcaaggaaattgacccggtgtggtggttcttatattggtaagaagacccttctttggtttctttttttccagatagctaaagtcaatgtcagtgattgcttcaagcatgatagtcttaccagcctacactctaagcttttcttatgcttccagaatgacttactcagcaatcacttctactttgtattaaaacagttttggttattcaggtaggaagaagagaaaaaaaccaggctgtttccagttgtctggggtttacattatgttacctctcagactgttagtgaaatcagggagactagtggtttttacggcatcagagataccaaatgtacaacagacagatgtcatcttactctttttaagtcatggacaaaaagacagacacattgccctgtaactttcagatcttctgtaacctttttaaacaacataggagagaagttggtacttgtacccaagggaagagaaagttaatgagtagaaaagacagaatttatttaggaaaacgatggaattaagctctggacaaaacatgcatcagtgatgcataacatttttgttaattgggtcttaacaggtttctgactcatatggtaatcattgtagaagtgggtcttactagaccacgccagtggcaaattgcgaagctgtaagaactcttacctccctgtgtgtgtgcacctgagtgtgtgggggggcgtacgtttctgtagcttaatttaggttccacatacacttcagtggttaaacctgagctagactcaaatagtttgtttccattaagaaaatgaatcttttatgtggaccaaggtcaggttagttaatttgtttgcttttattggaataacttttcccattccaattcatcacttaattttaagtggttctactaaaatacccattaaagtcctttacatttctcacagactagggctatgacagattcataagacgtttcttttttcctcaaggcacaaaaggtagcttttctggtcatcaatctagtcttccttgttcctaatttcacaacagtggggcaacattttatataataccaatatgaactctaattgcaaagagactaaatgaaatcttcacacgaagcaagattaattaaaatataaaatgtgcttgactgtggtaaaacatttcttttaaaaaaaatagtatgacttttttttttttttttgctaaatctttcttttttgtacacctcaccctcttcttcactgatgcattttccagcaactggaagttcactctggctaggaaagtaactaaatgtgatgttatcattctaattagtgattacaaaagatcaattaatgttataattaaaaacagtgtctagatctgttgtttgtagtgaataaatgtgacaattactttgttcattgacatagatgtgttgaatttcctccctagattttaaggggatgcattttagtgctgatgtgtgcatttaactgtggacagtaggaacaaggcaagcatattaggggaagagtagggcccctaatgtctaagctacagacatattttagcatgcttgacacctttccttggtatatgatgctatatcagcaacttgtactcattggatctggagcctctagcttttaatattttatcactaaatgcttaagtgtttatgttgcaaaaagaaaaggaaaaaaaaaagattcccacttggactctcaaaccatgtgaacaggctactctatgataactatgtcattaatgattttggtttcatttatggcaataatttttaagttgatcagtcaggatagtaagtatgtgatttttgcagatctggttgaatttttttctgatacagaccaagctgtttttcatacattgaagcctgggaaagctctgttactgttaaaagagtaaccatatctcttcactgaattgttgccaagcagatgtagacttttggagtgtgcccagaaaacctctacagctgatactttggtgacttgttcctactcctggctttactggcacctatttaaatagcagaggaacataattgtgttttggtaggtcaaaattttatacacttctgtagaaaaaattatatataggtaagccaattggtagaaatgaagtaaacccaatttgcttgttgagattagcactgaagatatgctaagctttggttatgtcatttggtcaaaaaagaatgaggaaaatccctcagaaaagttatctgagagatcagcactgaacgtcaagccagcctgtccactcccattactaaaagaaatctccccttttaacttcatcccataaatggatcatgcttcctggatccacccgaggaggacgtggtttagttttagattcttagattacagacttccaccatcagtttcagtattcttttcacgatattaatgttatgaaaactgttagaaatgaggaaataccgccatgtcaggttcactcatggatcaagaaatgagcattttcttaaacatcagtccaaaacaacaaacctcaagtaccataagttcagataacttgggagcagttgaaatcctttaagccacaaagatagtgtcttttggcatggctggtgaaagaaggaagctggttgaattcattgactaactctgttgctggctaaaaagacaattaaggagaaaagggatggaagaagaaaagaaccaaagaaactaaaatctgtttctttttcaggaggagttggaagatgaggagtaacacaacactttagatatacatgttaaaaacttataacaaatcatagatcatactaaaggattaccgaagtttagaacatggctgagggtatagatgtcagattttcttacacaatagtgggtcttttgtttcagagttcactcttggcaagcaactccctaccactgcgttaatttcctgtcgatctttcattcagcaacagacctagagatggggagcagacactgccccccccacccaggctttttaagactgtgctttgtgtagattaaaaagacgaaggaaaaaagaataaactttttccaaacaagatgtccatgtgcattctttaagatcctgtgtgtgcttaaaacgatcctgtaaaaaagccctctccataattttgaacctctcctttttctaaagacttttataggcatttttttttcttcttctcagcatgtgaaccaatgtgtaactcaaatagatgttactttgctgtttacttagattgttttaaaaggctagctgtgtggaggaatgaggaaggaagggaggcgggagtggctggagtttttttttttctctgttgacctaatgaatgcagttcttaaaaaataataaatatttatatgtggtcttaatttttaatgagtctcataaactggctggtatagaaaagtgtatgaaaagccatatatattaaactatagttattataaatacatgcatatgtacactagaatgttttatgaggaagggaacttactagtcttgttcactctttgttttcccagtgtctagaacagtgcctgacatacaactggtactcagtaaatatttgttgagtgaacaaaatgaatgtaaattgacagcattgcctagtgggggtaccattagactagaattcagaaaacttggagtctggttccatcactgccattaatcaagaatatattgttgctgaaatcacataacttctttgctcctctgttttttataaaaaactgggactagcccagctattcaggagtctgtggtggaaggatgacttgagcccaggagtttgaggctgtagtgggctacgattgtgcctgtgaatagccactgcactccagcctgggcaacatagtgagaccctgtctcttaaaggaataataggggctgggtgcggtggctcacacctgtaatcctagcactttgggaggctgagggggtggatccagaccagcctggccaacatggtgaaaccccatctctctaactaaaaatacaaaaattagccgggcgtggtggtgcatgcctgtaatcccagctactcaggaggctgaggcaggagaatcgcttgaatccaggaggcagaggttacagtgagcactccagcctgggtgacggtgcaagactctgtctcaaaaacaaaaaacaaaaagaggaataatagtatctgctctccttgccttttgtgggtttttttgatgattaaatgatatctgagggatacaaaaatgctttggaaactacagggtgctttacagactgtgtgtgtgagtgtgtgtgtgtgtgtgtgtgtgtgtgtgtgtgtgtgtgtgtacagaaaatcctttatctctttgcttctcaatttcttttcttaggaaaatcagattatttaaatcccattatgcacagctctcctctgttcttactaagcctctgtattccattacctccagtaaatcagtaaaaggtggtgagtcaggctgtagtggaaagcggggtctgctgttttctcatgtccatgttactctgtgggactcagaaatcttgcttacatgtctcatgaactttcttacctgtttgaactatacaggctataacatatgacttagagtcttttagttatgaccactcttaagattgatgactaagttgaagtatttattagttgttattatggtggattgataatcatgcattttaacatagtaaactaaagtctgtgtcgtagaattagctataatttactttttaggctggatgaggttactgatgcttgtaatcccagcacatcgaaaggctgaggtgggaggattgtttgagtccaggagttcaagacaggcctgggcaacatagggagaccctgtctctattatcataaataaaaacaaatttttttaaacaagtgtatatatgcatatgcttatgtgttgtaataataatatgtcccagagttgcacatctggaagagaagaagatagcaactgaaaagaaaatagaatggtattgacaaagagaaaagatggcgtcattaggacaattactttttatttttggaacaactcgaggctttacacccattcttttcccacatttattttttctatcagaattcttaaatctaagaaacaaataatatggaggttctttatattaacacattgctttaaattaggaagaaaactgtgtataggctgcagcagactttaaaagcattgtaagactttagatttggaaatcaactttaataacatggaaactttagatttaagagatcatttaatacagctactttgatttggcttttaagagaactgaggcccaggtagcccagaccaaggatcttttgcaaggtcgtgctactgggttctttagcgtcaagactgtaacctacatctttaggttcctaaatttttatcatgccttcttgttacctaactgttgattgttgaactttcttttttcttttttgagacagggtcttgctctgttgcacaggctggagtgcagtggcgcagtcatggctcactgcagcctgaaacttgagctcaagcaatcctcccatgtcagcctctcaagtagctgggactactggcatgtgccatcacacctggataatttttaaaaattatttgtagacacagggtctccctgtgttgtgtgggctggtctcaaactactgggctcaagctgtcctcctgcctcagcctcacaaagtgctgggatttgaattttcttaaacctaaatcaatattataggcctcaccttaggagaactttccaaaatattgttagtgttgaccaccttagcattacatttgctaacgacagtcatccaggtttactgaaccaggaaaccaactttcaggttaataagacagtttcgtctatgtgccatccttatccttgtctggacatatccatagagcacgcattttaaatctgaaagaatatatgtagtctcccctaccccagctttttttaagtagcaagggctattgaaaaaaatcagaaccctccgcttacgctcgcatacatgtagcttaaaatatatgttgcttattgaaagcattgtttaagttgaactcacgagatatactacatcatgtaatatgtctgcatttgtccatgcattcttttcggaaacctgatcttacttatgtctgcatttaacagataggctaggttaagttatgttaaaacatgttgtactgaggttggattcaccgtgtcacagcctggctttcttccttgattagctttaatcaaactctctgcattccgtgaccttaataaagctatttttcctgacaactgaagactgtcttaacaagcatagttcatctgtgctgaaactaaggctgagttaagatggggtttaggtcctcattaaagtccacagcatggagtgtaagaagaaatgatgaaatggtgctccctgaaacatctcttctttaaatttaattagacaaattatacgcaaactagtagatgccctgggaaggcaatcaacattagggctaataaaaagcttgagtagtataaaaaggctgggggaggtgctgtggagcctttctaacgcctatgagaggcaaattaaaaccaattgcgaaacatggaaactggatgaatttcaatattgatttagaaattaattttattatgttgttctaaatataaaaataaaggctatacttattaatcttccagaatttgacatgttaacacctatgcacaaagcattttatggatctttatatgctgggagacacaattatgggctgacttggaagttttggcagacctgggttcaaattctagcaacttcccctactagtttttttgtttgggggggttttttcggtgcacattacttcacctttgtgaaatccaatttcatcatctataaaatgagataaataattctattcctgaagaggctttataagaattttagaaaattaaaatagtaagtatagaacacttggtacaatgcctggcacataataggtgttcagaaataggtaccccatatttagaaggaacttccactgagttaagagtggtttcaagcaaactgtcctataaatatgtgagaattggattatgaatgtaaatattgtgtgcgtaatcttatggatcaagataagtttaagggaaaatgctagcggacagaaacttatagcttttggaagaaaaggtgactcaaacataagaagcaaattatttgaagcccacagtagccaaatggagagagtaggttgaaacatttgttaagtgctgcatgccaaacatcctgtataccttaccatctcatttaatattgataacaactccacaaggtagttattactgacctaattttgcagataaggaaaaaagagattcagaaaggctacgtgaattgcattttagcatagaagagtcaggactggaactcagtgttggcctagttcttgggggtggttggatggcaaactagtgcaggtatgttcataacttgtaagatcaaatttgtcatataaattacggggatatgtaatctctctcccttctggctcttttcatccttgggtgagttctaaataaaactattttgtgttatttttttaaccctcattccattgctttcagactctggttctcaaccttggctgcccatttagaatcacctggagtgggatctgggcgttagcattttttaaagctcctctagtgattccaggtaggcaacctgcactaaagacctctgctttaaaatctctctacctcaggcgtaggtgttttcattgcccatagtattaagcctagcttttagcagagatttgccaaggttgattatgatcctcttgcttgtttggaagaagaaatatggaagctgtgaaatcttttccagttgtgatagatgttgtttatgcattaattagcatgtaaaaattaaacactgtctattcttaatgttagcacattttctttctctctctctctctctcccacctctttttttttttttctattgaaggaggccaaattagatggagtgaagagaaaagtgattatggtaacttttcccttcagagaagtcaagagcaagagtatttttttccaatttcttagtaaaacaaaaaatattttctttccttttttcttttttgtttttgagacatggtctttctctgtcacccatgctggagtacattggtgagataatggctcgctgcagccttgacctcccaggctcaattgatcctcccacctcagcctcctaggtagctgggactacaggcacacgccaccacgtagggctaatttttgtattttttgtaaagatagggtctcaccatgttgcccaggctggttgcaaaccaccagactcaagtgatgctcctgccttagcttcccaaagtattggaattacaggcatgagccactgctctggccaaagttattttcaaaatacagtggttttaccccaccacccttagaggtagaaagaatctttgaccccaccacccttagaggtagaaagaatctttgttgccggacagatttgtggtaaatcctggtttctcactttctgataaagaattagtcattttatttgtttgtttgtttatttatttatttatttatttatttattattgagacaagatcttactctgtttcccaggctggagtgcggtggtacaatctcagctcactgcaacctccgcttcctgggttccagaaatctccctcctcagcctcccaagtagctgggattacaggcatgtgctactgcactcagactaattttttgtatctttagtagagacatggtttcaccatgttggccatgctggtctcgaactcctggcctcaagtcgtccgcccacctcggcctcccaaagtgctactattacgggtgtgagccaccgtgcctggctagaattagtcattttaaattcactggggctgggcgcagtggctcatgcctgtaaccccagcactttgggaggccgaggtaggcagatcacttgaagccaggagatcgagaccagcctggccaacatggtgaaacctcatctctgctaaaaatacaaaaattaactgggtgcctgtaatcccagctacttgggagactgaagcacaagaactgcttgaacccgggaggcggaggttgcagtgagctaagatcacgtcactgcactccagcctgggcaacagagcaagactgtctcaaacaaaacaaaagaacaaaactctctgggcttgatttcttaatctgtaaaacagaaataattcttaacacatttggttactctgaggataaaagtggaggaaaaaacatgcagaggatagtccggaactccccatgtagatcccattattaggtaactgaggtacaagtatcttaggctactggtccgggcaggctttgctgaggggctccgtgcagcttgctggtgcagccgagcaaatgggcctgtagccgactcttaatccaggttggtgctattcaaagagatcatctttcacccgagggatttctgggcatctattttgcggatcagaaagtagagaaagaaggtaactttgccgaaagctagtctggggagttagtagctgatacagatcagcatttcctaactatgagatttcataatattctctcttgtctcgattctgagtcactggtgcctgctgtggtggcattgttcatgaacatgtacagttattgggaagtgatcttgtctttcctcctgccttcaggcactgctacctaaattacaccccgacagatgtattcccattcttctttaaaagactatgtcatgagctgaactattaagttttaaagttgataagcatcaggctaagcatatttttcctgccatctcccacggaggtataacattgttttctatacttagggaatttaccaaaaaaaaaaaaaaaaaaaaaaaagttggtatctgctaatgggtcaaattagcaggatgttttgaaaactcagtggaagaatagctcttcctgcagatgcatgacctggtagaaatccagacattgggctccaccaaactcgaatgatacccaataaatgatgagaggaatatccaaagagttaaatgccatgagaccactcaccccctaaactctaaatccttgtatgaccctgagacaggcaggcagtagggctgcaaggctgagataagtactgaaaattggcccatatacattttgttttaacatagctccttcctttacacttttctgtacccctggcctgaaggctctacagcttgttacatactgatagctaagtaaatgcaatcaacattccatgctactgcctgcagaaaaaccgaaattgtttactgcctccaggatgttggtaaatatctggctgtattttttttttttttggcgggcgggggcggggggaggcaatgggtaggagaaagctagtatacagtgtcccaatttacattataaaatgcaaattttgtactccagaataagaaacaacttagagtagacctgtattgttccaaaactaatgagaaattatcatgttttctatgtgtagaaaagttttctcttcgcaatggctttacatattttctgtagggaaaaattctatttataaaatagcctgggatatggagaactcagtgataaaaggggcaagaacattttcagattgttttaccctgctggaatgtagcatgggaaagctccttccaaaaggctattacctctgggcattctggcacagttggggagtgaattggtaagataaaaatgggacgaaaatccctattttctgttaaatacaaacaggctcagaatggggcatcctgcatttaggattagaaacttcattatacaaaagcagggtggagaaaccctaatttgacagctaacccaagagtgtatggtgaccacaagattaacaggggccagcagtgtgacattgccattcaaaaagctggtgctgtagttgggctgtggtctaaccacagctgggtttttttttttttttttttttttgcccagttttgggcacagaatgctaagaggaacgccaacagaatggagactcgatgccaatgaattgggaaatcatattatgtgacgggcagttgaagaaggcatgtctgtaaaattgaagaagagatttcttagaatgacctcagtaacaagcttaaatatttaagtgtctggtgaaagtaggggtgggatagtctctgatgtgctacaagatcgaagaaggagttaagtccttctctagagcctcaaacccctgctcagcatgaaaaaaacaacagaaacccaagttaacatctccttgcaatatctgatctgtttttccaatacatctgctcatcttgtttcaaaacaagtagctgtcaccattcttaaccctgtcgtccaaaccagaaaccgggcatcatctttgactggtcccctttactcagggggaaaaaaaaccatgtcttttaaagtcagcgcctataatactggtctttggtttatctccaataactcgattgttaacagcccttgaaggggaggcaatactgttaaacttgataatttctaaagagttttgagctatttagcacgaagtgatgccaagaaaaaggaatactaacattactcacagcagagggaaaaattttatatcctttctgaaggccaaggttaagttctgtgtgactcagcacattgactttctatatgaccctaaatcccttctatttcctgatctacttgtcttgacctgtttcatttccacaccaaaatagtttcattaacacagcgatcatgctcaggagatagtggctaactgatgtaattaactgacatgtcaaaggctattggtttattgcatatgcaactgtctttcctggtgggaagatacagtttctgctgacataataggtatgcaaacatgccaaattgcccaataatctgcccccgtgatggtgaggtgtttgcggccattctacttacaggaacagaatggcggatctgttactatgttctcctaaaatgcagctggccaaaggtgctaattggtaaacagttaaaatagaaagaagagaaggcaattcagttttgggccttagtgagttttttttccttttctttccttaaaaaaaaaaaattgtgcttttggcatgctaatgcatgcatttagtctctgcaagaaatttccatttaagaaagaatttaaaaacatgaagtgctcaatccatatctcctaaacaactaaaaagactgcaatttcaaatgagaaattatgttgcaaagaagaaaaaagttgtttattatggctcaaaattttaatcacccaagggctgtaaagttaaaaatagacaattctgccttctgtttatggtaaacttggctgagtcccggcaaatttcaaagctgaacatactgtatgttatttttgcttaattttagattccacattttaaaattatttcttacaagaagcatatttcaggatataaacttagcctgaagaacagtattcttgatttttgcccatattgaaactcctttgaaaatagtaaactatggttttgggattttcctattcccaagagtccaaatgggtacctttctaagtcttttacattatgaatgaacacaggattatgaaattgtaaaggttactttctgctctctaattcctttactcgtaattttagttttcttaacggtataacttgatgcaaatatatacacagtagatactaactttcactgaagtgttttcgggagggaggggcactttacaagatgtgttgcctttagtttttccggtaaggagacaggaagacacagacacaggctcttagggcacatggaaagcgcctgcccctgtgccaagaacttaagagagagccggggatggaccctccttgctgtggctcctgaacagtgcagcctctcttctgatgcactcaccctggcgaggagaaccgcttgtgtggcgactgcttggcccaagagcgagtaggattgttgactcaactctcttcgtgtctcctcagagaggaggaacacctggcttcacctgtttacataactcttgttgattcttgtccctaagctcttccagaatgctcttttgggcttttcctcaaaaggtttttagaagaacaagctttttggggtggcaagaaatttaggatggagatttttgtttttaacctattagtcagcgtggcatcagagaaccacatgtgccccacagtcagtggcatgctcagtaaatatttgttgaatattatttaagtgaatgactgtttgctgaagaacaagatttctctgatgaccttgacaaacgtatgtttgtgattaagttaatcatagctaccacttagaacttcttactcactagacatgtagctgaacacttcatatgtcattctgctttttgtttttttaaagacagggtccctcccactctgtcacccaggctggagtatagtggtgcagtctcagctcattgcaacctctgacccccaggttcaagcagtcctcccacctcagcctcccaggtaactggggctacaggtgtctgccaccacacctggttaatttttgtatttttttgtacagatggggtttcaccatgttgcccaggctggtctagaacttctggactcaagtgatctgcccaccttggcctcccaaagtgctaggattacaggcatgagccactgtgccttgccttcatatgttatttctgatccactaggtttggaacctatcccaggacacctggccatatagagtagctatatcgagtctatattcagcaagtgcagggtaagctctgattccatggtccttccaatatgccataccaccgaggttgagaaaggtggtgttaacagtacccatacgttgacataaggcctctgagaggccaaaggatatgccacagtattctttaaggtgcttaagcccttaatcatgaaatgttttcctaggccacagtaagaatctacttagtttacacacaattctaataaatccggttatctgtttttcaaatacaaagcagattgattcattcagcaaatattttctgaatacctattatgtgccaagtagattgttctagatacagtgaacaaaaaagaatccttgctctgacagaggtgatgttgcagattaatagatcagtggttctcaaaagtgtagttcctggatcagtggcattagcataacatggggacttgttagcagtgcaaatgttggtccccacccccgacttactcagtgagaagctctaggggtggggcctgattttaaacaagccctgtagatgattatgatgtatgtgaaagtgtgagaaccagtattctagaagattttaaacaatttgtgttcctatggcagatagctctctggagaactttgtctcctgattcattcccagactaccgtgtgtgtgtacatgtgagtgttggggtcttaccttataacggcatttagtgattggcaaagctcagatgctgggcctctatggggcagaggcacttggacatttgtacctaaggatgtgggccctggagttacatgtacctgaattcagattcttactttgccaagcacagccacaagaacttgggagagttaggaaaactctctaagccttagtttcttcattgtgcaaatgaggttgacagtaataggaccatacctccatttgtagcatggctacttggtacaaagaaaatgtccagtaactagtaacaattgcttttctctctccaggatccagcacctggcctggcacagggtacatgctcagagaacaagtctttgaaagaatgggtagatgtttattttcctttgtattagccattagctcaaggtctgcagctacttaattccaacctgggtccatttttagcagaagaaaaaagaataatgggactcagcatcaaggcgcacctgacacagagtcctcttggaaatgtgtgacctgcctcagtttagccactgcttttacttcatcctcatcagtcagagtatgacattgccttcccctttacctcttaattttggaatatttcaagtgcctctaaaattttatttaattaaggggcttccaaatctgcttgtagatattttattcttgaaatgcttgtggcattaatagtaaatcagaatcagacctccacctattttgtgccatttcagcactaagccaaggagaaaaattattgaggaaattaatgcttcccttaagcacagtaggaacacgaagctaacatactgccgtataacctgatttcactggtattctttctgaaatttttgtttttctatttctattgcatattggacttcatggctaaaacaaagtgcaattatgaggaggatgttttctcaaaatctgtagggtctggttggtcacataacctttcagaagaaacattatctactggatgacttagatgttattcaccaatagattatcaaggtttatctccagatgttcattaattcactaagtattaattgagtatctactatgtgccaagcatcgtcctaggtgctaaagatatagcagtgaatgaatgggacaaaagtctctgccctcttggtatatacttagttactttctttttcacacatgggcatgtgtgtaggtgtctctggagtaatgcgttatatgcaggtgttgagcctagggtggtgttgggtgcatcatgggcactcacatgttaatttcctgcactgtagatgattgctgattctcagtgatataatccagtcaaaccatttggcgttcttctgctttaaattttattggtgaggtttaactcttcattaatgaacgctgtcacattttctctcttctctgacatgtcctggtgccctgggtttgtggggtcaagtcactgccgatttaattcaactcttctttgtatgactacaagtcctgtgttttagtttcctattgctgctgtaaaaaatcaacatgaacttaatggtttacagtaacacagatctattccctgataggtctggaggtggggagtctcaaatccagtgttactgggctgaaatgaaggtgttccgaggactggttccttctgtaggctccaggggagaacctgttccttgggccttccagcatctagaggctggctcttcactgcatcactgcatttgagctccgcttccttctcctggacctttgaccctcctgcctcccacttaaggagccttccagttgcatcattgggcctgcctgaataatccagggtaatctgtctacctcaagatcttcaacttgatcacagctgcagagtcccttttgttgtattcatgcattctggacattaggatatagacatcttggtggttggtcattgttcggccgatcataccttgtgagaaattccagtgtccctgggctgagctgctaaggagcaggttttattgagcagtctttcccattctatgaaacccaacccaggagaaaacgctctaaaatgcaaatgttgctaacttggcagagcctaattatatgtgcacaactacctaaaattttcttaataattgctctctgttccacaagacttggctcaaaaacccctcctccaaggagccttcctgaattttcctgggcttgtatagtactctgtgtttgtgattctgtgtcacgctctgtgtaagtgactccatgatcaaagctttcctgttgtaattgtgtggatttacttgttgcccactgtccccataccctccacccccacatggtgtgctttctccagaaagggactacttctgctgaccacacagaagacgtgtgtaaagtctgtgtatcaatgaatggattctcatctttcatagttttttttttaaatagttttatgtgtgtttaacttaatttcacttaaaaagatatttaccagaagctgaaagtagggtgtgatgaggttgggttcaggaaggactggtatcacatggcttccctaagttgtatattacattgttaggacacctgacagagctgtggattagtgaatcttacggatggctcttttcagttgaatataattctgaagctctgcaccattcttcccactgtgttgctgttaatctaccataaaccaggtagattctgcatagttggaagtgatggaaatcaaggtgaatgcctgattctttaaatctttttttttttttgagatggcgtcttgctctgttgcccaggctggcatccattggtgcaatcttggttcactgcaacctccgcctcctgagttcaagcaattctcgtgcctcagcctcctgagtagctggaattacaggtgggcaccaccatgcctggctaatttttgtatttttagtagagacgaggtttcaccacgttggccaggttggtctcaaactcctgacctcaagtgatctgcccgcctcggcctcccgaagtgctaggattacaggtgtgagccactgcgcctgacctgaatctttaaattcttaaaatcagttttagtcaccaaagaagatactctgtagcttaataactttgagttactgtaacggaatcaagtcactggtattgagacatttttatttaaaaattttaaattagaatcttactatgtggaaaaatacggtcattgttggaaaatcattttgcctctttttaacagcattcaggcagtttttttttccctttgaaaatagaccttggtctgtgttgttggaaagcatgtaattttcatttgttttttttcacctagtagtgcttaatgataccatgtgaatttttatagtcccagctgcactgaagtgtgtgccctgaaacttcggttggattaagaaaagtagcttggtgtgagggctgaaattggtgaaatgggagaacacagggttgcatctatatatattgcaattaatattgacgagtgggcagaagtccaacattatcctagggggttggctaatgttctttgtacaccaatgcaagtgagtcttttccctccaggtgtgaatagtttaatttagtaggtcgattagtagaagcaaggggtgttttcttgtattccagtttacattatacactcaacattaactagctgtttaaggtacagtgcattgttgagtagttgtggtacaggtatcctgagacgttgctaacccatcttggtatctccagggcctggcatctaatgtagtaggtactcattagcatttgcaacatgaataggagaatgaatgagtggttgttgtggcaaagtctcttaaaaatcctggtccctgcgtacctctgtagccttctcatctccccaccttctagcaataatattctatttgtagcttgttaaatactccacattctttccggcctttggacttttgtacatttcattccctctgactctcacaccaccttccctgtcccctatcccctttgtctggctaattcccgctggttctttatgacttagcaccttctagaagacgttttaggaggcatcatagtgggtattttgttgaaggcctggtttgtttttcatatctctatgataacatatctctttgggtaacaacagagagctgctgactagtggcaccgttgaaagctgcatatctgaagcttcttttcaggagaatgtggatcatttcaggtgcctgcatcatttgcatgtacatcttccaaactctattggtactttccatttagatatgggcagaacatgatgctacagtaactgaaacagaagttaagttagcagcagattctcttccatttatagcatcagtatcagggtaaaatgggaagatgaaggaaaactattgatgaattacctttggtacagctgatactaaagtgggtaaacaggcaaaaagaagttgggaaattgaaccattctctttcttttctttttttcaaaattagagacagggtcttaatttgtcacccaggctggagtgcaatggcacgatcctagctcactacagcctcgaactcctgggcttaagggatcctcctgccccagccgcatgagtagcaagtgcatgccaccatgcctggttaatttctttcttttctttttctttctttctttttttttttttttttggatgagatatgggtctaattatgttgaccaggctggtctcgaactcctggcctcaagcagtcttctcaccctaggcccccagaatgctgggattacaggctttagcaaccacacccagcctgaaccatttcctttctgatttaacttaggaaagtttgctgcatagtaggagctcagctaacatttgctgaggatgaaaaaaataaatgaaccaagtttgttttgtttgcatctttttccttttgctttacaataatatattttttaaaattccctgtcttttctactacacttcttttggccttcatagctctagccccagactatacttagtgcttttgctaagactgactcatcttgtttgattgctttagtgatataagattcttgtatccataggaatggtgtgagactgtatgcctttcatgtttgcaaaaatgtaaaccagaagagccagttattggtaccagtaccaactaattcctcagagctatagggcagtattaaattactaagccagtgtggaaacagcatgatctaatggaaagctaattagcctttgtgtcagatgggtgtgattcaaatcttgtctgtactgctgatgggctgtgtgactttgggcaagtagcttaacttctctgagttcccctgtctctgttttttcatttgtaaaatggagtggaggggacaatattaacttgcaggatggcttgatgatgagaaatgataaatgtcttagtctatattagatcttcagtaaatggtagttgttttgaccactgttactgcaatgagccaaggtggctataagcccttcagtgtttcagtaaggacaagcttacaggtaaccaccaagatcagggcagaacagctgatttaggtctaaacaggttccatcgtgtgtcttcaaaaaggttttcctttttttcctctggagaaaattcagactggtttaagaaggaaactgagagcctcttccctccctatgttctgagtgtttcagagatggccagaaatggatactagttactaagcaagacctttaaaaaatacacgttacaaggcaggttggtatgaaggaaagagcactgacccgtgagttattctcgcggggccaggctctgctccactcagctctgtgttctctgccaagtccctttagatcaatgtgtcgcatgtccccccattgtgagttgagtacattggaccaaaggattatagtttgttttcttcccaggcaagtgcctcctcctgatggggagttagtatgatgtgggtggccccagtaggactgggctggtcttactgttctaagaagtgttagcagaaaaatggctaggcattggagtaaccctgtgatttgacattttggggcatcctttcatggtacgatacacctggccaaaagtctcccagctcagaaattctataactagaaatgctttgaataaatatatactgagaaggtattttggggggaaattttaaaattcttatctgacttggctagagcaactgcttacgacactggacttcttaggggtatcgataatggttgtctttgaatggggagtggatttctcagcttcctgggaacagcaacaaaattcccccaacaaaccccagggtgtctgaagcgcctgctttcttctcaaagagcccgatcgaatactcttctgtgggctcaagagctatcaacagtattgaacagttagactagaaggatgggttgagaacagttgctccctcaaggcttggaaattaacaaagaccatattagtaagaatggggagggaggtgggaggtgaagagaatgagggctgggaggagcaattcggaagtggagagggtgattggaggggtttgtttcccagacagttttcaaagaagagggatttgtgtagtatgccatgggactgaagatgcagtgcaagaccagttgatgttcttcttttaatcaaccaattaatttctctatcatgtttcttttaggctaacgaagtgtcttctttcctttatcatggccattgatagcaagagcttaagggaatcttgcctccctgggctcaggataggctggagagaaggacacacataagaggaaattgacattttgcagtttttgttgttgttgtttgtttgtttgtttttttgagacagtctccactccgttgcccaggctggagtccagtggcacgatctcagctcactgcaacctctgcctcccaggttcaagtgattttcattcctcagcctcccaagtagctgggactacaggcttgcaccaccgtgcctggctaatacagcttttttttttttttcttaattttatcataggtaagggaagacgatccaatgtgcagagaaggctcaggttttcattttagtctgcgggtgattgatttctttctttcaaggggctggttgaggaggtcagagtcttagaaagggagaagaaatcagggaaaaggagaaaagaaggaatgagatttatgaccctctggatcccagattttatgtcgcgtaaccattcccaatactggaagttcatgacaccctgagaaacagccctggaactcagagcagtgatctgcatgcaaaggcaaaattaaatagtccagcaactgctttgaccgagagacacacatagtactattctgggtcctgagtgctgcttccctttcatttctcccctaggcacagattccactggctcacagagtgatgagttagaccacccagggccacttatgttatactgagggcggatgctgatagtgcttatagaggaattatttcaacaatgagacttttccattattctttctgcaatcaccctctatactcagaatgtggaaaccttggcatctctcacttaagaacactgaattcatggtgttgctcagagagtcctgtcctggttccataacactgtgataataactgaagatctttaaaaatgtatgtatcttccatttttattccatatggccccttaggtaacatgacccaatggggccattaaatgaccctgcctacacttggattactcagtacaaagcaaatttatggttgtttattctctcctcctatcagctattagtgcctaatcatatggtctatcgatcatgagattaatcgcctgcccaaagaggcagcaggtcttgtggaatgctgcactgcgccagactgaacttcaaccttttatacaaactggaggagtcaaaatcatcattcactgcctgaaatccttgcaccctgggcctcctgcaccccaggaggtaaatccctgctttttcaaacagtgtactttgcacttcctttccttgtgtaaaactttacctcattgattcaggcaggcacttgtaaataaaatcctttccaaggcatcctataaataatgatctaagctgaaaatatgtgggctttattatacaaagccccatagtgctgccataattaaaggtctgtcagtatttctattataaattctcattttagaagatttatcactgggctattaaagttttctctaagactttccaagagtatcatgatctaaggccttttttttctttctgtggaatgtgttgctttgaagatataaaaaataaagtccagaaacattatcacataggagtacacacatgcagagattggacactttaaaatttgagctctgcctccactaaagtggcttctgtttgcctcttgtgttctcattgcatttatgagaacagagaatcattgtagggctaatactgtattgtaatatttgtttcctggtctgtgtcttttactctgaggagagagagggcagggagttaaatcatttgtctttctggccctggttccaccagagggccttggcaatataagcactgggtttgttcagtaaatgagccccagggtgagagtcaggaaattttcttcctagtcttcatctagtcattaaaggtgaggagtgaattcaggcagtgaatttaggcaagtccctttactttcctgaaaacaagttttctgatcaatgaaacgagtgtgttgagttcagggctagtaaatctgtttttggtgggttgaatactgccggcacagtgttttcaaacacttgaattggaatgtctttagatggaatctgtgccttctagtttgccataatccccactgttccctattatattatgttgtatcagcagcctgcttctatcatttgcctgcagagtctataagcatttatgattccttgtaattattgatcatgtggtcttttgttgctatactaagggtctaaatctgattcaggttagccgttgatgcctttgactgtaactgtaattctctaactttcaacccttttatcatcaaggacctcaactattattttttgttccatatttgaaaacttttggtgttccagacacactgcattggttaataactaattttcccgttgtaaaaacagacacgtgtaactgaacacacaaatgagccatcaacagtatgaatataaaagtgtttgtgcaatgagttggttgacgtttcagctagcttgttcagttgtttcatgggtaagtgtatagtttttgtttgaagttttgatatatgaaaaatagttccgaggtcttctgccttattagacatgtgatagacaaaggattctaggtgagaacttagtttattcttttatgagttgctgaactgccctggtcattagaacatcaagtaagttgtttatccacatgcagttcatgtcttttcagttgtctccttattggtcagcttagagagggctctacaaaacctggcttttacattcagtgagctgaaaagagcttcctatatgagtttacccaaaggcccttgttacattttctccctttagtcaagagtactttggaattttacattttctccctttagtcaagagcactttggaatttgttaaaaggattgggagacaatttgaaaacttggctctccagttaagaagaatcattttttacactttaactcagactgttggtgaatattgtaaattgacaatttaaaaacacacatttgttttattttattttattttttatttatttttgaggtggagtctcacaccgtctcccaggcttgagtgcgtggtgcgatcttggctcactgcaaccaagtgagccttggctcaccgcctcccagattctcctacctcagccttccgagtagctgagattacaggcatgcaccaccatgcccagctaatttctgtatttttagtagagacagggttttgttgtgttgggcaggctggtctcaaactcctgaccttaggtgatccgcccgccttggcctcccaaagtgctgggattataggcatgagccaccacacccggccttattttatttttgagacagggtcttactctgtcacccagactggagtgcagtgacacgatattggctcactgcagccctcgccttctgggctcaagtgatcctcccacctcagcctcctgagtaactgggattacaggcacacgccaccctgcctggctaatttttttgtatttttaatagagatgggttttgccatgttgcccagactggtattgaactcctgggctcaagccatccacctgcctcaccctccccaagcgttgagactacaggcagtgagccactgcatctggccaaacatacatttaaatagagcagatgaaagatctatagtgtagaagtaatctgcatataaaccagtcttaaattgagacgtgacctatgactgttaaagcagtccacatcacacaaaaataaagggcttggaagatagcagcctggtttaaccaggttagatataatttaacaggaagagatagtgtctacattgttgctaaaagcttaggctctggggttcctaatttgggtttaattctgtcttggttacttgttaattctgtcaccttggagtggttccttaaatctccctaggccttggtttcctcatttgtaaaatggggataataatggcttaccgtgtggaataaattagagtaattcatacaaaggatttatcatcatattggttatagaagaaacaatgaatattcatgatcatttttatcaagaatataattgaaatatatttctgagcgttgaggtttttctcttaaagaaaagtgtaaaggtatactttcttaagactgctcatacatgctggatcacccatatacatttccaggaaattgtatgttctagcaattctatgttccaaatgtgctgctttcagttttttcgagaaacaaatgatgtttgactttaaaattctagagttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggtgggtgcctgtagtcccagctactcaggaggctgaggcaggaggatggcgtgaacccgggaagcggagcttgcagtgagccgagattgcgccactgcagtccgcagtccggcctgggcgacagagcgagactccatctcaaaaaaaaaaaaaaaaaatctagagttgaaatttttctcttacatttccttttccctctagatcaatcccaattaaagtttcattgcaaaagtttcacaaactcatattggcattaattattattggtgtgctggtgaaagtcctaaagtgagttcattaagaattaaaaaccttggctgggcgcggtggctcacgcctgtaatcgcagcactttgggaggccgaggtggatggatcacctgaggtcaggagttcgagaccagcctgaccaaacatggtgaaatcccgtcactactaaaaatgcaaaaattagctcggcgttgcgtgcgcctgtagtcccagctactcggaggctgtgacaggagaactgtttgaacccgggaggcggaggttgcagtgagctgagatcatgccattgcgctccagcctgggcgacagagcgagactgtctccaaaataaaaagaattaaaacccttgagaaaactttaaaccctcctggactcatagagctggaggggacctaagaggttatctcctctaagccccattttccagataaggaaagtgtattttccaaggtaaaataagttttcaacagtgaatatccttcataatggctttttaatttgtactgtcactggagtcagccctcatttgccatgttatgattatgttcttcttgtgggacttgtatgtatttattagagaccattgagacgtagcactgggcattacttttgtggcaaaggcaccagggcagtaatcattattaatggatttcattatttgggagagcattttactgactatagagaattcattgcattgatctattgtgccacagttttattataccgggtagtttaaaatgatattctctaaactgttaggctgaaaaattgtccagtgttggcagttatcccatcagtaagacattccttttactaccgaaaatacatagttctgtcgaaagagaccttttgactggtccccagtgccctgactgtgtttaaatccctcactagtgaaataggaggattactactgccatcattgttctaaaacaaacttccttttggaagataacagcagcggtaaatcagatgttgaagaaagtaccagcttaacttcactttgctttaaaagggtttcctctttaattgacaagtgtcatgtataatagggcatggcaactcacatagtaaaccttgtgtggggctgcctgctggggttggagttcttaatgaacatacaagtgaatacactgaggcaaaaaaattaaagctctccaactgtggggtattcattctgttcactgtggccagtgtggtgatcagtactggccacaccagtggccaaagagaactgcattcatcatgtggctgttctatagctgtgagctgtggtgactgttatttttcctagtgatagttttcagtgacagcatagattctggtatcatatccaaggaataaacaaacactgtttttggctttttgtttttttgtttttgacataaaaataataagctatttttggcatatgcagacttttcacaaagtgattgttttcttgagctctggactacttggtaacattcataagttccttcactttgtagctccctctttccttccctccactccctgcaaaagagagcagaactgatttttcagaggtgatgtttacaacagttcaacacactcgaatgagcacttagaataatgtcaatagaggaagaaaaaaaaggacatattattatcaaattaagtaatggatgggcagtgatattttatttattaaagcttgtctgagtaccattggaaacagagtatgttggttctgaagtgcacagattagaaaggaatgttgagtttggaaacgtggcagcctgcagcactgtgtatggtttaaattaaacctttttttggaaagcagaatagctgtaggccacatttaagggaaaagccacagcagagtgagctggctgtggtttttcttttactctgtaaccggcccactttcccttgttttaacacagaaaaagactttggactccttcagaccaaccacatagcttctctgctgaccacaaaaaggaagcttggcgtagaagccataggattaatacccactgtctcttaacccaacagagtgtgaaaactttcataagagatttctctgggcagactgacactgtggttggactttaaacattttaaatcaagcacaactttgaattgcattatgccacagtgctctgtaaattgttatgtgtgatcccactgttaaaagttatttacatgaatccccaggtttcagagggataaaccactaacagctttgtgtatcttataaagaaatacaaagagaattaaaggtatgcctatgacacattatctcagatagagtaggtagatcatagtcagattttattattcttaagcaaatggaggcaattggcttttggcagaaaagccttttcatctttgaaaataataggattaagattgtggattctgttaatcacttgatcagctttattaattaaccacatttttaaattagaaaaaaccctttttactagatgtgcatctttcttaataattttacattgcaggttttatttaatatactgatctactcaggtattataaatggttgtttctatgtcctgcacattaattttaataattggaatcctactaccctgatttactaatcatgcatttgtacaaagcaactctgaaatgaccaaaaataaccacaaaaaaaccttttgtgtttgtatttatatttactcattcagatgcctaggattaatatgttttacaagaaatcatttgaatttacatcttaccatgttgaattaatcagcttttcataagtgcactgtctcagtattctggtttctatttaacagagaatctcaatggaagagattgatttgaaaagttgaaggaaaaatcgtgcatacatgtttcaaaactgtggtcttacagtaaccacagagttaattcttggttgactttatgtcgcgagaggggttgatttgctgtcattagagaaattggtctgtataacacttcctgtatgtgaagaaatgcagttgtcatcatgcctagaccattaaagcagtatttaaatacttccagttgtgaggagccatgcatttattttggttattttcccaggtgtcttaggagcagctgttttgtgctttactgaacttaatagttgaagaatgtgggaaagaaatggtgtactttctgggtaaagtattttagccaccctggagtagttgcattgcatcttgatcttttttcatcttggtagaattatactgtaactaattgaatccattgatcactgtcttgttttttttccatcttcttctccgaggattcatttcataggggtctatacatcagtcaagaaaatagctaccgaggaattaccgagactagtaataaaggtaatttaacctagtttaatattttttttaaaggcaaaacactgtaaacattttttacctggtgagagttaacttcttaattaggccatgttggaaaacaaatcaaaaagacacttactggtagttttcagagagtgagagaaaaaaagaggcaagagaaagcattgatcttggaattagatgacctggtttctaggcctatctaccccaatgcttttcaaacttcaatgtgcatacgaatcaactggggatcttgttaaactgcagagtctgaatcagtatggttgcagtgggcctgagatgctgcatttctgacaagctcgctgagacatccctgctgtagaacctctgaccacaccctgagtagcaagggtctgctttaccacttagctaactttgtggctttgggtatactgtttaacaactctgcatctcagtttcctaatctataaaattgggatattaatctttgttctgcctacctcattgggttgttatgagaataaaattagataatgtagatgctttttttttttttttttttgagatggagtcttgctctgttgcccgggctggagtgcagtggctcgatctcggctcattgcaacctctgcctcccgggctcaagcagttctcctgattcagcctcccaagtaattggaattacaggcgcctgccaccatgcccgactaatttttatatttttagtagagacggggtttcaccatgttggccaggctggtctcaaactcctgacctcaggtgatcctcctgcctcggcctcccaaagtgctgggattacaggcgtgagccaccgcgcccggcctgtagatgtaattttaaagtgtcaaataagcataaggcagcaaggacatttgtttatagatacagacattctttggatacctttcatcaaatcagtgtgggctgttctttaataggaggggcctggaactgtgaggcaggagaagggaactggaatccctgcctccctagtacccattctgtgcctttggccaaatcatctcccctggtcccctgttgcgtcatctttaaaataagggcttgacctaggttagtgctcttaaagggtagttgcaagactagcagcatcagcatcactgggaaacttgctagaaatgcaggttagattcctagccccttccgagacctggtgaatcagaaactctgggaatgcagtccagcaatctgatttctaatgagctcttcaggtgattctgatgcagctaaattttgagaaactttctgaagtgtcatccaactttgaaatgagatatttaagccttctctttataggttcagccaacagagagcctatctgtgtgatctctagacactttcccatctcccaggtagaggaagattggggaattgaaccttctgtgattgtattgcattgagcatgtggtaaggaggactgaacttggacggttaaaacctcacctctctggaactcggaatagattataattgcattgacttacactggtctagcttatccagttttggggctgctttagtagcccacaaacgctgactaatgcagatgactgtacacactgagaaagttctcttccattttagtttcctccttactctcttcctgttccccgaatggttgtcatcatgatatagcaccaagtcacattttatagacttttcaataactttctaaagttgatcacaatctagattatttgcattgttgtgagatgagggaaactgagaaagtaaaatacatgttttgttttgttttgagacagagcctcactctgttgtccaggctggagtgcagtggcacaatctcagctcactgcaacctctgcctcccaggttcaagtgactctcctgcctcagcctcttgagtagcagcgattacaggcactcgccactatgcccagctaatttttgtatttttagtagcgatgggatttcaccatattggccaggctggtctcgaactcctgacctcaagtgatccgtccaccttggcctcccaaagtgctgggattacaggtgtgcaccaccgtgcctggcagtacatgtttttcttaaagtcatttacggttacgtttcctttatctgcagtttttgtttgttagtttgtacatttggaaatacatctgaaaacttaccaagttcaagcgctagagagcacaatctttatgtacagagaagacctcctcgatgaggtctaacaacttctgttctagacacaagtctgatttttcattccagagcagcaaataaagtcatagtggacagctgcttcagtctggaaactagaaacaaacaagaggtgttagctggcagctgaacaatgaagaaagacatggagacactgtccaagaggtcgagatggatagtagcttgagatcctctctttctctctagacatgcgccatgtgcaacacacacacacacacacacacacacacacacacgcagacagtctctgactttcaacggtttgactttatgatgagtttatcaggatgtaactctgtcacaagttgaggagcatgtgtttatgtgtgtatgtgtatccgtatacatttacatttatatatacacacacacacacccctctataatcctgtatacttaaattcctaaatagttgtttgggtgttcactatattggaacgctttaacttgtgttcttaataatatctttaggaaaagattaaagcatgtttctgcatataataatattagtaacaaatgatggaagattttgctccaaaatgagttaatgtagaaaacaggtagtgattaaagtggtgaatgtaagcaattttgtaaatttataaagtcatagacatctgtagttatgaaggacctcatagataattttctccagtggtttcaaatattatttaaataggaatgtttccttcaggaccaaatctgtggagaagctatgtacatgtatttatttttttaagttgaaaagtatgcgagtactggatccatattattaataactttggcccacctgttctttctcccagaagcagccccagttggaatcagcccctagagcgaggagtcacctgggaagcttgttacatgcagattctgattctgtgtgtctgggaaggcacctgagactctgcatttcagataaactcctaatgtgttaaacatgcattggccacattttgagaagcaaggccctgggggaaactgtgcacgtagttcgaaaacctttgatgggttaacttcttcatgtttcaaatgtgaaaagacagagttataaatgatctgccaaaagccacatgcttacctggggtcttgagtcttgggaaggctgtgttcttttacccaaggcctgggtgggatggctgtgtccttaccctttgggctgaaggaggcatcctagtaccagggttccacgggcactatccgtattcttagtttctatcatgatagattatgctgggaacttgttccttttagcccactatctgtcccatggaaaacagtactctgaatcagaccccatggagggtggaacattctgattagccagcaagggcagttaggcccgtagctgtggtgtctgctgccacagcagaatggataagcagttctcagccaccaccccccacaacataatccataaaactctttcaacctttttttttttttttgcatgtctagtgtttgcaaatggaaaatggctgaggaaaaacagagtgaaagtttatataaaatatttataccttaaagatcttttatcttgtgtcattcaagagagaagtgaaaaatgtattgggagtacattatcaagagtacattataaatttaaatctcagattgaataatatcagctgctaatgtgtggagctttggaaatgagtcacttttgaatctcaagaacttaactgtaccaggtcagttacacttaagaaggaagtgccttttgaaaaaagaaaaatcctataccggaataaagacttatactaatgggcattaaagatcaaatacttgacataatattcatgttagaatgtagctacataggaataagttgtaggatctgagacactttatggaatgtttctcaaaaacaatcaaataattttggtcttttctttgtgaagcaatataacctgtggttacgagttatgtgtcttagaaagacttagatttgaattctctgtctgctgcttgttagctgtgccattttggatcagttcttttctttgagactcactttattttaaagcaaagttaatatacctacctaattggttttttttgtaaaggattaaacatcatggtatttgtaaagcattcagcactttgcctagaattttatagttccagtaaatagtagctatttttatcattattgtcaccatgatattgtttttagacctaactagtattgcatcattctttggtgacctggtggtgtgctatggaagcgaaattggtgtgcctgttgaaaaagttagtagtcagaaaaaaagacatacttttataagtgagactgtgactattatgctggacacctgcattctaactagcaaaacagaaaatactttgttggttttaatggtgctttgtttttatactgcatggtatctatttttgtatgctggggtcttaaaatgcttggagcatctagagaggtaactaaaggaatgaagtaggccatagacatagcaacagcccatgtcccattgaaaggccatgagtcccagttgaggccccttggctctagccaattggtgctgtgtgaaaatctgggcccagtgttgtcagttcttttaattttttcctaagaatctggaagtgcagatttttacatgaatcataggatgctttaaataattgcagctgtatcttgagaatgctgttggctgcaagaaagaaaaattttagtttaacagtggtctaaacaaagatttttttttcttacatagcagtgagtccagcagtaatagctagtgtttttatttgctcactaataccaacaagaatttagacactttccatttttctgtcctgacatgcttcatttgttgacttgaaaaaaaaaagtgcttgtcatttatggttgccatatgtatgttgaaggtaggataatgaaggagatacattagactagccttatttattccatttatcaggaaagtgaaaacttttccagaaactacacaggagacatcccttatgatttactggccaaaactgggtcattctggctgcaaggaagcttgggaaaatgtctcaagctttcttttttttgttgttatgtgttttttttgtttgtttgtttgttttttggagatggagtattgctctgtcgcccaggctggagtgcagtggcgtgatctcagctcactgcaagctctgcttcctgggttcacgccattctcctgcctcagcctcccgagtagctgggactacagccgcccgccgccacgcccggctaatttttttgtatttttagtagagatggggtttcaccatgttagccaggatggtctcaatctcctgacctcatgatctgcccacctcagcctcccaaagtgctgggattacaggtgtgagccaccacgtccagccaaatgtctcaagctttctagcctctacagtgggagatggtgaagaagtgggaaatcattgttgcacttactagtgaacagttgctgtctggcacagcagctaactcaacatgaaacccaactgcaggacctgaagaccctgtggcctgcagtatttatcaaaaatcttcagattggggattataaagtgaaggtatcatttgggtggaaaggaggagggtcggagaggcagccagtgctttatttttttgtttaaatggtttcgtattatatatacgataggtcattgctaacaatgtgcaaactgttgagggaacattgtataaatttatttcttggaaaagtttatttagagttttagtggagaagctagagaagaaaataccatttaatgttatttctgtactgctatattacattttaatatatgaattactctattttttaaaaatgatggataaactacacttccctttagttgtttttattctgagataaatgcctgttttgtaaatcattgttacctgattttggtaatctctattagaaagaaatctctttttattaatatctgtatacttaactcagacactgggaaattcttgcaaaatgctttacaaaagcagccattttaagctgattaaaagtatattctatatgcatgtatgtagttgaagtgctaccaaaccacgtatgtatttagttaactaaactcaagaatcatggaagtttgaagaactccaaatcacagctaagaatgcactaaaggaaaaccatatctgtttgactccagcaaattgactcgtgtgatatttttgcttacacctttctgcagcttaactgctgagttagctgttctttaatgtccttgacaaattcaggaagtcatcacatgtagataaattgagaaaaatatttctgccaatttggtcctgatcatttcttcttggggttataaatttgggttttcatgatctagatgttaataaaaaagaaccccagataatctgaagggttactcctcaatattactatgataagtttagggtctgtgagttggctgcctactgagtacctaaaagcatgggaacttttacaacatataatccaatacgtaatcactttgtcaggctgagcaagttagtggaatctttagtaatactacgataattaaatagttaagctataggataaaaggcaaaactgttttattagggaagactatgcttagacagtcttttagaatgattgaaagggtatatagatatgagaaccagtctgctattccaaataatctagttaggattaaaaataaaaattttgtccagatgctgtatgaaaatctactttatagtaggattataattattgctttgttttaataggggactcttagagacaaggaagaaaagagtagggaaacctatttgtataggaaaatatagtacatttccattcaatatctacctataatgtgagagattatgccagacgcattgaaattgctgtctttaatcttcatcccaatcttataaattagcttttgttaccactgtttccttgatgaggatgccaagtccacaccaaatgacttgcctgagatatgtattcattacattttggagttgagctttgaacccagctccgtctgtgttccatactcatttcttttccctgtatcagaagatccacccacactggccaactgagaagaaaaatagcagatgggcttaaatatgggtaaatgtatgataatgtacttagtgaagaaacacctaccaaactacttatagtttatagactcttaggtgttaattttaactcatgaaagaaacctgggagtcataggtttctttcttaaatatgggtaaatatatgataatgtacttagtgaagaaacacctaccaaactacttatagtttatagactcttaggtgttaattttaactcatgaaagaaacctgggagtataggctctctcagcatgattattgtctcttccctacagtcaattcaggagggtttattgaggacctactttgtgtgaggataaatatagtgttcttgtacttaaagaacttacatcttttccttccttctggccgggcgcagtggctcacgcctgtaatcccaacactttgggaggccaaggcgggcggatcacaagttcaggagatcgagaccatcctggctaacacggtgaaaccccatctctactaaaaatacaaaaaattagccgggcgaggtggcacacacctgtaatcccagctactcgggaggctgaggcaggggaatggcatgaacccaggaggtggaggttgcagtgagctgagatcatgccactgcactccagcctgggtgacagagtgagactctgtctaaacaaaaaaagaatttacatattttcccataagacatttcttatgttcccatagtgagaaaaataaccctgtaaaaacctctttaagcaatatctcaatctgtatggcaaggaagatagatgagtgtactcatgtatgatcgtgtactgatttggagtatgttttggaaatgaagactaaaactttcactttaaaataaggttacttttctctaaaggaggcattttctttgtagagtcattatgatattatttcatagctattaaaatttgctatcttgatgcttggttattcactgaaaggaatgaaatatttattaaggtcatattactgttgtgtacaaagggagccacagggtgacttttatgctatgcctttttggtagcggtgtttctgctgggttgcatcaatgtctgtagattttattgattataattaagtcagtctgcattgtctctgagaatttacatggctttaaaaatcaatctctcacatactcattttttgaaataatttgaaaaaggatctcagtagaagggacaaatctacaactattaatcctgttgttatttgtttgagccaaaaatggtgttatttctcattaaaacatttgcaggttttaggtgttatgatccttttagttttcttttaatttcattttctctaccaccaagctttcaaaggcattttacagcttatttttatctctggtagatttctgggtatgcctggcaaaacccctagctcaaatcctgaaggttatttaaattccagtgttggatgctctccacatatatagattttgatgtacacttaataagattaggaagattttatgccagttgataccttgcatgtacatgatggatcagataaaggaccatcagagggctagtgggtctgagctttgattgcaggtagtggggaacattgtcagagctttttttgtgttactttaggtatacatttttaagccaagtttagcacatatatttatgttaacttggggcattaataatcatataagcttgtggaattaacccatacagatatagaaaagcaaagccctaatcaatagtgcaaagaccagttgtgatttttaaaaaccactgcttctgtggaagtgcaagcattgacttatgtttacattatttttctaaagcaactgatttcagtgacacctacttctgcctaaattggctgtctctgcgtgtgcatgtatattaaaggtatatattgagagatatatttgaaaaagttatagtttttgaaataaaaaataccctagtaaattgcccttttatgatggggaatgattaaataaaacagcattatttataacattaactagaattaaatatacagctgggtgagactttgtttgtttggaatttcttaaaggaattagcttcagtttcctaaactagagatatgtgaagattatgaacaccaacatattcttatgaccttgatttttgaaggtgttcaatgaaaaattcttggattatattccttaaaattcaaaatatatttggaatactccaggactatttcatgcttgtaagatggaggttatgtatctcttttctaaggcttgaaaaattaagccctggctatagcaatcttggtgttgtctacaaacccacagctttggtcacagttttttgaaaacttaattatgaatggctgttaaatatttttcatttaccaacttatcagcatttccttttttgcagcaagacttacttcctttgcttatggaaggccctaagtttgtttagaaaacaaagtctgtcttatcataattttgttggtgagaagatgcagctatataaaacaaagaacaaacctgtgaaacttctgctcctcctatcaggctctgtttgtgggaagcctaaatgcataaaatagcaacttgttaaacttagccttgactctgtttaaggggatcttttatttgcaaaatttagtcaattcctccctaaaggaaaaaaagtcattttagtggatcttgaaagcttttagataaatattccaagttttttttcccctgctgctgcaagcttaaaaggcaacatagaaggtctgaagcctggtttttccagctgtgtaacaagcacagaagagaggattctaaatatttactcctttttccttcccactattctgtgttccagtcaaacttgatttcttgctgtttgtttccaggacacttctcaccctgcattctcttagtttgtccccccaaggaatgctcttctttccatcctcacatctctgtccagtagaatcctatttgtcattcaatctgcatttaaaatgctatcagctcttcctgaagactttatggacacccccaaccaaatgtggaaaggggtccacaatttccagtgcaattaccttacctactttttggctggactcagtactctcattctaccttgtgtgttaggtgttcgtgtactcagtaatgttcggtggtcaaccgatatttactaaatgccccttattgtcaaacactgtgttacttactggggaaagcgaacggtttaaaacatggcccatgatgtcagtaacctctttcttgttttttttctccccaacttggttctgaattcccagttggtagaaatggccttataattctttggtgttctctgtgaatcctggcttcttgcacatagtagctgctcaagaaatggtcattgagccatattagttgagtaaaccagttttcttctgattgaatttgaacagcaaagatttttagctttcttctttggtatttaaataaaagtaatgttatttgttctatttgccattatattgtgatttttggtggtacagaaaggaagatttttcccattacccctaccatgtagtcgttgggcatttgttgtttggaaggcatggtaaattagcacaggtcaggcagtcaattttattgagtacctgtaggcactgtgttggcctcctcatctggctatatagagctaccctggagatcctcatgcatagacaactgtctgactgcaacctctggacaccatcagctgtggctttcatcaagttcccaaaggcatccttgaccccagaggttaagtgaatgaatctcacacctgtctccctgaaagatttctaaaatgtcagtggcatttggacaggttcacagctgctctgatccacagcattttctagaacttccttttacctcgatgggggaggaggaatgcctgtgaacttgagctgaccttcaagacgctgtagggctcttgggcaaattatggacaagacctacattgttaggataggcccagaaatccagcttgctaataaatagccttgggaggtgctcacagtcgagtcatagcatttggcatttccctgtactctagcctgtgtaggatttctggatgcttaggactgtaaccaaacttgaactcttgcctgggaatatgccctcccccacacccccagacctttttttgccatctaaatgacaaagataactatcagtaacattttgaactttcctacaaaattgcattcttcgtggtgtatagtaggaagcatttctttaccttggaactttagaagagggtctgaactgagcaaaaattagtgtccctgcctttttaacggctggacacttatcacaaagctgtgccaacatcagtgatggtgcacccacaaaggtgtttggtcttgataagcttctaaagaagcagactttgttgttgttttaaacagtaatgaactgtttcagtttcataaaaaaaaaagagacattctttcttaaatagaaaagggcagaaagtttatagagaataatgtctaacttgctaatgcagtgtttgcctttgctctgtggcatgtgtgtgtgtgtgtgtttatgtaggcatgcctacacggctgcttgtgttaatacttagtataaagccttaaaatggataccagattggctatgtaaccttggaagatttatttacactctcagtttcttttattcccaatcttttatcaaatggtgtttattatattctctgaaaccattaaataaaaaggactgtggaaaaattctaaaatgctaaaattattccaggctaaaaaaagtattacaataggatgatgatgtttaacccatctacttgaaataaaaagccgagcaaatcgaaatgtgatatattttagaaggtatttcttagagaaaaaaatgtttaatgttccttctagactgccattattcattgtatttttattttaaacataattatgaaatattttgaaagtaatcaagtaaatgtggtgacatttttttctctggttgagccaagtgataataacagataactgttatctataatgcatactacgttgactcattaaagcctcatctttgttaaaacattgaatataggatttgagaagaggagaagtttccttatttaggaaaggtttttggtaggtctttcttgaagaaatggagaaaatggcctgctgatctaatctgaggacgaataagagaatcctcctccctgtggctatcattcctatggtgctatacctgtgtgggtgtggatgtgatggtgtgtgcctttgttgggggaaagagagcacagattgtcataaggttgtacccttaattctcatcttctgtacttataggaactgtgtgcttgcctagagacagcagcatttggtccttgaaaaacgggatttcctgtgcaccccttagaaatcctcaggggctgatacaaagagtaatttcaaagagtttaccttaagagctttgtcactgagtgcagagaaaggaatttctgtgatgattccaaacttagagtcagtgctaaggaagaatccatagagctccaaggacttcaacctcaggggagaaaagcagtaatttatggatctttctagaaattacggttgggttctttcccctctcaacccaggcttccttagtcacgtgactggaatttaattatcagtgccataaataatcttgtgaatggaagcagtgtatttggcagtgaatttctgcttcctaaagagaaaggaacctttagaagttatttgaaataattctgtattagccacgatcctggaggcaaatggtcacagaagcagaggatggtatccccagagaaaagtgggttttagatgagtcagataatgtggatatgtgctggtgacgaatgacatgaaggttggatgtattttttaaaatacaaatttaaagcaggctgtatttagaagtttatttataattggttttaggataaagccagcctgttgatgcataacagagttgatcttttggttccattagcacccttgaaatatttaacaagaagctgactttagcatctgagcccttccaaccactgttggagatgaggcagtccatgttggataattcttgttgtaaaacaagcagacacctcctttgtttttccatcttgccccaagccctgtgttctagactagggaaggtcagctctttttatagtcagaggtctgtatgcctttgaaaatatccattcccttacctgtcctcagccagtaacaatttatgtcctgaagatagcaaggagtgctgatttaatttattttacaaacagtgtcctttcatgggagagagcaggctggtaaaattgtttcaagaatcagaacatttttcttggttatttataacataactcgacaatctagctacacagggcttcattcatttgagaaagactattgaatccaaaaataataatcctttatatttgtacagtatttgcagttttataaggaactcttcacgttcattttctcatttgatttttctgacaactccattagggtagagagggcaggtattgttacctccaaattacagatgaggaacctgaaacctgagtgcttgtaagtcctacccagggtttcacagccactcagtgactgggactggagccccctagattttaccctagctcaaaagccagtgctctttccactattccgttttgatacccttggaaagttcactgcttatctaggaaagaaaaattggtagttcttgctgaggaacgtggaaatctgaaggagagacagatctgagagagtcacattggctagtaagtaaaacaggaaaagaccaagggtgtctagggacctggcctcctgccctggttcattcactgtgtgatcatgggcaagtcactgacttctccttgcttgagatttattttcttctcttttcttttcttttcttttttgacagtctcattctgttgcccacgcaggagtgcagtggcgtgatctcggctcactgcagcttccacctcctgggttcaagtgattctcctgcctcagcctcccgagtagctgggattacagacattgcaccactatgccctgctaatttttttgtattttaatagagataaggtttcaccatgttggccaggctagtctcgaactgctggcctcaagtgatccacctgcctcggcctcccaaagtgctgggattatagatgtgagccactgtgcctggccctaattcccctttatgttttctctcacctctctggccagggctctgaagatattcctgggagaatgagggtacatgccacagagggagccttgggtttacagtcagcatagccctgcccatttccagctgcgtaaccaggagaagtggtggcttttctcagcctcagtttattctgtacagctggggtgagggtggtacctaagagaattaagtgaggtaatggatgtagggtccttggcatagtgactggtactcaatatcctctaaataaatattattctgtgttagggaaaagtgaatagagataaatgctaagggtagaggtgacgagagaagtggatggagacaaggatggcttttggatttgactgttttctccactgtaagcactgtttgttatctttcagctttcattttgtctctcatcttttcccccttcagatgtgaggtgtcttgaaggaagagacatttagaaggtgagggcattatgcagatggagaggtcggcggctaaatgtggttactgaagccctgccttgggtctgttcccagccttccttgattttgaaacacatgcgctctcagcaggccagggtagtttgcaaagctgttgtggaggcttttcccaggcagtgttacctgctccgaaagctgcaagcgtgcctacacacacttcacaaagcagatggtttcttttgctttccatgtggtctaaaaatcaaatggacttttaatggaaaggttggggaattccacactcaattatgaatccagtgcagtgcaaggggcagagagatggtataccacaccttttagaagaatttgttactcctggtctcatctggcattggagtggggaggtgagaaagaggaagtaagtaaataaagctgctactctgtgctccaaaactactgagtagctgacatctgccatttgcattgaaaactgagaaagaggagtgtggttttgtttttgattccacaagatgatgtggaagggcaaattgttttggttctatgtgataaactttgagtacctcctgtgtgcctgatactatgatggatacatatgcctagggtaaaaggatgagaagacacagatcatgtctttgagacgtttagcttgagtcacatttgctgagactgaagttgggctttgcatttgaaaagctagcatttttggatgcacttttgatgggacccaacaagagatgatttgtttatttgggaagaatcctggcatgcagtgaggagcacctttgtagctagaacatgcttagattttggtattcttgaaaatgtggcctcctccccaatgccagtgtataggatttaaaaaaaaacaaaaaaacacatctcaaaccttggcatttattgaatattaacaggccaggcaccaaagcattattcagcattgacacttaaacttttctgtattgattattattattattattattattattttttgagacaggatctcactctcttgcccaggctggagtacagtgacataatcttggctcactacaacttgtgcctcccaggctcaagtgattctcttgcctcagtcttttgagtagctgggactacaagctcgcaccaccacacccatctaatttttgtattttttgtagagacgggctttcaccatgttggccaggctgagctcaaactcctggcctcaagggatccacctgccttggcttcccaaagtgctgggattagagtcatgagccacagcgcctggcccttatcatgattttgagtttatgaaaaatgttgtataactatagatgggaaaaactattattgaatgttgttgtcattttctaccattgtaattgttagggtagagtaccaaatggtatttagcaaggtaacaatgccatacctcctccaggtcctcaaaaaaggcagtattaaaaatgaacctacactataggaagccttattctagtaggccagtatttatgcagatgattgttacatttatttattgtcacatgtcatagtctgtgtaagtcagttatttcacaggtaagctacatcttcatgtggttgccttctgcaagtgtctctttccttcttaggtcacagctagctatatagtcagtcacttcctcacttgctcatgcaacaatttttttgacacctactctgtgccacaaactgtaatagtcatgccatcacgaagctcatagtccaggggagaaagaaaagcaaagacaatacagcttgatttgtgatagaattaatgcagagtgccccgggctatctttctgcacgagaccccatcaaagccaagttgcagaggatgagtgggaattgagaggcaaagggttggtgcaggatggagataggaagcatggcatgtgtaaagaaaagcagagaggttggggagaacagggtgtgttccagcagttgtgcctagttctgcccaggccgaagagcaaggcaggagtccgcttaggaaagcctgcagctaactgctgtgtcacctctagtggaaggcttcatggcagctggtgaaagtctcctagcagggccatacttatcttttaccgggtgataattctcccccaccctttttaatttttgccattttttttattataaatgctgtcattttaagttggggcgtaaacgtagtatgcaggaggcaggcatgaattaatgaatagtaaagtcctcttaaattgccttataaaactaagtcctaccaggttcccctttcatctcagcagatgttttacaggatagaaataaaatctattttggttttttagcgtaccagaagataaaacatctggctgagtggattttctcccctctgattgcttacttccacttaaagcttttttcatataaaatttattgatatttttaaaaattctttcttattataaatgagtaatattatcttaagtttagaaaatttggaaaaagaaaaactacatagatgaatactacagttaaccttaatcttactacttgaagaactactataaaatgatagatggatattctttaaaaatttttttttctatgcttgtatacattctttaatatgagcagaatcaaattgcaataaactgatttttaaaaaattcatttattcaagagatacttgggctgggcgcggtggctcatacctgtaatcccagcactttgggaggctgcggcgggcagatcacgaggtcaggagatcgagaccatcctggctaacacagtgaaaccccgtctctactaaaagtacaaaaaaaattagctgggcatggtggcgggcgcctgtagtcccagctactcggcaggctgaggcaggagaatagcgtgaacctgggaggcagagcttgcagtgagccaagatcgcaccactgcactccagcctgggcgacagagcgagactctgtctcaaccaaaaaaaaaaaagagagagatacttgttatgtttccgtgctttatcttcatttttgcttggtaaaacctttcaaatgccctacagggaaatctggcaattgttgggaatatcaaacataggaaagtagaagtaactgtatttccctccttcccacatttgggtctctctatttatgaaaaaacgcaaaagaagcttatccggagatagttcaaagattgctttaaatgtgtcaagttatttcaatctcctatgccttctgtacacatcttcaacaggatttggtgaattcacagtgagagtcataataataatcgtgattttgaaaagtaatagttgtctaacactttcccatttatctagtgatgctatatgcattatcacatttaatgcttaaaacttgagctattgttatccctattctaacaagataatcaaagcatggagaaattaactctgtcttgctaagatcctcagatatgttctgaatcataaaaggttatgttatatttagcacagtgtttatagtaagaatgttttctctattgtgtgtgtgtgtgtgtgtgtgtgtgtgtgtgttggaataccattataatctataagtctctcttgattttcagctagtgtgactcccctttccataactcccacctcaaatttgaaccatcctgaatagagaggagctttaataaaccaactctattattggttctgtaagaccttgacatttgcaaactttattttttgccttttctcccacacagtagccactcttgcaaatcaaccttgggaagttagcattcttaatgaagatctataggagactttatccttagacagtaaatcagctctttcaaggcaccattcatctcccttcgagcgcatgaattggtatatggcaccttacaagagctcatttatcttatgtgggtccctagttattacttttgcccacttcccctagatcgccagagatcaaggcagaaatgaagtagaggatggctttgcactttgaaaatttgccaaggtcagctgaggtacctgtggcattgacttagagctggtgttgagtattacccataacttttagggtgatatcacccacactggcaaataattagtttagtttgtcaaagcatttgaattgtgcttggttaaataaaaatggctagaaggtaaagtaataggggaaaaagtttgttaccttgagaatttttttcctctttaacatttgtccaaatcatattgacatacttttggcttccatattagtgataaggatgaatttttactaagtgcctaggctatatgctaggtgcttttccaaatgccttaaaaaacaattctaccacgatataggagccattatcctcctttcatataggaggagctgatcatcactgatgttaaataacttgctgaaggatatgtgtaaccagataggtggaatcaggattcaatccgtgtatctccagtgtttgcccctgtgactgtggtaaggctgcagccttattggaagtcatccacttgtttaaaaggatgatgcatactctgtgcataatgtttgataacgaattaattgaagtggaatagcatgagcttacagtttgcagtggaccccgaagccaggctttcattgctaaaggagctaatacttgtttctgtggtttgggtttcctcacaagcagactctgaaacaaggttttgagtgcaagtattatagtttatttgggaggtgatcccaggaagtatggtgagggcatatactcaataacggatgccctaatgagcagattatcactgtgagagattgggctccctgcctgtgggcacctccctgacagactgtagaacatgcctcattgtttaactgagaagcaactccttgtctttcactagttgagagttgctcctgagtgcattaagtcccctgccctttcagcctgccccactttgccatgtggacagagaaagccctgaggcagagagactacggtgtttgtgcttcaagttggacagcatgtctgccccagctccaggtgacctccacggagtgtgagcagcatgtggggaggacaccaatagtttctgttacatttgcttttgaagccagcatcagtgctgataaagatgcatccagactgatgcacctggctttgggggtgacaaccttgtataaacaagtgagacaggagaggaggcagtgaagctaggattcctcttaagagaagaaggtaggatttggaatcaggcagtctggggtattgttcctagttctgtacttactagctgtatgctgggcaagtcaatttgttcgagtctcagttttctcagctataaagtggacatagctgcctcacagggatcaaatgcaatgccattcgtaaaagcgtttgtaaatgataaagcgacatgccacctttgagtcattgccattggagctcctgattgaggaatctggtggagtactaggtgctagcagagctttgagggcagctgtttgctttacaagacacacctgaaggctgctatcttggctcaagaagcctgtcctcaaatatcctgacgctttgaaagtcaagggtaagggattcaaaccctatgtaggcccctttctctcatctggtttctggcctactgagagttgctaaccctgctttgcaccaggtgagactgtatttccaatagccccctatcgagtgcagagatgttttggggggtgaaagttgattttgattggatttacaaccccatatatcaagcactagactaaaggtccatcagcctttagaagaagccacagtggttttcatttctttcactctgtttatcttctgaccaaaggctgactcttccacaggcggctgatatcgagtcaatcaggactctttatgcattatgtgaatttggccctcacacagctgagaatggcctgaatagctaagagagcatcctctctgcagcacctcttgactcctcaggacgagtcacactgaaagaggcaggtggatgcccctgattgtgtcccctcccatccagcatcatggccagcactgccattccttcaccccacccaccccagttagcccctggcttgaactccgtcactcaagagggaacattaaaaaccccacacctctgactcatactttgattttgtggcctaaagaggcaaagacgccgtaaggagcttttaggggccatcactatggagcctctttattgcccagcaaaagccttaaatgataatgggaaacctcactattgattggctgactcttaattcttcctctttgggttttgaagtagaagtgatggtccagaatatttatattactcattggatatattaaattaaacatacaaaagtcctacagccatttaagatggggttgcagcactggtgaatacgactttattaccaagagagaagagtagcttttagttgtggcttagctggaatatattgatgataagaatggctcagcagacagaagtcttgggactctcaaaaaggctccaagtgtgctttcttttaaaaaagttatttaggcccatcctttataaacacccaagtagatggtctgatggggtcatggtaacaaagattcagcttctatctaggtggatggtaagacccgctaacatcttggcaaaccgtgttattgggccattaaggaccagtgcttgaattctggggctgaaaattcaacgtattcccttataagaaaatgtctgctcatgataagaagtcacacaaagtacaacctcactatagtacaggatttagaatctttatttctccatctcatcttaaacccattggaagttagcatggattagagggtcggttgactcttctcaatgacggggctggcatataagagctaaaatttttattattgagttactactcaaggttttaaaagattttgacccctggaaaaaaatacagtgcttgaggcagtgaaatagttaatatgactgcctcccttacaggtttccccagatatgcttacttgctgtacaatggataattgttagctcttgttgtgcagatgctgttgcagatggagtcctgtacctgcatgcatagcaaatgaattagactggcaatcccctttataaagcataaatatgtaatttgttcagctgttgtaattaaatatgtatgtgtgaaacagccaccattcaggtcattaatgatgcgccatgccaaattagagcttacagacagtaatgtacattgttgtgcaatgagggaattgcaaataacatggctaagcctttcctagtaaagggatgcattcagcagctttaaaaagaatatttacatttgtaacataatttttatttagaaggtacatttttgttcattgtgaaagtctgtaagatggaattactttcatctccactttagttttattattgttttaacattttatcatacaaatgcaacagactttattaaacatgctgcttggtgataagtgttaagtatctacttacatataaaacagcagttacccctggttttctacatggctgtgatagaactgatgtatcatagcactgtggaatgtcttgataatttcattgcattaaaaaaaccacctcataatatttcaactctattccctactgatacataaagaaattcctgtgatagtaaatagtatttttatttccatagaaattgggctgagaaaaatgcagttatcaaaatataaacaaataaaagtggtaaatgtgcctcttgtgctttaattcccaatgaattacttgtgaatccaaggaatttcctaagaaaagtgtcatatatgggtcagaatggttgctttttaaaatttaagactcaaagtttgttaagtgaatgcacttgggaaaattattgctttgtcctttttctccttggttttaggttacagtctttgaaaatacttgaagctgaaatttaaatatataaaaactatttttactttaaattctttctgtatttgtattttggttgcctgcagtctatttttaacatacatgttgttttgacggttcatactgtgactacatgagctaaccatcttgacctttctgtccaccagggcagcaggaggaagcatcttagagttaattctgtcttgttcacagctgggaacagaacattcctctgtgatccccttgcacatgattcactgggatctcttggaagctggacttgatactataagtcctaggcttctaaggtcgaacacagatcaaacttagtggcatgtttggttaagagttagattagacaaaaccaatgaagttgttaaaagtttcagaaacaattgaaaatgaaattgatgcatgattttagctttgcaacaaattcaactttagaaatatccttaagcctaagattaatcaagattcaggaccttgaagaattttcaaagttagaactgtaatttgtgtagggacgtaaaatctttattttcaacaaacagcaaatgtttccgttaaacaaatgtgtattttatttgaaacagatgaaatcataacagtttggcttgctttacctaagttattgttccataatatcaaaaaaattacttaaaataagttcttctcttcatattccccgaagtttttgtccagttttctgtatagctttttggttcagccaaaaagagacatttcatttgcagcattagggaaaagtttaattattgtttatgaagatagaaatgttatatgaatgacagtgatttaaaaatattattacttatgattgtagtcaaccttttccccgaatattgaaaaccatgaaaaggctttgccctgacagctacatgcttagcattaactatacttgcaagttttccaaaaagatttttttcaagacctgttttcatttacttcctttatcctaattagagatcgtaatcttttgatgggcagcttctcttatttctacctgtttcagtactatagtactggtaaaatggcacagtgtatattttggttcttggagggagacttgggaggatccattactttaaaatattttgttgcagccacctatcagaggtttcttttaatttcttttactgcaggaatttcagagatgcttaaattatagaattatggactacagaattatagaatacctagggatgggaattgggaggtttgtaggaggcgtgcacgtcagaaggtgggagccatgcagaaaggtcacaggtcttatctaggtagtttcaaggagcaaatgcttgttttgcagtagtggtggcagggtggtttggctcattcaagccccttgctctggaggaacaccgataaaccatcaggatgtcttttcgtcttgcgttaactgtggcaaggctgtgcattaaagaacataaccatcactaaaagggtgggaacaccccagcgaccagtggccagtggccaggtgctttatggtaacaccacagacatgcctggccaatcagatgtgatcttttgctggcacttgctcctttggcccccactgcagtaaacactttcccttggatgttggttttctgttgtgtctggcagccacacagggctgcttgaactttagccagaggcaaatatttatacatcagagtgtgcagtgttcaactggtcaggcctgagagggagagggagagacctccgtgccttttagccaaagaggatatgtcctttttttccccttccctttccaccgtgacatggtaaagtgggaccatactggatgtcatttgagcttgctgcatgtgcttctctccaaaacgtacacgtgcgcaaacttgggatgtgctttcaaaagagaggacgtcctgacatttctgcctgctcctttaattcctcttggaaagtttacggttaatattttccctggaacattgtcaagcttttgacagtgcctgagtgtatgccgaactgtgaaattgagccggagaagcaagttgtgagaaatctgtttctactcagatccgtaaggtttatgggggggggaaaaaaaaccaaaaaaaaaaaaaaaaacccaaaaaaacaaaacaaaacaaaaaacaaaaaacttcagaggggaaactgagaatgggactcggcttgcttctcctggtgtgggttcaggccgccattttaaggagccagtgaagggcgacgttccgctccttacatggcggctgtatttactcggccgcagccaatcagccggcagtgccaagccacgtgacatgccacgagggcacgcacagccatttccttgtttctaaaaaacttgctacctccacagagtactttaccttgttttgcatgccaaatgttcttgctgaatgtgtctagcagactggcatttgtccataaagttattttagtaggtaaaaagtctctgagcacttgagctttgtgcattctttatgtaaaatggatttcccttcttggccagaggccaagggtacagcacactcgctgggtgagaagagagcttctctgctgagaaactggtggaccgacacactctaattttttggcttctgaccaaacaagctagaaggatgccaaaattcaacaaaataacacattattgtgtgataggagccgtgctccaagagagcaggaactcagaggaacttcatactggccccttttaaaaaagcattgtcactttggggagctttcttagagaaacgagaggaaaatggtaaaatgcaacctggagagtaaggtataatttgcacatgaacacgaaggaaggaactgaaagaaaacagaggagtttaaagttacttctatgaacttttcccagacataacacacagttctctgacttgacttacattcttttaaccctgaaagttccatctctgtgtctgagcagaatgctggactgcttaacgttaatatgagaactaatgtgagatttaaacacttttaaaaggttttaatgtctaaggatagctgcaaattccaaatatgaaaatttggcaggcttttggggggtaacagaaaactttttaaacttacatgctttatctttgcaccctgacatgtgttaagtgagtcaaatcttcctgttaattactcttgtgacattagcaagttatgtaagcccactatacctgtttccacatatgtataatgaagacgttaaagaagataggtagtagtcttctgagccctaaagaaattgaatttgaataaacaactggaataagtataaaatgcatttctagtttttatgtggaaatttgtcaatcaaaaggaaaaaaaggggaatatctccagttgaagccaccatcatccttacccagactacttgggtaatcctgagtattccctctttttccattcttgttccttcacaccatagccagagtggtatttcaaagaagttagttagtttatatcactcttctgcgtaagaacctccaatgttttcttatgcatctagaataaaatccaaacttgttgcattggcctgcaaagacactgcatgatctgtctggcttctgtatctacctttctaaccccactttttttttttttttttttttaaccgtgactccttagatgctccagccatactggtttcctttcagttttcagaacctgccatcccatttgctacttgtctgcttagaatgcatttttcccagctccttttgtggctggcttattcttacctttcagttctttcagttcgaataatagccctgtaaaagagtgttctgtctaaaattgtccttcctgtttatattttccataatactaataacagtctgaaatgctcttgttaatttatttgattactcattttatttatttatcttttgcactatgatgtcagtcccacaaggatgcaaactacgtttactaccttcttttctaccttttgcacttttcctaatcacattgggaataaaatgttgggcaagttagaatactccaaaatatttcatttaccttaaattttactcaatcctacattttattacctatactcataagaattgtattataaaatacattgttaaacgaatgttttcagtgctccattgagagtcggtggagcacactggttgggagaagacagagctgtgagccatccgtctgcctgtgcttgagtcttggctctgccattgactagttgtatgaactgccgcaggtggttcagccactcagaacctctgtaaaagtgagatgtaaaaacactttctacatcataggattattgtgaagattaaatgtgatatgttgtaaaattctggtcacacaagtattaacttactgttatttttgctgccactgctattaattaatggcagtgtggcggctcagtactaggcaatgggcgtgcaactgtgatgagaaacgcttctgtccattaaatcgttcagtcagtggaagagacatgtatgtaaataggtaagttacctaccatacattgtgccaagacctctcacattatgtgaacagaatattaaagaattataaaagagggagcaattgcctctgttaagtagacagcaaagatgccttataggaagtagcatttgagacagattaagtttctttttaggtaaaaatatgtcccctagagataataataaaataatagcaacggatacctatgtacttcttttactaatgcaccagagtctgttttacatatattctctcatttaatccttacagcaaccttatgaaacagtactgttatcaccttgattttacagagaaggaaagtgagccaaagagaggttatgtggcatgcccaaggtcatataactattaaatgtcagtgctgggatctcgtacattttcactcttaggacatctgtgctatccctgcttagtcactttggcatcccagtggtgctgtacttttgctttcataatacatggaagccctggaaggattcagtaaagagccagtttcaccctgttagcccttgttgctttatttgtaaaatgtcaactgtaaaagtatgcacctaccttatagggtgattatgagaattaaatgagataattcaggtaaagtgcttagcatattgcttggcatatggtaagcatttaacaaatgttccccgtaactactactacgactgctattattattattatgccatattgaaatgagatctgtgatcccttgtgacctgcccgagccccccttctcatgttagcatccatgctggtatatccacttccaaagagaacaagttcccagcagttgaaatggcatcctacccaggttgctagcaccatccctcagctgcttctccaactgccataactgccttagtcatttaaaaattactcttctcgttttatatttcaactcagaaatcgatgcatctgtgaggcagtttgttttcctggggaagtgtaaggagcggtggtggtggcatggagatgcgctccgtttagactcaatattgccacccactccctctgcagtgtcagagaacagtctcagaaagatctgttcctttctttctagactcagtaccacagactggcctatcctctgcaactttgcttagcagcaggagtagagaagtattgattgcccacaacttgcctttaagtcttgtttctgtggtgcaggatttttaaaaagcatttaatgttttccctgccttgaagacttcagaaccgtataaatgccactgtttaaagtcctgtccctgctgaaaaccagggcaggtctcatcacagccccatctccattttccttttgttgaagtgggtctgtgtgagagcgggctgtgccctccttctccacagggtggggaaaaggcagccctgtagtaaggaggttgaatagcctcgctcactttgcctcctgcttgaggtggactccgtgttcccagagatgttgggcctggtttagccagttgttaaactgaagcagggttagcttacccttgaagtgtttttgtttgtttgtttttgttgagacagagtctcgctctgtcacccaggctggagtgtagtggtgcgatctcggctcactgcaccctccgcctcccgggttcaagtgattctcctgcctcagccccggagtaactgggaccacaggtgcgcgcccccacgccagctaatttttgtatttttggtagagatgggatttcgctgtgttggccagcctggtagttttcttacatgaccatctttagatttcagagaaggaagaacatgatcccagaaagcacacagagttacaacatagcaatagcccctccgagctcaacaaaaacatctattgtgtcatgggctgcaaagaaagaggtatgctgggaaccaataacaagatgctaggaatttttttttctgttctattttagcttgaaaaacttgttttccccatatgagttgtgcatttactcttggatcttaaaagaggacaatttattaatctgggtttaaatcctggcccagccacttggatgctgtttgattttaggcaaattatttgactttgtgctattgtgtcgtcatcgacatcatcatcatcgtcatcttttagctgaattctgtgactcttctagggcatttatggtagacagaaatctgttcttgtaatgtagaaatcagtcatttagtgtatctgaaaattcccatcttcaaaaactagggccagatttagtcattcttttactcttaactgttgctaccaggtcatacctaatttgtatttttccaagttacgtatattaaagtcatactaattggtgcctgagcaagttttcagattcctgtttgtccgattccatctgggtcaaattacttaggtacaataagtgcttccttgtctgtaaaataaggatagtagtatccatttaataggcttactgtgaaaatgacacatgatttatataaaaaatggccagtatggtgtctcttaaaaattgtggggcattatgaccagtcaggcaaataagggaccaaggagataactgtaatcaaatcaaagtcctggtatcaggaggtatagtagggtaacgggtcaaggaaaggcatggtcttctgtggcccagagaaagcagtggtcttggcaggtcgtgggctggcaaggtatggaggagacagattcagaagctaagcagacaaggacaaggagccctgaagattagagtgtggagctggggcctgaccttagggcagtgactcttgcccttctgcttctgttctgctctgcttggattgcatatggcttcaggccctggagttacaggtttggagagagtgctctagagtgtggttaaaagtcattggctgggtgcagtggctcacgcctgtaatcccagcactttgggaggccgaggtgggctgatcatgaggtcaggagatcgagactatcctggccaacatggtgaaaccccctctctactaaaatacaaaaaattagctgggcatggtggcgcgcagctgtagtcccagctactcgggaggctgaggcaggggaattgcttgaaactgggaggcggaagttgcagtgagccgagatcgggccactgcactccagcctgggcgacagagcaagactccatctcaaaaaataaaaataaaaaaggctgccataggttgcgtctccagctttcaagtcagtagatctatatcagtaagttcactgctagtgttttactatgcagactcagtttgcctatattaaaaagacttcctgtcttcttacatccgaggagactggctaagcaggagggctaggcgtgttgaatcctagaaactcactgaatacttactgatgaatggactgggtctgggtcacatcttggatctggggaactttagttcacatttacagtcttaggataaggaataatgtcacgtattgcttgttcttcttaccgtgctgtttgattttaataatgatatttagtgaatttaatgaaattaaatgtgatattaaagaataatgatattttaatagcattggttgagtgctgcaatgtggcacacaggtagcgttggaagcctctccatcagttacctcatttaatcctcacactacctctttagagaggtggtactatttccccccatgttttactgaccaggaaattggcaccaggcaggtgacactagaggccacggtcttaatgaccacacaacatggtcttcatcagaatagattccatctccatgatgctttgcactaattaattctttccgcagcagcaccatgaggttggcggttcctttatttgccagctgtttattatttctgtgctaccaacattatgccaggcatggattggagtgtggaatcattcctggaagccaggccatgttcctgagttgtgctgctgtaagaattgggatttaaagttccaaatgtgtggcttccagtattttccttctaaaacagacacacgtcttatcccatttttatggttacatcacaagaatgattcacatttaatcaaacaagtcaggcagaatgatagctaatctatctcagggtttgttgcaaatgttatttacacatattgtgatatacctgattgtgtctaggcatccactgaaacaaacaaacaaattttatgacctgtagttacacagtttctaattagaatatgtgggaaatcagggtccaggaatatgagttgaataacatacattcactctagaccatatttggttaccctggtacttaaaatcttagtcacatgatttagacttcttgcaacaccaacttcttttcttcctttctccatggcagtctttgtatcatttttttctgctgagcaccaaactcttctggcagtttttaaattgaggtttgtagttttaatggtctggtactataaaaagccaactttgtgccaaaatttttccaagaccagacatgggttttgacaccacaataaattaaagataaataaagaaactggcagtgaaaatgaaggatttttttttttttcaagcaagcaagggtagcctatttgtaaatttcaggcatgttttcttagtactttagctcaatgttacaatgcttagctacattaatctgttactgggtaactccagaaagaatgttagaccaaaccattaagagattggcgatttttttcccccttgagcattattgaaatttgacaacattctcatagtctctgctttcttttaaggatttggctatcaaaaatacgggtaagtaaaaggaaccaagagaaactaatgaccaaatgaatagtagtatttaaagtctcaagttgctatgatacaggcttcaccgtgacctgagtggataaatgctaaacgggatttgctttccggagaatctgggtgcctgttccaccaattctgtttgtctctagcctggtttttttttgcctcctccctttcccagcaccatttattttgggttctgagaaacagcttcctcccattacaggcaccaattcaattaggcaggagatagtgctgaaggtttttgtttccatcagcttctgctgtgtagatagtagctctgtttgaaaaactttgagaagttgttgtgatgtgcctctttctgggttccgatcccttctcagcctggtgatgccatggcattcaaatcaatttgtttctcttcccctcccctaccctacatccatcatacaaaatgggggtggttgcactaatcagagatctgcttttttccccccacagatattggtaaattattaaaaaaccataaattttcttctagatgctaagtaactcttaacagtcttctgagtacgtgagtttgggatttggccttgcccttacagagacctgttaacttttcaaacccgtgacttaaaatttactaaaaataacaagttttgttgttgttgttgttttgttttttgtttttttttgacatggagtcttgctctggtgcccaggctggattgcagtggtgcagtctcagctcactgcaacctccacctcccgggttcaggcagttctcctcctcagcctcccgagtagctgggactacaggtgcgtgacaccacacctggctaattttttgtatttctagtagacatgggatttcaccgtgttagccaggatggtttcgatctcctgaccttgtaatccgcccgccttggcctcccaaaattacaggtgtgagccacagtgcaaagtgttgggattataggcatgagccactgcacccggccaaaaaataacaagttttgaagcatattagaaataatccaacaaaaaatttatttttctttagtcttctaaattagcaagttttaggccaccatgtggaactgaacctttttggaggtttaaaatgtcaaaataccttgccaggcgcagtggctcatgcctgtaatcacagcactttgggaggccatggtgggcagatgacaagttcaggagtttgagaccagcctgaccaacatggtgaaaccccatgactactaaaaatacaaaaaaaattagctgagcgtggtggtgggcgcctgtaatcccagctactcaggagacagaggcaggagaatcccctgaactggggaggcggaggttgcagtgagccgagatcgtgccattgcactccagcctgggtgacggagcgagactcttgtctcaaaaaaaaaaagaaaaaaaaagaaatgtcaaagtaaggaaggagttgtgtgtattttcagtcttgacttcatttactgtaagtgccgaagcaccaagtgggaggtggtttgggaagtatttctgatctaaagaggaaactccataaatcacccatggtaatgtgtctcattagcaacactccaagtagatgaccaacattccgaggagatgttgctcattttcatcctgcatcttggcctttgtgcttacctggccctagcttagattttaaaatttaaacatttttgtttctcactcttgaaaactttggtactcagattcttaaactcctctgttaaatagttttcagattagcctagtatagcgttcaaaactggaaaccactgccagaatcctctaatgtgggggaaaacatggctattatcattgaatgtgcctccaaaacctatcaaagttggcagatgtccatgtgtttggcttggaccaatttataaaacgttcacatgcttatgaaaattgttatctctgctattcagaatagttgagtataaaattgagcagaaaagcataataagagaagaagctctgctatgacttgcagtatttttcttttgatcactgaatactacaagaaggatcttttgtttgcgtgtttgtttcaaacttttccatgtatagaggtgtcttaggtgaagtgacaactaatgacatgtggaagtcactctctctggtgttctgtttcttctataactaccctcccttcctgtctaaagagagagggaatagctcctgaattaggtgaaacaaatagtttttaatgtatggtaaaaataagtcattcttcctctgttggcaaaattcattgtaggtgcctttcagtgtagttctgcaaatgttttttccattagttggagtagaaaagagatgaaggattatcagttgtcaggtatattttgcttctaccaaagatgatacataaatatgaaatatttgcagaacaagctgcaaaaccactaggtcctagaaataaaattctgatggttaatgcatttactttataatatgaccactttttccttttaacattttccccagtatgtccttagtgcctttcctggaaataccaaaaggcaaacatcccactttaatagaagtgataattgtagtacacattcttaagagaatgcctccttatgcctacatttttattgagggctttgtctacatacatccagagtcaacttaacttttggacccaattaactgattggcctgatgaatttaattaaaataggggaagtgcttgtacagagaggaacagcattagtataatgtggtggttaagattaacaagattgatttgacttgataattaattaatttgattaacaagataatttagtgtcaggcggagacctaggttcaaatccttactatagatgaccttggttttaaactctttaagtctcattttttccccatccattaagatgtcataaaaacactgaccccagaaggtagtgagaactggggagataagttagggaagtgctcagcacaacacttgggccagtcactgatggacggtagtaccttttgttattttctagtatttttaaagtatgtgttgtctgaaagacaccatgtctcagatcgctgtcagatttctttgagtgaacagagtcacttctttttctgaagacatcagtagtgcaagcatcatgtctttgccttgtattttgttcatctttttgcagttggaacgtttctccttcccttatttatatcaactttaggtcgtgttaactgtccctatattttaaaaaataacattttataatttccatgcaaacttaattaattttcacaaaacccctgtaaggtaggcaaggtagatattaggttatagagataaagaattgtaaaactggaaagaaatatggccttgacttcaccctatcattttgctggtaaagaagcaccatgttcaaggtcctgtatgtaggaactggcaaagataacaaagtagatctgaactcagtgcccttcccactatcccatgctgatcacttttctttttaattaaactgccctgttcctggccttccattgacaggttgcttacagctcttaatttctagggttctcaaaactgtttaatgagtgtgtctggattaaatccagatactctgactatatagagctcttttcattttcaaagatatctaagtaaacacagcatagaattcttcacaagttcctatcaatttccccttttgaaaattatggctcttttctgtagctttctgagacatcaattctgtgaacctttgcttctttctctcaccacctcttgttgtatgttattctgacttcaactgccacattttaagtcatggtaaccaggaatctatactgaaatattttcattaattcttatttattcggcagcatgaacagttgcagggattcttggtgtacatttgtaagttttcctttcctgttgtattttatggaatgttaattttgctcaattgggattcctttgtcaaaactgctgtgatgacagggtcttacggcatcatgaatgtgttcccctattaattaatattatcttagccatataagaaaatgacaggcacatgcagcttgtaagtgaaatgcaacccaaggagccggaagtctttcacctaaaccttaattttgttcaatcgtttgtatttcaaggtctagtctgtaatttattcccataaacaatgttgttctcctgacctttcttgtgtaccctcctctgtctgtatattatcattttccttatttttgtctatattgtgtcactaagagttaagacattttaaaatgtaatttggctacctcatccattttatctgcatttaaattgtgtttgaaaattttacttttgcagatttataaatttttttatccccttacagttttagcctattcaaaggggatacttattttttgtaaatgttttataataaatttaccattttgtgaaaaacagtgaaaatttacatactttttagaaccacaagaaatatctcttttaaaagctactttttaataatgtcattttggaggctagaaattcaatttcactttttattaacttagttcttgtgtgagaaagaaatgtgacgtataaagaaagcagagtaaaatactataaccgttttaaatcagtctggattttcttacagagtaactgaatttttctgtaccatagatttgatctttttagtcagactttgctttatttctctacagatgaattcagaatccactaatgttgtttgcaaagtatattttaaactctgtaattaacatgtttacaagtttttaattttacaaagaaaattaaaagtcagtttgctttgtaggtatgtttgttcttgtcttatgtgtaggtgctttatatgtgttttaaacagagtttaatggtatcttctgagaaaattatagctttagtgtgctactgaaaacctcaagtagggaatcaatacctaaaatttgatttggataagaaatttgtataaactttataaaggatttttgcagggcaaaaatttgcatcctcatgcccaatattctgccttacttagtaaattcctaggtcatggctatggagctcctaattaagttaaagaaatcttcacttgaaccagctaaaagctggtttaagataaatttggaaaatgtctagaattgataatatattttcttttagttttctctgctactcttaagggtacatgtaaatacatttcttagcgtagagcaaatgttgcatgcaatatgactggccagtggcattttatttcaaagatctcatgctaatatataggagactatatattatttttttttgtatcagcatgtttaatttttttaaggttaactgtgtgcaaatgcatatttgctgtccaaactagttaatgggcttacaactgaagggtgtaaattctagtatctgtattctccagcttgaagcagtgttgtctgaagcctgaaacggctgatgttaatcttcagcttattttgttgatatccaaaaattaacttgaagtagaataaaatgtgatgtaaatcgacttctctgcatactcataacagtgtcaatagttaaaaaataaagtctatataggtcacactgtttaaaaccttaaaggagtgtgtgtgtgtgtgtgtgtgtgtgtgtgtgtgtgtgtgtgtgcgcgcgcgcgctgtgtgtgtgtgatgcatatgtatttgtgtttaattaaacagagggaattgctggcttttaatcaagttgatgaattttgaatttccacttcagtgatggctctaccttaaattcatttggctgatgtgatagcagtattcggaatgcaacgaagagataagagtttggaccccatatttataatattccagaagaatttcattatgtaatggctagaaactcagatttcccacagagttgtagagtgtgcagtttggcatgcttatttactactctggttcttttttttttttttttttttttgagacggagtctctctgtgtcacgcaggctggtgtgcagtggcgtgatctcggctcactgcaacctttgcctcctgggttcaagcgattcttctgcctcagcctcctgagtagctgggattacaggcgcctgccaccacatccagcttatttttctatttttagtagagatgggatttcactgagttggccaggctggtttcgaactcctgaccttgcgatccacttacctctgcctcccaaagtgctgggattacaagcgtgagccaccgcacccggccactactctggttcttaatagtgaaagatttatacctcaaaaacactctgtagataaagaaggattcaaatatgattctcttaatattgcatggtttggctaagaaaccttgttattattcaagttactgtgagtcaagggcttgcttagaaacagcagacgtaggcatggcgcggtggctcatgcctgtaatcccagcactttgggaggctgaggcaggcagatcaccaggtcaggagttcaagaccagcctagccaatatagtgaaaccccatctctactaaaaatacaaaaaattagccgggcttggtggtgggtgccagtaattccagctactcgggaggctgaggcaggagaatcgcttgaacccgagaggcggaggttgcagtgagccaagatcgtgccattgcactccagcctgggtgacaagaatgaaactatgcaagaaagaaagaaagagagaaagaagaaagaaagaaagagaaagaacgaacagacatagatagtctattcccacttcaagtagagtaaacaggcaaagtggggcaaggaagagcggatgaaaaagccacaaggcaattcattaacccattttaagacattttcaggcaacttgtgaagcttcaaaggtcaaactgaccaacatttaattcatcacagaaaaaaaattctgggagaagaaaaaagaaaacttgaccttcacggtttaacaagttttcttaaaatgtctttatacaatcttgatagagttctttgctaacatgattcatcttccaatctatgcaaatcagacttttaaatcatacttggttttatataagggcttccttctgattgactttggagcaggtaacacagagctcttgatggcagtgccttgctgtgtgttctgttatggtgacagagagagcaccccctgcaagggtgatttagtgtgaaagtactagggtctttgactgagaagtcaccaaaaatcaatggctgtattgttttgaatgttatctgggcttgcaactgagaataggacctgggggttttactctttttattccttttcattcgttcttcactctctatctgaattgcagtcgtggtcctctggcaggcagcgtctgtatgcgaccggaaggcagtgctgaatagtggggtgatgttggcagagcactttccaggcatgctagcacctagcgcacaagcagagaactttgcttctgccaactgtgacttcagaacccaggtctgttcctgaacctggatgcccagctgtcagtgtgtcgccatatgtcaccagcacatggcaccctaattaaaatttcaaattgcatgcatttgtgtttgctggctggcttgcttaaaaggcagagacctcaccaccccggcttgcccccctccttcatcactctgaagtattatgtttgccatccttaggaatgagttggaaaacggcctttgcccactaaaaaatcatcactctccaattctctcacctcccattttgaaataggaatagtccttattttaagggagaaggagtggtgtgaagaaacgtggctggtacccttcagtagaattctaaagaccagaaatgtggttctcgtgtttccagtggttcatacagatcactcttcaatgctgtcctctctttgtgaatatgtttagctctttttatgtttacatttgaaattttaaaataggattagatggagcattcttggaaaacagtaacaacaaaatttaatgaagtaggtcccttcgtgcaaagcaaaaaagacatactgctggttgaggatatctgttaatagctaccatttattgatcatttacaaaatgctaaggaaaaatgcaagtcgatttacctgtgttgcctcatttgattctcacaccacttctattctgtggcaactgctaacactctcattttagagatgagcataccatggcttatgtagcatttccaatcttatgtaccgtatctcgtgagtagtagacatgaaatttgaactcagatccgtttgacttgagattgtatatactacattgcttccttcctgggaagaaaatggaagttttttctggttccttctaatcgtagcttcatagatatgtggtgtgcttccaagtgtgtatacttttccatgtatgctaagttttggtgatgtattaaaaaaaggttgaatggccaagtacagtggctcatgcctgcaatcccagcactttgggaggccgaggtaggtgggtcacttgaggtcaggagttcgagaccagcctgggcaacacggtgaaatcccatctctactaaaaatacaaaaattagccgggcgtggttgtgcgtgcctgtaatcgcagctactctggaggctgaggcaggagaatcacttgaaaccaggaggcggaggctgcagttagctgaaattgcatcactgcactccagcctgcacgacagagcgagactccaactcacaaaatatatatatgtatatatatatatatatatatatatatatatatatatatatatatatatatatatatgtatgtatgttgagctagaattatgcaattccctattgacccttagtcaccatttgcagtgatgacaaactggggtattttaaatgacagcaggaggcagtgcagtcattagcagcatggactctggagcccagttgctgctttagatctcagctcccctttgactagcgtcatgatcttgtgcaaatcacttgaccgctcagtgcctcagtttcctcatctgtatgggataataatattatgagttaatccatgtaaaacacttagaatcttcctcctggactattgaaagtacccattagaggttagctaaaattaatcaacacatttttagacttcacacagaaaaaaaaagaaattaaggaagattaattgatccattctttagaaaattctgatactaaacactggcctttatatagcatctgattaattaaaatgagtcaccctcttgatttgatctgccagtcaacaattgctgatggagcttctgctataaaatgatgtatacattctccaaaataaaaaacagtatcataaaccttaaaaaggtaccagtcatgttgggtagacaagacatatctacttaggttccacaagtgctctagagttgtttacctattcagtccagtgaattatcacaaccacataattaaatgtgtattcatccccaagtaatgacagaaaagatgaagaaaacctaaacaaaccaaaaaacctccagaaattttaacaatgtgtataatgctaataatatttctaactgtgataatagcagtaatagaaggtagtagtactcatttaagtggcttctgttatggctgtagacaagttatttacacatttagcaaagttatgaaattctgtcatctataatcttttcatgtatgaatgattcctttcttataaaactcccatttattctgtagggttgctgaaacacagcaaagtgtaaaagggaaaacaacgactccctctacgttttattttaaaatagaaaattctgatgggaatctgcaatataagccaagatatgtagtaagatctcacatactttctcagatttggcttttttgttgttgttaccttaagtatcacataccctgatagcgtaaagaatcagtatcttttatcctatctatggaaaatataatgattgttgataattttatgagccattgtactaattttaatcgacacatccgctcctctatagcacacttccttgagataaaactggctaatagtatcaactgacctgttttctgttttttcattgaactttaaaatgtaattctttttctttttctggtgctcaaagagatacatttgtttgagtccttgtgtattttatgtatcacattaagaaaattataaagaacttaaaagcttaaggcaaactttaaaaagtgtcttgtcaggttagatttctctttcctttcaactaaaaaacaaaaaaaaaaaaggaaaaaggaaataagggaaggaggaaggggtgggggccatcaggtggtaaaagcctgtttaatgtaacatcagttgtggagaaaatattaggttcaattacataaggattgtgtgagagggagcaccttgagaagcataatttaattagaatgaatttatgagcgagaggtcctgagctattagacaaagcgaaggcagtggtgtgctctcctttcacgagagcattttaatgagtttccatacaaagtatttcaggtaaaagatttgtagcaagtgtgaatagaaatgtagctccaaataaaaactgtcaaatagctctagtagcaatttctgggctaagagtatttaataaagtatgctgacattgttatttcttgatgattttattgaacaactatcgtgtaagaaaatcttaaaaaaaaaacactcagattccaatgtgttctttaatttgccattaaaaattgaactgcagggctggccttgcttgacttccaatttgggcaggtgttagattgtgacttacataacattgcaaactcatccattgccctgatattccagaaggataggtgccaatggtaacttaagattgagatttcacctttatggcttgcttcctatttctggtaagagggaattaaagcgttatctccctatagtgtaattatggtcataaacttgattagagttctttaaataaaatccaactaggaaaaaggcaggaaaacactgtggtcaattttggggaaggaggatggaatacaggcatgaccttcaccttggtcaaaatatgttccctaagactctgggaagtcttgtatatataagattcatatggcagggtttttaaaaagttgacaggagagtacatccttgtttaaggatttatttgtgtatgatcctcacaaggtacatttttgagatttattgcaaataattctgttaatcctttcctagatattctgacatgccaggtggttaaagaaggatgatacataccaggtctatagaaatatcataaattattacacagtaatataagtatttttgtcatccatgactaacttttaaaatggcaaaattataaatatctgtaaagtctatgcgcagttgttactgattattgtggcaataatacataaagaacatgttttttgttttattttccacccttatgttttatttataaaacaaaaatttatatttgcacaggaggagaattagcaggatgtaaaataaaaatgaaagaccccaatggggagaatattttaaatgtcttgcagggagtggaagaaagctttgcttaaaaatgtcaccatatgctaactatatacagcacttcaagtttatttattgttaaagcctcatgtaaatcacgtcattctgaaaatcatggaaactgcacatttgtgcattaaactatgtaaacaacaaaaactggtcatccgtccaattgttgcttcacttattttgaattatagtgcaattttgtggagggtgaaatggggattacacaatatagcgatttcctgttaacacctacatttttgctgatcaagcaaggtctgttggtgcgagagcttaacctttattttatttccaaatgtgttttttattccgagtcccgttggtgtctatggtttcacttttctccatgagccacatgttaaagcctgccctgactaaatgaaggagtgtaagcagtgggatagacattgcaggcaggcgaaactgggataagccccagaatcttttgaacctatcagtaatattactaacagggagaaagtataaaagtgagcgcttcaagtgctctagtgtacatgtcaaaattaaagcacgagttccacgggatggctcaccaccctcccttatttataaaacagaagtatcttttgagcccgctgtgccctcctcccccttttctatgcctgtttttctgcctgggttgcctggtttttgctctgcttgttgaaaccctgctcatccttcaggctgcctcaaaacttttgtggaagaaggtagggaacacatatctcttcttttgtccagccttccttgattagccttcttcctctcccttctacccattgtacatggtttctgttgccatgtagtggttaaatctggtttacgttgtagttgtttgtgtgtaaggaggtctcctacaccgggccatgttttcttaaacactgggatggtgttttcttagtgcttgtgatgttctttgtaacagtgggtgccctataacttttgtttggactgaattaaagaaaaaaaagaaatcgactttagtaggagccggcctttgagtgataaagatacattgagggaactctgtacatccccaagatcgtggccagttgccaggctccatttggattatgggagagcttaaccccatatttcagggcagatatttaggtgtgtgtatgagctgtagttggtgaatactcatttttgaccaaagaagatactggtttgttttccaggtgttgctgtgacttccgtttctgtaaattccgtgggatgtattttgccaccaactgcctagcagtttatgaaatggtgaactggacgggggcctttctgcatccacattgctctcattaaagtgacccctgctttcctctggccctcttgaagtgtatctagtttagaacttcttattagtctgtggtcttaagatctttgtcatcttaggcataggctcaaaggaattaaacttgggttttgattagtgaacttgagccagttagctggtggactggatgttattcaggcataaacttactcctatgtagtttctagaaggttggcctgggccacagaactttctatagaatatctcatccatgcatctatttggatttagagcatggatgtaaatgaccctaaaggtagtacctaatgtgagatgcagcaggagggacctttatatttttttattttttattttattttttttaagaaacagccttttctatgcaatcctggatggttacgtaagttccattttatttgtatctatattccttataaagacaaagcagcaaaaatgcactaaaattagatttaatttccagctgtgggtatttgtattatgtctgccttagtccaccttctgccccccccacccttgggttgatgtggttactgaagatagtgaggctatctggagattggacattgaccttcactatagaacaaactcaactgttcttatctaccagggatggtgagttgaagacacctgtagtctatgattagtttattgtgtgagcatttttctgacatatgctgagtgatattgaaaacatttaggtagagcttttttctctaaaaacctgctcattcattcactccatgactttttacttggcacccaccattctaggcactgggattgtattctgttggcccaaacatacttcactttgttgagaaggtttagcataggactaggaacatgctagtatacactgatggatttaaagcccattgccaattataaattcattttcactatcaattaggtacttaatggctatcctataaggtaatactattattatctatctccattttacaaatgaggaaactgaagcacaaagaagtggatcagtttatcgaaggccatactgctaggatattttatagaaatgcgttttgaaccgaggttgtcttaattcccaagtctgtactcttaatattatactaagttgcctgagaattttagcaagacttagcctaaatgatgtagagcatctcaatttctgtgcaggtccatttaacagattttcttgattcaagaggtgtttcatcataactcaattgtcttagcagttgtataaaaagctagctctcagagatggggctttctcataggcatagcagtaattatgtcaacatagagaaacttctagaatcgagcaaatctggtgctcctggctgtggcctagcactcggtccagtgtcttcatattaacccatttatgctggaggttgcaattttttgaatttttgcaatcagaccttggcgatgatcttgagcagtaggatataaataacttccacatccttagtgttccaataatggaacactaggcataaatatgttaaaaagtgaaagtaggaagtcagaaagttgtgagactgggcagagttcaaacacttggttatccaacgagacaggaccagagaggtttgttgaattgagcggacgagaacttcaacaggctcacgtttagtccagtcagtgtttcagcactgacacaggttaccatgttttaccttgattcacagtttcacagtagtcagcaaatgccctacactgaggttttactctttttattttgcagccctttttttttttttttttttttttttttttgagacagggtcttgcttgctgtgtcacccatgctggagtgcagtgatgcaatcatggctcactacaccctgacctccctggctcaactgatcctccctcctcagcctcccgagtagctgggaccacaggtgtgcatcaattaacttttttatgcccaactaatgtttttaaaattattttttgtctccctttattgctcaggcttattttgcagacatttttaagacaaaatttttgttatgtaagactttttgttataaaaattgttatataagactttataagacataaaattttgtaatatgaggcttttcctggttgaaaagtgtttcatttttcaatgttttgtatttgtatgaaatcagtctttttgccagcacactgaatcttgtcagattggatgcagagtttctttctgcaacacttttactgtttggtaacaaccttttcttaggaggagaagctacagatactaccttggctgctaacaagttttcagattagaccaatttcacagtgttgactagggaagaaaactgattgaacttccatgggctttagactgaaaccaatgactagcattttatctcttttggatgtgagcatgattagaagtcagtctgaagattttctttcaccagcattgataattcttgtcagtgcgacctcagacacatattgccttcttttctgtgcatcctctgaccagatagaatttcttctattttggatgacatgctgcattttaaagatgcaaggtgtaatctagataaatataaattcattggatgctacctttggaaaagagctgaggattatcttagagctgttcttttcctctttttctttcagaattgttattttctgctcaagattgccctcccaagcctacctcatggcagcacacacacacatacagtcacattcaaacacaccattgtactgttacttgcaaaattttgcatatttgggaccaacatacctgttattctgaagtgctgtcgtatgaaagaataagtaaaggtactgtttatatctttcgatgtatgtctagcactaatgggagttaggggacagatagatgtcaactccatgcaaagaaagtcattatgacaatgaagaaggccaacagtggacttgtggaggagctggggaccctacatctgggagggaatggttctgctgaggtggttcagagattttgtagctgtgatgggttagaaaattagatgagaagattgtcaaaattttgtacaatgtacagaattttgaaacaaaaatttaatgaatggtttggggaataaatggcattttacgttgactgttttatttctctcaaatttagaccctcactgggaaattatttttgagtcataaacaatagacccatttcacatctattcatattttctctctctccatgatttttagatttaaaacaagaccacaagccaactttaaacagttcatctttcttcctttttttattgttttttaacttcatggttttatctcagataatttgctaattctagctacgggtgccttcctcccagctcccccagtgtggtagctgtcattcttaacaaactgggatactcacgagacatctagagttcagttgatgatagtccagagtgtgtgagcagtgcagggaaatctgtagctgtgagcactcatctttgaccacagaagcgctgttcagatgtggccagatggaattcctatgaatctctcttctgtgaagtgggatttttgtggcaccaacagcaaagcgattcatgagtgaaaagccttctctggtgctgccatttccatcactgtttctgcctccttttgcttttgttaggcgtaggccctttatttattcagacaaaagtttttaaaagattagagcatacttccatattaataacatcccatgagttaccattttgagggaaatgtgcacatttgtgtaggggttttgctgaggaaaaggaatgaggagtgaaaggagtctcacccagttggatagtggtatgccttggaaatgcactgaacctttttttttttttttttttttttgatgcagctcttcacagatggataaggtaaggcactgtctgcaatgcgtgaagcactttttaaaaagtgagaactcccagtagacctgtggtgttgcaggagcaggtcaagtgctttctttctttaatatttagctaagagagatcacttaggtgaaccgttccctataactagatcatcctttgctttttcctgttcacattatgattgaactcttgtttttgtacaccagtaaaatcttgcatctgaaaatcttattgcaagcaagtctgcccagttttatcattttttctgccatattccttctgagagcagctagtttggaaaagtatggtccatgccaggcagagtgagctcagaagaggaagggaaatatgtagtgttttaagagcatgaagaggaaaagactactctggtagcttttctatctgtatgtttgttttggcttttagtcttgaaaagactcaaattctctttcccatcctttatttctaaattcaaagggaagcagtttgacatattagaagccctgtctttggagtcaggaagacctgagtttgaaactgtgtgttgtgaccttagacaaactacttaatctttctgagatccagtttgctgtctgtacaataggaataatagaagtctatcataggattgttataagggttaaataagacattgcttatgaaccttatacgtagtggcttgctattattcttgtattaacaaggttgtcctggcatttcttcctactgttaattttcacaaaatatgatatgtcttaagctttattattgaaaataataaagctttaaacttttaataaacatgtctggagtctaagatggaagatgttaaaaagggctcagacgtgattggtttcttgatgattaagtagtgggcagtcaaagatacttgttttatgacacatttaggagaaagtactgaatgaagctcttaacagtaacagcccctttaattaggggaccagagtagaggagtcattcccagcgctgcctgggaggaggatgaatttcctgctgtactggagtagccctgggcaaaggacccaaaagaactgctgtattaaggaaacctggaaactaaaaaacacaagagttttgttttttttttcccctgtcagatattggtcttttgtattccagtggtattaaatggaaatgggttttttcagaggaaaagtaatacttgagagaactccattatctatcagatttatatattttgccttagagaaatgcaacctgttcattgtgtaaaaagccgtcgtgtgtatacagatttgctcttctggaagccatcaatagccagctagggttaaacaggtttcccttcccctaaatggttttgttattatttatttattttgtgttcttttaaaatttatttttccatataatctctgtgagggcagggatcatacagctctcaaggtacacatcacagtatgcagataggcccaaaataaacaaacatctttatttttaaagttttttaattataaaaagtaatacgaggccaggcacagtggctcatacctgatacctgtaatcccagcactttgggaggctgaggcgggtggatcacctgaggtcaggagtttgagaccaatctggccaacatggtgataccccatctctatgaaaaatacaacaacaacaacaacaacaacaacaacaacaaattagccaggaatggtggtgtgtgcctgtagttccagctactcggaagggtgaggcaggagaatcacttgaacccaggagatggaagttacagtaagcagagattgcggccactgcactccagcctgggcaacagagcaagactctgtctcaaaaaaaaaattaaaaagtaatatgggattattatagtttggaaaatacagaaaaatggaagagaagtcaggtacagtttcactgtccaaaaataattaacattaacatcttggtatacttccttccagcctttttctgttagtacagagctttatgctagctatttatgattatgaatacagatatatcctaaaagatcttctcatgctgagcccaggtgttgtaggatagaaactgatggtagccaggcaaagtgtatagacataaaaactgggatgacagaatcacggggaagggtataatacctttgggttccttagctcagggctgtctcatttctgcagcaggcaatgtggttttcctcaagtggaataagattgcaaaaggaaggttggtaagctcaaaagaaatcttcacattgcccctgtgataggtagcaaaggtgatgaaacaacccaattttgctgtgttatggtattcctgttttcagaaaaattaaaaaaacacaaaaaccatttctttgaataaattcaggctttaatgtacttttttcccccagaacatttctcctaagggcttaaattattatcacatatggagaaggagacttaaatatgagaggatgtaagatccttaagcatgtacaaattttcgtggcatctatcacagtcctgaatcctgaaagactattttctgttgagttagatctttccttataaatgctttctgggatggcccatgcatctctgacagttctcatgctgagtcataccttgttctgttaaatttatccattattggacaaagactggaagaatggatatgacattgggaagtgtgcaagacttccacagatcacttgtagagagggatgatttcattgtaatcctacctcactggacacctcaaacctgccagtctcatctgtaaagtgagcatttttatcccctttccttggctctcttggctccatctacaggcaacactcaggtggacttctttactgaagagaagagcgtaatattcttctagtttgcctagctctttggcatttagaaaactagagaaatgcataaatttagcaaaggatcagggccaatgtgatggctgaactggcatcatttcacatttttcatgctctgtatttatagcaataaatttcaagtaagaaaatagattgcaaggagtatgctgtattaggaaggaagtttgtacactttcgtggcttatgggtatcttagtataaccttttctggttgagtgaactgtgtcatttcaaaagcctgaagacattgtgatgactgctgcctccataatggctacattctaggggctttgccctgaatcgcatatattaactcaaaaaacaaacagtacccagtttttattgggaaaattacagtaccagaagttatgtttctcagtcattgagaccttatgaagccttaataatatttagaagattctggttccttgtcttccttttttgagtcagcagttggtcacagttcagaaatgaattacaaattacaatttattagtaatgataatatttaagtagtaatgatgatgataaatagtaacagcttattttttaaaaagataccaagctaaatgctttcatggattatctcatttaattgtctcaacaaccttttaagtcttatatttttatcattgccgttttatagatgaagaaagtcaattttcagagaacttaaataacttctcatagatgtctagagcaaataagagacaccaggaaatattacacccaattaaacatgttttctcccacatattccgtcaattagagacttgtagagaagggtgctatttttcttttcatttttatttttttcgagacaaagtctggctctgtcacccaggctggagttcagtggtgcagtcttggctcactgcaacctctgcctcatgggctcgagccatccttgcacctcagcccccaagtagctgggactacaggcatgcaccaccacacctggataatttttgtattttttgtagacactgggttttgccatgttgcccaggctggtctcgaacttgtgaactcaaaccatctgcccgcctggcctcccaaagtgctgggattggttgctatttttcaaatgtgagaaaactcctttagaagttttagtcttcatgagtcttatgcgcttagggtgtggatttaaattagcaaattgggttgttggatttgtagttgcagcagaaaggggttgtttgtggatttttaagtaggggtgatagcataggggcctgcttttaaaagagggataagcaagcaaggaactttcagtgcttaagggcacaggtggggcagaacatcaaagacagattccatctgtgctaacatttcacctttactccactgaaaattttctaagatgtcacctttgagacacactaaagcttatttttctagacaattaacaaataaattacatttactccaaggacagtgtaatattaatctataaggatattttagattttagaaagcatgagttttgaattctagtttattatgcagtatggtctgtgagccatgaattgtcttcatctttatgtccagcagataatgtggtaaggacttcttaaagctttttgaataattgaattaatgaataaaatttataaagttttctatcatctactaaacatctgcttgtgaattttaaagaagctcattttctataacattaaaaagaggctgtaaaacatcgtttttactaacaatttcattttatacattgcagttgtccttattgataaaagagaactttgtggtttgatgcataaaagaaaatttactattcagtatagttgggactgtatcttcaggcacagacactgcattcagacctgcagacccccaccctgctcagtgtctgggttgcagcccagactgaggttgagccagaggaagaaggaggccgtgtggttaaaccacttgtggataatcgaaagtagaccatacttattttcaatttggcagctgcattagttttttactaaagtgtgcagctttgcctggttctgctaatgttgccttcacactgtggcctggtcaccattagtggtctggcagagatatctgaggaggctcaccattgctcctcttgactgttccactgcccatcccagtattttccctgacttttcctatgttctgtggtatcaggcagttggatcaattgcagtgactgcatcgaaagaaaaagacaaaaatcgggaaagtataaccccgagggcaacaataatgaaattttaaatttaaagtgacccaagtttgatgtacaggatatgaaaatgctgtggttcctccagtggtttcatatactttgattcagacccttagaagttcctggtgggcagttgacaattgagtatcagtcttgatgctccagatttgaataccatttcagttggaggcatggtgcgcctgatatagatgacgtgtgaatgtttcaatgtcaacaggagatgcgggttgtgaagatatgtgttcacatgaaacagactgcaagtctaagtctccaaggatgagctgatatatgtaaccctgttcatgatgggcctgtgtttttttcattttctgttttcctctctggcagatgatagatcatttaaatctgtactggcacatggacgtggtttcccaccccaactgaacttgagttagaagaacctcagctctgtagtgatcttattttactgttttcccaggataaaatgcccttggtaccacatactgtatgcagagtatttatgattgcttgagtacagttccttggaaaggacacaaggggtttcataaagcggtactaaaaatctgcttttctccctagcatttaccaacaaccttgcgatccgatggcttgaaataatggtcagagtgcatgttacccaacttctcctggctgctcctactctgtcacactgcacacagatcatgcccgccaccaccctacactccccgacctcacccaccagtcagacagtttaagtcctgctgacgcaccaggcgtgtgttggctcgtggttgtacttttcatgagtagcagggaagatacactccaggaaggtgggatacaaattattgaactgtgtgacttaaaagctccagtgagtttcgtcggaagtataggagtttgaaagtgctccccagtcaaacccagaactacatagggtcagccgtggttgagctaatttctgcttacacatgtgtggagggtgtcattttctgactacgcctaggcctgagtggacagccgattaaaagatgtaaattcgtggattgtatcaaggagagcgggttccatctttgtggtcaggagggggcccactcttttgttccgcaaagggtttatctggatgttccttgctggaagttgcttttccagtttggatcaaaccacttaagtggagctccagcctcagtccttgcaataaaaaaaaaaaagtcctggaaagccagaattttgctaatatcttacatagaatctcaatgatgggaattgggagtagaaggcagagagtggtgcttggctgatggaagttaaaagttgggttaataataaactacatttatatatcagttaacagcttgctaagtgcccacatattatttgagcttcatacttgcttgctgagaaagaatggctattattatcattatcatcattaccactttccattttatagataacaaaactgaggctctgagaatttaaagagattttccccaaatcattaaacggtgacttctgaatctggatatatgacaagacctctgtccccagtccccttgctttcacctctataatatatagtagctaagctcagctttctgagaacttccctgtcttatgtcatatttgacattataggagaattgaagatgttttgtaagtacatactttgtttactacctcagtagccagtataacaaatggcactgaagttttatgctttgcttgctaaaaccagcaccatttgtgaaacaggtcttggctccgagttacccttaaatgtaactcctttattataaaatcatttgcaaagagctgcagagatcaaggaatacactcttcccacttccctaatgccaggtagtactatgacaggacttcatagtaccacttcttcaacaaaataagtgtctgcagtgaaatatttgttaaaatgcacatttctcagtgaatatatttcttttaaaactgaaaaaaatagtacctaacggaaattttatcattgctttaaaatgtattttaatgaagatattaaaaaatacctttgatggattcttcaatattgtcgaactgctcaaaatgattatactgttatatgaagtctaaaatctttcatgcaacttacaagaatatttttgttgtatgcaacacagttggaaaattctagtgggaccatgtccatgcaattactgattatgtaatgctgtaaatttttgataagcatgttccaagttttcctgttctaaaaacaaaaacattaaaatcacccactgttgaagacaaaagatcattactttattaggagatattattagatatgtttagaactagttaaaaaaaaaaagtaaaagactggttaaaaaattaaattaactccaccaataaaaattcagttccttctgtagctgattaatgtaaggttctttccactgatgaccactgaatagaaaaaactaaagtaaatttcatcatcattgtagaagtgtaacttattcaagtaaatgagataagccaattttatatctatcaagctataattaaataaggatgatactatttgacttataaatgacctctgttttatatttcctgtggaaatcagctaactacaaaggaattgtttattaacttacttcactaacatgatgaacagaagtatttcaggactcatttgccccttttttatgtgactcagcgtcagattctgccctttgctcttctgaggtcagtctgacccagtcaggtaaaatgaacagcacatgaaagtttagcgcatgcggtcagcattcacgtaccttgctttggttaaataaattcttgaaatgcttgatggcttatttgccatgaacttgataattccccaaattgctgatgttaccaggtgcaaggacaaatattgatggctatgaaccttgcatggtgctgatgcactgtgatagtcatatcttgttgtaaaccatgttgtagtgacatagttccagttcatttacccattccctgtatcagagagtttgggccattgttgaacatcgctgagttcagttcatggtgctgggtagttcacatttctggaagggctgtaaggtttgcataatcgtccagtgctatcatcatatcatctttgcctggaagatgcatctgcatagcttcagtagtttttaatgtcttgggatgcccaacccagtactgtgggtttcaatttttatctgtcatcgccacaaacccctaaattaaaaaaaaaacatgaagaatattcaggtgactataaacatttcaaagaaggcctctacttcttgctctgggtaaaaggtagatgcagtctcatggtggaacatgagagttatctcagttggctcttgaaatgagaatgtttcactgtttcagctgaactgaatagtcactttagtttttaaaaacctgctcaattcaacaaaacatgattgattgctcaggtaaattaattgcctctgagacacatgtttgaaatagatatctatactctctctgatactagtgtgtagcaataacttttactgtcctattttgtttaactgtctgtgtatgtatgctctaaaaaggggattgaggctggaagcagtggcttacgcctgtaatcccagcactttgggaggccgaggcaggcagatcacttaaagtcaggagttcgagaccagtctgaccaaaatggtggaaccccgtctatactaaaactacaaaaattggctgggcgtggtggtgggtgcctgtaatcccagctacccgggaggctgaggcaggagaatcgcttgaacctgggaggcaaaggttacagtgaaccaagatcacgccattgcactccagcctgggtgacagaatgagacttcatctctaaattaattaattaattaattaataaaaaggacattgattaaacttttttttttcttttttcttttttttttttgagatggagtttcactctgtcacccaggctagagtgcagtggcgcagtcttggctcactgcaacctccgcctcctgggttcaagcgattcttctgcctcagccttctgagtagctgggactgccggcacatgccaccacaccttgctaatttttttttttttgttttgtatttttagtagagacggggtttcaccacattggtcaggctggtcttgaactcctgatctcgtgatccacccaccttggcctcccaaagtgctgggattacaggtgtgagccaccctgcctggccgattaaacttttcaatagctatatctactgtatggactctattaatgtacataattatgcccagaagagaactatatgtcattattaaatttatggttagaatagttgatctatacttttttctccttagcattcctttagctgtgcttccagagctgctcagaaacatgagttttgcttaataatccatagcagagctgaagtcaagaggggaaggacccacaggacttcagctggatctggttgggaaaagctcaagattgggaaatggaactttggtaggcacatgtcagtatgaaacatttgcctcacagccccatacatgattaacctttactttgcaggggaaaggctcacagtcttactgcagaatgagaataaacctcatttcagtggtttataaactcttaaatgtaacagaatataggcctaaaattagacattgtattcagtctgagctctgccacttaagaattctgggactttgggcaggctgcttattatccactaacctcaatttcttcagctcctaaaagggcagttgtcatacctatattatggcactgttttgaagaagaaatgaggtaatgcctaaaagtgtttaacatagtcactggcacagagaagatacttaataaatgttgatttccttcttgttcagcaaaaccttaaggcagaaagctcctaaggcatgattatatatttcattctttcagtagcatttgccaaacatttttaccatattgttgctaagtaggtaaaacagaaagacacatatctaaatatgcagagacatattttgtaatggaggtaccactctgtttttgtaaggcgttgctgattctcacttcgcttctgcatctctgaatatgttacaattgtaagagatgtttgaagctttggggatcttctaatggaaatgggggttcttcaccgaatgttcatgtaccgacttcaagaggtcaaagaatcacgaattgatatacaaagtggtgtatgttggagtatagtcgtcgcttggtatctgcaggggattcgttcccagacattcccacagatgataaaatccacggatgctcaagttcctcacagtcagtccttcatgccagtgggttctgtatccatggattcaatcaaccacgaattgaaaataccgtcatcacgtaaaacttgtaacatacattctaggaaaaagaagaaaataaaatcaccttgggaaaataatccttaaaattttactatgtagggatttattcttccaaacatatatatgtatttttgaaatcctttaaaaaataatgctgtatcacaagcacctttccctattatgtattcttctacagaatcatttcagtgggcgtatagtatttcatgttattgatggatcatttgtgaaaccaattctgtgatggtcactgagtttgtttgcaagtttttattattataattaatgtggcaattaagatctatattgctcaaacatgactgtgtacttatagatcatctttgtaaaaaagcagcattaacttgtgtttttaaaacatttttaaacaaaactaagtgataagaaattgatcaactcagccaggcgtggtggctcacgcctataatcccaacactttgggaggccgaggcgggcatatcacctgaggtcaggagttcaagaccagtctggccaatatggagaaaccccgtctctactaaaaatacaaaaagtagctgggtgtagtggcgggcacctataatcccagttactcgagaggctgaggcaggagaatcacttgaacccacagggcagaggttgcagtaagctgagatcaggtcactgatctccagcctaggtgaaaaagcgaaactcagtctcaaaaaaaaaaaaacctctaccctttattattgcttgcatactttgtaaaagaattttttccaaccactagcctcaattatttctaaactatttttaaacatttattagatatatggatttggcatatataaggagtctagttaggcttaaaactatctaaggaactaccaactatctaacatttaaataatagaacaaagaagccgggtgcggtggctcacacctgtaatcccaacactttaggaggctgaggcaggcggatcacgaggtcaggatatcgagaccctcctggctaacacggtgaaactccgtctctactaaaaatacaaaaaattagccgggcgtggtggcgggcgcctgtaatctcagctatttgggaggctgaggcaggagaatggcgtgaacgcgggaggcggagcttgcagtgagccgagatcgcgccattgccctccatcctgggtgacagagcgagactccgtctcaaaaaaaaaaaaagaaaaaaggcgggcggatcacgaggtcaaaagatcaagaccatcctggctaacatggtgaaaccctgtctctactaagcatagaaaaattagtggggcgcagtggcccacgccttagtcccagctactcaggaggctgaggcaggagaatcacttggacccgggaggcagaggttgcagtgagctgaaatcgcgccactgcactccagcctggagacagaacgagactccgtctcaaaataaataaataaataaataaataaataacgcataatagcttctatttgggggtggcaggtaaactatggcatgtcaggtcccatcggcattttccgccaatgatagggaggcatgttttatgcccctgtctttctgttgatgagaaaggagcaagtgaagaactccttgggtcttaaggaacaaggactagaaaccccacaatattagtgtttctgttttttgtaatgatctgtcacctcctgtttgttttcaaaacccatgagattttaactctgcatgtgtgtgtacatgtgtgtttcttccctgttcatattgcctccctatccatcagagaatatcttaaatgccactgggatacttgatgccatcccctccatttgtgggtttgtgggctagtccagcaacaggctttggagaagttactcgctactttattataacatacttaaactcaatagcaattcaggccttactgggtatttacctaatttattgtggcaatgcggtatttagaccactgattaagtgaagtttgtcagtatagttaaaagaaattagagacactatcattgctaaatcactttacaattcaaagaagaattgtaaacatatgaatccatttaattataatagtgccaattataagagaaattgtaacgctgggaacagtggcttttatgtaatcataataatggcatgtatttatcttggtttggcaagttaggcctttctttaatacttggctttgcctaaatagaatgtggtttgctgaaacccacaataacccccacaccctccaatttgttattgcagaaaatactgaacaataatcatgcggtatgaatgattaatgtatgcatgggttagtaagtatatttgaggtttaaaaagtgtttttatttacattcttctgttggctgaaggtataaaacaaataaatataaatccacatgttaaatattctcatccctttccatacagatacttgcagtgtgaatacaatcatagctttaattcattgtttctgtgcttttttggtttactcaacacgtgtcttttaaatatatttcaactgtagtatttgatagtaatccattttttaatttactaagtactttgaatatagcttccccaaaacatagaaataatcaatttaataatatctgaagattggcaaacttcatttataatgttgtgttcaaataatactatcagaataacagttgtttgaagagtgtatgtataaaaattacattctctatttaataagattactattattattgaggaagaggtgctatctagtggtataaacaaaattattatggaattgaaacatttctacactttggtgtcagggttttcatttatttctgtttcctgcttccagaaagataatttgcagcagtttcacactgtgtattagtagatgtggaaggaaatcctactttgctgagaaaagaaggaaggaatttaagtttaaaagggatctgacaaaaacttatttaaaaatttttattttaagaataaatagaccttccatagacacttagcatttattgtaaaagctgtattttatagagaacagtagaaatccaaatcgttgatagttttgcaagacatagccaaaaagtgaagataaatggtggattttaaaaattggcatcctgaaagagttaatatttttattagttgaaatttgatataaaattgtgggcaacccatgacatggtttggagtacttgattattcttttctcaataaataagagtggcgtacagttaatttcagcactgtaattgagcaatgcattctgggaagttaaaaagcactgtaagatgaggaaatgttttagggactaatcatgagaagaaaggagcctttcatagcccgtatgatgctgttgtcagagctaaaggcagataatgattcggtaataatggcacattgtgaatatttaagctgaaaagatttgggcaaaatgaacagacattgttggtttgttaaaactgagcgtttggtctttgggcttcaaaagcactctgaactctgtacaacatttttgttcacaaattttctctaaaacaagatacttttaaaataagttatgttaaacactatcactatatgaagttttaaagtgatctacgtgttttaagttttactgtagaaatggatagtgtgggctctttgttatggagaagtttaaaaagttttacggttttcttacacatattttaaatttagttggcagaagcaacacctttaaagaatattctcatagcaatgatgtaaaatattaaatctaagtccaagagtatccagttgcaaagaaagtcaagtaatttgcattatgtttctaaggtttccgttataccgtttagagtcttgcagttgggtttctatgtaccttgccttttctcctcattagcatattttcaacctgtttgttttcattcttgaatcatctgttacatgcagatgtattcagctctagtttcccattttggggtgaatgttaccaggagtttaaaggttgagtccttatagtctttctttaacttaggaaaagaagagaattgagccctgagagctgagaggtatagtttcaaacttactaactttaatgatgggtatttagagtcagtaccacatctggtaaaaagctagattctgttttgctaaagtataggtaaaacactgttatgctgaaataatgctttatagaactttaaaaatgtgattcaattagaatactcctttagagtaggttttaagacagaattcaaccttcatatatgtaagatatgtatatctccagtgagctctcatttattatatatatgctacagtgacataaataattccaagtctggtatttcctttataaatatacttttcatgtgcagttttatacaaagactgaaatgaaacagatttctgaggctatacaaatgttttttcttgaggaagaaatgattacttattaaaatggcttcacaatttaaaccaaaataacttttttttgtttctgctctgaaatttttttgaagggaaaaaatgttgccgaatgtttacactaacattcatttttacccatatgctttaaatctgtgtatttgtttaaccaaatattgtttatttttagaactgtttaatctttctttttaactggaattttttaacagcagttctttgaaaattaaattgaataaaatttcactatttaaagaacattttctttaggagttttaaccaagaagtaaatcatttattaccattaggtgagactactctttggccaggaaatagagaccagaagcaaaaataaaatagagcaaatgtttaccaggaaaatgtgttgtaatccaagcatattcttgtgtcatttttttaaaaaaagtagctttaatgaaaggtgtcacatgcagctatgagtagaagaacctttccctgtactttgcaaggagacaaaatatggattttgatggacctgtacaaacttacagtttttcaggtttcataaagggaattgagaatataaaatgagactacttggaaactccacaaattttaacttatttttagaatataagataaacatttcaaattatattttaaaaattttatgatcacttgttgactttctctgagattccacgattccagaattgtttttttgtaaatattttgtctgaatgtggaattctcatttgataataaacagtaattttatttagaatgatagctatcctccacctcttctctgtatttctatttattaaaatttacattttctaattggacaactctgtgaccaaaatctagatcattagggtgctaaattctattaacaaatactttgaggttttctgaggatatcaactaaaacttcatctcagaaaccttctagaaaaattaaattttgttttaaataattaaaacccatattcagaaaccagcctgtttgaaaactgacctctctatttacatattaccagagggttcttgcctaatatgaagaaaaaagcttgtgttagagttgggttttatttggaggtggggaggacttttaatgctgataagatagaattttacttattgagatacatacagtaaggtcagttagacactgtgtttaaaatagggaaattattacttagtttttaatattagtttaatatttaaaaattagttttaaaaatatatttaaaattagtttattgtcttgaacttaacttttcaatttaattttaaacaagtttacttaagtctaacttttaaaagctcaagttaatattagccaaaatatacttcttaatgcttatctcttatgctccatagaaaaaagtgtgcttttttggtgaattaagatttaaatatgtatgcatactgttgtctctcttggagagagtcatgacgcacattaatatattagagggtctgagaactttgtttaaactagcagtagccaaatttatttgtcagtggaatccttttttcatgcaacccccattaacctcccaaaacacactttgagaaattatgcccttagccttttctctgcttttgagtgaagaaacttattctgattcagtcctgttggtgtaaaaatcatcttcctgctgacccttctgtttatctgaagcccttaaaaattaataacgctctagtctccatttggtaccaagtgcctggtggtgggggactctgtctcagaagcagtgatacttgattcagttgtctcacctcctctactcatctatccagtccattgcaatttactctaagtacttcaaactgtgtccttggaagacagagttgcctggagctattccaagttggcaaagggatgttctaataaagctcttaagtggtactacttgctgatcaagagcagaggataagggtgttgaaaatgtgatgctgcaaaggtcatttcatgaggcactaaagtccatttttaaaaggtctccactcctttcaccccataattttgagtattggaaagatttactaatgaagctctttgctgtgttatccctgccaagaaacagactttaaaaatatattattttccagattcatgacataggaatctattgaacccttccaccttaagtttgctccattcctcaaaatgtgtttctatcacttatatattttgttttttgtttttttaaaaaacaaaaaaaaaagtctgtgagaaggaaattgatttgaaggttttagcctaaaacacagtaaatactcaatgtaaagccattacatgagtttttatgtccatagtacttttttttttttgagactgagtctcgctttgttgccaggctggagtgcagtggcccaatctcagctcactgcaacctctgcctcccgggttcaagtgattctcctgcctcagcctcctgagtagctgggactacaggtgcatgccaccatgcccagctaatttttgtatttttagtagagacggggtttcaccatgttggccaggatggtcttgatctcttgactttgtgatccgcctgcctcggcctcccaaagtgctggcattacagctgtgagccatcgcgcccagctcgtactttttttttttttttttttgcatgtgaaagagatggagcaactatagcaggaaattttattttgtatcaccaaaaggaagtttgcttgttcgtatctacgattgacatcttcagtacttgctgaataagcacaaatgattccttttctatcgcaatatatatgtttgcatctacctaagagattttagatttgtgagtgtatggagccctcattagtatgagagattaatttatttcagtgtttgagctgttactgagcttaaaatcttaaaaaacacacacaatacaacaccagctctgtaatctttttaccgagtagactataataattccagaagatttaacatagtttattagatgaatggcttgcaactttaagggaccataaacttatatttaaaaattatcataagtaaaacaggattctgacagtaatgcatgtaatctaattcactaatgtatcagttgtgaatactttttagatatccagtaaactaaaatgaaacagtggacatacaacaaacatgtgtaacagaagaaaacccaactttagaagaaagtagtatttgtgtaatatttaatgtggtacgatagtagtagcattacaagattagtgatcagctggggttattaaaccaaagtttgcctcatgctgtcgacgttaagcagccacttggtaaagcctgggaagtaacatgtgcctcaacagttagcacttaaagactgtgttttaacgagtctccagatatgtatttacatgatagaccatactaacaccttttagtgttatctgtcaatcaagatttcataatattcctttacaaaatgtatctgctgtccacatccattatcctactctacttactttgtatttttatgtatttattaggaattcatagtcacctgacctcttggcagccatccctaaacttcacattaaccctgcttctcagggattgcaggggtcattttaacccccatgaacctgaaaggtccaaataattcagtccaaagatggttgaaaagggatctgcaaagtctcctcccacaaagaaatgctttatttcatgcatttggcaaccaacccctcccatctttttatttttatttttatttttggtaaagggattttacatcagacagatattattaaaaaattttatttaacactcagacacattttattctaaaacgaatgcttgctcaagagtctaagaaggcttcatgggaagagcaaagcaatctaagccatatgtattgggcaggttgccagttgtttgccaatatgcccaagccacctggctgtgcattcagccaagtatgccattccgaccagccagctttaacctcccggctgcttttcagcacttaggaaactccaaaggcctgggagctgcacttcatttctcccatgccaatagttttcacttatacaaactgcacagctacactgaccggtaactctcaaacgcccattttgaatgagctctccttttgtttaaagcaccattcactggtgttgaaccagtgccataagatgagtctggagatagcagactgaaacctttacccatatgccatagacagacactttgactgacaagcagcatttttttcccaagcctgtagcgacagggttttgtgattctggtttgctgagatttggattggctttatttgccgctggtttcaattttattttgggtggttctaacttttaaatgtttggaaacgtttgttcatttgattttccctttttgtttagtttagaaattggttgagctgtttcataatttatcaagcttgatttcataatctttggcaatctaggtcaggaatcatgcagaacaggcacgatttgatgatgggatcttgaagactgattcgttctttttaaaagtcacgatagagaaagctttactcctgaaaggcggtattctttctttcatcagggcgtaaaaattatataatgccttgtttccctttttgccttggctcccaagaaactcagagataagtttaattcttaaccttggtgaatatttcagcctaagtttttgcccccactacttctctaacccctgcagtttttgttcatgtttttcttcttttatggacttaaatgtgtatgtgtgctaatttactatatgtttatgaaccatctcaaattatttttggaaggtagatgaagtaaccagtaagtaaataaaacttcagattagaaactttagtctattcctaattaaaatctttaagtggccttgtctggtatcataagcaggtgtttcagattcattatctcaggttttaaatgaggaaagctgtgaatatttaagcctagaagtttcattattataaatttttgtgctagcctttggactgaccaatttattattttctatcactattgtggtctgtacattctcaagttgatgccatttccctcttcccggctcaatgaccactatctctcagatcttgaagatctgttttggcttggttccaatttaatcagtctgaatggatcctattgagtaacttgactcattcaccctgctaaagagagtctgaatacactatttctgaaggtttttttaaacctattataatgttcttttttattagaattgtcagtcatttcaggaaaaacatgtgatctgtatgtaagtgtgttttgagagtccatttttcatcccattaataagacccattcgaattgtagcattttggccaaagtcctgtgacacactcaacaaagccgtgagcaaggtggagttgcaccagctcacaagatggatagacagagctgggggaagtgtcccagcgggtttttgcagtctgtcagaggagctgcagctgtaaccacccatctgtgcatccttggcttggactgggcttcagtattgaacacttaccctgaagaaagatgttcaaagaaatggatggtgtggctcaaataataatggccaaaatgtgacagggttaatgttggaagagaaaaactattatgttccagaaactatgagatttagctttttggcatttctaaaattttaaaatttctgcagtattcaattcattcattcattttgtttttttctggacctggtagaaatactgggctttctgtattttttaaaaaaaatgtgtacatgaaggttttcggtgtaatgttaaatccaaaagaatcctgaagatcatattagtagtattttccctgatttatgtttatatcttatgatttaagctttcttcgttaggcagccacattgtatgtctttgctctctaatgtttattatctcctcatttattctgagatataaatttttcttttgaaaacatttgagtgcaacaataagctcaataatcctgaacaaagaaaagactattaattatttgtgcctttaaaggttaattatttcaaccttaaaagaatcttataagaacccattaataaaaaagaatgcaaatatattgcccaaaaaaatacacaaattattgtctttcatataggggaggaaataaatatgtttcatctgaattgtctgaagtaagtcatgaatggagtcagggtaaaagaaaaaaaaaaagcaacgtaattttttcctttattggaaccaaatttcttaattcctctgtacaaatcaacttgaccattttattgaactaaaaagcataaaatataagatcacgttaaagatattcttagaaagataaattactatgtcatttttctcaatataacccgcaaattactcagtcatatattctgaaaataaatatcttttgtatttatgcttgaaattttgtgatatatttatagtgcagtgaatttttcatcccatctctcaaatattttctcatgtacataggcctccaaaacatcattgttgctctaggtaagatcttaggaaatgttttattaaaatttcttgtatttgattttgtttgataagctcaaacaaaaatggaatgtgaaactagatgtcatctcaaagagaaatcaatattggttcatttattgaatgcctactatgctaggtgctataagaatcccatccttgctctgtgatcaaagtctgattgaatcaggagctgtgtgtctttccttcctccccaacatgcatttattgccttttcattcaaattttaaatattttaaatgttgacttttctacaaaaatctgggatacaggtgtgaaaaccttactaaaaatcatgtggaacaaaaagaatttgatacaatttagcattgattccaaattttttaaaaccagtaacaaaggagaatagtatccttaacaggataaaattatctatgtcatgtcaacagaaggaatcatactgaattgtgaaatattggaatcatctcccctaagatcaggaagaaaacaaagatggctgctatcaccattattatttaatgttcttctagaagttttggacaatgtcatattatatgacttagaaataagaattataactatctgaaaggaagaaatgaaattatcactatttggaaatgatagaattatctacctagacaaaaggtttaattaaaaaacatttggaattaataagaaaatttagcagaagatctagttaaaagataaacatcccaaagccaaaaattgtgttatataatcatctccaataagaagctgtgacagaaaaaagatctcattcaggagagcaataaaaaacagaatatctagaaataaccttaaaataatttgacagtaatttgatggaaagacctactgtgaagtgggtgttctgaattatgagagttatatgaataggaaggaatggcatctaatggtatcaccccttaaatatttctgtcaaatcataacctagaagttatctcttactcttctttcatgtttcatatctaatcatccactaagttccccgagtccaccttttcattagcatgcaaattaattcctatcctaccctatgtttccttcaattttagacctttattatttctaacctagactttgtaacctctttactcccagtctttcccaatcatctatcccttcattacactactgccagagtgatctttctgaaataacaactattgctcctttgttaacataccttcattgactccctctcaccagctgtataaagtccactctcctcacccgcatcccgtttttcacacttgggcacaccctgctccagctctgtgttctagctgggttgccatgcttacagtttaccaaggtgctgtgctttaccagtgcctcagtactgcagtgtcagtgcagggccattgcgtcttctggtttctctacaggacactctccatctaaatggcttcacagtgtggaaaactccagctcttctttacattcagtttaggcattggatcacttggaaaaccattccacacactttcttgcagttagggacttaccttccctgtttcctgagaagctttgtatacttctgccacagtacttatcacattatactgtagctactagtgacccccactagagtgtaaagctcgttgcatctctagcatgtagctcagtggctggctctttgttatttgttgaaatgtatatttttaacaaatttgatactcatgaagttctgtgtttctgagataattttatagttacacagctgttttctgggacagttactttaaaatttcctggttttttcttttgcatattggaactaagcaatgactggatataaagtatcactatacacatatttgatgtcaccactaaagtttgaccaatgtttaatggtttttcaggaataaaaataaagtcctatgaattaggatataaattgtgtttatgttgccactgcttaccatttctttgttagatgttatgcctagattaatgtcattagcttatatgctgaaaatgtaatcacataatgtttttaaaatagtaaatgacacaattattatatatatgtaaaattcagatccattcaaaaaatatccatgttcttttatatgcttaggactcaacttggtgctattgtatttagctattgtaaaatagctcagcctttaagaagtttgtatataaggtaagacctgcttatataacagccaatttaagattaaaaatagcagtctaagctgagtatagtggcacatgcctatagtcccagctactcaggaggctaaggcaggaggattgcttgagctaagagtttaaggctacagtgagctgtgattgtaactgagaatagccactgtactccagcctgggtaacacagagagaccatgcctcagtgtaaaaaacaaacaaacaaacaacaacaacaaaaaaaaacaaaacaagaaataatacaacagtattgcattctgagagggcctatatcatctattttatagataaggaaactgactttcaaagaaattctgtgactactatcattacccagctgttagtgacgggtttgaggctggaaccttagttttcagtttcttgattgagggctcaaaacagaactcaatatgcaaaaaagaaatgtaatgcattgggaaagtataaagcaagtccacaaagattaaacagaacagaacagtgattctggatttttctaatagtttttcccttaatttacttctacgtttgtagaagtaaatattgagtaggttatatctgaataataaagcatggcattgggtagcccttcagttttataggcattccacaaccactaattatgaataatccaagtttacaaatattcctctgagtgattgggctagactcattttaactaaaagggaaaattaagccatatatattatatatgtacatatttatgtaaagcatagtatagcaatattacataaaagttttattgccatgagtttgagatgacatgttataagtggtaaagccacaagtgaattatgcaggtcatctcaactaaatgccaaaaatgtttttactgtaccacatcatccagtattctgcctatgctacaaatttaaagagaaccaattttagaaatttccagagttgtaaaagtttttattggcactatatttcaaacttgctggcctgtaaatattagttccattaattgtggcaaaaattaatgcacagagatttttttaaaaaacacttgtgacaggagttttttttaaaaaacatcttcctttccagtttagtttagtttttcctgctctaagtataaacactttctactttcttccctttttatgtaagtttttttcttttttgaaacccatctcaagctccatctccaagaaactctctgtgggtacttacgtcaccccaagtttatttttctgaactcttgctttttcactcattgctcataaattcatttggcaagaatttttcgttgggttttaaccactcttttagttctggtttgttctatttttttctcagaattgtaattgagtgtatattgtctttgctaaataaattctaagctcctagagtgtgtatttagtgcctttatattgtctctggactctggagcactgctttttaaaaaaatgttctttcttttttccccctccctccttgcctttcacagacattgattcagtacctactatattcttgtctaagctatgcattggattttgtagatgaaaggcagcctagaaaaaatcttatacagaaattattctcaaactattgtgtgcacaaaaatcacttggaaagaattgttaagcaagtattttcccaagccttaaatgcagagattctgaactagaggccaaagatcatgctactgaataccaggtgattcagatgcagggagcccacagaccatactgagaaactcagttcataggtgacgggagaaagttccgtaagttgaccgtcacgatgctaagctatttaaaaaggcctgtggtagcaacatgctgcaggtatttgaggagcccagtgaaggggaacctactgaaactggggaagtcagaagagtctcgtcatagttggtgcttactacttgtgctgtgaatagaagaatgaatatttgaatttataattggaggaggtggttgaaatcctggggccttatgaccttgaacaaattccttaatttctctgagcccgagttcctttatctgtaaaattgggatgatagtaaccacctcaaagaggatttgtgagatgaaattaatagacataagtaaaaaacctagcacagtgccgacgcagaggtgctcaatcaataattacactttcccttctgtgccagcagcctcctggagatagctgtggtctctccttgggagggtgtttggccatgggtcagtgtatccacaaagctacaaaattggtttccattacattagtttcaatagttgcttggcataatttatgattttctactgagaatctataggtagatctacagagagctgtgaagagatccttgacctcttaactgtttcttgttttaaatcatctggtcagaaggggaagtgagagaatggctctcctttccacacaaagacctaatgtagaaagtggctcctggctgggcgcggtggctcacacttgtaatcccagcactttgggaggccgaggcgggcggatcacctgaggtcgggagtttgcgaccagcctgacccacatggagaaaccccatctctactaaaaatacaaaattagcctggagtgttggcacatgcctgtaatcccagctactcaggaggctgaggcaggagaatcgcttgaacccgggaggcggaggttgcggtgaaccgagatcgtgccattgcgccccagcctgggcaacaagagtgaaacgccatctcaaaaaaaaaaaaaaaaaaaaaagtggctcctgagaccacagacccagctttgtggttttgaatgcttgatgctgataatccttgcgttatgcgggtatacgtctgcctcctctgttccgattgccaactcttctgtgagctctgaaagtttgttctcttgtttctacccacctaccatattactttgcccttactaatcccttcataaatactagcatataaaagaaagtagtccctcagagaggcccctaatggttagctctagtcccagcaagagatgcagtatttaactactttaggcaaaaaaaaggttgtgcttttcgtgttaccataaaactgtcaatattccctcctttctagctgtgctgctttaatggtctgagagcggatgacttacaagttactcaagaagactgagtatgtattttgactgcctgcacttcctgaataggctttttaaattaaaaatacagtttatgttgttttactttttttgttgttgtttttaagtggctacatctgcattgtttcctaaaaacacaatagctgcgattggccataccagttggcatctgtctgtggttcccctggcttcttattttagttcctccctcttcctggtaggtcctgtcttgatcctagtcaagcctttataccccttttaagacttttttcttaagaaagaagctattcccacaaaaataagttgccacttgcagtgaaaggcataatggacaggaggaccagtgtttgttgagtgaataaaggaatgaaactactacatcacaggcaatttttaaaaatgaacaaaggggctgggcgcggtggctcatgcctatgatcccagcactttgggaggccgaggcgtgtggatcatgaggtcaggagatcgagaccatcctgtctaacacggtgaaaccccgtctctactaaaaatacaaaaaaattagccaggtgtggtgggtggtgcctgtagtcccagctactcgggaggctgaggcaggagaatggcgtgaacccgggaggcggaggttgcagtgagccgagatggcgccactgcactccagcctgggcaacagagcgagactccatctcaaaataaataaataaataaataaataaataaataaataaataaaaataaaaaataaaaaaaaatgaacaaaggttgggtttggtggcccatgcctgtaatcccaacactttggaaggctgaagtgggagaatcacttgagcccaggagtttgagaccagcctgggcaacatagtgagaccccatctctttaaaaaaaaaaaaaagctgggtgtggtgatgcacacctgtggtcctagctacttgggaggctgaggtgggaggatcgcttgaacctgggaagttgaagctgcagtgagctgtgatagtgccactgcactccatcctgggtgacagagtaagatcctgtctcaaaaaaaaaaaaaagaaaaagaaaaagaaagagacaaaaggtttttcagcttcatttgtaagaaaaaagactgagttggctcccccactcaactgaagattgtcttgctattatagagacacatagttgttttaggttagtgcctgacaatgtggatgacagatcagtggggaatgatatgttatttacatggttctgaacttcacttccctcctcttatccctactttggggctgatcttatgttctactgctgattcagaacacgttaaaaacagcctgaaatgggcaattcatctgcatccaattcaaggtatacttattgttttggagaaaagtccatcttaaaaaaaaaaaaaaggtggaaagagagggcagagagaagccaatttctctaggtcagtatcaacatgggaacagccatcctatttagagctgacaaacccagtagccatctgagagagttctttagctaaataggtgtgaagcaggggctgtatcttgagggtacttgtagttagggtccccaaacatatggcacaagctatctttgaacaaaataacagacggcagtgtttgctctgtgcttttaaggcaggtgttttatataatttttacgttatttatttgatatgatttctcaccaatgtacttcatcacatctaaaccccaaatcatgacccttacctacaaaaatactacacagagaaagagaaaatgccgaagttgtagggctaacaaacaccttccaagccacactttggcctaatagtattacttggatatgtttttaacaggtactaaacaggattttttttttttcaagaaaggacttctttcttgtttgtgatcattttgttatttttgcaacttctttcttttccttattgtctaaaatggctcagtgtattcatcagtggtattaacgtgtgaaggacataaccaaggacttagtccataggcagatatggtccatttctctaatcatttcctgcccaaagagctatggcaatcactcttttgcttgtcaccagtgagaatatcttaagaaaattaaattttctaagaagaaaacagaacaacctctttgaagccatagccaatgactctttcatacttttattccagaggctgaggtgtttcataattgttgaatgaattaattaatacatatctagaacccttcttctcaagtccagtctaatataagctcctgaagggtggggactttttgtctcttgttcactgctctattcctagcaccttgatcactgcatggcacataggagatgtgcctcacctctccaccaccatgttgaatgaataaatgatcaaagcatttcttaaccctaaaatagttggtgatatagttatctctcatttgcattattgagaacatcaaacttacatagccatgtcgcaagtcaaagcactctcccaactcagaaaaatatgcacttattattattttaattttgtatttccataggttattggggaataggtggtgtttggttacatgagtaagttctttagtggtgatttgtaattctgttaaacagaaggtaatatgagaagctcatctttgttggatgacattagcaacagaagaattagtttgacaattgactgataaatctctggcagagaaaatattgtgcttatgtatattaaaactgaaattcagaaaacaaatagtgttttcatcattggcagaataggtaaaagcaagtaaacaaacaaataaaacccattgtgggtgttctttaatcaacagaatcaacaggagataagcccttttgtttcttcattagttattccatgcaagtttttttcctctcccatcattgttttcaaatatggatttcaagatgcactattttgtgagtttactacattcttgttttcattcttgtgcctgctgtaggaccttgatttacccttaccactttgctgtgcctcagctttcccagatataaaattggcatcacagtactcatctacctagtaagggagtggggaatatgagacttaattagggaacagctgtaaaacctcttgagatagttctgtgagtcagaatggaagtgcatcattattaatcattattattattgttagtattttcaaatggctcaaagccgtctctaaatttaatagtaaaatgagtgcatctaataattctttgtatgtacatgctctgtggtcatgcatttcacaaattaaatggcagaatacttgtaggatatgattataatgatccaagtaaatgatcctcaaccaattcaagattatgtgattaagaccccaaggagctaaagcaagcagtttgctttgttaccttttagcttctcgaataacccattttgtgttaatttatgtgaaagggaagaagttagctctttaaaaattaacttagagttttctgtgtcattagtttggaatttgggagtaagtgggttactccttaatttccaaataaatctatctgtaacaccttgtccataatctacatttaaatggtttcgaatatgattggcctagcttcctagcagttgttgagtcgagcataatttatgaactttcagagtcatatgcggtatcttcagacatcatcggaaaagaaaattatatgttttagttttgcagttgttcccttgtctcctgtacccttctgtcaagaaactgcatttgtctctgaggttatgttgcaagtcaatggagaattgccttccaccgtacactgcttggtttcagcttgaattatctcagacagacatcctggctagctgcaatgcaagctcacagggctcaagcctgagaagacctaagtttggcagcgcactaagttgaggatgagaaaagaaaaaagaaattctgtcttttctggtgcttttccctcttggtttctccactaaaaatcaatagcgtggtcgatagttggttttgagttgtcccctacatgctggagtttttctgatgtaaacctttggtgtctgggcttcagacattataatgtgtcagggaaagtttgatagctgtcacagctctcctgggttacattttattcccacgatagcctttgtaatttgagaagggaagaatagatcaatttttataccatttagttgttgggggaatttcttttccataaattgatttttctttgaaaaatttacaatatttattttccttcttcacagcaaaagcaaataaaatgaaatattttcattaatgaatattttaaaataaaagcaatcccaatcttgctgtaagttgttaagactcagttatatcctgttcaggatttctcacgttccttttgcataacttggaatgacacttttaattttaaatgtatccatttgggaaaacctggtgtcttttcttagtagtactctagaatggcaatatcacgaagaataaagtggcacaacaacagctctaatgcttgcgtggttttaatgcagattttggtttctttgaaactaaatgattacttttatggataccaaataattatggataatgaataattattataagtgatgtctgttaaaaagtgtttatttttattttgagtcttttctatgaaatctcgttatcgggactatcagataacattaaatcattaattttctcttctgaaaatatttttagttgcttatctatctttcattctaatatgtattcttcttcaacataataactcttattagaattatccttgaaaaactttggggtaacttctagcatgttctatgaatataaggtgataaaattgtgtttgtaaggtggcttaaagtttcaaaagatagctttctgagtgaaataatgtttgtataaaattgtgttgaaacagcatcttatagaggagcaaatgctatgtctttaaacacttaatatattattcgaaataattgtcaaatatttgaacaataatatttaagaaggaacactagaattgggtgtcttttcatcagatagtgttagatatcaactatgctgtattaattgaaaggatttggtataatctcataaagaaacaggcaaattctggggtttcctctctagtgaaaatatatcattcatgtctttcattactgtgctataattatggtaagtgaagcagaacgagatcgatagagcaatttatcaatgcattccaaactattctagcatggtttacgtcatatctctgcagatactgtcattcaataaagagacatctaatagtataaagacttcagatggatccatttcagcataatgtctttctacgtgatgttctaatttcgatcatggtttaactaattgtttcactctgtatagtattaagtgaagtaaaatgttttctttgttgaatttcaatagaaattttaaaattcagctttcaagtgtaaaaagcactgcagtagtggaaacattgttattaatggatggctttagccttctttttcagtgccattgtaagttatatcaccattgaaactagaatacaagtcaggtatccatcatgcccccaaaagcattaaaattcaaataacaaaaataacagtcattatttaatgactgtaaatttttgtcttttaacatcacaagattcaaaattctttaggctttatcaccgtatttatgatttaactataagagtaggttcacaggctagctcatttagacttttttttccacaaaccgtacacaatggggtcttttttttaatcgtaaatattccccccatactgacatgatattaaatattgataatattgaagagaagatactgaagtatacatgaaagtgttatttatttcagtatggacaaaaaatattttcaaattactagattgtaattttcttttttcatatgttataaaattatcacccactgtcattttggttaattcagttttctacaaaactatataggtctggtaatgatgccagagtcacaccagtgcaaaattgtcatttgtatttcaggtttgtagacatcgagaaatattttcaaggacagaacttattttttattgagttagaaatgttgaaacgtaagggaaaagagtgaagttgaatatgaccactttgtcagaaaactgtatacgtaactcttgattttggaaaaatcagcacctgcaaattttgtcttttggggtttgtttttttttttttagtccagttcataagattacatgtttttggtttataatttctttacctaaggagagttttgtgctgcatgactccttaagagagtttccatgagctcataaaacatgaagtgggacagtctgaaatattgtgatcgttttctagaattatacctgatggaatgtgatgacagcacctctcccttctattttatatgttgaatttgaaagtgcttgggaatgtgttgatgtcaatcgtggctgtgtttttggccatctttctttccttataccttccactttcctactaactggtgcccctctgacattgtttcttaagagcttgtctgttaaagggttaaagaattagatttttaagctgctttcgtgcaatgtatttaagttaaggaaattgggatatcattacctcagtgaggatgttgtaaattgttttgttggcaagatttattgggggttattttacctgatatcacattgtattgtttaatgtggactatttttaactagcgttctatttaaacagtgtcagtgaattctgagagcttgccaaacaaattctcaaaatggttgccaagctgtaagatggctgccaaggtctgagcacattgaacaggttcaaaatggtgaccaacttctcagaatctgttggtcagattcccccactgccaaccccctccccccacacaactaccacccaaaaaggaaggaaaaaaaccacaaacccgaagatgcaagacttggcaccatctccttggcacgagtggctgtagtgtcatccagagattcaagtagtcaccacgtactacttgtttcacatgcttggcagaagactattcaggggaatacatgaggtgaaaaaccactgtaaaataacatggtcattttctttaccttatctaatatgcacaaaataattctttagaaaggggaaaagcctagacaaggcaatactttcaaagagctttctaaatgagatcgaagagcgttaactaagacttcgggctgtgcctttttgtactgcttgcctgaagtggcacaaactttatatacaacaggtttaagatttattttagttttgcatttgtttacttaagtttatagcaattgctttctggcagttgtggtacttagcagattgaaataaaatcataagggtgaattaaaacatactgctgttagtgctgattagaattttagcttagtgtaaataccggatgcagggtccaacttttcagacacttggcatgagctcaatagggatctccaggctacacaggagacagtgtgtgtgcttggatgcttttaaaattcttggataggtggagcatactacttctgctggcatgttggttcattgtgctggctgcataatgtgcttggattccaaggtagatagaagaagctgaggaaatggtaataagggaagatagtttgaacttaaaaaacaaagcctggaaaaaagaattttatttgaaccctctgcagtttgtactctgtgatatggttaattatataaataaccagtactaaactaagttgaaaatggcaggatttgtggtagtttgaagaatgacctagaagtgaatttgtttccacaagttgttgaaatttttctgtgtgatcctttaaaaaatagacagataaattaacttctccaggcagttagtttagtcagtgaattccttaaatagatcttctgtttaatatcagcaatggactaggttttatattctgattgagacctgcattcctaaagatagtttttaggtgataaaacattttatttaatgcttaagtagctgttaaaaaaggctggttgtcatgaaggtactggcgttttgtttttatctcaattggtagtggaatcagctagggataatactatagagcgatatagtttatatagcttgagttttgaaaaatctatagctttaggatttgttcagtcatggagcccttaggtggtgtgtacattttgtatattctctatcacaaggggtagtcaagaaatgtgacttttcggtcctttttttaatgattttctcctgccatttaggcaacaatgttagtagccatcaaagcttctcgtatgtttatttctagtcttttctcacctagtaagcaattgtcaaccaaggcccaatcattcaataggtaaaaccaaatgttattgacagagctgaaatctgaactctgtatccttcagcgtagaagatcaatgttcattaagatgcttcagttctggaaatttcaacataaagctatggaggcatttagaggttagcagggcaaatgtgtgatatgcaaggtgtgtagcagatcccttcttacatatttccagagtatatttgtaatgttacatgttacaaatgtaaaatagtttaattaaaagtctttcttgccaattcttacatattgtactgtaagttagtgacaaggaactcaaataaaacctttctttttaaattagaaaaccaagagtccacacctcattacagtaaatcatagtgcattttaaatcttcagattaagaatgtgtaatactgattattacttgtcaattttgttgttttttttctattacatattcattgatgatttattcagatgactaacgttgttgtagctgaggcaaaaattaaatcattttaaaatatgtcatttttacttattcgtaacaagttatgagtatgtaagcaagtagaattttttcaaattgcctgaagcatgacaaaattctagatttatagtataaaatgccaatcaggcagtgtttacgtaggtagaataaggcatatttttgcaaattcccacatcaccattcttgcttatatgaaaaagcatagtactttttagtattttgagagaaactttattcattttgctgttgtagacacagtccgtgttttaaattagtgaactgcagaaatcttttctttaggaaattttttctattagtccttccaaagtgagtattttactttaaaagagttgtttgtgttttaaatttatgtggtggtatatttagcattttacccttttctacgtagcatacacgtgtaattagtacatggggtgtatgtgtatgctggtgtctacccaagtatgtattgaaatataaaatttactttctatatagtagctttctgcatagggcaacccaaacagctgttattcctttttatagcttctttaatctatgtgccaacaagtcagtttacaaaatctgttttgttgatgactgctgcgataataattgtggtgttttgtggcttggcaaaaggctggggtctcctctgaggactcttgccaaaggctttgaaggggttgaggtggattcactgccaaaatgagtcaccactctctattttatttagtgtccttctgccaaggccttagacactgtctgttttcattcttttgtaggctttcctccccacattgtggttttcttcacagccagaggcctgggtctgccaggataggtgagagaggctgtgtgtagggaaactgaagggctaggggtttagctgttgtataccttgaatgtatatgtgagttaaattatatggttataagttacaaatgatggacttaaataatctagtaccttgtggtcacctgggtttgggtcagacattctcagaagagtattatttacttttaagtaggattcaaataatgtgacagtgttttcataattggtattgattatttaaaaaccctagattatttgtgagttctggctagaggcctaaatcttgaatttttcctcaaacaaaagagtatcatcctcctccttttaaatggcataataatttacttcacataaatgcgttttctacgtacacacctaatagacttcagggaattatgctaaaattttatttctacctgtctagatttaaattgtcaaccattaagtagactgagcaatatgaattgctggtctgttccctgagatatatttgagatttaaacatttttttcttcattaaatactttcagtagattgaaataaatggaactaaatgtcctcttgctaggtttgtccaactcaaacatgtattatgtatagaaaaatggctgggatgaatttgagtcttcaaaatataagcagaaatggcatttcatgcattagtatgaggaggacatacttgggtttttgctaactttcaacctataaaatttagatgggtttttcttaactaaaagctatgacaccatcctgaaatcttgtagattatgtatgcagaattaaattgaggggcatggtttttgttttgtaagtattcattcattgtgttaactctttaaacatcgtatacacaggaaaacttcattataacatcccctgaaaacatttccataaatataaagtaaattttcaaagttcaaagtcctaactataggcaacaaaatgttttccatatattatggtcgaagcttttgttcttcaggggaaaaaatgttataaaaatgattttaacactttgttcacaaaataaattctattaataattgattattatttttcataaatctttcagttagaaaacataattacgtaggtaaagagtgagataatattaggataaatactgatctcattatattctacaaaggtcagtggttagtatccactaagttaatatatgaaagtcctttgtaaactgttaaatatatagatatcaagacatttaggtttttatttttgttttttttaaaactttggattatcacattctcctctctgtgtatctacttcatggttttcatttaaaatagcaaaaataagaaaatagaaacagttactaaaaacttgtagtcattctgtgatataaattcatttggaatttaaatacttagagctcacggcaagagtccaagacagaaattcttttggatgatctataaaccactcaatccctggttaatgctcaaaccatgtgaaaagttccaggtgaaattcactatgagccttgtctgaaccccataaactgagggaagtcctataaaccctatatgaaccccaaagaatcaaaataactaaatccggcacataattaaaaaccactattttctagtggctgctttatgtgtccacagtttgaagacaagctttgcatatggaagtgaactattttatttcgaagatatgaatcataagctacttagtatttaaatatagttatcctgttgtgaagatctaataataatgctgtttaaaaagaggaactggaactcctttacaagtattaccatttccaggatctctcggaaagttgccaagacataaatatagttgtagtaatgattgttgttttaggagtggaattaacagtagatatgttcatcaacgttattttgaaaaagtaacgttatcttggatttgtactaacctttatgccgtatacttaaaatgcaactcttgataatcatttactatgacagtgtgggttgatagaagctaggtattatggttctctttaggcagaaagagaaacagaacccctgcatgacttcagatgcagtatattaatcttttgggggcatcagtttcctcttctgaaaaatgaagggattagactaaaacaatgtctcagattccttccaactcttaaaaaaaaaatctggaagcaactatctttgcgttattgtccataatatccccttcaaaggtgggatgactgatttatggaggacacattgtaaatcactaggctaatatctcttattaattattgcaatcagaagtataatcattgttaacgtgtaccgagtacttactcctagacatcacctgctgggctcctgatgtgaaattggctcactggttcgtctgtagttctttattagtagccttagtatcttagcatattagtgattttattaagttgactaagcattgtatgactttttacaggccagtgtcttggatgctcaagaatcctgaactcattccctttacctgtaaatgttgaccgtgaaccaaaatgagctctgtcagtctcttaaccattttacttttttgaccgtttgtctcatgataagttttgtaagcattaagtaattttcatacatcatctgtttttgcattcattcttccagccatctgccatgtacttggcttttgggcactgggaagagctagatggggtagaaatgcatcttctcttaaaaggagcttacaactcccaaagttacaactctatcacaaaaagagtgtcaagacacaacccaagttcatcacctgaatgccattgataaggatttccagatggacaaaacattaagctgacaccaagtgaaacgtgtacttcacagactttcatgtttcatttcgtgatatgcagtggcactctgaagaactgggctttcagaatgtatgtgtttggtccggttcttcgtatagggagcagtatctttggaacagtcacagcatacaccacaccacactaggttctatctgtggcagggtcagctcattaaagctactttctgggtcctcgttaatgtcatgcaggccttgtgacaggtgttacagctccccacctggcacggtccattgggggtgtgctgtaattgctcttgatgccacacttaatgggtgggggaagaaagtagcattatgtgtgaggggaggtgagagggatgccctcgggccgttgctgacatctggtcaccactcctgttttgctggcttgtctgtttggtgcctacaaatattgggcctttgagttgagtttgctgccaccattgggttccttgcagccatcattatttcacagctgggccatggttttaacttggaaaaagggcattcatctcagggccagaaatggtctactgccaacatgatcctgagaactttcttagtttaataaatgagagaataagtattctcatgagctcctgtatcaagtgtttcctggttttgagcttttttgttttttggtgagaatgttatctttcattgttatttctgaacccttaaaggactaaatttccttttcaagagtttcaagtagttcttgtacatgtgtgcggtgataagcaaacattagtctgagaaagttctgaaaaatctaattgagccagcatttaccaagcccttctatgtcagctactgaactaggtgcagggaaaaaaataaaggtcctcaactagctcaccctcaactagctgtccctccagctagagaaccaaacctctgcataattaaccataataatgggcagatagattcaagggagaatgcagtaaaatatgtaatatcatgagtgcagtttttatctgtgtgcacaattacgcaagccttttaactaaaaggcttcggtgagatggatttcgtaaaaatgcacagaacttcctgaagcacaaattagacagttccctaatattaaaacacagccctgagaggtagggtttcaggctttctggaacccccaaacttgaattggtccacagaactaaattagaagtaacaacctttccttatgatgtgtgatttctcaaatggtggcatcttcccagagctgtgtgttcttttgtttggagcacagctgcttcctattgttaagttgcaccggagagctctgagacaattaatgaaggggatttaaatgttatttaaaggtaatcccaaaacgtttctttgtgaaagatgccccttactgcagtcccaacttaaataccaacttaaataagaaacttccactctaggcatgctcaataaatattcagtgaccatttctggtttctggggcataactaaaactaaataactaaaaaattgccaattaaatcttccccagccccaattccacataacgcctatgcacaaccacttctgaatgctcatggagaaatagcattaaggctctgatctgacctcagtaattttacaaatgtaaaggtagcatctcatggtccctgtagggatatattattagaagaacatgcatacaattttgttttaattgattctcactcttaagtatgcaaccaatctgtgtatatctccttttaattatttatctgagttgtgagagaaaagtaggtaattatttggtgatccattcaaatgtcttgaaaggaaggcatccaacttttatgacatacatcctgaaagacataaaacaatacatttttattttataatttcatcagtatcaagtgtagtgtaaactattttaaaacaatttataaaaggtgcttacatacttactgattgaaaaaatggccacaagaattaagtttatggaattgaaaaaatttagaccacaacaacatggtaaacattgatttttttcagaaggaaataatttctacaaatcaaaaactttactaaccagatgttatagttaggacaaacaatgaaataatcttactgtaagaaaaataattcagccaacacgttttttaagtgtcttctttacgcttaacatgggtatttgctattagatgggggaggtggaaggaatgtatcaaaaatgaataatggccagatgcggtggctcacgcctataatccaagcactttcagaggccaaggcaggtggatcccagcactttcggaggccgaggcgggtagatcacttgaggtcaggagtttgacactagcctggcctcaaactctggtgaaaccccatctctactaaaaatacaaaaattagctgggcgcggtggcagtcgccggtagtcccagttgctcaggaggctgaggcacaagaattgcttgaacccgggaggcggaggttgcagtgagccagtgagccaagatcatgccacagcattccagcctaggcaacagagtgagacttgatctcaaaaaaaagaaaaaaagaataatattcgttaccatgttcctgctgacagtttgagtacacaagatacactgtgacatagtgaattcaaggaagcaaacatggtatgggttggaataatcatggatggatacttactgcaagaggcagaaaaacacatgcagttccttttctaggaaaatattggtaaattatgcttggttagtaaaagtgcacagaaagcatatggaagtttcaaatctattttccataaatttttccccaaagtatttctgagatgctgggtgcaaggtacggttcattgtcctagtcctctatgctgaaaatgatcattttaattggattgcttctttggaaacaagacaaagcgtacattgctaaaagcttctggaggccattttcaatatttgtaataatataagtgctagaaatgtgctttcatttatattcaaaggcaataatgccttctgtaagcatggcgtctctgtaagacttttataatgtctacttaaatgcaagcagacaaaattagttttcactttagattggaagacctttctccattgcaactttttggcctctctttttgttctgctccccaagagcaatgtaaatgttgctctttgttttgctaaaagaggaatgtttatttttacaagtaccatgccacttccatatgatctacatggtatgtgtcatgaatataatttctgtatgattggccaaatttttcacttttaattaagatgaccagacaaaaatttgaattgtaagaaaattatgggccaatttagtgcctgttgaaatgtacactggatattgaaatgttctacagagcataatgaatgaaagtaaaaaggctctatctcttttctgaagcctacttgaaaattttgctttcataacatgacattgaaaaagatactataaaaatatttattaaaatcatagctcgagttttttcttagaagtaagaaattatgtttaatatcaaggactttactacaggataacatgattgtgtttcacatagaaaaactttgttgaaaaatcagtgtggagttgagttcatctgggccctagctgaaactaattttacttttggatattccataaactgcatacatctctttcttactgttttgtttttctatgtatgagaaatccatagacacagaaaaaagatggagagccttcatttctcttattttcacttttgtcccatccctctgtgcttgttctttgtttaaataaacttttgttgtatgtctttcacacatcatcactctctgcttcaaaggcttcttttaataacttagccctggctcacttttcttttgcatatgaaattgatttaactaaagtgtatgtgtgtgtttgtgtgcgcatatgcctacatacacatgcatccgtacaaataaaaatttcactggaaagggaactccgtgatctctttactacgtacatacacacaccttgtcgaagtgggaaaacttaagtttggagttaatttggttttgagttccagctttttctcttagtgctgtctgtttcctcaccctgaaatgaagatggtaatgtttactttgcaaaagttgctgggaaagttatgtatatataaatcactttatttttattgctagacattcaataaatgctagctgttactgtgaccatcattattgtcatatatgtaacacaattatgtcatacatttattttgaagctgataataagtaaactgataaaaagcagaaggttgagattaaggcttcttattgctaaaagattgatcttaagtacaatcacgtgaaaactgatagttacataacctgaaaaatcataaaatactgaaaaattatgactgttatgtgattgttttcagttgtcagactacgtgatgttaaaatggcagttgattttttgtattaacacagtgcctctaattttaaaaactgcttcagcaatcatgtatttaatgaaaacagaagtaacgatacaaaataacaaaaatataaatagagttcagaatttgaaaatactgtattaggaggtaagctgactatttttcgtgttctttaaatatatttagatcaacttgaatattaagcctcctacagcaggtagatagaggtatcaattcagttaccatttaaaatacagtaactccaatgaggagtttcttataattatttctaattactttttgatattagaaattagagctataccagaatgctgggaaagatgtctttttcaacattgtatcacagcatcaagcattatgcatcaaacatcaattcctactcacaatatccattcaatgtatatttggattatattttctttggatagaccctcatagtagaaactctgtattaaccagcttgcaagatgaaccaagactttttgttttctttgtaatatactgattcctttggcatgttgaattttcatggccaacagttacctactaccacatcctagcactattgtttttaccagttgtgtgcttaccacgtcagttgtgttattccggacctgtttatactagtcttatttgtatcaccattgtgtaatttaattaaatttatgtgaaccaatggcatgcaagttcaaaatggaaaagttttatttctatgaaactaacccagtgccttggaaagaatcagtaaaggcaagctacaaaaatttctgtcagattacatgtcagtgagataactacagaagatgagagaaggttgtaaaaataagagttttgttagattattttagaaatatctttaaattctcccactacttaaagtaaatggaactggaaatcttttatgatgcattatagatacgcattatataagaaagatgctgtggagctccaattattaacagacattattaaatttaaatttttgcctctgcataaaaagattggccaaagaatgtacatacacatgctcaaagttaaaatgtttaaggtgcatatgtctcattaatgagtatcttcttcatccattttttcaaattaaccaatcaacaactggccctaacagtactggataaggtaacttctattctattttgtattcctactctttacagagttttagagatgttttgtttcctacctaccaagggaaaaaaagggaattggcagatagagtttatatcttgggatgagatgtgtaaagggccaggacctgaaattacgtgaaggttgatattctgggattggtagttttgaagttccataaagaagttcagtccagccatgttccaaatgctctgagtataggcactggctggtaagcttagtggagtgttatacaacatggaagtctaactggcagttcaatgtcccaaaagttggacagaaccaagaaatagagaacataagcagatgacagtaatccaggcagaaggttagtgtcagagaagtctgtcagtgggtcatagggctccacgtgctagcctgggtttccgtgccagaattttgttcttgggaggcaggtagggaaaagcaagtcaacatctccagttccagatgagctagggcacttgaccaaatacaggtacagaagttagtccttgaggtagagcttacctgttggagaacatggcagaaatcattgtaccaaaattggagcacaggtcagaggctaaagcatggcttactgctgtggctcatggtgaacttgagcttctcatggcccctcctatctcctgaggatggctgagctcacagatggggactgttatgtaatcagaggtcaagtggtttagctggggtggcagagagccaggtgaagactgaaagtgttcaaataaggaagagaacagaattgctttatgtctgccttcatgaagacaaaccctaatagccaaaggactgaaagtttgcccaaagagacctcaatttttgaaaggaaaatgcatcttctccttatgttagaatgaccacgtctaaataaaataaactcttttgccttttgttgttacttgtcttggtatctaccattgtttgacactaaaaaaaaataaagcagtgactaattattggctaatttaatctgtcatgatggcatttgtaattcaggtacatccttcattaaagcaagtataggcattattatttttaaaactttttttttctatttggatttcttctattttgtttgattatttattttgttgttactggtggtggtggtgttttacagtgagacatactggttagctcagctaaggtgtttgagtaagacttcataaacataaagtactttgtgtgggtttgttttgtgtgttccatcttacgtcatttgtggcactgaaaatgagattgcaattcccagagtactgggatagttcattcagaggttagcccacctaagtttatagcagttgtctgtaatagaattgtaactaatttccactgttgtttttggagaaaactgtagactataattatgtgttagcactttttaaacagctccctgcattgtcatatcattttaaatgggctctgttttaaaatgacctttcatgttttgattgcaaaaatatagcttacacaggtctgtagttagcaaaatacaaggatccagtaaatgatagagcattgacacaactctagaagcatgtgttaaacatcactggcactgccctaggtttaaaggggaagaaatagggaagtagaaattcactgttcttcaacactccttctgttggataggcaagattagtacatagaacagttatggagccatgtgaaaaaaaatagtagttatacaaatgtaaaatgctacacatgaagtatattgcattacctttttgtggcctatggaaagaagtctcagagcacagtaagattcaagtaccatctcccagaattggggtcagcaacaccattttatattttggcaaatgctacccactgtctcccaaacggcagatatctgcatatagttagtcatgtggacacacccttcctctgctacattgcattgccatattagtagtagaattttagtgttgatttaaaagacagtctgccttaaagcagattgcatagtttgcacactgtgaattgtaattaaagtgtaaggggggcttattatgtcaacaactggcatgagaacccccgagcagcaggtgaccctgaccatgtgacgtttgtgacagctaggatccccttttcactggcttagcgatctgaaagtccaaattgaaagaagcccagaggctgtatatttcattagatcccaggggaagtacaggatacagcttccttctgttttcctgggaggtcgccagaaagtttgtagagctctgtttctgtcagagactcaaaagagaaaagaaaaagcacacacaaaacaaaacaaaacaccatacacaccacaaaaccatccaccaatcacccccaggaccataaatttgacatttcccacagtctgagaccacagtgttgctgtgtcagcaatacgctccttgtttgaattgtctgaaaggaaggctcagtgttctagcttttaaaaaatgtgtaatcttcaatatgcagtgattctcttggtgtaaaaccatgagaaattatcaagtacagatatcatatgatttgcttgaaatacttttgcattatgcgttactttctcctgaccttctaaaatggggcataagtccgaatttagaaagaggaaaccacatgtgtaataagggaaacagactaaggagacatgccatgtgtatttcagatcttattgtgatgggtaaactgtttgaaatgtggtcacattaaaagtatgttactttgtgggagactcaaaatcttttacgagtagatttttattgtgttccatagtggaaatagaactagggtttggttttggtgggaagttttggtcttcaagtcaccttggcacctgactggcagttgtgaaactaagtagaaaagatacctcttttttcttggcacctcacacgggatcataggattcttactatcatacaatttatatatcacagaaatgaaaacttcggtactttgttgtataatacagatcttgtgcttgttgatttttaatttggggctcaagcttcccatgtcaactaatgtggccgctgctaggctgccctcgggtagaccaaatgtaagctcactaggaagtatttctagctctgtaaatacctagcatatcgtttagtccaggcatgtccaatcttttggcttccctcgaccacattggaagaagaagaattgccttgggtcacacataaagtacactaacattaacgatagctgatgagcttaaaacaaaaatcgcaaaaaaatcttagcatgttggccaggcatggtggctcacgcctgtaatcccagcacttggggaggccaaggcgggtggatcatttgaggtgaggtcaggagttcaagaccagcctggccaacatggtgaaaccccatctctactaaaaatacaaaaaaaattatctgggtgtggtggtgcgtgcctgtaatcccagctactcaggaggctgaggcaggagaatcgcttgaaccgaggagacagaggttgcagtgagccaagatcgcacctctgcactccagcctgggtgagaaagtgagactccatctaaaaaaaaaaaaaaaaaaaaaaaatctcataatgttgtaagaaagtttacgaatttgtgttgggccgtgttcaaagctgtcctgggctgcatgtggcccctgggccgtgggttggacgagcttggtttagtccctaagtgttgttcattttaaaccagaaagtgagaattttctgagcccagattctacctttatactgctatttgttatgttttggtcaaaagggaaatacagaaagaggaaagttaacagtcatggtttgtgtgcttgtatgttgtatactttcatgttttgattgcaagaatatggtttacacaggtctgtagttagcaaaatacaaggatccagtaaatgatccttgtatcatttatttaggaccctctgttgtaagggcccaaaaagactcactcacagtgccatacacatggcactgcatgtgtgtgtgcttgtgccagcctgggacgagaacttcaaggcttgagagaaagatgtaccattttcataaatttggtaaataaattaaaacctttcaacttagagctgcatttaagtgttataattaaaggactaccagttgggttttttgttttgttttgttttgttgttttacagtccatctattttagcaaattcgcaaataattagtttcttttatttatgtttttcaagatcggttcctctattcagccagaggaaaacccaatatccttagctgcgttttacctcaggtacccagagaattgaggcaagaataggttgtgggaatgtgagagaagtgtgtctgtgctgtctcagctcagttaactagtcctctgtagcaggataagcatgtttgtgcagaggtagagaattgtctccagtcatgattttgttttttatattttttactgcgttgttttttttttttttttttttttttttgagacagagtctccctctgtcacccaggctggagtgcagtggcatgatcttggctcattgcaacctctgcctcccggattcaagcaattctcctgactcaggctcccgagtagctgggattacaggcacacatcaccatgtccagctaatttttgtatttttttagtagagacggggtttcaccatgttagccaggatggtctcgaactcctgacctcatgatctgcctactttggcctcccaaagtgctgggattataggcgtgagccaccacacccagctctactgagttcgtaagtgaagctttttcccctctcatgttatttgaatattgtttccttcatctttgtttatttattatttatttttcaaaccagggtctcactctgttgccagaactggagtgcagtggcacacaatcatagctcagcatagcctcaaactcctggacttaggtgatcctctcatctcagcctcctgagtaactaggactacatgcttagctgtttttttttttttttctttttttcttttttttttttcctgagacagggttttgctaagtttcccaggctggtcttaaatgatgctctcatcttggcctcctaaagtgctgggattacagggatgtaatcctggacccttaatctttattattagttcatcatcttttatcatgtatactatgtgccttgaaagtgtgtattattttattatctgcacaattccacatcactttattgatattctgaatatacctgtagtatgttaataaatagcatctaataaaatgtagatacataaaaataagccattttcataacttttggctaattttggaaacagcattctcaactgcaggtcagatttttaaaagaatttaattttatctgtgattgtgtatacatcatgccaaagataaaagcaattcagttgagtgagatagggtgtggaaacaggctacatgttggagtttgttgccagcctgacattttcaacacagtttctagacccatctttttaaatgcgtgctacaatgaaaaccaaaaggactttttcatattgtatttgcagtcatctatagatgtaacttctgatgtctttatttttgttgctcttctcttctcattaacagcagacctgtagacacactagtcccaacatggttgttttacttcctcatatgtgtactgaagtgttctttgctgtctgatgtatattaaggggtcttcagcaattatgaaaccattgctgcagaagcccagagtcacatactatagaaatattctatagtaaggacctaacaggattcacattaaacagaacttgactataaactaatggattcctactacagataataggaaatgtggttttttttttatttttttgaaacagggtctcactttgccacccaggctggagtggggtgacatgatcatggctcactgcagtctcgactcctgggctgaagtgatcttcccacctcagccttctaagtagctgggattacaggcacacatcaccacacccagctaatttttttgtagagacggggttttgccacattgcccaggctggtctcgaactcctgagctcaagcgatccacctgccttggcctcccaaagtgctgggattacaggcataagccaccatgcctggccaggaaatgtttttaaagactctggttcctacaaaatttgcaaagaattgtgaaaactgtctatccacttctttaaattttaatttttgttggtttatatttcaaatattacattgtcaattaggattattatgaccatagatgacacattttgcccatccctgataaagagaagaaatttgctccctaatgtgtagccagtttaggaattttagccttaattgaaaaatgtatacttttttgtaactggactttgtttctgctaggagatagaaaagtctataagccatctctgagatagatttctactcttcctttaaaatcttgcccggactggcccttcccctctctgttcttccattcaaggctcacttattgaacatatattatgtgcaagcacttcatttaggcaagtacgagctgtgtgccctcaagggcttataacttgttgggaaggcacgtgggagttatatacacagagaaatgaattaggatctgagtcccattctcagtaaccagggtgtagggagccagaggaaggaatgatgagttctgccaagaggaagggaaaggattctgacgttatcttctacactggttagaatagaaggatggaatcctaaatttaagacggagatctgtgctgtatacatgtgactaacagagattgggaaagagtgtaattacctcctgtgcctaagaaggttgttggcgtaaacaaggtagaagcaaagccaatttttgggacagtttaaccgaaatcttttcaaatatttggtagaaagcattggatgaagtgttacaattttaattaatgtttttaaatgacaattgagggttaataaagccattgttgccgtgcagttgagaagagtagaatgggtttgtttttgcaatcccagtggggtaattaaacttgcagtgcctgtcactcattccttaggctgagggacttttgagattgcaatagctcatcttgtgttgcagctttgtttttaaatttagctaagttaaagcctatggaaaaaaaatcaagggaatggaagagatgagttttgaactagtgaatgtgttcactcaaggcacagggcctctttgaggaatttaggtcgcagacgtctttcacagaaaagctgtgtccaaactgtcacagttactgcctcagtgtcctgttttgttctgaaggacatgacacctattttccatgcactttttcagaaaatagtatttgtacccatttgttttgtcttcttaaggaacgttcatgcagacttttcgagcagtgagcaggcgccagagactatgtcactgttctgttctgcacagtgtagcgatttgcagttggcgaatgaattcatcagcggatgaatgtcagctcactaggtgacaagcttcctgtgatatagactgggtgaggacagagcttggtgagccttttttgttcacgacttcatctctagcactcacagtagtgcttggcacatagtacatgctcaataaatatttgtagttttatttgtggaatgatatgctgagtaaatgattagagtatattatcaagaaattactatttttttttgagacggagtctcgctctgtcgcccaggctggagtgcagtggcctgatctcggctcactgcaagctccgcctcccgggttcatgccattctcctgcctcaacctctggagtaactgggactacaggcgcccaccaccaggcccggctaattttttgtatttttagtagagacggggtttcaccgtgttagccaggatggtctcgatctcctgacctcatgatctgcccacctcggcctcccgaggtgctgggattacaggcgtgagcccctgcgcccggccaagaaattttcatagagtttccacttccttggttgctgaatgatttgtaatattgtaatcagtatatctatgacacaatttctaaagttatttagtgtttgtcagtgatgtctgaagctccatttgctcttttgaagtcatttgtttcttaggacctacaattcttaggaaaaaatgacttacagtcaaataatttaggaattttaggggaaatctggagcccattttatttagtggccttaaagatgaggtacataagacccaggctaacccagcttctaacagttgattctgaatcccaggtttcctgattctgaacttgatgtccattttgaggggttgttaagccaaataccttcaagcttttcccctctgttgcactcacatttatgaatacagatggtctctaacttaggatggttcaacttaagaatccacattccataaaaatgggactttgattacccatacaatactggttttcactttcagtacagtattcaataaattacatgagatatttaacactttaatataaaagaggctgtgtgttagatgattttgcccaactgcaggataacgttaagtgttctgagcacatttaaggtagactagcctaagctgtaatgtttggtagtttaggtgtatcaaatgcattttcaactgatgatactttcaacttccaatggatttatcaggatgcaacccccatcataagtcgaagtgcatctgtacttactttagactaaacaggaataataaagtactctaggagaagagaactcagtaagaggttaactttacgtggaaatgttacaggcctaatgtaaggtacagccaacaacaacaaaaaaagcaagctggcgatctgccttccatgcaaaggttatttttcttattacaacaaaactaattagtggattttctaatgtaagaaaatgttgctgttagtaaaagtttcctcagtgtgccagaaagcagatggtggcagtgaatagtgttttcttttgccaggttttgtatatgctttctaaacctgcaagagattttgcttttccagattcagatttctgatcttttttattttaaaacagaaatagaaacttatatttaaatgtacttgcatcatgtggtctgtttgacatattatggttacttgaaaatgttgagtaacatttgatgttctgcatgaatttcttctctaagagtcttgggacttttaatgttgttctatactctctctctttatggaaataaagagtttctgccttgagagtgctacaatggggagttttgagtgatttatgaaaagcaatgggtaagatttttttatgtgaaaatttgtattttgtttcactcccaattactgtgcaagtaccagcttttcacagtgaggtttcttacagcatgactttgttcattatgacttcagtgtttgtatacagttttgaataatttatttctgtctactactggtgagatgttactttctgctaatttaaaatgttttgcctaacgtttttaatgaaagtccttataaatatgtttgtttaaagtctgaaatctaaacatgtccttaacagtaccaacgaggcagcattaaaacaaaaggcatgttgattttaaggccaactggaagaatgtatatctacaatggtgtagacgtgaggctgtaatgagcatgagtgtagtcaagacttatggctttgttgactaaaacttaagagatgctttcctttctataggacctccatttagaggagaaaaggaaatcattaagtcaatagatgagttattaaagtataaagtaaaaatggaaaatgaaaacacactcagtgatttttttggaaatcatttgggcaaaagtatcaagaaagaattgtctcaaagttactaaatggaatagtctccttatggaattatgtgctattttgggaggtgatagccagaatcaaaggaaatgaaagaaggactttcatcccttctttcacctcattcccatgtagctctgctgtgttgttccatccatccccaacactaacctgataattcggagacaccttgccgcatattgtttcacctttaattcttgaataaactctgattcttacttataacttttcccatgtttgttgccaataaaatttcccatctcatttgaagagttgctatttctgtcacctgttcaaaggatagcacttcttttattactacctctttctttttccttttccaactatttctcctttgactttgtttttcccaataatgatttgtttttatcttctttcctagtaaccaaaaattaaaacaggacagagtttccaaaggaaatgtctgtagatgttaaccaaactgattgaatcactggttattctttgcttactttaaggctgtaaatctgcaaaaagacagaggtgatactggtatcactcacagccacaggttagtgccttggctgtgctgatgctgccagggtttaaacattgctgtgaggagcccagcacaggcaggagtgtggggtgaggatgtgtgataacagggcatgacgggcaggtagaactgctcgcttgtgttttacacacaggcgccccagccttcctataggctctttcttgtgaataggcttccaccatgaccaaaatgtttgaaaaaccgtaaagccaagagataagtaatttttgttgaatataaaatagataagccattacctattcataggaatatttacctcctgatagactttggcaagggttctaacacagagacactccatgttctcaccaccagtgaagacgagggaagtagctactctcaaaaaacaaatagcattggctgggcacggtggctcacgcctgtaatcccagcactttgggaggctgaggcagctggatcacttgaggccaggaagtcaagacaagcctggccaacgtagccctgtctctactaaaaatacaaaaattagctgggcatggcaacatgcacctggagtcccagctactcacgaggctgaggcaggagaatcgcttgaacccgggaggcagaggttgcagtgagcagagatcacaccactgcactccagcctgggtggcagagtgagactctgacttaaaaaaaaaaaagtgtaaacttttataaatgatacagagttgaatgaatggaattcttggtgaacatgatgagctatctcaagactgaataatgctttgcacacagtaggtgataacaaatgtttgaggccctgacataaacaagcttcctcctcctaagaaaggttaatcaatagtcattctttagagtgagggatccatgctgatttttgaaaagtgaatcagagtaaaagttccaatcgccctcttggactttttgatgatcagctattgaaatagcacgtatgttagagacagtcctcccagcaaacatgattttctattaaaatacatccaggtgacaaaaaagaagcttttagaaaaaaagaatttgactgagcgtggtgactcacgcctataatcccagcgcttcaggaggctgaggcgggtggattgcttgagctcaggagttcaggaccagcctagccaacatggtgaaaccctgtctctactaaaaaatacaaaaaagaaaaagagctgggcatggaggtgggcgcctgtaatcccagctactcaggaggctgagacgggagaattgccagaacccggaaggcgaaggttgcagtgagccgagatcgcaccattgcactccagcctgggcgataagagcaaaactccaccttacaaaaaaaaaaaaaaaaaaaaaaaaaaaggatttcccgaaggtagtttatttggcaaatcccacacaaactattagtagtccttatacgaagacaatttaattttgggattattactaagcaaattactcacaaatactgagttactgaaatggaaaatatttttatctccccccagtgtaactacagacaagaatgtagatagtgtacttaggtgtaaatgacagatggaatgaactttgggtgaaggcgagagcacagaagctcagtggtactgagctgggtttgagtgggtgggaccccatgactggttactgatctttgaaagcgtttcaggatttcaaagctacataagcgaattcacgtgttttagttatctaggtttgttttttccttgttatataggatgtttgcagttttcccatttgtatcaactcatacatctttgaagttttgtaattcagtatagctttggttatagattaaagttcactggaaaatcactgactaatccttttagcatgttccactgttccatagtataaagatacacagaacttgatggcttccaagtgtggttcaaacatccaaagcactcgagattagcaccatgtgaagaaattttaaaatattgtactgcaattaattttaaataacttagcactgcatatgtcagggagaaagccatggtagaattcaaacagaagctcctataagtgaaatgattcacttacatcatttaaataattttatctctcataaagacatagaagcaaaatatatgcctatttccacttaggaaaggcttgggtgaatttctgaagaatcagatattacctgaggtttattataatatgggaagtctgtggagcatttattggttaccaaatgattaactccctatattcatgtgtatttgttataggttcaaaaaccaagttattacagaaaagttattgtcaatgtggaaattgaaaacacattattttaataatataacgtagagaaggtatatctaaaatacatatttttaagtattatcctaaattctaggatctagattaaattctttgaggatatctttttagtagctcctgaaacacaaagttttctggaagacccgatgggtcaagatataaaggaaaaaacttagtttatggccttctgtggtcaggggttagccaagtcactgaaaataaacatttgcaactgttagtgggctatttgcggtcatttataaagtataataagacacagtttatgacttgtagtgattattgcactcatgttatttctaattgcacttatgatcagcagcaaataagcaaatatcactcagtgccttttgatgaaatgagagtcttagccttgaatgcagccgaagaccaacagctcaattgctagtgatgtgtttcaaatgtagaaaggctggaaagaacctttgctgaacacctaaccctcaccttcatctatagatattctggcctggagaggtaagaatttacatatccaagggaaaatgggtgatttacgaccagaaagtagacctcctgactcccatagagacccttcttaccacatgaaacataccatcttccagtcatagagtctcctccaaaccagaaagaacaccccaaacacctattgacctttcccaagagagaccctattgtattttatggctctgaaagagctaattttttttctttctttctttattttttattttattttatttttatttttgagacggagtttcactctgtgtcccaggctggagtgcagtggcacgatctcagctcactgcaacctctgtctcctgggtttaagccatcctcccggttcaagcaattctcctgcctcagcctcccaagtagctgggattacaggcatgctccaccacgcccagctaatttttgtatttttagtagagacggggtttctccatattggccaggctggtctcaaactctcctgacctcaggtgatctgcccacctcggcctcccaaagtgctgggattacaggcatgagccactgtacctggcctgaaagagctattttttcatctttgtatttaaattccatttcaacaaacatgtgttagtatctgtatgttccaggcatggtgctatctgccagtaaaaatgagacagaaaattaaatagcatgatgctttaaccagtctatatgctttagaaaacctgcttccaagcagtgaacagttagagaattatagccactcataatttacaaggcactgtaaatcatgccattcagtcctggtactctctagagtcaggtatttggaatgagtcagttgaggttcagggaggtaaaggggcttgcccaattcctcaaagctaatataaatagccaagaagggactcaaacccaggttttcttttatcatgccttttgccttttttcactataccatagctacttctggtagaactgtcatttctattaaagggaggataccaggcctaattcagaataacattctgtactatgtatgcaattgtttctaaggagaaaagtctgatttaaaaaaaaatatttttatacttttaggctgggtgccgtggctcatgcctgtaatcccagcactttgggaagctgaggtgggtggatcacctgaggtcagtagttcgagagcagcctggccaacatggtgaaaccctgtctctaccaaaaaacacaaaaattagctgggcgtggtggcagcacctgtaatcccagctacttgggaggctgaggcaggagaatcacttgaactcaggaggcggaggttgcagtgagccgagattgcaccattgcactccagcctgggcaacaaagggagacttcgtctcaagaaaaaaaaaaattggatactttacaccatttccagcaatgctagttatgcagtaatagcttaatatttcacttaaaaaaagattctgcctaaacctctctttatctcactagaagagctaaccctaaccactaccaccgccagttagtatcagggctgctgtaaattgttccaagggtacatttagtggtattgattgctgctaatagtaaaagaataaaagcaattatgaatgtacacaacaacttgttgctctaccccagtttcaccaggagataggatttagtcaagaggggatgtcacagaatctttatcctgattaggagctttttgaggggagggaccttgccttttttcattttgtatctccaggtatacagggtgaaaggcaccatagtagatgccaagcgaatgaatgaatgaacgagatggataggcccaaagacaactaaatcaaaaaacctgtgttgtttcagaggagaatgatccagtatcatttcccctttgggtaggagtagtggtatgaatattgctatgactgcagaatcccagacttgtctagaatctctagttatagctttcctcagcagtgggattcaccaacacactgaaataacctgtctgtggcaaaactccatacacaatcctgttttctcaaatgcttcaaggggaaaagaaattcctgatttacccaaccacagaatcttcaaccttctcattaaggcttctgcattttttaggcaaattgttactgtgccattcttactcctatcctttcacagaattattttctgattatggatatgacaagacccagttgattttttcagagtttagtcatttattctgtggtttcaaatctcttctaccatgttatcttcctgcccctctactcccctgcccccaccccccgacaccaattcttaattccctttcttccttttattctcaccaggaagggatatgtcacagtaaaccctaccaccttgtcatccaaaatttctagggagccttagttctgagggtcttcttcttgaggccttaaccttacttttagacagttgtcattatctttgtctaaaggtcatagctaaattgaataaaaggaaagctgtgttttcctgttgatgcacaaaggcagtattgacttccctaatccagtttgctgaggggtgagagaattaaattagatatctaagcacagaaattgagagcctttgaaaacaaagataaggagacaagactgtattttcccttttcctgggagctctgggctcaagattttgcaggtgtgtcatctgatccatggcttgcatcgatcaaaactgtgccaatgcatatttaattagcaaggggaccctggatgcattatagccatcatccctatattgaatggactgtcagactctccgcacacttctccacccccaccgtcccctgaacccgtgctccctcccttgcctcgttgtttgggaagcttctgcattttgtctgagcagctaaaaagtttctttgtttttagctgctgatgcatacagcgccactgaggagaatacaaacaagtagagtcctaaagtgtttattttgtctaggaagacaagctaaaccaatttgattccttcggtaagattttcaaaccctgtagaaaaccgacaagaaaagcaaaaagaaaatgaatacactgttcaactcttcacgtatagaatttaaaaaaaaaaaaaagaattggttatattaggaataaagaagacttcggacaaatattttaataatagaattaaagaatactttctattatgatagaaggtattttattttaaaagctctgttttgatacttaaataagacatttgttgttggcaaatattttattgatcagtctaatttgcttgatgcaattcaccattctgacatgaatctgtcattaccattaggaaatccaatgcctgtacaaaagttatttatgatagaaggtgacaaagagttagagctggatgtatttttttttaaagtttctaaggttttgtgggtgtttctgttggtgagaattcttaaagtgcaggaggtttggagttttgccacagacaggttatttcatgggattatggtcactgttcattttcacacaggttccaaagcttgaatatccagacagtgttgtctgataaacagatgtaatgcaccaagtctgcttagaataaagagcaacagactgtgagcacatgtttaggactcatttaaactcatcagcatagtctagctcatagttctctgtctctagtctacttttgaggtagcttcttgctggtaaagtaacaaggaattattttttctctgctacaatttgctgcagagactcatgggaaattcatttgcatacatcttgttacaaagactgactacttcctggcttagacaaagtgttgcctgataaacagacttaacacacaaatgtctgtctggaataaacaacggcaagctgagatttacatttcattatcaaagataatctctttcccagtatatgagaattaagaacctgttctttaaaaccaggtctgtgctcctgatgttttatactagaatcacatcatgtgtcggttggggttgattttcacaaagaaacgaaaaacttgttgggatgtgaagatctgtagggcagaggtaaatgtacattttggggggcctttatgagtttcaaaaccaggttttcttgctttattttatttgaaccacacaacatcctgttaagttaggcaaaatcatcagtagtgtctccattttacagatgaagaaactgagatccagcacagttaaattatatagctgaggtttctaggacaccatctttttaccatttcatactcttttcaatggtggaatatgaatgcaagaaaattagtactttaaggtgctacctggacttaaatagcatgtttacacttgatagagggcattttattatttcaataaaagtttgtgcagacatccaggtacatgaaaataatgcatgtagattataactcaattatccttcattttcatttgaagcatgtattttatagtaggaaagaatacagggacattttctacattaagtagtatagatggctgtatgagtaatcttcaagtatatatcatcctgttgaagaactccaagaacctagtgttaagattaattttgattgtgaaaaaagtgactaaatggggaaattaagcacaattctgctatgcaataatgttgcagggatggctttttaagcaggtctttgtttacatgggagtgggtaggtgatcgggtagactcaataacttgagttctgaattaatcagcaggcaccgctgtgaacacagcgcctcttatggggaaaacaaaattcaaaatgattacctagacattttagtttagtttagtcaaagcgtcttctcaaagaaaatgtgagaagttacaaacttagtcaaagtatcatgtttgcctgtcttttataatcaccagcttcttaccattgacttcatttataacatcactgaaaaagctgatcattacttgaaattcagcctcatgcgaagattgaaggtttaatgattgagtcattttgtcattactttcagagtgactgaatttgtcatttttaaagcttagaaatgatcctcccctcactgtcataacacaacaatagttatgccatttcatttttttctcaacgtgttagaactgtgtatcattctgcaacctccttgtgcatgtagaaaaataacacattgatgagtaggtgataaggcagttgactcactcttcaacttaaacagtcttatcatcgtacacagtaccgactaaacagatgggccctggaataccaacattaatgaaataccagaaaagttgaatttctgtaaatttaatatttcacaaacttgtggccagaaaggcattacaaaaagaaaagttttgagaaagaaaatggtagtaacctagattatgtaacagtcttaagtaggccttgacaatgcggtacaggggagtgactaaggggtggatctccagagcagctggcagcccccagggtggtctggtggagggagcccttccaagtggctgctgcaggaacacagaccttgctccctgtctgaatcaggagtagaggagatgaggaccaatgcgtgcaaactagcctggtccttttggagctaggagttcccctgcaccccgccacagctccccatctcccttcgataaaggacttactctgcatacattaattactgcagttaccgtgtacatatatctagacaaacactcaattctagcttgctgggaaagttataaagatgaaattttgtatttaaaatccagtaatgataagatttcccatttaaagaaccacagagtgtttccatttttaaagcttaagaaaacttttatggtatgactcacctcatcttttatctgttttaggaactcggttattgtacgttaattttcattaagcgggccacagttgtgtacattaattgaccttaaatattagtttggttattcactgagcttaaaagattttattcattctctgtaaatgctaatcataattgcatattttcggtggtccggatttagtaatggtgttacagatttctgtttgttcttaaccagaccatgatggataatattatatttagctgatggtgttgtattcatcaatgtttacccttaagctacaaattgtatatacatgtgtacacctgtacgctgacattctacattctcaaataaggtttttccaatattttcttcacacgtcagtctttaaggtcacggtcatactggaaaaaatagataattttcctaaatattacaaagtattacaataataatttcttttataactgcagctgtgagactaataagcaaaatgtgactattatagttatttgattttctggatttcgttaatgtaataaacttatggtactggctgatcaaaacagagtaattttaaaaattatgttactcataagaacagaattatttctctattacaaccttatagatgtagaaaaatgaattccttggcctcttctgcagagtacttatcttcccaaaccctcagaaactaaaacttatctaaattttgaacatctttaaggtctacagttgtagagggtaactgcttattacactcagagtgtaatcacccttactccttactttcttttacctcagaaatgttcctaactcttcatttatttgcaggaaagtattcactcctgtctttgccttttagtttttatactacaaacaactctagctcatgagagtggaattttcgctttatttctttcactaatatttttgggtttggatgccttctggtttcttcataccgtcttttaatttgggagatttaaaactggacataaaattctaacaaaggctcttcagacttcatctttagccaaatcattatgcatgtagggaggctgaaacttaggctatattatttttctagtggaaccagaatttgtgcttttatggtccatagactttggttgctatcgtgttgatggaccaggaatgacatcggtttgttttagggtgggaagggttcctcaccagtgtgtctgcttttcctttatcaagaaattcacaacagcagttgtgaggattttgaggcagtctacaggcaccagaatatggtgggtttctctaatcattgtaatttttaaatgtgtgaaatattcctccatcattcatcattttaacctgtatacatttctggagggcctcctatgtgtcagatacggcttcagctcagcctctgtgctgcttgggccagtggatcataggaggtgattgtctgcaatttctaaacactgtgtaagatttccaaaccactcacaaaccagagggatatgccctatattcccttgccaggtctcaagaagcaaggcatcaagcagagatagaggactttttgcgctcctttctcatcttagaagtcccactcccctttcaggtgtaagcttagcatatttttcagtcactgacagtggttcagtatcagaaagctgaacaacaattgaaatttcgtctcttcagttcagcagttattgaactccttggctgggccaggcaccctgtggaaagtaccggggataagagaagagtaggaaggaactcctttctttagaagctgacattctcagatggtttgaactcaccttactacagcataatattaatcacactgtaagagatacatttgcaatgaaagagggactggagaggacaaagtgtttaattctaggtgaaagggaagatttagcaatattctatctttgtttattgcctaaagaacataaaatacatggaagggatatttatatttttgcctcactcattttaccatactaacatgtttttgtcattcctcaccttccccaaaggaatactgaagtttcattctgaaggggagtagacctgaggtttgaggagccgaatatgtgtacatgtagcaaatccagtacaaggtttccgttcttgcattgtacaagcgtttggaagcagagacaaatatgtaggcatcaggatttattttattcctttccctagtgattacgttgacagtgaactatctttgtctgagtactccagcaatatagctgtaggcgccataaaactgcataggtggatggctaccagttcaattaagagttcttaacctagcctcccatatgcaaaccctgtctattttaggtttaaatttctgctcataaattttttaaaaatccaaagaaacattgcttttcaaggttaggttgaagtctaagtttccttaaacaaaaagcaaatccctagatagggaaaaaaaattgataaccctaatgtacttccttacaagagcatttccaaccccatcctttaaacacagtgtaagtaaaattctcttcattgtaatatacagatcttctggctttcaaccagtaagccagagaaactcactggtatgggagactcagatacaagaagaacatccagttctatgcagttgggtttgttttctgaggttcctaattatttaaggtggtagaaatcaatcaaccacgtgatatttgtccgaaagagtaagacacaaagttaccttggcttctgacaggtgtctatggagtatataaaggagaaaagtgaattaattgttaaccttcttgatagtgttttaatgcaaatgtttgagaaagagatctttcatttgtatcaattatacctgggtagaaattaatttataattttggtcatctggttggctccacacttaacagcatcagtgaccttttgcaataccagaaagagtgtccatgcatcctcagcagagaatagcactaagactgggtagttttgctccttcttggctgaaaaagaaaatggtattgaacggccgagggtagaaaataattattgaagttttgagatcatatgcattttcttgtagatctttggctttgcttgccccttagcaggatggtgcattttagtatgcagtcctcagatggatagcggtgtctccagcttttgaataaaactagaaaaattaaattccgttttcagtttggctggatgccttctccagtgtttgtatctgagctttcacgagaatgcggcggccccttgcagaccaactctgagcattttcttgccactcactcctttgctgttggtttgcttatttttctgtggcttggaattttaaactttctttggacatacctaatattcatcttttattgttgttcatgttttctattattatgctatgtatctgtaaaggtaggtgacaaatttaaacaaaaagtgaaaagaagaaagaagtctgctttcagattaaataaaaaaaatttagggtctttcctgatccctttttgctttaatattcatggataaatatcggaaaagtaattggctattgtatatctaataattgagataaaactattttccatttattcatagagaagtgattaattataaagatattacacatagaagtagtacatggatagagatgtatgtttgctagtattattccaaagaaaatattatgtttggcaaaattttatgtatctgtttcgggacatgatcaagaattttaattttccctaaaacaaaattagatattttgctttcattttagttatagaaattaatggtttaagattttccagaacaaaaacaatggaggcatgtctttctcctaaaatacattgaattactactcaaaatatttaatgtgtaatttctaatggcaaaattataggcttgtttcctagaagaaaaagaaggtagtcatgctgtattttttaattgtttgtgatatatataatattaatttatgtagttaaaattttaaatatgggtcaatgtaaatttgtttgcatttctaatttttagtctaggttttgtatttttgtagtttattctgaaggatttctttaaaggtttttggcatataataatacattttgtttgtgtcttctctgtggcaattgttacagaacgataaaagctgtcactttgccagactcaaataaaaattcactttttagcatcttctgttatttaaacctttgaatcaacatagaatttttgctatagtcaccaggttaagattatctgaaaattttaaaatggatattttttgctatagcactttcttataagtaaaatcttcgtttgcttaaaagcagggagtcttttaaagtaataaattagcatttctagacctaaggtcactagtagtgccacttctttctgcagcatctccaagaaagagaagggtgatgctataactcagttgctatagaagtaatattttctgtttaatcacagttaagtgtcatgaccttttgaccttacattaaacttgcagaaatgtggttaaatttcaggcagctaattcaaaacctgtgaagtcaagttgaagttaggatgcaagctctccgcagatacagaggttttgttgaaaaaaaatttttgtgtttgcttttgaacaatgttgtaaacgacttcaagtctcagaaaacgctttatttttaaatcaaaatttttccccttgaaacattttgcctgttttttctctcctctccccaaaaactgtaccataaatatgcttgtttctaattttgtgaaattcttttgatctaagttaattttatctaatttaaaaattaagttactttgattttcccttatttcatttagaaattaagttaatcaaattccttttttagtttgaaaatatgattatattttttaaattaaaaaatgtttaattctatagaggtgtacaaaaatctgtttttgcaaacaagtccttttaggatctcccaaatgcatcagtacaagaaaaaaataattcttataaagcaggggaaacttgtaccttcagaaagacttctttgagttatgcagttatttcaagaaaatgtgatggaatattaggactctagtatttaatggtgttagtctgcgtagtctgttgctggaatgcagagctaaatatcaacagaacttgttactgttgtttgggttgcttttatataccagcttcaaaatatgttttgacactttattatgttctgaatcaagcttcagatgtgtgtaatgaaggatgaagtctttatcagactcgagtgtataaatagtggagaagagcagtttggaaatggtctctctaagagaatggttgctgaagagcttcaagttgtgatctggcaaaagccaatgccaccgtaggtgtccgcaaaccggagcgtcctctctaaaggcacaggctgctgctgcatttccctctctttcttttctctttccatcttttctttttttcatgtctcatgtcatttctgtaatgttccctttcttagtttataggttgaaccttttgagaaagtctggcacctctgatgcactttcccttgcagaccctgtaatttttggctgtatttttatgtttttcagattcaagtcaatctgaaagtcccagccagccaagtgacgctgacattaaggaccagccagaaaatggtaagtttagcttgggactctagctgctgctttcagagtccacagcagccagcaggccgactaagtgtgaggatttgggggcctaccctataagtagcccacagtaggaacaactccaaagactcggaaaaactcaagtagattacttttaatagggcagcttcttgttctcgggatcaccccagcagcctcaggacccccggccctaaacactattagggtgcccatgagaacctgaattcccaagaacgttgattacccaattaaactatgagaagtggggttaatttaccaaatcagatttttttttaatagcattaagtgaggagtcatggctttttcatttcattttagttctttaatgtggcaaatgccccatgatcatcttcactagtgatttaagatcattcattcacaagcagttttaagccttttgggagctcaacactttgccaattcctttaagaaaaaaaaaaatatctatgctttgaaggatttttctaccttaaattgtctaaaataaaatagtgaggatacagggcagcattaaattccactgctgcataaatatctaaattttctgttgcagatgctttattaaaatagaacatacattatatatgaatatcatagtatctggtaaaatttgaattcgtggcaggcactacaagtatgaaaaatactgtcatgggttggagttttatattgaataaaactatcggtttcaataaaaacagagacttcagtgaactagcagtgcctatcatataacaaacattgtgttacatactttcacagatatcatctcataaaattccaaaatgttcttctttgctgatagcactgaggactctggtggaatgctttaccttgaagggcctgtggggagaatatgccattgtgattaaaagctcaggctgtgggctgggcgtggtggctttcacctgtaatcccagcactttgggaggctgaggctggcagatcacgaggtcaggagttcaagaccagcctggccaacatggtgaaatcatgtctttactaaaaatagaaaaattattcggtcgtagtggcatgtgcctgctgtaatcccagctacttgggaggcttaggcaggagaattgcttgaacctgggaggcagaggttgcagtgagctgagattgcgccactgcactctagctctgggcaacagagcagaacatctcaggggaggcggggcggcggaagctcaggctgtgacctgcattcaaattctgcctctcctatttcttacctgtgtgatactgaataggttatttaacctctcagagtattgatttattcctctaaaacagggtaataatattacctgtttgttgaagagttaaataagataatatgtgtaatgtgtttaccatagtatctttcatagagtttatgctttaaaaatgtcagctgtggttcattatgacttttattatttttcttgtcaatataattctgtcatactttgtttttcacccactttgaatgaccccattgcttgagtctcttccttttgttgttctgtacattgttccatgttgatctccatccaatcttttggaaaagataggcaaacggaattatgttggtattgtggggtgaaggatcaagtttaccacattagctatcctatcactgatttttcagaatatgtttcatttcctacccatgagaaatttgattacattgctggattctagcattaaatatggactgcctggcaattcctctcctcatcctggtattttggtgatattttctttatcaaagttgtctttttaaagcaggcagttaaaaaaaaaaaaagagagaactctggaggtttgtttttagtgtcatatacagctacatcttattttttgttgacattttaaagagtggtatttatagactagtttcgttctttattttccacttgacttgtaggtgatgtcttcaaagtttcacttttttctacatattgtatttgtgcataatctccctaaagatgtctccagaggtataattttattttcatcttcaaaaatgtgtggactgtacgggtgtgtagttcgcgtatttaggtctggccgcccctctagcaggcctgtgattcatctgtcttcataaaatggccaacaagctgttcacatgcaaatataaattgagagcatgagaggcctggcatgcctttctggagctgcctgcaatcccaatattgtgtgtttcccattccagaaagcaaccaggattgagcctggattttttggccaaaggcagagagatactagccaagttcacttttaacctcagatcacttgatgctactacctcaaggatttacactatcattttggggaaatcatgtgagttcaaagaaagaaagtattaatatctaggagataaagtaataaattcctatctttcagttttctatttgtttcaaagaaaaagtagtagaagctggcttatcttagccccagttgaagaattatcagcctactcagttttctgcctcttgtcaatctcagatgaagttagtggaggaaaaatgatttttctcttttccttaaagacacgtaatcccaaaaggaataaatgaagattcagggctgggtatttacatgcattagataaggttctactctctggtgttgcgttgatcaagagaatgtttcctctttttcattacctcaggatatgaagatgaagtgtgtgtttcgtttttgttttgaaagagggaactctcataggtgtatcaacaaagctctaagaaattttggaatcttgctgattgaagaagtaacagacttgattcttcaaataaaatgggaattcattacttcacatatatgtatgtgtgtgtatatatatatgtatgtttgtatgtatgcgaaaaaataatattctttttatcctagctcttgagaaaggtaatgggaaacgaatggtatttccctagtaaaccatggagaatgaatagacaaatggtaacacgctgtttcatcccaaaccgtaaactgggccatgtaactttacataaagtggatgcagctgtttcttccctgtccaactagtctgctttttctgtggaatttttgctttcttttcttgtactcccttaagactcaactgtaaaagaaaacaaatctttgtccaattagagcattagatgggaattttgaaggaattatctgaagcccagcgataaaatatcagaagctctgaaactcaaaattggtataatataatgggtaaaaactctgcctctggagtcaaaaagacctgagttcaaattaaataatagctgagtgactgagtaaggtacaccccaatctcagttttcttaccagtaaaacagaaatactaaaaggaggccaggtgcagtggctcacgcctataatcccagcactttgggaggctgaggtgagtcgatcacttgaggtcaggagttcgaaaccagcctggccaacatggtgcccgtctctactaaaaatacaaaaattagccaggcatagtggcacatgcctgtaataccactactcgggaggctgaggcagcagactatcttgaatccgggcagcagatgttgtagtgagccaagatggcaccacttcatccagcctgggtgacagagcaagactccatctcaaaaaaaaaaaagaaaagaaaagaaataaaatactaaaaggacgtatctcatgagtggtaaactgagaatatgcatacaaaatagcattctgcctggttcacagtaaggactcaaaggaaggttaccattactaccttccagttaaagcttgtcgtatttacaacgagtacgtatattcaagaggtccaaagctgggagccttggagtggaaggggatggcgtcagaaatataccaagacttttagagacatctttagtgggtacttaccctgctctgaaatgtcagacatgggtttcccaaatccccacaatccccatggtgccacgtctgttttcccattttgttttatcctcacaatctgttcatctcccatgagtttgagaaccagggaattgcaaaaaggattcagagttgctggaaccttcagaatgagtgctcaagaaggtgattctggaaagaagagacttctcctagatgtctttaattttagctgagtttttccttggcacaaaccaaatagaatctggcttattaaaaactataagctgattaagggtaggatttatgacaaattccttttaaaaaaaatcctgcacagcccgtagatctgtgccttgaacttaatgggtacctagtacttatttgcttaatgaataaaattaataagtagatgaatatattgtcattactcccaaatatttttggagtatctgttcactcttgatttacctagagattttaagaaaaacaaacaaacaaaaaaaacaaaaacgctctggagaagctgaaaacctaatttgggtgtgggggaaggctgtcctcagacacatggacagagattaacagatataactagtaggtctaggaagccaaagctgagggctaggtactaatgggaataggacatcaagttgtccctctccccttcctgcccgcccccacccccacttcaatgagcaggtgtggtcagatgtttgaaacatcaccatttcagtttatgcatgatgcttgattaccgtagggaatgcagttcagacaaagttcctagctctgattggtatcatttaatcctttgttatatcactgaatctggcttttccagagctcctgaaggttttaagccttatttgttggactttgacttagaacatcgatttaaacaacttttgtgaactcccatgacatactttggttactttaaacatatttatgggacagagcatttaaaatgcctgcctgatatttacagggcctgtgaacagtcctccaaagcttgcattctgtggtgtatcaggtcagtcattaatgaggataaagctcatgtgatagccttcttacttaattcaaggcacacttctgtagggctgcactgagtcagtgtctgaggcaacagtataggccagcgttggcactctgaaaacacacccccactggctctcactgttatccgtgaaagcatccttaactaaaaaaagaaaatgtggggctcccttgccagaaagtaatgctatcttcacctggttatttttcccttctatttgccatttctcatcacctgcacagactgctagtaataactttatcatagtggtttttaaaatgtgatatttataacaagaaatcagaattggtatttagatgatttcctttaggtttaatcatgtttgttcctcctcatttatctggtagttgcacatatgttggtggcatcaaccctcagatgggtctttgcaatcagtggaagcccattaatcatgatgcttgccccagattttgaaaatttccagctctacctgccaatttgaaaattaccctgtggagtattggttgaatctacctttcatgttcaccatcttcatttatgtcgttcacatcctgaattgttaaaagaggtatcattgttaaatgttgctaggtgaacaaggaatgtacttcttttcatccgtaattgttgctatttcatgcattattatttaactcattgaatttttaatgtttacgaaataagttttagtgcaactgacttcctgacttaagatttatgtgtagggctggacacagtggctcacgcctgtaatcctagcactttgggaggccaaggcgggtggatcacttgaggtcaggagttcaagaccagcctggccaacatggtaaaacccggtctctactaaaaataccaaaaaaaaaaaaaaattaaccgggcgtgatggcagatgcttgtaatcctagccacttgggaggctgaggcaggagaatcgtatgaacccagaaggcagaggttgcagtgagctgagatcacaccactgcactccatcctgggtgacagaacgagactctgtctcaaaaaaaaaaaaaaaaaaaaaaaaaaagatttatgtgtaggatttactttgtaatttggggctgagaagagaaacctataaatttctttttctcttttttgatgaacatttttttatctgacattattctctttaaaaattgtgggccttcttgtttaatgttttaaattgtttttactacctcctcacatgtatagtagatatattacaatattatattgcaatatttatatatagtgggaaggcaaaataaaattgataattcaaaactgcaaaaatggtcactgctggatggactgcttgttttaggaactgttttgatgaatgtgtcatttagttgggtgatttaaaaaaatttggaggcaatgcaaccttacagtttatgttttactgggaaagaaggagcattctagcaccattgacttgtaaatgcagtttatcaatatttcataatttgcatgactttcttttacaattacctagcaacagttcttctctgcagtgttccttcaaaaaaccccgcagggacagacacagtagagtgaccaccaaaatagcagcaataacagttatgatcaatattctaaaatatgtaaaggtcccaactcagggagacattaaaacctaaatgccttctggtttccagatctgtataattaaattctgactgatgaattttcagcaatgcaatggagctagtctctcttctttaagagattagggaactagaatttggtttcatctgaaatttcattctgaaactaggtgaattttgctttcttaagaattgttagcaggtgtgacccatcattgtttgcaaaggctcctcagaaatgcctccagacaaaggaaattcctgagtctttctctgtgaaagatgaggtgccatcctaggctgggggcttccccaagtgcatgacgcagtggaggctgcagagcttaagccacgggatccagtgtacttaaggcgccttttcaactgaaaaatggggggtgtggggggagatttgtagccattttaaagtagtcttatcctcacacattatgagtattttattgtcttcacacagagaataactagctgaacagactttaggttagttggctagtagccaaaataggaaatgttttagatcctattcccctgattttcaggttctaaaatggactgactgggtggtctgtttcagacatcttcccctccccactccccccacctccaacccttcacacacaaagagttacacaggaaagaagaaaaaaagggatttcttgctggtcctcaaattcgtttgtgcctctgactcttatcccaggagagacccagaagtgcctattgaatgtaacgttccaagtaggaaagcattttaaagtgtgtatttagaatgtatctggaattgcgtaaatatatacatagatctagattctaaaaatatgaaaatatgaagcaatacaatttatgcagtatttgaattgggctcaaaaaggaaatcaaatgaggagccgtcatcaaatcacagtgcggtagaaggtgcacctggtgtttggctacagctccatctgccattgctctgttttccctgtgatctaagcctggaactagtatgacaggaccctttgacagagatatccttagaaggaccacttctaatggccacttttcatacctccccatcaattaaaaaccagcgtggtgaaagatcagaggggcgagctggggtcaggaattgggtatgagctttccttgccacaaataatagggtcacttctgcttttaaatttgaatgtgaatttgttgtttttaagcctgtacattattttttggaaggaattacctatttgtggataatattagtaaactgaatgtaatatacataatgtatttggggatttggagtcactaatccagattgattagttgcctgctagaaaaattcatgtggccacaaggatttttggcaccttttctccctgcagcttcctcattctttttctcttcttcaggttttactcagctccaggcaactcttttccccctggcattagcttgtcgttaaggaaatctagtgggatatctcaaataggggtggagggtagggggcactatttgctgcagattactctgccccatctcagttgtgcatttctatacttggttgattttaacccaaagggaaccagggagtctcatatggcttatccacaggcatcatatggtgaatatccaaaaagagaaatgtaaggatattgtggcaaggctcggcaaaataggaatagcttttcaacaatctttccacgaaggaaagtcagtgttttcttagatctctgtaggtattttacaaccagagagcttctcagcaagtagcacttgtaaactcagagatgaacaagaagaagccaaatcacagcttccgaataggtcaaattagcaaaagagacttgccattaaaagcctgacactgagcgtctgttaagggaaaatcagttgtccaagtcacttaaagacttgtacctcaattttctcataagtaatttaacagatcattcttaagaattgctggataggccgggcaggatggctcacgcctgtaatcccagcactttgggaggccaaggcaggcggatcacgaggtcaggggattgagaccatcctggctaacactgtgaaaccctgtctctacttaaaaaaaaaaaaaattagccgggtgtggttgcaggcgcctgtagtcccagctactcaggaggctgaggcaggagaatggcatgaacctgggaggcagagcttgcagtgagcagagattgcgccactgcactccagcctgggtgaccgagcgagactctgtctcaaaaaaaaaaaaaaaaatagaattgctggatatatttggactaggtattggatgtgttaagggaatacagagatagagcagacatcctgctcttgagaacctgatagtctagtaaaagggaaaagacaccatttgttcgttcattcattcaacaggtatttatcaaatacactctaagaaccaggcatgttctaggcatcacactgagcaaaacagaaaatcctactcttaatttagcttaccttcttggggaaggagacagacaatcagctgattaatacacatgtcacatgccaagtggcatcaaacattataaaagaaaataaggcaatataagggattaaagaagggaggatgtgggtactgtcttataaagggtggtaaaggaaggcctttctgatgtgttgacatttgagttaagtcctaatgaagtcaaagaagtgaattatgcagatattagggacttttattctaagaagagggaacattaaatataacagccctgagacatgctggaagaacactaagggggttggtgtggcttgaagggtacaaacaagggagagaatagttgcagatgagtagcaggaaggcaaatcatattggatcttgtaagccaaggaaaagatatggcacatccttgaaaagccatggtatactctggaagaatgcacatatgagtccattcatttcttggtacagtagatatgtcctgatcccctacactgtgatagtcactgttctagataatgagtgttcagtgggaagcaaagtagacagagtttagtgtggagttgtacacaaagacctcattcatagcattgttaaggaatgagactctgatttgtcatggcagtatcttttagtacctccaaaggttttccctcgtgcatattactaaaagccaagttacttgcatggaataatatttggtttcacatacccaattgtgtaaacaattatttctcaaaatggaggtcgaaatctgtggagtttcagcttacccctgctctcgtgaccccattagattataacccccaggtctcacatacattcaccatgaaggtggattttgttcctaaatagttgccagatgtagcacaatggtggctcacacctgtaatcccagcactttgggaggccaaggcaggtagatcacttgtggccaggagtttgagaccagcctgggcaacatggcaaaacccgtgacagagcaagactgtccccaaccccccccaaaaaaaacaagatgccaagttaaatttgagtttcagataaacagtgaataattttttagtactgcgtgaaatatacttacacaaacaaagtattcattgtttgtctagaccaagttttgtattttatctggcaaccagttgtaattctccacatattcctgtggaggttacataggcaatagtaacagcagtgtatgaaaaggtttgattagtctgtgatgatttcactgatcacaaaaggtcaaaccactggaatttaacccactgaaaatgaaatctgggaagagtactacaaagttctagtgacttggctgcttaaattccattccttccgcatctgctggtacctagcccagtagttttcttggaacaataaaccacttgtgaggcacagtcaataggtacaatataatagttgagagccactcagcccatgcaagtgagtgtataagtttaattagtcgtgtattaattgagtaagccactgcgacactgtgtgagcccatacatccagttactggcagaccatttactcacgaaagatgatgaaaataggaaatcagtcaaataatagagcatttggaattcgcacatccaaaggtgaagtagagaaatggcatttctgataaacttgaaaatagaaggggccatatttttcatgtgcaatatggaatgataaatgtatatgttttcatctgtaattgggacaactttgctaggtatgacaaatcttgtttgaacatgttaaagaaatatagtgtaacctttgaatcctcctgctttaaaaaagaatagtgttcacagattcaaggaaaacaattttggaaatagggttaaactctattaggcttaaagccagataataacaaaaataatgatttttggtgataataatcataatagtagctcacaatcattgtggactttctgtgtgccagtatgttagtttgggtcctccaagaataatatgtcctgataggacaagagatttattggggcaatacctatcaaatataaagggggacagagcaagagtagattgagagaacttttaggctgcagtacagttctgacaggtgggaaaggaggagggaagaatgagagattgggttggaagaatcccagagctctcactcccattgcctaggctggagtgcagtggtatgatcatggctcactgcagcctcaacctcccaggctcaggtgatgctcccacctcagcctaccaaatagctgagactataggcacacgccaccaagcccagctaatttactgtatttttagtagagacgagggtctcactatgttgtccaggctgggttcaaactcctgggctcaagagatccacctgcctcaacctctcaaagtgctggggtcacaggtgtgagccactgcgcctggagtaagcttctaagaaaattttgaccatgccaatggagagtccctgagcttaagtcccctgttggaagaattctgtgttttataggaatgggtctgtgttggtatcctccccctcagttattggctggaaacagcctggaggaagtgtggcctttaagcaaatgtggtggtggattcagaggagcagccctgttaggcaaccatgttccttgcaacaggtggtcagggtggaccatttttattcatggccaccagagccatgcactgtgctgagttctatattcatgatcttatatcatcttaatataatcctatggaggtaggtgctattagtgtgcccattttacagattaggaaactgagacacaaagaatttaagtagcttgtcctacagtcaagaaggcataaagggtattcagactcaactctaagtccagagtcttaactgcttaaccatggcattctattagagaaagaatggaattcaaactctggttctataatgtattgattgtataaatttgaacaagttatttaaactcttaaacttttattttctaatgtataaggtgcgatgtcatcaccttcccaggaaatgtgttttcgttgctgttttgttctgagcacaaacaacgttagttccttttccttcctcttgttttgctctcatctaggattgtcatctcttcctttatttcttatctcatcttcccaggtatctgcctcagccttgttcaggcacccacaggcttaactacatcctcagaactaacaggactgtttctgtgtggattatatgtctggatgtagatatgtggaaagtgctgagcacttgcaacaatccataaatagatactcaataaaatgtagctcgccttctctctcatccacctcattgcctcatagacatgaactaggtgccagggacatcttctttttaagtttcttttttttttttttttgacaaaatatacatctttatagaaaaattacattcttatttttttatgaacactttgttctttttttctacagtctcaagtattatgagtatatggtactttaatagatatttttaaacaatggactgagttttcatttgatttttctgctggaggtggagactataaaatgaggttagttgcaaggtatttataccagatgccattatgtttgttagatggcataaaacaattatgattgccaataaatttaaaagtgtttccgttgcaaaagatttaggagtatagttttactgaaaacataaaatgtttcttttcattccccattttttgtgcagtacaatagaaatttgtgccccattcctttcattttagatttctgaattatttaaaagaattggttaattctccatttcaagtgagcaagacaaagttcattaggatatctgattcctagcaggtcccacattcacagatcatgttaactccatagagaggtttatcttcttttaaaattacaaatgctacccacactgaaagcttttcagtttaatgcattgttacagctttgaactcttcagtaggatcctaaacaatagaaagaaggaaaatgaagcaccttgttgtccgagcttgagccagttctaaaagtagcagtgcagaacgtctatgtcctttcaattctagtggatttgcaacacaatatcatgaaaggcatgcaagtaaaccttagcacgtgctccaccagtagttaccaactggtggtccttgaagggagccagaggaaaaatcttaaattatgcattttttccccttatataaagctgcactggctgaagatttttgcttttgactttatgcttgtgaactcatgggttctcttatacttacagagactctggcagttatagtttggattcatttaatgaaaggtaggggaatgatgaattatctattatttagcaaagatggtaaattaaatactttgagaagctggccttatgagaggaaatgattacaagttgtccttaatggtaagaagatacagaagcctgtgctgtagaccactggttaatagcctttaactttatcttaggaaagacgaagaaagaagagaaaagcaggtgctaggaatagccagtcaagactggttgttgcaggtgctgcccgtcatctccattgtacccctttccggtgttctttcagcagatattgttgaattcagttctatctgagcagaattgatagtgaggccgatgtggaaagcaactcagagtaggagactcaggtggtacttctgtatgtaaattgactaggaaagcataactttgaaacaaaagattctaacaaagtttcatagcccaatcacatgtaagtgtgtagaacatttgagttttggactctgatctctgtggatttttttctgtgcattcataagagaggcacaaaaattgactgtggtcaaataatactatgtactgtaaactttagattgtttgaatatgttaatttgatgtaataattctaagatatagaggacaaggaaactgaggcttggaagttgaggcacatgttcatgatcaatagcaagtgagtgcctgcttcatctttcttgggagagctttgagaataaacagggataacggatagtggtgtgctttgaaatgttttgtactcagcagctataatctcaaataatttgtattgttaggttttcaatgtattgactattctgtccccttaccccagggaaagtatagacttgaggtcagggaataacaatggcatatgacatgtaagtatggtgacataatgtcatatgatatactacataatatatgtattatagtgttacatgcattatgtattacattattgagtaaatatgtattatattacaatgtgtaatctgtagtccttataatctattaggactttgactgaacaccagtcaatgaaaatagtaaatgtcacagtatactgaaagcgaagccagtgagagagagtctgcagaattccacattttcctcaggatacctcgcagaccatgggtgacacatgaccacctgacattggtaccaagtgagggagaatgcattattagaaataaacttatcgtttttcaaagacgacttatttttaaaagctacagtataaatggaagctccagtgatttctttggacaccgcaaatttgtgttttaaggagaccactattctagactatgtgctccctgagggcagaaagtagtgtattatattccaaacaaaatggcactcagtaaatattttagggtgaatgaatgaatgggtaaatgaatgaatcttgtgttcaggagtttaagtcttttcaggggaaaataatacataatcataagttattcccctccttccaattgatctttcttaattgtacatatatttattaatatataatccctgtgccaggcagtgggcatatccacataaaagagaaaccaaccccatactccttgagtacatattctagcaaaggatacagatatttaggcagatagttgcataaaatgtgattgtgatctcctaaagttatttggatggtgtttggggcatatggtggaggcacaagtgataaaggctatgcaagaagcaacaaaagtaaagttagaagtgttcagagaagagcttgttaggtatttgacctaaatgctgaagtgtatacatgttcctagatgttacttagagctttcttgctccttaaaattagctcaaaccccccattccacaacctgaggaaatctaaagcctatcccagtatttctgtgcatttctggggatgcttacagcaaaagttttcttctagctgtcagttcctgcacctgctgagttagtttactttatagatcttcccccaagtcgtgcaatgctcttttccatgtcctgtgcccgtatgttgggttgagcaccttctctgtatttctgtctgatctacctgtagaaattatgtgtacagctggctttggtgaagttgtaggagggcgagtttgggcacttcagtaaagtctcagaacatactaaccgcatcacattgattttaaacaactctgtttttaagagcacttaggtcactctgccatgttaccattgccctctcttcctccctccctctcttctctgagcctctccttgttcttctttagttttccttgagccttgcaaatttatgttcttgggaatctcctttgtaaataagaaatgtgccatcaagatatttcccaatcaatggattctggcactcttgacaaaatgatagatggaatttgcagtttctgtgtgtatgagagggaagatgcaaagtccttgttaaacaaaaggaacattatgggtaaaggcctaggggcagaaaggacccagcatgtaaagctgcagcttggctaagacatagtgtttctgaacagtttcaaatacgccagtcatatcatgttgaattcttggatggccagtcacccagcgtgtttcccttggaatgaagcttgctgactgactggctgacagctagaaagcatccataaatgagagatggagatgaaattaaaatgtgacttctttggcatccacctttcgaacctaggccttccccactttactctaattcaatttagtagatgttggatggaaactaatacagttaaaaagaacttcatgtaatctcactaacattcttagaacatgatgctcaaggttttctggtcaaggatatttgcatttgcatttatagaatagttaagagccagaattctatgcatgtgagaagtccttgctttgagaatgacatttccaagctgtcaaaatctaatgtgctcaaagctcaaaccaaaattgctttttattctgtaaatattgaagagaaggcttagagtggcaccagtgaagttgctagccagggtactagcctactgagttggaatcagaaaaagtccatttgttgagtttaaattataatacaatccaagcctgagggatgcagtgaaaaagtatgaccagtggtcagattcccacattttcctgctgaccacttggtcactttgacacagtttactagagaagtttgatttgcaggtgtgtaagcacagtacatgcatctttgttacttgactcttctcatctccaatttcttaatgcttacattgaactacaaaaatcttcacatgaaatcttcccatattatattcactcattcaaccaatatttatttattaaacatctgctgtatggcagatactgctccaggcattagtcacaagagtgatgaagcacagaaaagtaaagtttcatgcatccaatagcagattcattgtagaactgagagccttgatgttcggttccttgtccagctttctttctcctacatttctactctgcttttcttacacttgctgtttcaccaaaaaaaaagttacttgaaaggcgattgaaatcattcttttcatttgccaataagttgtaaaggttattggaaagtcatttgtgtaggattttgaatcagtttaacacagttttcatattacatttatgtgtgtgattttctgaataatgcctttaaaggcagacattaagtggattgcgaactccatgaaagcaaggattgtttttcttttttactcactgttttctctttagcacagtgcctatcccatagtacatgttcaataaatatttactataaatgcagaactaaatgcatttcttatgcttcgctatatccctgttgtctggtgcagtgtgtgcagtgtgagctctctctgagtctgtcgctggtaagatggtgaacagtgctgtccgtattcagtggacttctgtatagagcatgtcattcccagtctatctcgatattcagtactcgatattcagtacttaagtgtccagtcaagcagcttgtagttttccttgctatgttggggtgggtactctggtacctggaggccccctggctgcagacacagcaagatggtttcgagcagggtgtgaaatgtttgctgccagtgagggagaaaggtttgccttggctaggagtagcaggatttcaggctccacatctgggtcttccgtctacgtcaccaccaccatcctcatatgcgcatagccatcagctgtcctaagtgcagcactctgacagaaaattgtatacgaggcagaggtggctgtaactagtcaaagtgtgagagaaatactcattccatggcaaagctgactgacatgaagagatctttgtgctgagagagattcagcaaagggaggccagagtaaactaggagtgggctccgggttagagttgaagcaagaacctgtatgaaaagaaaggcaatgtccacctcatatttcctagcagacataaaagacatggtgtctctcttgctcagtctttttcatcatcttactgggttcagaacatgggtaaagttcgaagtggtacattggataattctttcgggcagaactttgttgaaaggaagagtgtggtcgtctaattggagcttggcaagtgcaagggtgggagagaaagggagaccctaccttgactccaccgctcacctggctgtgaaacgctttaagaacagaaacacttactaattgtaactggccttaggaaggtacctgacctcccgtgcctcagtttcctcgtctgtaaaatagtcacgaatgcttcttgcccttctttgctcccaaggatttagtaaggatttaatgatatgatgtatctgaaagcactttatgaacaatcaagccatatgtaaaatgagctattgtaataattttgagtcattaggaattccttcatttccatcccaggtcccctggacaatgctgagaaaccagtggctatattgcatattttcttttcagcccagcagtactcattttcaggttgaatatggtaacaaagctgttgcataagaaatgcacactcctctcttagggggaacattctttacattcagcacaccagtgcacccccatgactgcagagtactgcagggtactgaaaggtgtctttctgtgtttaccgtggtatcactttcaccctctattctgaactgatctggcattctaagattttcaaacataatctttaaaagtataagcatccaaaattacctcaaagagccaaaacaaataaatacaacactgaataaatgatgctccagttgatccagaatacacttaagaaatcttttgactctgttaacctatcagtatttgacttcagattgactcgtttatttattcttaaactcccttgaatctccaggcttttttcttatttgcattgagtatgttctccccattgacattcagatcactttgaattggcttttacttaggcttttcttttttggagacaatcagctcagagacaaaataggcttaaaccacaaagatgttttagtaaatagatacatttcattagttgctgagggctgtaggaacacagttgtcccaagtaatttcttctttgtatttggtgatcttaagaggaaatattagtgtcctttttcttaagccactggtctaaaatatctgtcaagcataagatttaaatccctgacaaacaacttctaagattttagaaaaagttttgagtaccttgtgattccaactcttatctctgcttttgagcctcgatttctaccccctcgtcatagtccttacccacctgtaactttaagacatcaaagttcattttaaaaaagaaaaaaataataagtttcatagaaagaaaacctctcatatatattgggagggctaagacaaatatgtttctcttttcatgcatttttctggttgaactgaattctttcacctcctcttagaaaagtcttcgactgtgccagctagaagtacggcagaatgggtaaagtccagccttgctaagacaatttttttggtctgtggtacctacagaggaggttcttacttataatgtgaagtacatggcataaactggtggagaagagcttccttttgttaaatcgttcatttattccactggcctaatgaaagttatatgaaccacaatgagtcacaacaattaccagtttaattcattttttaccctgtatttatttaaaaggtttgctctataaatataggacctgtagataaaaggtttctctaaaaatcactctcttttcaagatgttttcattagttagtattcatttaagtgggttctactctgcataccattaaaggtgtgtgtaaatgtttttattggtttcttccctatcttccacttttgtatttcctctataagaggcagtgccattaaccttagcagggctgagtgtgattgtctttcgatcagccccatcattgcaaaccactgacccatagcttacattacttaaaccactggttcctaaacagaaaaatagccccattaccttccttggaatggtgatgggctgtctgaaaagtcctttcaaaaagaagagtgagcaaaaatactccctacttcctttgagaatagtcctttctttgatataaatgttgcggtagtagtacctgagtttcctattttaactctacatgaaacatttattgagtgtctgctgtgttcagggtgctgttgaagacacatggctatagcaacatgttttggatgcagtcctttaagagccatacttttttatgcaggtgataggcaggtttgcacctaataacaatgcagggtaaatatgctaagtgctctaactgtgaaacaaagtgctctgagaatgtggaaaagagaatgctttaattcagactttagggacaggaagcggaaagttagatttcaaccagcagagaagggtaaggaggatagagaaagaggttccaaaaaaataaaaaagcacccccaaaggcatagtgtggtctgaaagtttatgatgagcttggataatcgccaagtagtgtggtatggcctttgcaaggtaatgaggggatggaggtaaggcattcatgcttttgtataactgatacggtttggctctgtgtccccacccaaatctcatctcgaattgtaatccccacatgtcgagggaggagggagctgtaattcccatgtgtcaagggagggaagtgattggattatgggggcagtttcccccacgttgttcccataatagtgagtgaattctcaagagatctgatggttttataaatggtattttcctgtgctcacacacgctctctcttgcctgccaccgtgtaagatgtgtctgcttccccttcaaccaggattgtaagtttcctgaggcctccccagccatgcagaactgtgactcaagtatacctctttttttaaaaaaataaataaaataagttacccagttcttggtggtattctctatagcagtgtgaaaatggactaacgtactacccttttagataatccttgcagcataagacaaagaaacgatcagttcacctttggccatggactcactgtcaccagagcttgctttaacccaattctgtagttcagccagtcagaatgttggtagaaaatgcattaaatcaggaacccagaaaacaggcttctattcctggctcagctattcattgactatgattttggataaataactgtttctctctgagccttggtttacttccgtaaattggagataataatactacctacctcatggctgttgagagtcttaaatgagaccatgcctacaaggtgtttagcagggtcctcagcatatagccagtactcaaaaagtagaaacaacttaaaaagatttttatacttcattgcccatcttcattgaactggactttattttacttattgataacttacaacacgctgggagaaacgtcccggtgtttcaaagtgactgcgttaacttggaaaataagatcctatttatttccttccgagtaatagtcatcctaacatactgctcacttgtgtttgtagagtagttattttgaaatttttgagacctgaacttatgaaatgtactttcatgcatttctaaaataattgtatactagagctcttttccattgcttgacagttgttcatgagtgttccagtgagtttatagaagctaaaaagaagatgatcttctctagttacattctaagtgctgaatttttccttccttgacagattcccatccggtatcaagaggctctaaagatccctcaaatcactgttggcatttagtgccattccagcaattttgcatcttgatctttttattgattagaattttaccttccttttcaatcttttgaactctcttctgaactttgaagactcaagtgtttgaaatcttgatctgggtctgtcttaggctatacagaagagagctttaacttatgtttccaaaatgaggccactacctctttaatttttctttttaatttaatctcaatgtctgtagaagaaaagctttcacttaaagcacaaactttatgaaaagcatttttgttaaagggaaatcttaatgggaagaactgtagataacaaatttgaggaaaatgtctggcaacacagacttctgcaagtttgaggctcttggtgaaatctcaaacagtccaaatggaaaattacccagtctgtttcctcaagatagacttgtttgtacagcgactcaaagtttaaatggctgaacagtaggtacacacgctgtacttataagctgtttgtattacaatgctctgtttttaacctccttttagtttggaacacaagctggttaatgtcttagttctgtgcttcctggattattagtgaatagctaagttgtatttaataaacagaaagaaagtaacaaacaggccaataccttcactgagaaagcttctcatctctgagatttttacttctgtttgttatgcagaatattttaaaattagataatgttttatactcatgagatgaaagagttttcaaatatctgagggtttgtgagtatatccgtatttttgagagtcccagtaaaagtttctggaacttacaaaaaactcatccatgagctggccaggtcctctcaaggagcaaatcaactgaggatgacattaaaaaaaatttttttaacttgtttcaacagttgttttccgcatttccacagtaattaccatgcttaccagtaagatacaattcatctctggatcatattttatgtgttttaggcaatagcagtgatagctaacaattacactctagagttttacaaaacacttgcttatgcgttatctcatgaggtacctgacagatcttctaagtataattttatgatattccagcagatctataccagtttcactagagtatgagtaataagcatattgaatttttaaaaattgacacctgtctgaaatttttaagaacaaggccatttagaaaattagatttcaagaactctaaatacttacttatattatacaaaaatgttacagaaagtaccattaagcatggctatttctatatattcttcgatagcccacagaaatttatttaaaataattctccacaatgactaatccattacaaccaatattgttttagttctttctcatgaaaatagactactaaaattatagtctttctagttacccagtatacatatacacatatatatatgtatgtatgtatatatacacacacataccatatgtaagctggctatatatgtgtatatatatgtatatacacacacacccatatgtaagctcgatatgtatgtatgtgtttatatatgtacctatacacatagaggtacatacacatgtataaacctccatttttataaagattggtggcttataagaatacatacagtaagatagaaaatataaacaagtaaaaaatgagaattaggaaatacataaattaaagtagaaaggtaaaaatcagagaaaaagaattgaacaaaggttctaccatatggttctacatagttaataacattgagatataagtttgattctgagtttcctggcagccaaaggaaaaagagaaacgtatgattaatcatgtggttctcattacccatgagaaaatacataccagttcctcaagggaaggaagctttccctggcacttaattgtgatgtaaatttctcacgtagaacttcagcaggaggacaccgggtgatatgctaacagtcagtgctattcaagtagatagactaaaggatttggtaagatagcttcttttagggcccactaactagaaactgagaacctaatacaaaagtgtaactcaataaaagtgattctgagtgatccatgaaagtaacttgctgccaatccatcaggacttttataagagctggagaaattcacatcatgaaatttataaatcctgagaagcaggtaggtctcatagtccttggatgattttaaatatttctcacagccaaacttttgattaaagctgagccacagacagttcccattggtgttttttaagaactgatattttcttaaggactcgactttacagagtaaacaaacaggattggccttacaaggtaaaaactgaagctcctgaatataggaaaagcaagcatttacccttgtggttattttttaaagtgctttttaaaaattcctctcattatcttcccttgatagatttcctgaagatttatttaacagtataatgtctattgttatttaaagagaaatgaggtttagaatgcagagccttttttaagagagtatgaacatgctgatttagttcacctccaaacagaaatgattgacatcagattcttcctgaaagcagtttctcctgtggaaagaactttgggttcttcaaggggagtgaaatggtaggttctgtctgagccaggtcacctacaaaagcaaacaacaatgctgtttcctaaggtggttgttggcagcacttagccgctgctgacctggtaacctttcctttgagtctcatccatagctctcctctgagagagaactttcccatttacaatattacttggacacactactgttgcttaggaccaaaagggttatttacacaggggagatagtggtaggtgtgaaggtatgtgttgtgacaactgccatttacccatgcagtgggcagagtttctcttttgaccttgttcattcatagcagtgaagtgtgggctaggacctgtaacatctcctagttttaaatgctccggatgggtactctacaaaagtcttggtcatatagaacctatatggaatgcagtcatgttaagaaattgttaagctgttgatcatgatattatactgttaaacataacagtacaaaaagagggttttgttctccaaatagctaattcatagctacagttatttttttagtgtacaacctcagatttatttcatcagagagcaactgggaggtcccaggacagtgactaagtgggaatatgcagcaatgacgagtaaaagcttagtttctaagaatctcagtttttgtggaaatcccctttagactaatgatacaagagaaaacatgtggtgtgtgttgggtagatcattccccaacaggatgttttattttttgtgtttagtcttcgtccatagtaacaattataatgaatgcatcaaaaataaagcctgcagaccttgtgacctatcttgtaatcagcacaaattagttttagggcaggaaaatccagctgcatattagttttattagatgttcccaaacattttattgcaatattttggaaaaaacatccacaaacaaacctaagttttcaatgtgtttcctattcaatatgtattttgttttgaaggataattagattgtatgtttataattcctttgttcttaattcatcaaattgctgccttttgggaaaataatttcagcataggaaaattactctttttttcaccaacctgttctcagaaagggaaatgtatctttagtacacccccaactcccaaaaatgttctccacattctaaaaatgcttttaaaagttcaaaccattattcctcatttggttctaatgatattgaaatggttttttcctattttgagggtcacaattgctactgttaatctaatggctaaatgatctgtgcactgtgtctgcttttcatcttcattctctttttattggtgaggaaactgaggctcaaagcgattaagtaccttgcacaggtcaaatggcttctaagaggcagaatgtaatcattccttctctcaacattcaggaaatatttaatgagcccatactttattccagataccttggtagttgcacaggatacatcactgaataataaaatccctgcccctcaaggagcttaccttctagttgatggagacagataattaaaatatcaatgagaaaagtatctagtgcatgagatgataataagtgctatggagaaaaattaagaaagaaagaggaatagggagtccagagtagttttggtttgaaaggcaatgatggccacaaacacattgctaagaagttgacatttgaacaagacctagaaaaggtgagggagtgcgacacacagatttccttggggaagactagtgtggatggaatgaagacagcaaggtgagcaggagaaaaggaactcaggtaaaagcctggggcagttcatgcaggacagtggctgtttgacttcagcagcataagaatcacttggaagtcttattaaaacacagatctctgggcactacccttacagtttctgattcagaagtttgcattcctaacaagggtccaagtgatgccagtgccactggtccagggatcacacttgagatccactgaagctattgggaggctttggcttttcctcttaataacatgaatgccatttccaggaactgagaataggagaaacaaaatctctttatgctgttccgagtacactgtaggagacaagggcagaagaagggaaaccaactagggttctactatagtaatcaaaataagagatcagggtgacattggccgggcgcggtggctcacgcctgtaaacccagcactttaggaggccaaggtgggccagatcacttgaggccggaagttcgagaccagcctggccaacatgatgaaaccccgtgtctactgaaaatagaaaaattagctgggcatggtggcacgtgcctgtaatcccagctactcaggaggctgaggtgagagaattgcttaaacctgagaggtggaggttgcagtgagccaagatcacgccactgcactccagcctgggcaacagagcgagactccatctaaaaaagaaaaagagagagagagagagatcagggtgacatcattgagctatgctctctctccattctgagtttatttgaggttgtcctctaaagcaaaagcatactaagcattagttatgtcaacctaaaattcctttggttaaatcttcagtttaattagtgtatgaattccttttcaaagagctgcttgcccacaactttgagaaacgggtggaaaatatggggagtttatagttgggatacgtttcaaatatggctgacaaggatctgcctaggaacatggaactcatagaatatcctcaggaggcagtggggaacaggacactgagatggtccatggaagagaaacaacagttgttcttcaaattcctgccatttgatctaagatctgatttttttttttgtaggattgaagagatgaaagttcccctggtcccccaaaattttgtttatagtacatacaaatgctccctgagatacccagctgtatgaggaataaataaggaaagagaacaataacgtggcaccaccttttcctccttcctgatgtacaaaatgagggaaagtcataaacctccaattaataactgtgcaaccttgctcaagtctcttaatctcatctgaaaacaggaatagtaatagtgcttgtctcatagcaggggttaagggagggtactcatcaaatgttagctgcaactatcatgatcacaatgaaatgtaagtagatttctattctcttttcaagatggagacttactggtccctaaccaaaattcttactgtatacaaaaatagtgtagtataaagtaagtcaggggcaaaggagaaaacggtggaaatgcggtgggcatgggagtgtgaaaagcagtaaccccttaaaaggagagagaaggaaaagaagtcaggtagaaaatggagatatggtagggagcaggaatgattgatattaaggtagccagaggcaaatacaaaggggaaggaggggatgggaaggggtggcagaagagaaaaggaccagagttcctagaacctgttagcagggcagaggttaaccataagcaactcattaccatgccccccaaagcatcaggccagaacctccgttaaacacaagacggccattggctgcacctgcagaagtctctgcattttttatgaacagcagaaaacaagagaagtattagagaggttgcaagttagagactggagacacctggagactctacatagctgtggtggttttgcagtgtagacttatgaaatctgatacccccatgcagtcctgttaggcagataaactgagagcctagacattttataagcccccatgtaagcatttgaggggtaggattccttcaatgctcttccaataggatggaaacagaagggaagaccatcctgtcttcagggcttgccctcttgtttaatcctcagatggacaacattagtcccgtttaacagaagaagactctgaggcttggttagtaaaagaatatggccagaatccagacctggagcctagctccaaaggattgctttcctgttagcaagacactgtcttcttttgattttttttttttttttttttctgagacagagtctcactctgtcgcccaggccgaagtgcagtggtgtgatcttggctcagtacaagctccatctcccgagttcacaccattctcctgcatcagcctcccgagtagctgggactacaggcacacaccaccacgcccggctaatttttgttgtattttttattagagacagagtttcaccgtgttagccaggatggtctcaatctcctgacctcgtgatccgcccgccttggcctcccaaagtgctgggattacaggcgtgagccaccgcacccagccttcttttgattgttttcggagacttgtactcagcctttttgcttctctcacttctctggttctctacctgcctaccttttagccatttcacctatcatcctggagacccagattttgttctttttttttttttttttttttttttaagacagagtctcactctgtcatccaggctggagtgcagtgaagccatctctgctcacgcaacctccccctcctgggttcaagcgattcttgtgcctcagcctcccaagtagctgggactacaggcgcacaccaccatgcctggctaattttggtatttttagtagagacaaagttttgccacgttggccaggctagtctcgaactcctgacctcagatgatccaccaccttggcctcccaaagtgctgctagattttgttctcaaatagcagctgtaggatttggtgtggtattttttcccctcagctgttgtttcttgaatgctttctcttgttcacccacttcttctttaccacttaccatgattaataacaaggtacctgcaaagtaaggttttcccctgaatacttcctagatggtggaggtttttcagaagtaccacccaacctcaaaaacacatagtggtccacatactggccttggagtcctggaggagttattctataggaacagcaaatccatgcacagccaggcattgtctgtcttgacatatcagggtacggaaaactcttatgctgtaagaagagtcacactaagccaaagtttaggaaccagcctgctccagtatgccttttggaggacttttcttttctaattcaccttgccttcctctgtcacatctaacccaatactgtccatataggaaaaattcagaaagtattgggttggtgaatgcagcacagattacctatttaaattaaagctgtgtctttagggaaaaaaacttctgggggatgggagcagtggcatgagcttggaaggatttttgcattctacagcaaaccacagctgctatggccttaatgtttgtgtccccccaaaattcatatgttgaaatcctgactccatggtgatggtattcagaagtggggccttttgggagactaggtcatgaggctagaaccctcttgaatggaactagtgctcttataaagagaacacagagagctagctagcccttctgccacgtgaggatgtggacggtgtgatctatgaggaagagtgctcccactgggtaataaatccgttggtgccttgatcttgcactttctagcccccagaagtgtgagaaatagatttctgttgtttataagctactttgtttatggtgtttcgttacagcagcccaaaaggactaagagaacaccaccacccaacaccagaaaatgggatttgcttaaaccaatctgagaatcagtcacctggataagtgtgtcgagtgatccattgaatcagccagcaatgcataaagaatcatttccagtacccacatatgactgtgcttctgttttgtgttttattaagttgctctggagtaatgccactatcagtgcttccccagcacaaggaggttggcaattgagttacctgtttgtgacagctaaactttcatgaatctttaggagatccatttgctagcatcttttaaagactctggatttttctgagcattttgtgatgataactgatgcatctgaagtagaggtgggagcccttctttgtcaagagttagaaaatacaggctgtcttgtcttcctataaatgtcagttgttgttgttgttattattattgtgtcagcagtaaactgctccccagaggactaagatacagcattacagagagagcatgccttgctgtgaaaatgggtagtagaagtatgatgatattatttcgtggtaatgaatttacctttatgacagatcattatccccttctgtagctgaactggatgaaggacaagtctagcagaataacctggtagtacttggatttattggctttaaatttttaagctggaaaaatgcagtagcagccaggttatctctgtatgaatgttgcagaggaggacagagatgaaggaagtcacattttctttctagtaatggtagaaagcaggtgatgatgacagtcttttaacgaaacatgaatgcagttgctcatatgctttgccattttagtgcacaagtcaaggagtaaatgagtagaaaaaaatccataagatatcatcatcatcaataataaaaaattgcttaaggtctcattgagtgttacaccataggaaagagcaaagatttctttttaaaatgagttagacgagacttccctctcaggtgtgtataatccaggttcatgctttaaaggctatatgtgaaatagaactgttttatattagtgagctgttggggatagtaagttgcagttttgcataaaggcaaaccatggtacagtgaggatggtgcccctgtgggaagaagatgggcttggaaatcatttaggtttacatcctggctttgtccttttctagtagtgtgacctcaagcaaatcatttaaactttctgtcttagttttctcaggaagcaaagaagttagtacctaactttcagatttctttgcagctttagtttcaggtacatagtaagtcttcaataaatgatcactattgctgttcctgctgttgttattgctgttcttgtcttgattcagaagccctggtggtgatactccatgctatattccaaggagtaaccataacctaattattttgaatgactgagaaccagtgctgatgtaaagctccctaaacccagcacttctccagaagccgtaagaaatccatgccatcatttagtaacctacactgtagggctaagatctcaatccgttttccatttgcacactcatcagagtagatagagactagttgttcactatgtctgtgaatactctatagagttttccccagcttcctcctttcctccaattttccttacaaagcctttccttctttcgtctgagctctaacactttgtacgttgtagtaattttatggagcccagtgccaaacatctctatagaggggatgttgtaagggttgaatatgaagagaccctacatgtgacgtgtgtcctacgaatcttggagtcttgactccttctccagtgtcagtactcgttatctttaatttggggccagatatgagcaccccacacactttccaaaaaagcccccgatccacaaatgtatgcatgatttttccttacataagtcttttcatgtttctggacatattttatctcccttcctcctctaatactttttcccttgctttccacagtgagaaaaacaacaacaacaaaaaaaaaaacacaaaattcacacaaaggcttatgtatataaagacatggctccaggttctcatcagttcaaggagtaaaagcaaattccaaaagtatagaaatttaggtggatgtggccgggcgcagtggctaacgcctataatcccagcactctgggaggccagggtgggtggatcacgaggtcagaagtttgagagcagcctgaccaacacagtgaaaccccgtctctactaaaaatacaaaaattagctgggtgtggtggcatgcacctgtagtcccagctacttgggaggctgaggcaggagaattgcttgaacccaggaggcggaggttgcagtgagccgagattgcaccactgcactccagcctgggtgacagagtgaaacgccgtctccagaaataaataaatttaggtgaatgttaccttctccctttaattttctattttatagaatggttgcatgcaataaaagcagttgcttctcttttaactttttaataaaatggaagtctgtttttaaagccatttgctttgaatatgtaagaatacctagagtgttttaccatggtagagataatttacaaagtaagacccagttggagttgctcagttaagatgtatctcaggtgaaatgttaatcaattcaatgtttctttgtgttttgaaaatctctttagtgtgctgggccgatggccacattttctgctgtgtatatgtgatatcaaactttaacaagtctgttgcaacaaggataagacacagcagtaggaaaagaccactggagataaaggggctcaactctcttcccagtgagaactgccatgttatcttccatctgatcacattactggaagcttactactcttcaggaactcttcagcactttacccaagctccagtgaggaggcgatgctggtgcttatggggtacttggacaagtagaggctctccctcgcttgtcaaaatgcctggggaggaagcaccttctgccatttagtgtatggggggaaaaggaagagggcagtgagggatcttaaatgtctcgtaatgctctggatagacctgcctaagaaagaattaactttccccaaatgccagtcacgtcccagttaagaaaggcctgcctggttcttcagcctcatcagtgttcccagaagtcccagctccagccatcacaaaccaaacgtgccacttgccttctttcttttctcttttcctttcttcctccttcccctcccctctcatcccctcctcctgcttctccctcttttccttccttccttccttccttccttccttcctctgaatttcctgtatatcctctctgagaggccttacttagatgccacttgctctgcgcttttgttgcccctggcacacatgtgactccacctgggtggtgagcccactgtgtgctctttccactcttactcacctgtgcaagctcctgatgggcaggtcccagtctttatctctgtatccccagtactgacacagtcctggaacatagtaggcccttggtgtgttttagggaaatgaactaatgaatagtaggtatttagttagtattgcatcgcgttttctgaaagtaattttaaaaaaacacatactgtaggccaggtgcagtggctcacgcctataatcccaacactttgggaggccaaggcaggcagatcagctgaggtcggaagttcgagaccagcctgaccaacatggagaaaccccatctctactaaaaatacaaaattatccgggtttggtggcacatgcctatagtcccagctactcgagaggctgaggcaggagaatcgcttgaacccgggaggtggaggttgcggtgagccgagatcgcgacattgcactccagcctgggcaacaaaagtgaaactccgtctcaaaaaaacaaaaaacaaacaaaaaaaacatactgtagggagttcagtaaaaataaggtcaaggtttctcagcctcagcaccattgacattttgggcaggatactttggtgttctgtcacgtgcattgtcctatgtgtgggtcactgtcctgtgcgttgtaggatgttagcagcacccatggcctctactcaccaaatggcaggagcattccccagtagtaacaaccagaaatgtatccagacattgccaaatgtcacctgggggcaaatcaccccaactgacaatcatcaaattaagataaaagaagaactaacatattgaattccatttaataaacaaaatttctatatgttgtggcaccaataattcactaatccatttagtaaacacattatggaatgatcttcaaattaatgggctgtatagtcttaaccgttaatgtttgagtattctgtaagctcttaagaatttcagtattataaaataatccacccaccctttggaggcttgaagcacctccaccagtggtgaagagccctttggaatcacctttgcagtcataggctcctagaaataacatcaggagtattaggaaatggtgcccattgcattcctctcccgtggcctttactgggaactgtgctggagactgtgttatttcatcggggttggctgccaccaaagtgtggggagccatatgttagctattctgtgcagtaacacctgcactctatatcacaggcaagcttatatgcctgtaatgataagcctgcctatgtagacttgtgagtgcacagttgcagcacagttggcctgctctttgggtgtgggaagtagagttcatggaggtaaaccattgccaagcaagagatttgtactctccctcatgttttgtccatgtgaaacctttgtaagtgcagtgtccacatgcccaaggggccctcaggtaaaaacacagataacaacattgctccagggtttttctttattagaattctgtattgtctaacatgattggtaaaaccaggtgagctcctaaattgtggtttttagtgacattctataattcactgctgaccttctccccaatgttgtgacttggaaaaaaattcaaattaagacttttttttttttttgagacaggattagacaacgtggtcacccaggctggagtgaagtggcacgatcatggctcactgcagcctcaacttcccaggctcaggtgatccttctgagtagctgggactacaggtgcatgccaccatgcctagctaattgtttgtattttttatttttttattttttagagatggggtttgttatattgctcaggctggtctcaaactcctgggctcaagtgatcctcctgcctcagccttccaaagtgctgggattacaggtgtgagccaccatgcccaacttcaaattaggacttctttacaataagggttattctattcagaatctcattagatgttaaaaaaaaatcaaaccaaaacaaaaaaatactttttagtaattctgtcccacaccttttacttttaatttatattacttttaatttgttctttcccaccttttactattaatttggtgtcgctttatccttgcacatatgaacagaaatatagtaaattaagtagtaggcaaagataggccaagtcaaggatagtagtagggcaaggatagagcccagagggaagaagtagaggggaagtgtgttagcggtgacaaattgtattcagagagaatggcttcagtggtattgataaggaagaaacaaccttcccaccaggttgtttgatgaaccacactattagaccattcttgctttgctataaaggaatatctgaggctgggtaatttataaagaaaaaaggtttaattggctcactggtctgtgggctgtgcagggagcatgctgcaggcatctgctgggcttctgggaaggcctcagggagctttcactcatggcagagggtgacgcaggagcagacaggtcacatggcaggagcgggagcaagaaagagaaggggttggggaggtgacacacactttacaaccagatcttgcaagaactcactatcctgaggacaacaccaagaatatggcactgtttcattcatgagaaatctgcccccatgattcaatcacctcccaccaggccacacttccaatattggggattacagttcaacatgagatttagagggagcaacatccacactctatcagacactttccctggactgtaaagctggagttttggtttgggtaaaatctactgagtccatcatttggtgagaaaaaaaaatctatggtacttagatgtgcacatcaggaatttgtatgtacacattgattacaataatggttataatccatcatcatcttccaaacctgttctaagtgcttccgcctctggagtaggtgttcttactcgtgcaattagggaacagtgccttagttaattacattgcttcagttgaaatcccgactctaccagttactgtctgtgtgaccttagactgtgctttatctgtaaaatgaaattataatatgtaatagcacctacctcataacactttgaaaattacaggaaataacacatggcaaagctgaggagaatatctggcatgcagtgagcactcagtaaatattagctcgtatcactttattgttattgttattcttacaaccacaaaaaaactgtgtcactttcctgcacttcacgtcactaatcctgctggtctttgatgacttgtataggccatcactgcttccacaaagccttccctagccctttcactagtttaatgcccccctctgtgccctcagagcctgcttccactaccagagcccttaccacattgtattgtaatgcttcctctgttggcctgcctcccctactggactgcaaggacctgaaggtcaaagaggtacactctaatgcctaccatagtacctgaagcagagaagatattcaacaaaggtttcttgggtaaattattgaaagtttaattaacttgcttaaggtcacaaagctagtaattgagtgaaacccatgtctgacttataaaagtaaataataagctataagaaaaatattcctctaataatgataatgcactaaattatgattccacctgattattacttacagaatactctcaaaattacttgaaaccttccaaattttggctctatcatctcttcaaacctctgtctgacaatggtactcactttatactctgcctccaacatatacacttgacttcctatccatagggttatccttgttgccccccataaatttgacttgcactttcatctcctctcaagcagtcatcagtatttattgaggcctacattgcagcgacctgtgatgctctaaggatacagaaatgatatcagaaggtggtgacatttgaactggatcttcctggtgtgaatcaagccttccccactagctgttctttgaaagaagttttgactaatctgtgagcccttgatgacacgaaatattttgatatatgttctgagttcactgttcgtatttgtttataggttggcatcaatagatatttgttgaatgaataaatcaggctgtagagaaacattttaggtttataattaaagcacctgaaacaaaaaaaaacactacatttagcttctctctaacccttttaatggtagttggaacatcagaaattagccattgagcttactgactctttttctaacgatttactgtataagagagcagaatgctattggcttcaccagctgtggccagaagggctccatgttcaaattagctacaaatcatgtcccttatggcattgttgctaatggtgacactgagggtcagaaatgcctacggtagtgaaaaatatttcaagtgcccctgacagttaacatctgacaagaaagtgcttttctctgtgtgggttttcgagggagtaaatgaaattgaactcgcatacatatatgtttgtgtatacatgcataaacatggtactttgcatctggtctgtgactacgctgcaaccttgggagatttgatcgattttctgatgttagaggtaggaatttaactaagggagtattctttggtaatcgcaaagcagaaggacttccatgcaacctggtactgggtagcagccattggctcttaattttgtaaaaatgacagatattcaataaagtatcagaatgattagagggaaaaatattagagctggaggagctgccctacttctgaacaagcagttgaaacaaaggcactcattggaattcatggttggttgacattatgtagcctgttgttgcttaattttgtttcctgtatattttcagggttgtgttcatttggttttagcaataaggacgggtcattttggtgctgtgtctttttagttcacctgcatccttgagttgagagcagagaacagaatgcatatttattttcaatttttacatgttatttcgtatttccatagagtctgtggacttttaggtacaatgatgctgtcgtgaacaaataagatgctgtctgaatgttcctgagagctttagtgcagtgaacacaccttctcagcaacaacaaaaggagatcagggaggcttggccaatgtactctctcgtccacatacggactgataagccaatcttcaaaatcaagattcttccagaaagtccaaattgtcgagtttatatttatagaccacatgtctgagagtctcctcccaacccccctcaaccaaagatagtagtttagatataacagtttttaaaatcaagttctcactataaaatctgagttagatacttgggtaagggtgaggagtagagggtatggctgaggaagaaggggcatttcaaaagaattgtaataatcagtccctgaccttataagagtttatattctaattacagagaatataagtcagacagctcaacagtggcaagatcacatagtactaaatacctgctgaggtcttaaggcagtgtttatacactggagggtattttcctccagggaccatatggctctccttaagggtattcaaaaatgtgtgagggcatttttggtgctcacaaggaggggatgttgctggcattcagtggtgcaggccagggatgctgagcatcctgaggggacagggcagttctaaacactggaactgattcccctccgaatgctgataaccctgatgagaaacattgtagtggttccgagaagaacaagagcgctcttacttggagccgagtctgagatgtcctcaacacgttctgtgagtcaaaggttatgttccctaaaatcaaggaagtggcctggatcataaagtgcttcaatgatcaaagtcagtcaagtgaaatgtgtcgatcattctcctgcctaaaaggccaaattctttcagcattgatttaaagctataaggaatcaagaccctttctttaatgatgctttctgatgattctccatttgtattgacggaaggagctaaagtgtggaggctctgcactagagggtagtttattttaaaaagttatttctgcatttagtgttaatattaattgcttattttatatgcctttttataccatctgaagtactttcacatctaaaaaaatttaaataactttttttcaaaaaaatactgaaaaataaaatcagatttctaaattaaataaattaaattcagtttcctagagcaggcagcatggcatatttagttatcaacaggaattttcagcaaacgaaagtcttttaaaaaataaagtgaaactggaaaaaggaggccatttttaattctttctctatatacttctgtacattatttatgaaaaagtagataaaacttgatctcctgcaagtaagattgacctaacgtccatttctagagtattagtagtcatcatcccaaaaatataagaccaaaatttgtatccttatgtctagaataatgcttggcctctatagatattcaatatgtatttaaagaagagatggtgatttatatttgaaaatatttgaggaattataaacaattattttcataaacacacaaatatatatactaatatgattatatttaggaattagatttctaacatttaaaatagcttagagactaagtactgttatttctcactttttgtagaaaaatcaaaaaattctagagaatttatttttaataatttgttactagctttagaaaataatttttttactcaaaaattcacttaaataaaattacattatctacattttgatttttatagacaacttttataagaatacttgcattatttaacattccatgtgaaaagaatgtggttatttcttaattttttctgttaaaaattccctgtatgattgaagatctaagatataaagattatgtttgttatttataacagttatcattttttgaacacattctgtgttctaggttctttgctaagcattttaagtgtactatttcattattcctaatgacaaacttatgaagtaagtataatcattagtgtcattttacaggtgtggaaattgaggcttaggattttggaattataatttctgtaatactgcccctcctactttattgtaaataaataatatcttggaaatatgatttttgaaagatgaatgaacattttgccatatagatccctttacaagagaaaagacaagtacattgcaaattcaccccgattcatatttagccctgagtatttgtttttttcagatcacaaacaactaaaaactatgaaacttactatgtttgataattacatattttacattagatatataacttacttaagttcaaaactaagtctggagaaggtggataaataagtcaaaattaacttcattttaagggaagttttacaagcaatggtaataagtcgctgaggagaatggaccccggcatgttggaatccgtggttgcaagctgacactttgagggaatgttcttagcaaaacactcacttcaacggaaattaggtcagccttctggaacatttatcatgtatacctgtcaccagcaagacccagtccttaaagtgaattgagatcacaagcaatggtccctcctgctctgagctgcaaaggacactctaaaccaatagttctacaaatatgtgagcttggcagacgctcccatgaaactaaagccaacacccatatagttgctctgggaattgaattccttaatgctttgtttatagaattttgaaacagcaaatggatttggtctgttctgaaaaaacaatctgtcctgtggcttgtttggaataacatctagagttgctatagaaggatggaggcagatgacccatgtctgatttggaagacagtttcgccagtttcttctccttgtcctttattgttcagccaggttggtttttgcccgactcaaggtatttgcatagaggaaaggccaccttctaccgaagctaatttgatatagaaactagagtagttagcaaaatccagagctaaaagagttagcaaaatccagagtaatagaaggtaagatagagtgtatggtaaaaccaaaacaacgtaaatgagtcataacccagtgccctttcagtaatcatatggcatcattctggtggtttcagagcagtgtcagcaagtatggagtcctgtgtaggaatctgagagtgcatctgtgtcagtgtacatgtacttcagcccagtgaatataattcattgagggttttatgcatggaaattaccacattcaccaggtagcctgtatctactggactaagttaccttgccttggaaaggaagtaattactaatctttctcttgtgtttatgtttggcaaactacacctaaagacttcactaaaaaattggtaaaatatatatgaagctggttgaaaaaaagatgaaattatacatatgtttgtgtagtagcaggaatcttccattacatctcaagaatgaaaggaaaaaactattaagaatagatgtttcatttctgtgttcattcatcacagatatactgagtacccaccatatgtcatacattgtacaaatggtagaatcagaaagatgagagaagtaagatccccactttaactgagtccttattcaagctgtgtgtctgtgtgtgtctgtctgtttgcgagtgacagatccttaaacaaaaaataatgataacctatgtgaaatgccccagtagaggttattttaaaactcaaggagagaactctataacttaaagatattttgtctacaaaaaggagcgaaggttttattcgaagaaagaggagcctgttttatatgaaaatcctgaagatttgaaggggctgaagaagtagaatggatatggaagaaatccaccaatgatttcttcctggaagaattaaacacacacacacacacacacacacacacacacacacacacacacaccaactttcatgatcacactctattaagccaggaccaggaaacaatttctaatcagcactctgatctgggcagagattgtgcagtcttttataccaggcctcagatctgtgttctctattcacacatgctcacttccagctgttgtcattgaaatctcacataatcttccaaggtcaaagggcagtcacccatggctgctgcagttaaaaggttatgctgatttctgttgtcaaatattggcccttttctcttccaaccactcccattctacttcttttttttttttaaacaagaaaaatccagcctagaattgcattacatgactttaaagtcttaaaagtgttcctccattgtgctaacacgacatggcctgaacagtctaattcattctgttacatttcacaaagaattttctggtacttctaaaatactttgtgctaggccagcaaacttcaaagtattgtgacccacatgattgtggcctgccatagtatctgcagaagtgaataatacaggttccacaatttaataaacatggtgaattttggcatcgataactaattactgggtaaatgagcaagaattacacaaaaaatgacttttgaaaagatgaaagctctttgcattttgtggttctaaacattagctagttttattttatatttggagacgtatataatagtacatttaatatttggagtcttagaaaagtaattgtaaggatttttaaaaaatattattgcttcactccatccaggattttctttccatgcttggtgaaccaaaatcagtgttgagtatcttaaaattagcacatggcccctggctatctactttcattatcattgcatgtgtcctcaggtggtttagcaagcaggattctctgtaaatggtctgtctcacagccctgtgtataaaacctaaaaaggaagaaaagggagatgggccattacgattttttgctgtttaacgtccatgaaccagggtagccctcaggtgatccagtttcatgtctgtttcacttaagataatcagtttctgatgtattcagggaatacatttccctgttttttccctagtatatgtaaaagttcataagcagaaactaaagctattacaaatagcttgattcatttgcaaattaccagttgttactgtccaagtttagaggaaactttgatgcagaacataaaaacaataagtttgctttttaaaaaacctctttaattcaaaaccgggttaattaaaaaatgttaatttatagtgcattaaaaccataaaattaattttaaaatattaagcttataaaatactgatactatgctaattacagaagaccttagcttttctaatatgatgcaaaattctctgttttttaaaatggtgctaaagtaagtgtttaaatttttaaaataatccctaaagattatttttgtttctctgttcttgtacaagtctaaattttcagttgagtccgcttgcaaaacaactgtttcagcttttaagactaataaatgcataattctaaatgtttcggggaaatggggaaaataatttgttgacatgacgagagagagaaagggagggaggaaggaaggaaaggaagggaaggaaggaaggaaggaaggacggaaggatatttagcctggaagagagaaaattaggttgatgagatgtcttcagatatttgaaggatagtagaaataaagagagccaacatttgttctgcctataccagaggacaaaatctaggtaaattacaagttataggaaggtagacatattcagggaaatatgatttttttaacccctcatttttttattaaccacaatttttttgttgcaacatgacgattattactccactactagatgaactttaaggtcccttccatatccagttcattgtgtgatgccatggatctgatatttgcaaagatacaaataggtaaaaatcttttttcacttttatttttagatattttgatatctaatagacatagtcctttaattgctcaatcacttggaacttaaaactcatgaactttctttctatgaagtcattgggcaatcacatttagtttaattaaatgctacccttcctttattaactgcaggaattggtgaaaagatgtgacaaggcctttggattagactgggtaattaagtctctgatgctaaaaatcatggattaaaatgggataaaattcattatataaagagtggtaaatatacctgtgttctaatcctaattttgccactatctgtgtgacattaagcaagtcacttaacttctcatgtctagtttaaaagcattcctttgcagattaataatacatactgtactagcaaaatatgtttgtagactggaattggcctgagggctgctaagttgtgacacgttagattcaaaagggataagttagtagttatgtgggttagggtaagtgcttagctactataacaaagcaaccaataaaacgcaaaaacatacagtagttaatgtatattgaaatctatttttctttctgttaatattcccagatgagcagcctaagttggcaggatggttctactccacagtgtcattcagggtcccaggttccttctgtcttactgctctgctattccacgggtgtgtgcctgcatggtagaaagtgttttcgctcataaaaaggggtagagacaatgttcagggcaagaatttcctttcaggtacgtgggggtagaagttgattgtatcacttgcgttcactttctggttgtggccactcctaactgtaaggcagtctggaaagtgtgctttctggctatcaaccacgtatatgtgtgacaaacagcagactcatcacaggaagatattgcagtagtctttattagtttctaatgttctcctagaaaggtattacaaaaacatgaattttatataaatacattactgaaaatcttgctgtaaatatctgccttgactggggacataagtccccaagagtaaggaccttgtgttattttacctgttgcatcccaggtcctaggattgtggttgccatgtaatagacattaagtaaacatttattgaatggaagcagtaaattaaatattgactctgtctctatggctatggcagaaatcattgagtgagcaatgatggcaaaaacaaacaaaaaaacacagattaggtgtctgtattgagtaacagtaaatgagcagcacagggaaatttggagccacaaaagaaggccaacagtgtgtaagtcccatgacacatacttctcaaacctctttttgccccattcttcttttggtctaagagtacattatttccataatggtgacaatttcttaatgtgtcatgataaaccaaaatgacaatcatacccatgttacaaatgcatttaaagcaatccatgtattcatctgagaatctcaaaacacctcatccatattattagctgacaaacatttctgcattttgcaaattctcaggcacaactttctagatatagaagtgtttcagccttactgtcagtccaacaccatatgtcaaccttttaatgtttaccataagcacactaccaagtgaatttttctccactatcataaaggttaatctcacaaacagaatatatatgtacttttattgctcctgtgttcttttttagatatctgaatttttgcatttctttaaactataaggaattattctaaaaataagccgtatctcaaatgtcaccaatgagtggcagaacaatttaaatagtcactatacagtcagaaatcagaccagaaatttaaaatttggcattaatggatcagcagaaacatccctgcacctgactcctcaaaaggaaaaactgttttccaagataatctaaattaagagtacagaagtaatatcactgtaggtgagctaacaaaaatttacatcacgctttagaggactaccaaataacagtatcataagtcactcatctgaatcactaaataaatatttattacacacctagaataaaggcttatgctgggccctgtggacaatgtgagataatgagacccaaccctcccctccccggtttgttgtaggagtgcagagataatacatataaacaaataactgtccagtcaggtagaaagaggcaagtgccgtaagacaagcagagaagttctccttaattgaatagtgtctcctgagcacacctaaaatgttctgtgttggggtgagagggaagattaacgagccacattcccacaggtggctcataagccagtggggaattcacagaaggagaaattaaaattccaaggagggagtctggttgatgaggtaaacttttctttagaaggatgagaatgtaggttccctgagagcagtgtccccagggactagcacagacctgcacagcacaggcagtccaaaatccttctggaatataaacagcgtgagaaggagggagcttttcccgtcaagtggccaaggcacaccagcatggagaagcctggtaatcattggcctgtcttgttattagggatggaaccctatttaccaaaggaagactagaatagagatgagttctttttgatgaaatgactggggtattgcagtttgcctacatcccttaaccagacgagatttgatcatttagagctgacagccccttgatattccagcagagaaaacaaaaataccatcttggatataaactttccttctcagatgcaaaattaactctgtttcttggacctgaaaactttctttagtggtcagcctcctgtgtggtttgttcccaggtgtctctggccttgacctctgaacagctcttcaaggttacctgtctctcttcaaatcttaactttgttcctctcctgcctgctaaaaggcggatagatgttcagttcctccatgaaatgagatttagttcccatgtaatggcattttccataataactgctgatatcatcaaggtaaagagagctgcttctcctaactacccatgaaagaatttagctttttatatttctacctctcccatatagtttaatctctccccactgcgagtatgactgactccaaggtattgaagtctgtgctctaattgggaattcaatgaacaagacttcagtgaatgaacttttttagccatattatataaaatgaaaaaggatctgctcctcatttcaatctcctgtacaattgctcctgaacagtagtacagaattgtagagatagcacattgtgcaacctggctttttatctgagacatacttaatgaaagcacatgttttgcactttttttctgagaggccctattcaaaatgtaaatcttgggaccttttgggagtgtttaatgtgctttccaatggaggatctttcaatattaataatatctgaatttggaatcgcttaaactcacctttttattttcttttccacttttttcttactttgcagtaaagtggaacaatcagattagtgtcatttccctgcaagtcatttttaagatttggtttgtgttcatgagaatgaaatattaattcactcaggtttgcttagtagttgtgttagcaatatcactttttccatcatttcttaggtttcatttctcattgctgtcttcttacaaagttcatcagtgggtttccaagcaattggtaaaggaacaagagcagtttcatcaccatttaaagttacatggagtgtttacacagacctttccatggggacatattataaacataatctagccaaggctgtctgataatactgtgtgaagagatggttacatcaaaacctgccaaagaaggctaggcgtggtggctcacgcctgtaatcccagcactttgggaggccaaggcaggcggatcatgaggtcaggagatcgagaccatcctggctaacacagtgaaaccccatctctactaaaaatacaaaaaattagcagggcgtggtggcaggcgcctgtggttccagctacttgggaggctgaggcaggagaatggcatgaaagataatggcatgaaacccagaggcggagcttgcagtgagccgaaatggcgccgctgcactccagcctgggagacagagctagactctgtctcaaaaaaaaaaaaaaaaaaaaaaatctgccaaagaattatactctttatttttgtgattatagtgcattcacatatgttttaccttctaaattgcacacattccactaaggtaagccttgggaggcaagttgctggtagggaaaagggatgaaattgttatttttgcagtgactttctcaggatcacacaagatcttcttttaagcttgggactagatcctttttgggtggagggagctttatggccatgatggacaatgctactgccctttaactctatttttacttgaactttaaaaatatgaaccataaagggaacaataagacaatccccaggcatttatcatcagaaacgcctgaatcaatctgaccagaagcttcattgcctgtcctgtcctgatcctgtttagtttggagggaatatgtggatggttcattttcatagtttcccagtacagactgactcagttttagttaaactatattgctggaaatgagagaaagagacagaaataagaagttctgccaatgattttaccaagaggaaaaatgacataggtgagcccagtttgagtttcattcactctgaggcatctcaggaacactgaccccatcaggcagtgtgtcaagacctggagggccagaggcacagaagatacttcccctcctcagagggcttacagtctaatgtgagaaaaagacaaagttacaatcacgtacggcaggtcccaggtgagaaatatagagtataactggtcagtattcagaagggagaaaaaaagtgttccccagtggtgggggcagccagggaagacttttgtgagaggtgacaacaaagctgagttctaaaagacactttaggaggtggttaagctaggagtaggaagaacagatgtttcaggaagaaggagctgtatcaggggatggcagtgaagcagtgcaacgaggagcttgcagttcacttaggtcaagggtagggccagaagtgagagagaataaacaagaggctatatctaggtcccatgccatggaaaggagttagtactgtactctgaacgttctgtggggctcttgcaagcattctttctttttaaaagaaaaaaaaatatatatatatgatatgtatatatctactattatgatatgtatatatctacttatatataaatatatatttattatatattttttcattttaatagtttcccagtgcagatcagctcagttttagtttaaactatattgctgcaaatgagacagagagacagaaataagaagttctgtcaaagttttacagtatatataaaaatatatatttacatatatatatttcatttcagtgacctttggggtaaaagtgatttttgggtacatggatgaattgtacagtggtgaagtctgagatttcagtgcatccctcacccaagtagtgtaacttgtacccaatatgtaggcatttttttaatccgtcactccctacacagccgccccctcctgagtctctgcggtccattatatcactctgtatacgtctgcacacccatagcttaacttccacttgtaagtgagaacatgacggtatttagttttccattcctgagttacttcacttagaataatggcctctggctccatccacgttgctgcaaaatacattattttgttcttttttatggctgagtagtattccatggtatatatatataccatattttctttatccgctccttggccaatgggcatttaggttggttccacatctttgcaaatgtgatttgtgtggcagtaaacatacacatacagttgtctttttgatatattgacttcttttcctttgagtaggtaccaagtagtgggattgctggatcaagtggtagatctactttgagttctttaagaaatctccatactgtttcacatagagatggtacttattcttaccagcagtatataagcatacccttttcaccacatccatgccaatatctattattttttttttactttttattaatggccattcttgtagaagtaaggtggcatctcattatagttctaatttgcatttccctgatgattagtgatgttgggcattttttcatgtttgttggccatttgtctatcttcttttgaaaaatgtctgatcatatcatttgcctactttttgctgggatttttttttttcttgttgatttatttgagttccttgtcaattctggatactagttctttgttgtatgcatatttcttgtaaactttctgatagggcagggggctcagaacacattggatttgtctcagtgtctccaacatcttgctctttcctgcctcagggcctttgctcatgttaatcctctgcctgaagagctctttcttcttttcctatttggctccttcgtatctttcagatatcagctcttaaacaagacctgccctggccaccctttctaaagcttttgatatttttctccttcatatcatttattttatatatatatatttttttcgagacggaatttcgctcttattgcccaagctggagtgcaatggcacgatctcggctcaccacaacctacgcttccccgttcaagtgattctcctgcctcagccctcccgagtagctgggattacaggcaagcgccaccatgcccggctaattttgtatttttagtagagacaggatttctctgttagtcaggctggtctctaactcccgacctcaggtgatttgcctgcctcggcctcccaaagtgctgggattacaggcataaaccaccgcacccggcctataattttttttttttttttttgagacggatcttgctctgtcacccaggctggagtgcagtggcgcaatctcagctcactgcaacctttgcctcttgggttcaaatgattctcctgcctcagcttcctgaatagctgggattacaggtacacgtcactacagccggctaatttttgtatttttagtagagacagggtttcaccatgttggccaggctggtcttgaactcctgacctcaaacgatctgcctgctttggccttccaaagtgctgggattacaggcatgagccaccgcacccagcctccatttataatttttttctttttttcttttttttttttttttgagatggagtctcactcggtcgcccaggctggagtgcagtggcgcgatcttggctcgctgcaacctccgcctcccaggttcaagctgttctcctgcctcagcctcctgagtagctgggattacaagcgtgcgccaccatgcctagctaattttttttatttttagtagagatgggttttaccgtattagccaggatggtcttgatttcctgaccttgtgatctgcccacctcagcctcccaaagtgctgggattacaggtgggagccactgcccccggcctgagccaccatacctggcctatcatttttaaagtaatttttttttttttttttttgagacagagtcttgctctgtcacccatgctagaatacagtggcacgatctcggctcactgcaacctctgcctcccgggttcaagtgattctcctgcctcagcctcctgagtagctgggattacaggcgctcgccaccatgcccagctagtttttgtattttcagtagagacgggtttcactatgttggccaagctggtcttgaactcctgaccttgtgatctacccaaagggctgggattacaggtgtgagccacagtgccctgccgtaattttttttacatgtttttagctgtttctgtaaactccctgaaggtgggaactgtatcttgtgcccctagcatgatgcatggcacatagtaggtactccgtagacatttattgaataaatgagtaactcatcagatttgcatatctgtcagacagccctggctaaagggtggagaggggattggagagcaagccaagagagatgatagacagcacagttaggaggctttcccaccatgctggtgaagagggaaggtcctgagccacagtcgcaggagggtgatggagacatacatagagtcaggaatcacagaagcggtggggactggttggatgtgggtgattgtcagaggcaggagtcagggatgatgccaaaaaactagatgagtggccgatggttcattgaaatatggaattcaaaagagtaagaacgggttttgggtgcagtagaaaatggattcggctttgcgcatgttggttctaagaatacctgtgggctatctggatggaatgcccaacaaatacttagatttatgggtttggaacccaggagatagatctcagtaaatgataaagagttgagagtcattggcctgtagattcattcatctactcattcagtaaatattcacttactaacgtgctttgtctcaggcattaagtatacagtggtaaattaaaacattattttagttttcacaaatatcacagtctagactgctagttgatgacatggaggtagataaaataacttaggaaatagatacaccccccccacacacacacacacacgcacacatctgcacacacatacagggagagatgagcacagaccctggagaacaccaacatttaagaggtggacacaagaaaagggggcaaccaggagagggtggtaatttgaatgaatgaacgcaagggtcttcccaattcccaagtccttgcacctaaatcaccctagcctttaaaatatattgcttgcttttttggtggcaggattaaattgccttgtgtttacattcacgctatacagaaattcatgttagttcatccttaaaatgaggaatttcaaagattggaactgaaacaagtatcagcctgtaagtcaagtaaagaaggtagggatgagcaagagctggagatcaacccagattttcctattcatctatgaatttccttgttattgttctatgtgttttaagtcaaccttaatgtacattgtggttagatttcctttgctgtgatctgtgggataaatgtaatgttgatggtctccctataagaaagagatgttgtggtctgttttgccaagacctcattagagaattttatttatttattaattttttaacttctcagttctcttaatctaagagacagcatcttaggtgcttaccaaagccaattgaatacctgggtgtgggtggttttgagaggtgaaatttcttgagcactttgatggtaaaattttgccattttatttcaaaaagccatttacaattattgtctatcctaaaacttggaactgtttcatctcaaataccatagattatgtgtttgatataaaagttaactgaaatttaaaaaaatctcagtagaaatttcttatgcaaaaatccagtgtaacctaaaaaagacaagtaacttgcaggtccatttatactcctccaaaacatggcaactttttgcatgtgtttatgtgtatgacatttagtaaatttattggtggatatgcagtgccacaggtaaatttgctttccctcagtattgtatgaaatctagcttttattaataacaaattttgtttatggattgttatatattcagattggtctattttcttttattgcattttctcaaggtatgtttcttatgtcaaagaacaattatttcaaaaatcccttcggccaacaattttttgacccagattttaaagcagggaaagactaagctgaccttggagtgatctctcaactagactctacctgtgtgagagtcatagaatcagaaaattttagaggtagagtgggaaactacataccatagattatgtgttccttgtcatttataagttctatgtttctgaatgcatcataaaattaaatgagtagttggtgatcgacataataccaggtgtcttaaagggaattaattgcatccagcaaaaatgaagcagaaacaaagttcgaagattaatcactttttgaaccattgatttattatcttttctcaaaaaaatcaacagacacaaaaaaaaatttggggtgtataaataatctgaatttttatttgtgctcaaaagaatttgttttcctgttttgtgagttggggcttgctttttctattttgactttttaaaaattcaccctgtggtgcctctagaaaagaacacctttaaatcttgtttgagttaaatgaatagataactaattccaatcaaatgtttctttagagaataatgtttaaaaaactatgatggaatgcagctctcctagtgattcttagatatgctgtttttatcccaattgttaaggtcttagaggtcacccaaggtaactatttattgtaaattgtcttttgtttcatatttccggttgaattttttttaaccatttcaaaaatcagctagttgttgtaccatagctttgcacaaccttgaaattcaaaccaaaaatctatctgcttagctaaatgactgtgccctcccacataaaccccaaggagagcagagaatgagattaggcaccacatgtgttaatcataatgaaactaatatttaaagctctgttgtcaaatgtcttgtatttatgacactttgttttcttttgtttttgtttccccaggacatttgggcttccaggacagttttgtcacatcaggtgtttttagtgtcactgagctagtaagagtgtcacagagtaagtataattttgctttgatttggtacagatttgccttggtttgtgcttactttctgcctaggactcctagagaccaaaaaaagctttcagaatctccttttcattcacccattggaagaattttgacacacagtttgtttgacaaccaagaatttaaatcaggaaaaattaaatattattttgatgtgaggcataaaagaaagaccaaaatcctgagggtctcatatattctgaggcttccctgatttctaagaaattctgcattttaaaagaatttgtttttgacctttaaaaaatgctaatgccctcagtatgagtgacacagtctgggatgatcattaccagtttgtcaataatcactaacagtgaatgaagagtacctgtcaccatcttgctccattgatcaaaggcccattcaattgattgtagttttgttatgacataatctagcatgcacgcacacacacacacacacacatacacacacacacacacacacacatacacagttgccttcccttaggaatctgttttttcttatttaaaagcacaaatacaatgattatgatgttccaggtcccagtaagaagaaggaaaaataaataccaaatattaaaattttattttgttttactcctccaactacttcaaaataccacttgtaggtaaaatttacatggttaaaattggttttgagcagcatcagccctttgtggaatgagctggagtaaaaagaaacattttcatttcaggttcataccccccattcactgtgttacaggcttgcaagattgactgagtaagccagtccatctcagggcatgacgtcaggtcaaacaagtcaagccatcctggtcccaaaatcctggattttgtctgttcttattttagccactcataggctaggagagtcttgagagcacagaatgtgatacacagtgtgggaacaggggagaatctaatgactactgttcatttactgtctgccaggcactgtcgtaggccttagtgtaaggtacataagttaatccttgcaataagcttttcagacaagaaattaccccatttttaaagatgagttaaattgagggtctatataagttatttatccaaagtcaaacagtgaggccaggcacggtggctcacgcttgtaatcccagcactttgagaggccgaggcaggtggatcacttgaggtcaggagtttgagaccagcctggccaacatggtgaaaccccgtctcgactaaaaatacaaaaagattagctgggcatggtggtgcacgcctatggccccagctactcaggaggctgaggcaggacaattgctcgaacccggagggtggaggttgcagtgagctgagatcacactaccacactccagcctgggcgacagagtgagactccatctcaaaaaacaaaccaacaaaaaattcaaatagcggataaatcgttaagctaagtctctataatgccagtatccgtactcttagactggcccaaaggaacttgaagagatctatagcatgagactagacagggaaacagtgggaaggtaactgtcggggttagaattgtgggagtcaaggactcccaggttgatgctgaggtattccagtgtagaagagttggaaccctaagaaatgagacattaggagcagcaggtcataacttggaagagagaggttgctgccatggtattgaagcgtacttaaagtaccaaccggttaagtagacactacattgccttgttaagctggagaggatatgctcccctagttatagcacagctgattaggcagttatttgccatagacaaataacagtgcatctgtatatatcttttttttttaacttcttaggacttttgaacacaataaatatctcacattttcttgtaattttaataataaccgtaatatggggagtatttgtgtgtgtgtatatatgtgtgtgtgtgtgtgtgtgtatatatatatatatatatatatatatatatatatatatatatatatatatatatatgtatcagaccataccagtcatagtagcattataggaaaatacattcattgagccctcactgggatctaaaacatagccttaaagagtgaaatgaaaatccttttaagcgtaagattggagcactagccattttattctgccctggatgctgcaattcttacatttagtcctcattaccatcagccttcccaggcctgggggttgtatgagaaggcccacacagtacagaatcacccccagcctctcctcctccttccactccctgtctttccttttaaggtcttatatcccaaagcttatcagttccaagtttgagtagaactctggtcagtctaagatagcttggctgccaaatgaattctaaacctgccttcaagactgccagagattatggctgaacagggattgagtttgcagagggacctggacttgtttcctgtccctgcttagggggttgcttagccagtgcctggcatcatgaacatcctttggctctcaaatgctttttgattctgcacactgctgtgtaatcgctctgggactcactcacacatggcctcgtgctgacggaaactgtttggcaagagtgggtctgggctgtgtcagctcgatcatggcttcaggccaaactagtcgactgtagtcaggagacccctttttcttagagataatctaggtttgtcggggtatatttcacaagattaccttggctgcctgggtaaggatccccagctcaggtttcgtcacctacgcaccctcctgaaaggcttaacactcaagccgcatgctggagttgaaatccctcagcattgccttgcaaggctgccctcttccttgttcccccatgtgggaaaagagaagcaaccgtttcagaactatggtggatgctttttgcagatgagtggacctggggtgcattctgtatcctcgaatagaaataagctaactggccaggcgcggtggctcatgcctgtaatcccagcactttgggaggccaaggcgggtggatcacctgaggttgggagttcgagaccagcctggccaacatggagaaaccccatctctactaaaaatacaaaattagccaggtgtggtgtcgggcgcctgtaatcccacctactcgggaggctgaggcaggagaatcgcttgaacccgggagacggaggttgcagtgagctgagatcatgccattgcactccaggctgggtgacaagggcgagactccatctcaaaaaaaaaaagaaataagctaactggcacaaaaggtgattaaacacatgatgttagccctgttaggagtgtgatgtcatataatatgaaaaattagagtagctagcatttatcaagcatataccatgtaccaggcattgtgctgggtactttgtaagcattatctcattcaatcctcccatggttggtgttactgtccctttttatagatggagtctgtgatgctccaagaggttaagcaacttgctctttttcctttattctactcagctagctgactgcctaccttttcatcaaaacctctcctataattgcattatagaactaaatagaatccaaggattctgtgcttttattgaataatcagttcttgttgatttgatacacttttagcttattaatttgtgcattaaaaaaaggttaaaactattttcatgtaaaccaaagcaagtaagatacttaattaattttttttcctggatttgtttttaggtgtgagtttgtttttaattaacagactttattcttttttagggcagttttttaggtttacagttttaggttaacagaaagtacagaagtcccgtatacccctcctccaaaacagtttcccctattgttaacatcgtttgttagtgtggtacatttgttaaaattcatgagccagtattgacgcataattaataattaaagtccacagtttaccttagggttcactcttgtacattctgtgggttttgacaaatgcatagtgatgggtagctactattatggtatcatatggaatagttttactgccctaaatatctcctgttctccacctattcattacctcccactccccaccactgatctttttactctctccatagttatgcctttcacttagatgtttttgatggtctcagtgtcctacaatctctgactgttttgcagatttcttcttaaccttctgttatctatcccagccccatccagtcccctgcaattatacctaattatgactacttacatgggctgaaaatttcacagtcatcattaatgatggcttaggttgagatttttctccctttctggatctttagtattcgatttttaaatttgctaatacaaatatttacttacactaggtttccagttagtttttgtttttcattttcttccttttaaatgtaagagaggagggaggtgctatttcagtatttcctcatgtggattcactgaaataactatgtcctaagtgtgttgtttttaatagcgttactaccaaggtggcaatggcagagaaactcaggagaaagctgctggcttagcctcacaaattcagaggtgagggatgaggcaacaaggatgcttgccattgaattatactgatcagatacatgaacctgttggaatcagggactcctgctggccaactgaagctgcaatcttccgtgaactcccctttcctccttgcctcctgcctaccaccttttaattttttttttcattatcatctaaagtccacgaaaggcaagaatggaaagttctgcttccatggcaaagaaaatactgtagcataaaaatctatatttgttctcttgctagtttttcccccatgtggtaggaccatctgaaagtagctcaattatttattgccttgttccaggggaggaggaaaatacagaccactagatgctgtgccagagagagagagagaagtattctctgctttggggaagggggttttacaagtgttaacaatgtggttcagaatcactaaagttgttttagcataatactatgaggaaagagacaagaaccatctgttgaaatggctcttacatgatgctgcattttcaaacaaagccttctcaaggcatttttagattggtctctttcccttgaagttgctacaaagagagcccactctactagctgctaagtgatgctgcttagatagctctctctgtcagcacccactcttttgtttattttgcgctagtgttttcctcaaagtatgagtgctaaggctgtcaaatatcactcctggtaggaacccagaaagttctcctgaaaaatccactacttctgcccatttccttccaaattgctgactctattttacttgaagttggtggagtgacttcgaaaccctaactacttcactgggaaagaggaaaaccgcaaatacacacaggccattgtgactctggcctggtgggctctaattttctagcggcggtttgtacacccaagccggctgcaagggttaagtaaacttcgtggctaaggatgacttcatggccctggaattttgaaaagccaggattctcagtacactgtggccagccttagagtctttgggtgtgaaaaccactctcagttacccggactgatttttggttcctgttgcagtgctgcagaatctattaaaatccggcagctgaattgtcctggctctgccacaaagctcagctgccgggtccactacaggattcctgagttgtttgtcaatggagagtgggagtgaatggaaccaggcatatgcctcagcctggcatgaggtggcaccctagtggctgttttctgccttagaaatgtgcgctctttctatattttcacacaggaattgtcattaacatccaaattgcagttcatttctaaagttctttttgaagtctctgggtccttgttacgttttcaagtacccatattcagatgcttagattttcaggctagtaatttagtaagaactattggcaatattctaacctgacatggtggaacttctaagacagaatgaactcggctacaaggcacaacaagaaaacgaaactcttgggtaggaacaagcccaaacttgaaaatacaaaatgttcttgcacagaaggactaatgaggaaatgggtgtaggataagaaattccagacatccagtcatttggggtgccatttaaacattcgcagtactttagatcttaattaaagtgggatagatttaaaactttctttctaaactagtggcctgttggttttcctgtgttaagtaacacgatagctgtgatcattgcatggaaattaatttttaaaatagcttatattcttaagcaagatcttctttcaaaagaaaccatttgggctcgagcattaaaggaagaaacaaaaagaatataataaaaaatagattgcagccctagcatgaacagttgccgtgaccttgccttttgtttgccattacacaattcaatggcagtctactcaaactatgtgctcgatcaatatcctattaaagcagcacaaaaagtctccataaacttagtggttagctatgtttataaatggaactcggcataattggatggtcaatagcaggctctactagtaattttaaaatgaacgtcacacattttatatctgtagaagtcaatggcacctcttctagagtgaaggtagagtgtggagcagacaaaagagtgggtggccctttaaaaaaatcataatgtctatttccaaatgtagtttttaaagaaaatctaagttatggaagagaaaattctgattggcccctatatatttttattttgcctatctgaaccaccttcttctgaatatattatgactttgcaaatgttacattttctagttttaatcaacccctcatagagaggtaaaataataaatattgccatactcgtaggaagaaaaataacagtctggctggcttaattcagccagcttcctctactataattcaataaattttcaaaataaatattgaaattgaattagttcaggaggatgttttgttgtatgattttttccttttaattttcttgacatgtttggggtgaatatttgggtagtaaagctggcagcaagtgcaatggactggtagtaatagaaattgtcgtcaaactacgctttcttctgaatcctagctcacagtatgggtggccaagcttgatttttttcctatcctaccctcctcacctaatgaagccatgtaaggtgagagtatccccacccttagactgactctgtcctcagccgactcagccctatgaattaaaaggtgcatataccttgtgttcgatatgtgccctggctgttgtcatggaccactgagctgttgaaattagaactatggcaggaatacgcttatgacattagtgtatccttcagtcactgctctgcatgaaggtctagtcctttctcttacatgcatactcctacaatcttcctggttagagctggcagtgagagttctcatggcagaatttggggccgttttgatctctgttctcagctgaagcttctgataaatttaccagactatgaatactcttattataaagatttgaactggggagaaacacaacataccccttgatgtacatactaatgtgttgtcatggtctctattcgtatgttcatctatttctaggtcattcatcagttatgctttctatgtgtcaagtataaaacctatattcaagatggcagcatgatattgtaaaacagtacaggatatagagttggggaattgagctttgcaacttatcaactctatagctttgggcaatatttaacccctcttggctgtgttttcttctaggttacaatcatttattcattgagcaaatgtttatgaagtcctaactgtgtgctgagtctaagtccaagtactggaaataggaatacctctcaggagtgtaatgagggttaagtgacagatagtctagtgtctgccacatagtagatgctcaacaatgataaccaccacgattattgaacagagcctcagcccctgatcgttcttcactgtgtgctcagagccaatcttggagctgaccactatcagtaaatttattgaaaatgcatgtgtgtgtgcgtgtataaattaagaagggccaattttagaattcatgttctaacaaccaattattagaagagccactctagtgacccttacggagttagtaattccaatagagtaagagcatgccaatagtagacctcattcctctgttttgagcattgtttttcctcaaattttcagaagattctttttcctcaaattttcagccagagcctgtgtttctgcattattctagaaattgttctcctaggatatctcgtggatagcagaatgttttaaaattctcaatctaacactgacacattaacaactttttaagtggcaaaccacacctgggtcatctgtaccggcattctttttttttttttttttttttgagatggagtctcgctctgtcacccaggctggagtgcagtggcgtgatctcggctcactgcaagctccaccttccgggttcacaccattctcctgcctccgcctgccgagtagccgggactacaggtgtccaccaccgcgcccggctaattttttgtatttttagtagagacggggtttcaccgtggtctcgatctcctgacctcgtgatccgcccgcctccacctcccgaagtgctgggattacaggtgtgagccactgcacctggcccatgtaccagcattcttaaaagtagtacttagttttacagtattttaaaattttgctttcactcatattatgagcaaaaattccctatgaatggcagaagcatgctacaggtcattactgacaatgtggtttgtttgggttttcttgagacagagtctcactctgttgtccaggctggagtgtggtgatacaatcatggctccctgtaactccacctcccaggccccagggatcctcccacctcagccttcccagtagccgggaccacaggcacgcgttgccacatccaactaatgtttgcattttttgcagaagtagggttttgtcatgttgcccaggctcgtctcgaactcctgggctcaagagatctgcctgccttggcctcccaaagtgcctggattacaggcgtgagccagtgtgcccagctaataatgtgctttttaataaacctttatttatgcactcataagcctcaactttttaatggtggatattcatatccagtagtaacactgaaaaactagaaggggtttttgtgacctccaaagcttgagagaaatcctatattaccctgcagtagggccacaaatattattgagatttggctggagtacattatcatagctaactcttgccgagtagaagggctgttggtagtgaccatcttagcatgtctagaatggggccggtggagtccacattcagcaaaaccacacataggtcaaatactggaactgaactaatccagtgtgtggttaatatgagtacatgttaatacccaggatttttcactaggtggaggagaaaaaaaatgaaagttattggtggaaatattgaaaactattttttttttttgtaaacagctgaattagtcagttgttgggatgggactctgttgatacggtttggtttcctaatagctaatggtcaagtagtcccagtgcactattggttgtggggcttatgtttagcttagcccttccctggtttatagatcactgtggcaaaaagacctcttaggccatcaaatcccatccctgtcagagaagacttaatcccatgactgaggctgtatcagatactaagcaggtaccacatttgacctcaaccaaaagctaagacatgatgatactctaaaatgcagaaaatcaatttcagcccccaaagcagaaggcactaatgcagatcagtcagcattgctaacccctctgtggactgctctgttagaccaagtggcagggcccttcatccaatggaactcttgctgacgcttataaagtttaagacctgcaaaagcagagaggcgagaaggagaatgatgagatagaagttttgccacataagtgtaggcgataattattcttctatttaaacgtgttgaatatatctccttcataactgatgacaaaggaaagacagcaacactagaaatgtgaatttcactcctgtttctttgaacagatatctaggaaatatctacattcaagcccttcttctgtcacttacttagttgcatgatcttgaccatgttacttaactctcagcgtagtttctcatttctaaatgagaataatataaatacatattccatagggataatgcaaagattaaatgagataattcaggtaaaatacctagcacattgcctggcatgtaataaatgctcaataaatattagctcttagctatttttcattaacaagctcgtgtaattttagttcaactcagtaaacatttggtgcatatgtaatatatgaagcaccctgcactgtgtactgaggagaatacaaaaataagtaggagacagccttttcctctacagggtatatatttaagtttcttgagatctaagactgagcttattttatggcaataaaaagcctgaatacacttaatttacaaattaaactcacagtaattatctgtcaaagataaagtatcttcctgattcggagtggggtgggaaaatgtatcggttaatttttcctattttaatgaaacagaaacattttttgaaaaataaaaattcctctcttcacctcccttttctccttccgccaccatgtatatattccttaacatgtgttcacaagacagggatgtgtgaaaatagggctctgtctgtgttagcggatgcctttcatggggttaaaaaatattctactggcttttgtcacctaatagtacatttcgtaaaaagcattgcttaaatcttttaatagcaggcaagttcattttcacatagagggaaatccttgttttagttcattgcctttttttaatgttcctgtttggaaaaccatactcttagcctgcatttggtcagaccttttagaaaggaaaagtagaaaacaggagatcagcacagggtttacagaccagaaatctgcttggcaaaggagttgctgaagactgtggcgtagaagctgcagagaaagtacctttatgattgatttccattcaagtcagactgactgcagtgtggtcatttttctaacccataactgctcacactgcagcagtctgctatctgcagggtgtctgaattatagcagtctatgttcgtgttacctcttatacaaattacttacactggtttctttttccatgcaaattcatcagttttacagcctctcacagccacagtcaggaaactctggcagagagcacaaattgataaaatgagttaatttttactatacttattttttttctttctaaaagccctttctcataggcagtgttcaggaagcatattacggtaaaagggagataacaaaggagttgaattttcttgccataaattactttccaagttaattccctttaacgatgattccagatttgcttgagttttcatagcattgtgcgttttacaactgtgcctttgatagaaagaagaacaagtattttcccatgttcagtccctttgtgccagtgacatgaactttcttacaagatctttgccactggaatgcaaaacaacactaaattgtgctgggtccatagaactctgtgctgctattggacttttcccctcccccggtcttcaaatacaagttcccaaagtctcactgagtgttttagatcatgtaatcagaagaaaaatatctctccattttttcatatttgtaagttggaaattgagttgggttacttattgccattctttcatattcctcggtggccatacagatttgaagaagggacaataatggtcagtctctgaaatgtaagccccacaagggcaggggttttctatatcttgtccactgatgtttctcaagcatctggaatgatgcctggctcactaaaagtgctccataaatattgttgaattccattgaatacagcctctctgaggatatgtactattaaccataggctggacaaactagtcatttcgttaatgctccctgctgacttccgttgaacaagttggaaacttagcacactgtaatctctcaggcagagtagctcaaaaatttgtatggaaattttttccatcatcctctctttccaacaatgcaagcctgagcagcttgtctctggtggatggcagaagttcaataaccacaaccttatccaactactaatgtgtacagaagagcaggtcattaagagggttggctactaaaataacccctttcttccagtagcctacattactataatgattccttaatagcaaaccatttattaagaaatgacacaaagactacattctacttatgacaggaaagaggcaggggtagaggatgaatgacttggaagtaatatttgaagagaccatttccaaaagttaaccttttgagaaaaactcctcgatagagcaaaatacttcagattcgttaattacaatactacttaagaaaattgaggagccttcaacacaatttatatgtatttatagaattctgagtttcatttggtattgtttaaagtttagagggggcaaatagggagggtaattattcactcttcttaattcaaagcatatttattgatgatcaactgtgtacacaaaactggtcaaagggagctctaggacctgtaggattaaagtcatgtgtatcacctctgacttcatgacctgggagagttatttaacctctttgtgcctcagttccttcctggtggtatggtgaggatcaggattccccagtgctcaggctgcagactagtaccagtcagtggcctgttaggaaccggactgcacagcaggaggggagtggcgggtgagtgagcattgctccctgaactctgcctcctgtcagatcagtggtagcattagattctcctaggaacgcaaaccctattgtgaactgcacgtgcgaaggacctgggttgcagcctccttatgagagtctaatgcctgatgatctgagggggaacagtttcactccgaaatcacccccctactctgattcatggcaaaattgttttctatgaaactggtctctggtgccaaaaaggttggggacttctggtgaggagtaagtgggatgatgtgcttaaaacccttagcccaacttctggttcataaatgatgcctaataaatcgtgatggtgatggtggcagcagtggttagtggtggcagttcatttttgccataattattattagaattatgaggcccaaagagttccagtgacttaatcaagtaaacaggtggtgattggcaggattgggaatctagacaatctctccccgtcctatactagcattttttatgccccatgacatctctttataaccttcaaaatgcatctcaacctagatagggagaaaatgttacatatgagacaaagcatgataaagcccagagtcaattacaaatggagcaaaactggatttcacaataaatggaacagaaaggcagtgctgtgcttggtccagtcctacctaacatctccacatttgattggcagcgactgcatcgtttttatagcacaccagaaggcagttagtctttaacctcaaaaacccaatgtgataacctgggcaggccagaatttatgtgacattggacaaatcatttaaccttccacaacttttattagtttcttaattttcaaaagaaggacttaatgccattattagttaaaaagtatactgtgttacatacatcttattgatattttatatttgttagaagaatatgatcatttatttatgccctttcaagtgcacaattgggaacaggtctttgagacctgtttgctctcctggaggaggtgtcaaatttccattgtaaaaattctattttctttcccagcagcagagtcttggcctccattcccttctgctgggacacttgcatcaatcttctgatttccccacctccagaatcttagcccccttccatgcattctgaatatggttgctgtgttagtccgttctcatgctgctatgaagaaatacccgagactgggtgatttgtaaagaaaagaggtttaattgactcacagttctacatggctgggaaagtctcgggaaacttataatcatggcagaaggcacctcttcacagggcagcaggagagagaatcggtccccagcaaagggggaagccccttataacaccatcagatctcgtgggaacttactcactatcacgagaacagcatgggggaaactgcccccaagattcagttatctccacctggtcccacccttgacatgtggaaattacaattcaaggtgagatttgggtggggacacagagccaaaccatatcagttgccttgtgattgttcccaggtccacagtgatcttatcacttccctattcagaaactgtcctggatcccacttttttttttttttttttttttttttgagatggagtcttgctctgtcgcccaggctagagtgcagtggcacgatctgggctcactgtaagctccgcctcctgggttcacaccattctcctgcctcagcctcccgagtagctgggactacaggcgcccaccaccacgcccggctaattttctgtatttttagcagagatggagtttcaccgtgttagccaggatggtctcgatctcctgacctcatgatccgcctgcctcagcctcccaaagtgctgggattacagtcgtgagccaccgtgcccggcccactttgcttcttatctccaaacttatgcacatactttgtctattgccaagaaagcctctcctgtgtcctgtgcctctttaaatctgaactatcctcgaaggctcagcttaagtgcccactcttcctggaatcaaacctttttctgatctcacaagccaatgggatccatgactcctttgaactttcctagcacattctttgcattttttcctatgaaatttagcatgttcggcattgcattagatattcaggtattattttagtattccacttaggttgtaaaccttttggggacagagacactgtgtatctttttatcatttcaagtttaagacaaatactatatgtgggagtcagtgtggcgcagtaagaaaagcccaggttttgaggtcagtatccttacattttaaccctgactctctctttttgtctttttgtaatcgaggacaagttatttaatctcacttcaaggcttcgttctcctcatctagcaaatgcactttgaggtttgagaatgaaattaagtacagtaagtacagtgcttatcaaaacatggcatcatgggtgctccaaaaagcctgcctaaagcccacctcttcagttcttcatgacctgccaaaagctctttctgttctccagattagaggtactgagaatacccaacccaatgcaaggatactttgatagggactgctcccctcaagtgtgaagctttctctttggctgtgacagtgtcactgagtcagaatccaacccaataagccaactgtccatgtgattcatacctacaggcagttgcagggggatgttcctttataagactcttgaagaaggcagagtttgggtctgtgaattactaggattatttaactcagggtgtgaaacccattctcatttcagaaacttagtgatgttttaaaattcaagacacacataaccagtttgccaagctctcaagttactcatcagaagtctgatagacactttcgggacgtgccaggccacctggtgccatttgccacattacaattccagtgtacttaagtggttcacaggaagtatatatatgaccaagctaagcccgtttatgtgggcttaattattttttaacatctggaaggtgggcacaccatgtttacacaggcttttctttttcttcccctattctggctctcttgacatttaaaaaagataaggcaaaagacatttttctaggatagataaagtattaaatttaagtgcagctggatgttcaccacgagctaggaggcctcttcttctctccgtctgatcaagtccctcacattcacactttgctctgtgttcctctccttccaagagcgagggagtgagggccagacagtgtccgccatgctcaggaatgaaacggcttctccacccagttgagacctcatctcccttctgacatttgtgaaaaacatctaaatccagagctatgacactgatcagccttataacccttctttggttaatgagaggtgtgaatctctaatctccaggaaggcacaaagcattaagtacctactgtatgtcagcttgctgggagtgaggatgagtgatctaggctcatatttgactaatctcccccacccttcctccatagcctatttcatacataaagattacctaataaaagaggaaattatgcaaataaatttaatataaaaagcaaattagggaatgactatcagaattattaattagaaccctgtttacacttattgtcaagcctcaccgtttttttttaaacgaaaggcccttagagcctgttactgagagatgtgtttgaatttcagaaagtagatgtgaatttcagtcttccattttttttagcagtgactgtttttgtatattgacagttgtgattaaggtttattcattggtattaatcaaataactaagtatttattcttagaaattgttttatttcctcataccgtccctcgattccatagttccattatggcacctcaattcacctggtttcccaagtgctaatcgtgggagttatcccatactcccctgttcccattattacgatagtcaagaagtcagcatgtcttctttttatttatttattttccaagatttttattcgagatgggttctcactccattgcccaggctggagttgtagtgacatgatcatagttaactgcagcctcaaactcctgggctcaagtgatcctcccgtctcagcctcctaagtagctgggactacaggcacgtgtcactacacctagctaatttaatttttaaaaaaaatattttttttttctgtggagacatagtctcactatgttgctcaggctggtcttgaacttttggtctcaagcaatcctcccacctcagcttcccaaagtgctgtgattataggcgtgagccaccacacgtgtgcccagccagtcagtacatcttgattctaactcctgaataacttacatcaggctcctcctttccatcctttgagtttagtccccatccccactataccttgcataaatgccccagtggactctctggtttgcctattatattcttcaggcgccccccaccctttcacctccatgcctaccctcatgacagactgatctttctaggtgataaatgcaaatttgatgatagcattcccatactttgctggtccttctttgactattgaatacaactcaatgcagcaacccattccattgaccagtgtttactgactgcctcctggtgtcagggactatattagatgctgacagtataatccccagttatagtggggtgaggtagatgctttaatagcttataaacttgggaatctgctgaattcaaatttatgttccttaaataaacctgccagatcccaccgggcacatgttggctcatgcttgtaatcccagtgctttgggaggcaaaggcaggaggatcgctttagactggaagttcaataccagcctgggcattatggtaaggacccatctctacaaaagaaatttttaaaaaattagccgggtgtggcgtagcatacctgtggtcccagctattccggaggctgaggcgggaagattgcttgagcgcaggagctggaggctacagtaagctatgatcacacctctgcatctgcacttagcctgtgtggcaaagtgagctcttgtctctaaaacaaagaaagaaaaacctgccagatccttcataacctcaccttaaccatccttcctctttcccgtgtattctacactatgtcatcataccaagctatcagaaatccagtaaacattttctgctctcttgatgctgtttcctctacctagaagtcctccatccctttcagttgcataattcctcctttccttttaacattgtttccaggcttcacgttttctgaggccattcccttgaacttcttatccccaggttgggttagataacccacttctttgcagccacttcaatttaggaatgcagatggtccccaatttacaatgattccacttaaaattttcagctttacgatggtgggaaagtgacatgtgttcagtagaagtcatacttcaagtagccatacacttattctgtttttcactttcagtacaatattcaatcagttacatgagatattcaacactttattataaaataggcatattaagtgcattttaagctgatgatatttttaacttatgatgagtttatcaggacatagcctcattgtaagttgagcacctgtagctctatcagatgacttcgcagacttttaaaaaattaatctgtcagactttcttttccgtttaagggtagggaccatgtctttcatctaagtgccttcctcactcatcatagttcttggcagtagcaggctctcagtaagcattcattggatgtacaaatgtccctggttcatgataacccttattgttatttcttctgatggatactaacctgtaatttatttattccagtatcaaatcatgtgggcttagctctcaaaccagtgcctcagtacagtatctattgttcctgctttgacataacctttcaaaaagattatttgcactaataatttacaccactaattttacggagttgttttatagaattggtacttgttatttgtccattggaaaacatgtattaaactactgtcaaaaaggtatctaaagattcaaagacagaaaatgcaaggaatcagtctcacacaagggtcatttctgaaaatcacaaataatcaaaattaaatcaaaggtcagaaaatcattttataagaggccagctaataaatatgttaggctttgtgggccatatggtctctgttgcagctactcgtctctgatggtgtaatgtggcagcagtcatagacaatatagaaatgaaaggccatggctatgctcccgtaaaactttattcataaaaactatgggcctgccttaaattacaaggttggacaaatattcagttaaggtgtatgcaagatggagaggtgattcagagtaaagagaaaccacacatttcatgttataagaaactgggaatggacagcttagaaagatgactttgttctcaccaaagttcaaaacagaattccaaaatacagatgagtagaagctgtcaggatcagataaagttagaaaagtctaaagagtgttttggctggtcattccagaaaagtgtaagaccaaaatgtggggaagtatttttgttaaaagcatccaagaatgttgcaaccttggtgacaatttactattacataaagagaaaagatgaaaaatatattagaaaaaatatgcctttcctgtatagactatttttagtcaatattcctttggagtcatagtttattactgattattttcgattcgcttacatataaatgcaaaaagaaaatgtgctaaatgcaacactgaggatgctgtcattgatttttttatccacagaatttaactgatttttgtttgttttcttaattctagcaccaatagctgcaggaactggcccaaatttttctctctcagatttggaaagttcttcatactacagcatgagtccaggagcaatgaggaggtctttacccagcacatcctctacgaggtaattttattggcagctcttgaagaaattatgctacatggttgcacaccttgattttaactctgggcccactatggatttagcaatgcgcctttagtaatagaagataacaaagtagtgggttcagccccaaaagactgtcggtctcgttggggagataaagcaaatatgcatgtggcaagattaaatacacacacacacacacacacacacacacgcacacacactaaaaaactgtgaactaaattgtgtgacacaggctaaaaatagttaaagagagctttatgcaaaaagaataccttgtttccagctctaaatgttggttagggttggtgagatagaaaggaaaaggaatggaattctgggtggggtgaaaaatgagcaaaggcttggaggaaggatggatgatgaacataacatgttctcaggaaatgaaggacaaggctggactgcagcaaagggcatatgttttggcttgtttggcaggaagtgaacactggtgacagtctcagtgtcatgcccacagcagacattacagctcagtgccagctcttttcccaccgagcccccaaagctctcaatatccagtttactggagttgccctaaaaggtgaaacccatttgatatcctggtgtgaggttatacaaatggaagtagtcacttgcataacctcaagtgagggtggggccagaccacagaccccattgtattgagagaccttaaaaacagtaaagctagagtagtgtaacctgataatgattctggggttcttgctccctttaacgtcacaaagccaaaatcaaaatgaagcatttttgcaagatcgtgttgtctctagataacctgtaccagagggaaagggattaggcattaaacccacagtattcttttacaaattggctttagcactggactgtgacaacaaagaatagaatggtacagaacgatctttaatgtttgtgtactttgcagaaaaatgtctgacaaaggtatattcctcctaaagcaagtacctgagtcttatgatttaaaacaatgcccaaattatagaacttttccttggtgcacactcgttcttaccttgcctttatatattttaaacatcactactttaaaaaaaagatcaacttagtcatccctaataccttgaagacagttaaagaaacaggtattcccttaatataactatcaaatcctaccatcatctttcatgttgtttaaatgttccctttagttccctgtagtatcagctcctcagggggacaaaaaagtcacacatccaaagtatatttataatagaagaaagagattgtgaatatatttgggtgttcatacattttgaggattttgaatgtttgctgatgggagagaccttgtgtgtaactgtactcagtcaacatgaaaaagctttgcaaatacctgtgggcagtgattaatttaaaagtttatgggctgtttgtttttcatgtgtgtgctgtatgtgtaccatgtacctcccaaacagtgtttccccctttttatgttttcacacaattctccagctatgttttattatcttttgtgactctctgagaggaaagctcattatgaatgtcatttaaaaggccagtgtcgttctcatattctgcaaataactaaccctgataaggagctaattataacctgcatcagtagttaataacccggtaatatgtttgttttactctcattaggctcttcctaggatgatttttaaaattctttaaatacatagattcagcagaattaacgatgtacaggttagaaagtgtgcccagaagaatatctcagatttatatatagaaatgttcaccgatcaatatgtcttcctgctgtgccaatattaatgggtcattttctctgtggcaggcaccatattaggtgagttgtatacctgttctgatttattcttcacaataatttgacaacacacacagtgttttcatttaaacagtggagcaacacaaagctcagagaagttaagtaacttgcccaaagtcacagtcctagtgaatagaggagtctccattcacactcaggtctgttggaactttaaaaatatgctcttttcacacagaatcctcttgagaataggactgactcttttagtaaggaacaacagaatatgaggtcctaaaaaaggagtttctagcatctctattcctccctggcatttagtgtttgccgtcttgagttattcttaaccatctttgaggccaacacgtgtgcagcctccccatctagacagtgagtcccttgaacgacagcgtctagctcttcccattcagcagcgaacgttattagtaagaaacaaggacaccgtccttggcaccatgggtgtaaagtcaaataagaggggctttacaatctagtggtagagactgagaagtgggaattttcagttcagggtcctatgaacactcaggaaagttaaggcattttgcagtcttaggaatgctaagtaagacttctaggccgtaattacacagagtaggaattaagatatttggaattagggtaatacttttaccttattttttagatataattgctagaaatacaagaaaaaattccacatacaagaagaaatagtgcatcactccttaggagaatattcatccttttcgtgtagatcttacagatactttcctgcttccctcaagtgtttctgggaaaatgagtgtgttagaaagagcaagaaaccaaaatcaatgactgattcatttcaatagatagataggtaggtagataatgtgatgcaatggtactgactgtaagttctgtaccccttcagggtaaacatcttcaaaatcatagaaagagcagtgtaaaaattgggatacgatacattttttattccaaaaaactttatcaagataaaccagctgtcaaaagtttgtgaagtcagagtaaagttgtctcggaagcctccacctgtgcttcctaacttgcttcattcctgatctttttatcttttccatgctccctccagatgttaatttttttttttctccaatagagacagagtctctttctattacccaaggtgagtgcagtgatcataattcactgcaacctcgaagtcccgagctcaagcaattctcctgcctcagcctttgaagtagctaggactgtaggcatctgccaccacacgcggctgatttaaaaaatatttttttttgtaaagacaaggtctcgctatgttgcccacggtggtctctcaactcctggcttcaagtgatcctcctgccttggcctcccaaagtgttggaattataggtgtgagccaccatgcccagccctcttttgtcaacttctgaaaatccttgctttcaaactaaggcatcaaccgatagctatagaatctttcaactctaggatttaatactggcttggggtatttgcattttattagaggatgccaaggaaatcaaaacctttaaaaactcagaaaagtatcaataatgggagaatgatggacaatggagttggcctttggggctagatctaactgaattatacttggatgaatccatgtcacatgtatttgtatggctgtttctaagtcagtagcccaattcagcagttttttagtatcttctgttagccagacactgtggtaggcactagagattaaaaagtatatagtcattttccctgaagatcttacagccccatcagaacatataggcttctcattttatttgccagagtacttcagggaaatgtttatttttttctaacatgtattctttctgtttccaagatgatttccagtggctttccattttaaaacaacaggtaatattaaatgtagaaagaggccagaaaccatgtggaaaaaaattgttatagcaggagcctgaaccaagagttatgccttaagtttagccctgagcttcctggttgccaaggcaaaaagggttatatagtttgcatttctaataaaaggatacaagataaatttgttcaaagagaccatatttttctgattatgttttgtaaggaattcgctgtgtatatcgtcttataaaggactcccattagatgtagttttacataaaatatagaaaagttcttcagtggctatttttcattgaactttcaaggaaagcccagcaaagaacattaaataagcattaaaggcatttcctttgagtactaagctagcatggcacagttatgttgctttcctgtggtctggctttaatgagaatagaacttaatggctaagaatactggaatgccaacattaataattagaatttcttgccataaattggccctccacattttttcattcagattgctgcaatagcttaactgtctccctgccctaggctccattttcctgttttcccctttgcctttctaaatctatcatctgcacaattaccaaagtaacttttctaaaatataactcccctgtcattccctgtttagattatttcggggagtctacattgcttataggagaaagtccagacgtgcaatatcttctataacctccacccttctcactcgctgtgccccttcttccccacctcagccatcctaaacagctggcagttctctgaacatatcacacttcactcacaatgtggcttcttcctgataggctcctcccttctgggggttatgttcgaaatatctgataacctgtgtgacatgagcataccaattagaacagacactgccctgcttgcagggctttctttggctaggtcctggaatgctcctgatctgcaagacattaaccctttagatttcggactgtgagggtgtctgggacaaagaaggggaggcaaggttggaagaaatgtatggagtttaagacaatgacagtttgcccattgataatatttttaataccaaatggctgcctgagtggtacatcagctgtagagcagccctgcctctgccctttccttcattcttccctgtctccttgaccctcttgaagatagctcaggagccatttcctccaggaagcctttcccgaacccctggctcatcactgtctccattgtgtgacccactgtaccctgtgtgtggttccatcataactcctatatttctcttttgcacagttttgtttgcctctctgtctccatgtctgactcatctctatatcccagcactttgcacagcacctggcatgtaggatgcgcacagtaggtatttcatgaatgaaacatacgaaaacttctgtcccctgaaacgtgaagaagagatttcccaacacgcactcccagtagatatgaaatctactcatcctaataatatgggtagatttgacagttttatcacccctgcaaacttcctgattctgtggcattcaattaaaacaactacagcaagcatagcagcaggcggcatttcactacgttttcactcctgaagcctcaaactggggagaatattcagtccttcaactggaaaaaatgagatatattctgaaagtttcttgaccgtacctctccaaaaaatgaaaatccctaccctgatggaataaaactttgttttgataatctttgcatagagaaagcacataaaagtcattgggccactctttttttatgtctcttgttctcaggggacagagcactccttcttccttcctttttatttgttttgttcactgatttatttctagtatttagagcaggacctggactagctgtgcagtaaatgtttttttgaatgaacaactccaagtggaagatgggaaaatgtggcaaaagaaaaaaaaagcaatccaaacttttcattttcttttcttttctttctttctttttttttttttttttttttttttgagacagaatcttgctctgtcgcccagggttgagtgcagtggcacgatctcggctcactgcaacctccacctctcaattcaagcaattgtcctgcctcagcctcccgagtagctgggattacaggtgcctgccaccacacccagctaatttttgcacttttagtagagataggattttaccatgttggccaggatggtctcaaactcctgacctcaagtgtgatcagcctgccttggcctcccaaagtcctgggattacaggcttgagccaccatgcccagcccaatccaagcttttcctgaaggatcacgagccctgctttttatcctttctgaggttccagcagggattaaattgatgcccaggttcattgctgatggccaggccccagccaccacctgtggagataggaaatatgtggccttactcccaacacttccaggtggaggcaggagctagagccagccgcttattcctcaaaggaaacaggaacaggatgtggcagcagcagcaacttgattgacaataaaaatcaaactcagacacttggaacaacacagacccaagactttgttctacatccagtgactcaccagactgaacagaagtttaaaaggagtcctagaactacattaagttgcccaattgcttcctcccttggctttctttcaaccagaggtgcagtgtccaagagaaaggtggttgcgattgcttttaaacatgcacccatttgttatttcagctccacaaagcgcctcaagtctgtggaggatgaaatggacagtcctggtgaggagccattttatacaggccaagggcgctccccaggaagtggcagtcagtcaagtggatggcatgaagtggagccaggtaagcagagtggcggcacgggcatgtggctaacactgtgaaactgaaaatacgtgtggggtcccatgccacgcataaaagtgaagaaagaaagctcaaggtagttcactttttcaggatgagcacttgtttgtattgtaatctgattgccacattcataaaaggatggctgtgcaaagcagtagtaattcaactgaaatgcaagactggtgagatggtgtatgattttctgctcttacatattttcccctacaccacaatccagcatttgatttgcttttggtttttttgtttgttttgttttgtttgtttgtttgcttttttgagacagagtcttgccctgtcgcccgggctggagtacagtggcatgatcttggctcactgcaacctccttctccctggttcctccttcttctgcctcagcctcccgagtagctgggattacaggcacctgccaccacgcctggctaattttttgtatttttagtagagacggggtttcaccatgttggccaagctggtcaatttttgtatttttaaaagagacggggtttcaccatgttggccaggctggtctcaaactcctgaccttgtgattcacccacctcggcctcccaattgtttttgtttttatactatcttttggtttagtttttgaaattatcttttaatcctaataaaaatctatcaactttttcagcaggatcgataacattcgaaagaagaatgggttccttgcgatagtttagactcagatttttatataataaggacactttgcaatatttttcctattactggatatcatcatgattatttttctatttaaatggaacaactctctttattctgatctgtactaaactgaacaaatgatgactgctggtctaatctcctggggtagtctaatcttggctctggagtcttgggagtaatatggataagtctgattgcaaaaactatttgaaaccctttccaatgtctaacacgtggtttagagggaatcttctccaaagcttcctgaatatggcaagtccaatgggtataaaggatagagtatgtgccttgaaatcagacagttggagtgccaacctggcttcaactcctgctggctgtgtgattgtgggcaagttacctagcctctctgagcctgtgtctccctttttataatctgacagtactaatagctatttcctagcatagctactacctagcatagagtaagtatgaaaatactgttctatggccatccttccccagcttttgcttcagagttaattccctgcaagtacagacgagcaccaagaaaatttctgaaccaacctcttcatctataaatcctagctcccttgtctcctcccttaattttttttcaaaagacaatgctcaggggatgtgactataaaggtgtagcacggggaaaatgttggggtgatagaaccattctgtatcctgattgtggtggtcacagtaatctatacaatcgttaacattcacagaagtacatacctccctgctcaagttaattttactgtatcataattaaacacaaaacaaaaacacctcaggcccattggcggtgtcttttatcttgcccctgctattaaaatgcaaaaatgtctctttgctttgcttctgcctagtctttcattcattcactcattggatagtcttcactggggactttctctgtatgaagcactatgccaggttctgggaactcaaggatagatgggaaggttatggcccctgctctcaaggaattcacagtcagaggtgggaaacaaacacataagcagatcattatacggtgatatgggaagcgcagagatggtggtgttagtcttccgtgacttctgtttctaattagtaccaaccacagcactcaaggtgtggtggttcttctatgaaggtcacacatcatcttttctccgaattcgtgttcacatcagtttgcctaaagtgcctaagaaatagtcccagccctaaatgagaaggaaaatgctgactctcactgccactacccgcatcatcagcatgacctctatatagtgccaatgaaaagtttatgtgctattaaaaaattaaaagatggaaaacttctttgaaccctttttcaaaggctaattagagccctagtcaatttacctgcttcagtgaaaatcagaattaaacatataggtttggtacatttgtgcttgattattgtgtagatgcatttttgtgcatattgaagctgctttattaggttgaggtactcagagctcccccatcatgaggctgagctctaggtccttgcatttaattcctctgggtatattgggggctgtggaggttgattgataattacagaatattttgacctagtgactcttttattcagggcaattcctattcctatctgtacattatgattcaaacgatcataaattttaacatttgaatacctgaatcctttgtagtcattaaataactgaagtttaatggctgaatcctttttggtaagaggtgtgtgtgtgtgtgtgtgtgtgtgtgtgtgtgtgtgtgtgtgtacgtacacatatatattcttagagaatccctcacagttgtattcctggactgactctccattctctatccccatttcattacagaaaaatgcagtttcatggtatatgtttatagggagtgatagaggacagtggataaacgtacatttggccatactcagcaagcgcagaaagtcataattgcaacaaggcctgaggggacattaaaactcaactgaaggatgttgcacatgttcttggtgactttggtgtcattaactcacaccagccattttaaatggataatttatgctgccagatggtcctttttggggattttccataaagcccaatcccctttttggcacagagagcacctttatgttgttcccacacttatgcaggcctgcatagcttttccccaggggtacagttaaattgagtaggaggcttttagtagttcacatgtaaattaccttcagaaatatgttgggagttatgtatatctgaatgcaccagcagcctcttggttgcctacatttgggataattctctcaaacaagtactaaggatactgtgtttaggcctcagatgtgacacaggaagcaaggcctgtacctgctcctcactcagaatgctttggtttccgtttacctgccttaaaatgcttttccaggactccctggccaaaagagggccaaaggttgccagaagagacaaatttcctagagcaacaggaagattgtggaaagtaaaacaaaccagacatgcagtaaattacatgggctatttcaaatgtcttttgtagtatcctgttccccattagtttatctcagcacttttagtgcacagctcttattatctgggaagaagggcataggagattaaagatgatgttagtttaaaaacatcagacaacttcagaatgactttcgcttctcttacaatgctgcatttgtctctcgtacttagttttgtttcccagttatctcaaaactgggttagatacgaagctttgaagcaaatcatgaattgacaaaacgagtcctatgaaattctatcaagcacaaatgcacatatcatcaactcttgtttatctgtacaaatgaagaattacagagaaattgataatgcagataaacaggaaagaaaccaatacacagcgcccacattgggtcagacactcatgttgctttcaaatatatggaaaaattctagttacaattgagtacctactgtgtaccaggtttttaaaaaattaacctcctttaaaatatgcaaaatataatgatcctgcctctaaagagataaaaactgagactcataaaaggtcaagtgacttgcccaagcccacacagatagtaaatctgtggatccaaaatccatatttgaaaccaaatctgacttcatagtctaagtttatcttctacactcagtaacctcttttaccataaacatttggagcagcattttagggtctcatgtcctggactggtactttagttaaaacgttataaagccgggtgtgatggctcacgcctgtaatcccagcactttgggaggccgaggtggacggatcacctgaggttgggagttcgagaccagcctgaccaacatggagaaaccccatctctactaaaaatacaaaattagctgcgcatggtgctgcatgcctataatcccagctactcgggaggctgaggcaggagaattggttgaacctgggaggtggaggttgcagtgaaccgagatcgtgccattgcactccagcctgggcaacaagagcaaaactccgtcaaaaaaaaaaaaaattataataagaaacaataaataactcatgagagagacctgaaaaatattcgattttccttatcccaaagccttgtaatacaacttaatctagagaagaaatatagattattaaatatacataggacacaatatataagcaaagagtattaactgttaacaaagtaaactatcgttttcatttataaaatcaaataaccctcagcagttaggtctttgttcaaatagtagctcatcacacaggccctcagtgatctaaaatagctgctgaccctcactccatcatcctataactcacaacactgttttgctttctttacatctgcatctactattttttttttttttctgagacagagtcttgctctatcgcccaggctggagtgcagtggcgcgatctcagctcactgcaacctccacctccgggttcaggtgattctcctgcctcagcctcccgagcaggtaggactacaggtgcatgccaccatgcctggctaatttttgtatttttagtagagacagggtttcatcatattggccaggctagtctcaaactcctggcctcaagtgatcctcctgcctcagcctcccaaagtgctgggattaccagtgtgagcccaccacgccaggccatctctctgctattattgtctgttttctctctctagaatatatacttcatgaacagtgggacttagtctgtcttttccattgctgtatctctaacatccataacagtgtctagcacataataggtattcaataaatattgattgaatgaatgaagcgataaagcagagaatttggggtgctttcaataaacttgaaagcagaatttgctatcaagaatactctcagaattggtgtttactacactttcaatttgtaggctttcagtcaaatccaattactagcaagtcgtaagcagaacaattgcttaggctcagccaaggacctcttgacgagcagcagtgcattgactttattacaagtatccctcacctgaaagtgtgttcctttaagtgaatcaaaccttttttaaaaaaacaaataataattctgtattatttctaagtttgttgtttagtattagctccgtattaagaatcccaacagtgaatcctttgtagaacattttatgtagtatagacaacctccctgacttacctgtgaaaaattcagatttccataccaaatgttctcttctacaagtgtaaggagcacccatatgagacacttcagacccttgctgctccaagtgtggtctgaggacctgcaacatggcatcacctgggggcttactaaaaatagagaaccctggccgggcatggggcccaaggtgggaggattgcttgaggccaggagcttgagatcagcctaagtaacatagcaggaccctgtctctacaaaaaaaaatttttaattagccatgcataatggtgtgtgcccgtagtcccagctacttgggaggctgaggcaggaggcttgcttgagccgaggaactcaaggttacagtgagctatgattgtgccattgcactccagcctgagcaacagagtgagaccctgtctcaaaagaaaagagaaacaaacagaaaaacagaatctcacgccccacctagaccaacagaattttaacaagatctcccggtgatgcttgtgcatgttacactttgcaaagcactgatttaggctgcttttttgttcctttaggtgggttctccctactcagtacttgtctggaagccaccttaactttaaatgtcacgctctccaaccgttctctctatgttaaagtaggttctctttaaaacaattctagataggtagaaatctagcctattttcaaatagattagaaaagattggattctgggtgactctagatacctcactataagaaaaacaattctcttgtctccctctctgtcccatattcctccagtttagggcctgctgcatgaaaaggaatggctggtcttctaatcattatcattaaagtcaagccaagttgttgaatccttattaagtgctgattgtatgcagtatactagagtagatacagagaggactccagcaagtccctgtctccaagggcaaacctctgaatttcctcaagtgtcagtcactacctgtaaggtgggaactgttccttctgctccatctctgtcacaaagttatgacagatgaggtaatgaagtccaaagtcctttgtgaaaattaatattctctaatcacgtgaaatatcatcattaggattactgaggcagccaggcttacccagctgagggtagttgaaagcagacagggttaagtgtcacaggagtaaaagaaaagagctgttaaatctggagaataagggatagtttccttaaaaggtggcaattaaactggatttagatggaatcagactgagaaatgttcaagtctcacttgaaagtgagacttgtctcttagtcttttgattgttagtatatataaatttaagtcttcttcctaagttgaaaggcagctctgtggctgttctgtgagcctttctcaggttatatttgtccccgaagttaacgatttataccaggggtccagtgggcttcatggatgactgcgttgcaccactttcagatttgagaccgcatctgcattaagtacagacatatcagtaagttttggcagacctaaaaagtaaagcaaatttttttattgtaaaaaaaaatgaaattacagtacttttcagtgaagttcagtactgtgtttcaaatatatgcataagaagctacttaaattttctcctgtagaaaaacattcaaaattccaaatgccttcaattatactgggattgtaaaacaattaacagacacagttacatccaccaacatgttgaaagtttcaaaacagtttagtgaaagttttgaagtcaaatttgataaggaataaatttagttttatttttataaataacttttggagatacatttctctgcaaagagtaagttgttctcatttttgaaggtcaaaattaagtactttaggccgagcacaatggctcacacctgtaatcccagcactttgggaggccgaggtgggcagatcacttgaggtcaggagtttgagacctgcctggccaacatggtgagaccccatctctgctaaaaacacaaaatttagctgggcgtggcggcgccctcctgtaatcccagctactagggaggctgaggcaggagaatcgcttgaacccaggaggcagaggttgcagtgagtcaagattgtgccattgcactccagtctgggcgacaagaacaaaactcctgtctgaaaaacaaaaatgaagtattttaataacatgttctctgttcctatcacaatgattaagaaacacagttttaaaaaattgtttaaaggcatctgtcaaagaatatttcggtaaacatctggtcagtcagcgacccagggcattcagaactaggggtcagtgtcacaactactggcagcatagttgaattttgcagacttatgttagtcattgtaattttaaatatcacatattaggttcacctggattcccaactctgctggtcctaatttgactgccaacagtcatttatcaattgtaagagtggaggaagtctaccaacttagatttctagctgagacacaggggaaacccattatcagtgccagtaaaaaggcagcgactggtaacaatagtgctttgatcatggacactccactgcactagcatatattagagaaaatgattaaatctcccatcatctcttgctggagtaggaatagtcactgctacagaacattgccatgggatcgatgtcttggcttttcttctgcatttatggagcagtaggaaagcatcatctgggaccacatcctcttctatgatctcatattggcacctgcccattagagactggtacaccaggggacattggtacagtaacaaggggcctcttctttacgaacccttctttatcagagaaatttcacccaaataaggggttatgacaggaaagctgtattaccaaatgagcactgtaaccacccttcaaaaatcccttgccttctttatcaaggctgttttttcttaatgtcagaaaagggcctaaaacagctccttgtaattggagtctaaaaggttacctcttagaggaaaagaaatattcttctcatacacacacacatatactctgtgtatgtgttatatacatatataataaagcatgatccagaaaactgtttggattcctgaagcctctagtacctggcgacttagtagccattcaatcaatatttgtttaataaataagtaaataataagatggagatcacacacgtctcactttgtccttcgagtaggatcaagcgctcagaagcagagcgatgtatacgtttgtcgaacgaatgagcgttgctccgcttgcatcggagaacccagatgtacaattttgtgaatgcagaagctctcaggaaaacagatgctgcatttcagctggtcttgtctgaataaataaattacccaaatctccaaatttttaatttcatgtttgaaaatgaagctgtgtaaatattctagaaggggaggaagaaggagatgcagtgtatacattaggtttatatgtgaaatcctcctccctgtgcctgtcaccatcctcagtacagcccccgtggctcaggtggccaactcatggtgtggcttgggtggagcatactgtaaagaggaacattaaagcaaatttcattccaaccacagcaatcttcataggcttgctggggaggaagataagtgagaaatagaatgtattttaaagaggaaaaagtacaaattaagaattttaaaagttagtcattctcatattctgccatgagcaagcctgagaattttagcaaactacttctctgaattttcatttcctcatatgtaaacattgaggacaataaaacagccttgccttcctaactcatagctttgaaaagatcaaatgagatgataagaacaagagctgccatttattaagcatcagctctgtgtaaaagtatcgtgcagggcactatacatatttttaatatacgcaaagtatatttaataaatcaaaatgctgtaaagaaatactgtatatcctttttagggggtaaatactttgaaaaccctaaacttactgtatgaatttaagatactgtgaaatttatttgataacatatattacacctctgcatctattatatgcaaagcactgtgcaaaaatgatagaagaagtatgaaaataagcaaaacagaacttgccttcaaagagcttacagcccagtgaaggaaggaagggtaactggttaaataagtacccaatggctgtaatagataagatgtagagcacagcaagcttcatatgggtgaggagtttattcagcggcttagaccacagtcctctgctgtgcctgcttaaaatagctggtgcatcagccatttcatcgttaaaggagcagcagtgaatactggcccgtttccttcgtttcgtaatatcagagtcgaatcttactccatctctaagaagcttctagagagctgacatactaggaagtcctcaagaagtgcatatacaaaaatacagtttatcatactatactcatggacccaaatctcccctgcctgaaacagacagttttctgatttgtagataatagattgggtagaatacaagcaaataatttacttggagggaacaaaattaatctgaatggagattaaattcaccagagggtagaataaccagaaagtgtagttggaagaggaggaaggaaagaaaaaagacagagcgatcattgatagaaagataatagatcagacttacctaagagtataccatgttttcctatatctaatattatttaaatatttatagaacttaaattgaaggtagttttaaccatagatataaagatgaaaatactttagtgatcttacttcctgcgttctatcatataaacacagtgtagctattttatagactcaagacaagttgattaacaataaatatatattggcttgtattttgtcactgctgctgaaattttaaatatataagcgttttataagtaatagcaataactgatgtttattgagcacttactatgggccacacattgttctaagctatatgcacacatatataaatatatatgtgtgcatacatatacattcatttaatttgtaaaaaagtgataccactaatactattgtttgcagacttatttccctctctcatagggtcttatatttttcctacatactgatgattctctttaaacgttaaataacctaatatagcaccatcagtttatatggaaataaagttctgtggtttttggccatcaatgtttttaacaaagtagtttgttaacactccagaataagtggcttttacatggggaattggggagagagggaagaaataagtccttggtctgtgcagatcccagaagtcaatcaatagtgtgtgcagcacgctgctgtgcagcagtttctcatgaggctgtgcacatcccaattgctttctgctcagcagaggattacaataatgcctatttatccagctctgtccatccaaggattttagatacatcataaactcatcaattaatcagagacatggcacccatttcaaaatgctgggagaattacatcctggaagattacgagaaatgctcacgtcgacagagtaaatcaagaactatttcctgatggattcctgaatggcacaccaagtactgaaatgaagagggctgtctccagcactgattcacaaagtatatctcaagtggaagaaaacttccggaataaaacgtcactttactttgaagcatctgttaaacttgaaaaattaaactgaggtagaatggcaaagctcattaaatattaatacaattaattggcttccctcttcagagtaaagtatcactgacctccctttcttaacaattaaaacccctctgaaacctttgggttttttaaatacagtgtaactttggttcttgattctctggtctttgtcaagtgaggaattcttcctgtggtccagcacgctcagcccactgtggggaactggctttccagacagctgtgaatgttcggtatttattcagacaatactcccacactttgatgatttactgtggtccaagcatcttgttcctcattttgaagaaacattccagtctgtaggtatcgtctactttgtatgtaatgagaggtagtttaaagttttcatttgcgtagctggaagtgcactcacgtcattagaaattcaaggaatggcaactcaatatccatttctaatctgaagggtcttccctgcccctgccatgttagccccacccagaaatcacttaactatgattagcttccaagattagtgaattctaggatagcaggattacttatgacttaatgccagtcagaatttgccatctgcctttcagccatttcatgaacccagcagaagagagcatttatcaaaatggctgtgcaacacccctcatgtcttaacactctttagggacttatataagcaacacttcatgttcgaatgtcaaaatccacgtgtaaggcttaaaagtagtatgggatgcttaagaatgcttttcagggccagttattctttgatatttatcacttcatggtgctgacacctgcttctaattttaagagttcgttcttccagtggatttttttttccttcagaaatcttatcctcaaaagacttaactagcaatttttctttttttgatgtgcttgatgttttgatgagtttgtctatcagcattgaaaccttaacatacctttcatttagaataaaaaaaaatctttgtgacacacatttattatattggatcacataaatttttgccctggcagtacattcgaagacttttgcagagatataatttattagaaatgtcattatctgccacttggcctacttgatagttgtcttaagttgacaaaagctatagacatagataaagtcttccttgagggagcaattcagtaaataactttcacccaatacccttatttggttgtctttcacacccaagggtcaggttggtggcaattgtcatttgagagttagtaagtggaaagacaaagacagagaggaacctagttttgtctattgagacacatatggaaatagtcctttggtttgggtgtagccagcctagttgtagtgcccaatgtggtttgctttcttgtttttatcttgtctaaagacctttccctcacaagtttcctcacaagtgctggataaagttcattgcatgagtagaagaagccgcaaaagatgatatatagctagcaacccgttctgattggtctatgaagagttgcctgtataaaattggatccttgtgttcggttccaaaaaaaggtgtgaatgtgaagaagaagtgttaaatcatgactccagagaaaatgtcggccatgagcagtttttagtttaagtgaaaaccaaactttaggatttggacaaataagatgaggagaaaaaagggtgaatcattaactccaatatgaaaggattatggtgatcaagtttcacccaacttgaataagaaacccaacaaagactatgactgatggaactaactcatttacttaattgatatgccaaactctgccaagcatttacccttagtgtcaaataagtaatttttaataaaatatttctaagatatgaagacagttaagaaaatagcatgctttttaataattgtactcataagtaaatggatcattacattgtcacaaagaatgacagtgagcagaaacagcctgctaatccctcttagataagtatttaacataattagacagacaccatctcttctgttgaatgtagcattaatcattagaagtgcaactttacacagcatacttgtttctgatatgtcattgttgttaaaaaaaaaaaagcaaactattttgtcagatacagtgcttcagaaaatgactcatgtagttgtgtgatttacataaatacagttatttccctttttattgttttttgtttgctttaatagtgtttaatagtagtgtggtccttttacatccatgaagctgcatttgaggtaagtggttcatacattttgttttgcaaaatatcagtatagtgaacatacttgaatttgaagtatttttaagctttgaagggatcttttggctcatctacctaaactgaaggcacaactctttcagagaaaggttttcttataaggaatgggctagaagttttctgcattaaataagagctgaagagagaacctctttctattaaaaatttgaggttaaaatgatggaatgtattgccctcttccagtattcataagcactacctttaaaaaaattcattttcttttgctgtgtagcttctagcttgaactatgaactacggaatacttataaagtgatagcagctcaattcattgcacaacgctagcttcccactttctctgtgattcaaaggccttcgaaggcaaagaatggggttattgaaggatggcaggcagatttcactaagtaacaggtggaggtcaaagcagtttatttgtgggatgaacagagtgcagagatgaaaaagcaaatgctttgccataataagatttagcaagaaaatgctgacaacacgaagccttagattctagctgacagaaccttttctcgtgttcattacttgatttcacagttcaagcaatttgaagagggctaaaattttctttctttttcccttatgaaatgtttcaatcagtttcaaatttttactttagctgggttctctgcttgtatccaaggaacactggaattaatagagctccagcacaggcgtatcccaaacatggaccctcacagactatgcatctctttcaaattaaattttatccataggacccttaagctctagctctctatcatgttttaactgacagaagagagtatatttaagtaaatactaaagttcacatcatcaaggctaatgttatatgccaacgaaagtattcataagggtgttaaccaagcttgaacactgagttacttccagcttgttggagatggagaggaaaagctttcatttttttcccattatacagttctatatttgtacagtgaatatgtttcgcttttggaagttaaaaaaaaaaagactaaacatgctgaacaatacaaaataaggtttatctactgttgtacagcatgaccaaaaaagtaaaaagttatttggtatcatatcatagagaccagagctgtccaatagaattttctgcagtgatagagatgttctgtgtctatactatccagtattctaaccatgagccacatatggctactaagcccttgcaatgtggctatgctgagcaacttaatttttaaattcatttaattttaattaatttagatttaagtagccacatgtggctagtagctaccatattgggcagggcagatataagccaaacatatgtatgattgagttttttactattcagctggatatctaaggagaatgaataaaacattatgctattttatactatatgtattgtttatgcaaagaaataatttggttttctcagaaatgtcttctttatcctcagtccttctgtgaatgcgtataattgctatgttgagctaaaatcagtcctttcctgaacacatggggggatgggatggctagggggcagatggaatgggtagggaatctccaacctcttgtaagtatatggagcatgtaacacaattttttttatttcagtcctgtcactggggtgtctgtgtttaccttgaaaggagaggaaatcccccaactagtcaagagattttatttttggcccagaaaccagatttttatatgacattttccttgtgtctattctttactctctctggttgtaaattttcactcacaaatgaacatttggaatatattacagaactcatcgtttctttccccctgaataatccatgtaatttttactccatactcccattttttaaaaactgaagaaatcactgatgtccccaagccatttaaattacctgaacttctttatgatgtgataattctttgggagtccttttagctcattttcaatggctacatatagagtaagaaggataaacctcagaagctatattaactttcatttatgctctctatcataaaaatgattttaaaacatttttattgactgaaaaaggctaaaagtcaaaatagtctattttacctttttatcgttgagtgtgctaatcataaaaaattatattagaatgaactctaatggattttatcattaggacacacatctaacaaacgtgtggtgtcttcaacgacctccttgtatcacgcagcctgtgtttatgctcacaagaacagaatggtcccttaaccgtgggattcttctgttcagtcacagcctttatttggcatcatggttagagataatctaattacaaggtatactttaaatggttctagaaaggtcttgttcctgcctgtgggggaattactagagtgcagtatagctctgcatctggaagagatgtgtctgagtgtaaatctgatggtggatgacttgcaaaagatggtactggtactcagcattcatgctgggcttgagaaatgtcactgaaatttatgtggacaccattagtctgatggacatgactgagctgtctgttccccacacttagatctagtggagtaggggaatctgaatgcctgagtgtaaaaaagagtcacaaagcagttagcatcattaagacttggaatgtttgcaagaagaaacatgttcaagtgtcattaatagttcagatttaaatcagctcatgataggtttgtattgataagatacataagtagtactcccccgcgccctcacccagaagtagggatcttggtagcatggtacactgaaaggagcaagagctttggtttcctgggttcaaatcctggctcctccactcactgattgtgtagcctctcaccttcttaaggactgcactgcctcaggcaccctctcttctctgagtcatggctttctgcctgtctgctggaccattcccatcagtagacaagcatgctggactctctcccaccttcagaaagctatcccttgcttccctccctcttcctgtagccactaccctatttttctgctctcctgtgcagattcctccttcgtttcatggaagttgactacaccatttcccctgtttcttcacttcccattgattttataaaccatgctatcctgtcttctatgtgcctcactctcctggaactcacttttcaagactgtcagaaacattcatgttgccaaatccagtggacccttttctgtcctcattatacgtgatctctcagtggcattcaactcagttgattgcagccttctccttgaaacacttcttagtttctataaagatatactctccaatgagttaaatgcctcaacttagttgcctgtttagatgctgactttagacactcgggggccttccttgatttttacacattactgaattctaaataattgtgtgtgtgttatagcctctggttaagtgagctatttattactgcattgtaatatatagtctaggcttggacactatcaacaagtcttaagagaagaatttttgtcctttcttgttatagatagataacatggtttgcaggaggctttatagaaaaagcaacttgttgaataggcaagaggcctatagtaaatataaaacatttatatactcttttgcaactcaacatctggggtcattatcttcttctaaatctatgtgatatttattttgtggaggttctgtgttagaatcgctgataattcattcagtgtgtgtttgataaaatcttaactgatccttactaaggccaagagaaaactttgatatataagacaaatgattcctagtatacttcagagtgggtttttttgcatacacttttgtatctgatatacccttcctttttttccccctttggataaccaaatttaaaacttcagctataaatatactttattgacttaaataggacactgtttttatagtatactagggaaactacatgagggttttataaaatgtatgcacttgagaaccagagagacctggatctgcagtaccatctaatagctgtatgatcctagacaaattgtttaacatcacttgatatctaatttctgtaatattaagttattggtagaaaagataataatacctacctatctcagatgaaaatgtaaggatttggggatggacacggtggcttatgcctgtaatcccagcactttgggaggccaaggtgggtggatcacctgaggtctggagttcgagaccagcttggccaacatggtgaaaccctgtatctactaaaaaaaaaaatacaaaaattagccgggtatggtggcatgtgcctgtagacccagctactcaggaggctgaggcaggagaattgcttgaaccagggaggcagaggttgcagtgagccaagattgcaccactgcactccagcctgggtaacagaccgagactccatctcaaaaaaaagaaagaaagagaagaaaatgtaaggatttgagatatttataagtacatggcacatagtgggcacttcataatttgtagcttttattattttcagcctggtttttggacgtgatcgacatgcagagatttaatctctgtagctgcctcctgcctctcttgaggccacttgatggatgaaggcttccagttgcctttaagcctttaagtttggtgtaatcgttgttctggtaataacagttataaaaataggttgttgggaattagatgatgacaatgaacaggacactatccaagtcatgaacaattaaacttgtaacattttggggtcctctctaacctgcttattgtattggatttaaaaactaaagtgctgaggttgcttgctttcagagtttctctccgtttgtgactataaatgaacattattgaaactaaactttctattcttgactttgtcactttgaagaaaagaacatacaccagttatatcttctctgacaacttgaattacatctcccaaactcctgcgacagacaagataaggtcctgctgtcccgagcagcacttaccagggatacttttaacaggagaatgaatttttggataggtgctctaacaaagtaagcactaacactgagaagttacagttccttttgaaaaatccagcatgttgttcggttgtcactggaataattatagtttatggtgatccttcccttctcttccattcccattaatgttgtagctcctttgactcctaaaaatctcccctttaagaagatacctaaggaagaaaaaacagctttgtacttcctaatgattcctgcagtgtttcctttactattgtcactatggagttcttggtcaaagtgtctgaaaaatatcataacttgggagtaggggagaggtgaaattaattatgattggttttcttctttttattttatgtgatatcaaattgcagtgaaaaattccctaaaacaaattttaacttcttaggggagaccccaagaatttgagtttttttcccacgtcactcaatctaattttgttattgatgtttctcgaaagaatcaggagaagtagaaattttcaaaagtatttatgtccctcgaaaattaccactttttagttccctttctaagaatacgtcttaccgttttctctaggtgactaggctagtgaaagactatacaacctagggtggattaggtaaaaataagggaaactttcagaattatagagagtaattattgtacagtaaacatctttaatacacacatgtctagcattgcagtcgtcttatatttgaatatcatgtttgttttctgtactgcagaacaaattttcacagagttagcaacttgaagcaacacacagttattaatattatctcacagtttccatgggtctggagcctggccacggctgaactagatcttctgcttaggtcatacaaggctgcaatgagaattttgttcagactccatttctttctggagctcaagggcctgttgctgactctcgtgattgttggcagaattcagttgcttgtggatgtgggactaaggtccctgctttctgaaagctgtcagcaaggggccccactcagctcccagaggcccctgcagttccttaccatgtggctgtcacaggccctttcacaatatggcagctgacttcttcaaagcctgaagaagaatctctctgacttctaattccttttatacaaggctcccctgattaggtcaggccctccagggataatatatttttccttaactcaaactcacctgattggggaccttaattatatctgtagaagtcttttgcaatataacataacctaatcaatataatcacctttgcggtataatataacctattcacaagaatgacatttatcatattcacaagtatctcacacatgcaagaggagaggattatataaggcatcattatacaaggctggaaactaggaagccatcttagaattctgagtaccacaatttttttttcaagataaggtctctctctgttgcccaggctggagtgcagtggtatgatgatagcttataaactcctgggttcatgtgatcctcctgcctcagccttctgagtagctgggactgtaggcatataccaccacactcagctaactttttctttttcttttttttttttttttttttttttgagatggaatcttgctctgtcagtaggctggagtgcagtagcatgatctgggctgactgcaacctccgcctcccaggttcaagcaatcctcctgcctccacgtcctgagtagctgggactacaggcacatgtcaccatgcccagctaagttttgtatttttagtagagatgcggtttcaccatgttggccaggatggtctcgatctcttgaccttgtgatctgcccacctcagcctcccaaagtgctgggattacaggcatgagccaccgtgcctggcctcagctaacttttaaaaattaattttttgtagagataaggtctcactatattgtccaggctgctctcgaactcctggcctgaagcaatcctcctgtctcagcctcccacagtgctgagattatagacatgagccaccagcccagcctgactaccacaaataccaatgatgaatttgaaggaatctttgtgaatagtgcatttgacctgtattttcaaggttttcttgttgaactttgcacttataagtgcctccagagatgaaagccactacatgactagaatcccatatatgtttgcccttgtctactgaacacaatttggaatgactcatatagcttagaaaaaaatggcagactagagggaaattgaaaattcaaaaattctggatgtttagaaaaccagtgacaagccacaggccttcttgacatgtttctccaattctatttactctcattgggtttttttataccaatcaaaaggatgaaatgccccattgaaacaaaacattatgctagatttctgcttctcattctacaaaagtctttatttttctgcattgaactttgaagtaacatttcatttcctccagaaaaagagtaggattacttcatccgtagtctttttttaaaaatctggtacttctagaaaatacattgaaattaaagttttaatgcattgaaagaaagccaatcagtcattaatccatacagtaattttgtaacagttgtgcataaataattggcaaaagagattttaaaaaggagtttatttttaaagtaatgtacagaaccaaatttgatttcaaaaataaaagccaacattaatgttttctagcttttaacagaaagcagtttactagcattttggaatttcatctggtcaattaaatatacaaaacaaattaaccaaaacatacattatgtatgtagagaaaatattaaagtatataataaggaaatgtgctcaatacgaactctttaaaaattgaaaacacaaagtaattttgagattcatgacagccttagggttcatattacttgactgtgataaatttagaagattatacatagtttggctggttgttcctgcatgctgacggtatttcttccgtctttaacccttgcaaagaagatttaaattttgctatttttgaacttgtttaccaacttggtcattcttgatacttgttattgcccaaattttacttgtaattccttttagaagcataaatagtggatttcaatcatgtcaatatttctgcagtatttagaatggcatgaattagaaaacatgaatttttcaaagaaatcataactttttcttgagtccagccatttgctatcatcaataagattagttaggatactggatttcatcagtgattccattatctgaaaaaaaaaaaaaaatctgccacctttaaagttttgatttttgttttaattatctgttctgcttctgttttatgacatgtagttcaggcattggactaaatttaaatcagtggaatggttggcagcctataaattggtctacacaaaaaggtttaaatgagttgggagatttgtttacattttgctagctttttatttctttcattttttttatttgaaatctcctccttagtggaattacatgatgataaccttaggttaggttatcttacagtgaatgttcacccaaaatctcagtgcatcctacattagaactttggtatggtgtgactggttactgattcagcaagcaacaaatataactaaagtcacttaattacttcatttttaattcaaatcacatggatgttgatctagaaaggatctgattcaaattgtcaaattagtatgaaatcacataccactctatgttgtacttatatctgactatgcaaatgtgtttaccaattttcaatttttctttcttggggtgaaaattctaagctttgctatgtttaagcatctattcatgaagctacagataaagctgagacctgcacaagtagtttaaatatcttttcagaccatttgggtgtttcagacccttggaggtcttggacatagaggggaacaaagcagacaaggactctgtccttatacagtctgagtcacactcaaaggtcatgttgtagaattgcattaaggaaatctgtgatcagaaataacagggacatatttagatacacgcaaaactagctaaatttctggaaagatctatacctataaagtgcttggcacagtacatggtactccataacagttacatgttaatatcattatgatttttattacttttccagttcatccaaataattctctggtcatgggcagaacacagcacatgtaaacatgtataagtaaaatggaatttggttcttttaacatcagtgcagaccagttttgtgctacaaccttaagagagcccaaatttgtcccctgatgcggagactaggagtcatttcttttatttttatatccaaattttcattgttttaattggcaccctatcaaactgatagatgcctccagttgggtatgtcagcgtggttgccgagaacattacaaatccagtaattacaaggaactgtttctccattattttcttcccaaagcattttctatgctggaaatgctgtgaaaactttagacacaataataaaagtactatttttaaaaacaagcttttattgtattaacatgaaagcaatatatgttcatcatagaaaagacaggtaagcaaaacaaaggcaatgaaaatcacccaaattcaatacagagagagaactaccattatagtttatgcatattgccttccagttctttctctgtgcatagaaatagccttttcaatggtgtcatagtataacatcctattttgtaattgcctttttcaattaacattatattataaatgttttgccacatcattactcttttacagtattgcttacattggttataccatacttatttaaccagtccccaattgtagggcatttaagatttttttacttttcttttttctttttttctattctaaagaattcattgaatgaacaactaagttgccattgttgagggtattcttatgttaaaacagccaaattatttaaaatatggagaaagtgatttggtgtcaaagcaaggtaaccaacaagatgaaacgattgcatgtgaagtcttcataagcatacatggtttcctttttgggagtcacagaggtcacagacacaagcagcaacttttaggaaacactggaaaagttgaaccctgtattattattgaagaccaataacccaaaaatggactgtgattaattagaataaattgaaatcaaatacagaccgacttatcaggggactattctgtcacctctttgtttctgtgacaaatgcaaagcaattcacaacatctttttcattcacaggtggatttctctttttgtttgtttttaattctttaaatgttatcttttaggttgcacaaatcattgttccatgaattaaagtgtacttaccagttgatccttcttgccaggaatgccatctccaaccacactgaagaagtcggagaagtctggtttcagcagcccctccccttcacagacctcctccctgggaacggcgttcacacagcatcaccgacctgtcattacaggacccagaggtgagctgctccacaggcacccttggttgtgcttatatcatggcctttggacccaagtagcaaaatgagaaacaatgaggactccccctgaacactcgtgaggcagtgagtgttccaatttcttacccttgggggcagccttggaattttagagaccaaagagatttggcatcacattttttgtcctttcctaaggcaaaaagagaccaaatctgttttttgttggccagtgagatttttgcagaaagatgggaagtaacttgaattgaaccaaaatcaaatctgttctacaagttgtgtgtgtgtgtgtgtgagagagagagacagaatgtgtgtgtgtgtgcgcacatgcgcgtgcacacatgcatgcattgggtgagtatatttccatgtggtcaattacctgttttcaagtagtagctttttctcatccctgctgactctctttccataaaacctgatttcaatatgtggcattttgtgttgaggttgtttgcatcagggtgttgacgagcagtcttcattcactccttttgaagtggtagatagtttgtctggttttcattgcaatgttttcattatttttgtctcatatgcttttaagtttattattaaaatgtgtccacgagaaatatgatttgtatttcgcattaaagacaagccttaagcctcaagagaatgtcagcaaatcacttaacttgatcttattgcaagataaaaatatttattattttgtttatgaaactcccacagtagaagtatgaataattgtagccatgtttgctttcctttatcagattttcttttaggtaggtctgtgacctaccagctggtttcataaaacatcctagaaaattatgatctcttgtctgctttgacatatacctggggaaactgatgtttcttgcattaatctcaatgttagccccaccaatctgaatccctttatgaatgtgctctgtgtgcatctcagggaaatgtggcaggtaagagggctgtccggtgcacacatgggagtcatattgaagaaagtaagcattttgaccactgtgggaatgaaacttacttgtttcatctttaaacatcttgtgatcattggtagaactttctcaagatcccttctttcatttgtgtattatgtgtggtataatcagagaggcttactatcgatatataatttgaaaacctgcatcagaattagattataaggtcccagaatgaggcttattaaatagtattaagatattatcctcatagttaacactcattgagcatataaactgtagtgggggatcagagatatgaagcccttttagtcagaatatttatggcctgaaggagatgaggcatgtgttgtttttcatctgtttggggtcaagttaacatattctaaatgctaactgaatggtaaaagttcctgcaggagctcagtattggggggaccgtggaggttcattcactctttaaacaaggatttactgagtgcctctatagacactgggaccagtggttcctgtcctcatagagcatgttatctactgcagaagagaggcacacaaggaaataagcaagtaaaagatgatgggccgggcacagtggctcacgcctgtaatcctagcactttctgaggccaaggcgggcagatcacttgagctcaggaattcaagatcagcctggccaacatggtgaaaccccatctctactaaaaatacaaaaaaaaattagccaggtgtggtggcacatgcctgtaaatcccagctacctgtgaggctgaggcaggagaatcacttgaacccaggaggcagaggctgcagtgagccaagatggtgccactgcactccagcctgggcaacagagcaagactccatctcaaaaaaaaaagagacttcaaagtataaataacattgaagtcaaatcttaaaagatgcttagataaatggagggccatcctaagcaaaggaaagatttgtggtgtagtaagttagtaagaactgagaagaacagtatgccagcaatcaggagagctgggtaggctccctcttttccttcccactcaccttctgggttttttaatgtcctcatcaatatagtgggtacaatactaataatgaccatttcctcccaatcttgtattcttatacagaaacaacaataaaacagtatttgtggagattccatgaagagcataatgcaatctgtatatattatcattagtcagtaaatattaagagtgtctaatgtgtgtcttgccttaaaactgtagttctagaaattactgtcatgggcacttccctatgggtacaggttgagagcttgttcatgctagatgactaagcacattttctaaaatgacccacgctgggttgaaccagagtggacctccttagctcacagcataacaagttgcagtctattcatattcattcataaaactgtgtttgaggaaaagagaaagatgcctagtgtaagaattatggaataccaaagattctttgttttcaccagaattcaagatggctcccagcatcctcggctctcctttctggaaagtctactcaggtacccgttcttaccgtgtcccaccccgcttagtggtctggtgaagggaattggagtagttgagatgaaacttcagttgcctctttgtggtaagaatcataagaattgagataggctaacgtaagacatttttctggctaagacatttttaaaaggttggaattcagcctcattatttatttgctgtgggtactgtaatttccttcatttctctctgaactagttggaaagctaatgcttggaatgataccacatttgggagtaagacgtggtgttttaggaagatgaggccaaaattgaggaggaagagtatagctgcaagagtcagtgtggaatcgatgtcacatgtgcgcataaaggagatttcaacctctgacactccttgtattgggcaaagttgccacaacccaaaatagtaaattattagataatccagagaatcaaactttaaaaggatcttgaagaaaagaaaagaatgtcctttatcaggtccccagggcatggggcagggatcacggaggccattgactgctctctggttagcactaggttgtgaggcttctgctgccttccctagcatttatcacgggaatgcttcaactagactagcaccagttagtaagcaataactgtccaacacacatccacgctcagaatggagatgagattttacagagctacagcaaatcaaggtcacctcactaaaaacacaagggccttacttttggctgcaaacataagctacatttggaaatttcacagccaccttttacaaagaaaatctctctcttaagattgcaaagcaaagggagaaacacagggcgttgaagggaggtagcgtagcacagcggttgtccttgtctgttttgactgccagaacagaacaccatagactgggtggtctataaacaacagaaatgtattgctcacagttctagaggctggaagtccaagattaaggctctggcagcttctgtgtctggtgagggcccacttcctggttcatagatggcatcttcttgctgtgtcctcacatggcagaaggggtggggtcgctctctagtgtctctttcttaaaagcactaatcctattcatgagggccccaccctgtgacctaatcacctcccaaaggccctgctacctattaccatcacattgggggttaggatttcaagatatggatcctagagggccacagacattcagcctatagcagtggttaagcacaaaatctcagggggtcagataggctggtgtctgaatctctgtccactacttggcacattgcttttctctctgaaccaaaggtttctcatctctaagttagagattatcatctctaactcaaaagaattgtattatgttaggagcaaaggaaataatgtatttgtagtcatttgcacagtgcctggaagtacagtatgcacgtgggtcatacaattaaataatcctttttcacccaggctttgaaagtatcatgctgtccctattgccttcgcccagcaacattctgcccatcccccagatcagctcaagcactttctttttttttttttttttttttttgagacggagtctcgtcaagcagtactttcaaagtgaaacctcctctcctccacccagcttgccatcatctcacactgcttaagctcctgctgcctttcatgtctgcacattgactccaccaacctcatctggccttgttagttaatctacatgtctcctggaggagaacctccaaagggaaggatctctaacttagacatttcactatctttgttgtgcctcacacagtgggttttatgctcaaatattggttgaatgaataaaagtagtcaaattgcatataaatgcacacaggagacatttatcccctctctgaccctgatgagttttcatttcttcagataaatgtgtgatagttcatgcagtacttccttgtaagaaatgtccaagacatggaagaaccatggcgttgcatccaaagaaaacctatgcaagattctctaagtagagctttgctattaagagctatgggctttctttatgttgttctaaccacttccctatttatagtgtaaaggtagagacatgtggtttcttaaaatgaatcccctctctgatagtggctttctttatggctttgataaatcacttaaccttgtcgcctcagtttggccatctgtaccatggggacaatactttaccacctgtttctctgtgtggttagaattaggtaaagaggttatttgggaatatcctatcgatagggggaagatattaaatttcagtagaggcatttgtacatcgttatacgttagtataattactgtgcactttaagctgaaagattgagctttcaaagactttcttttaccactacttaaaattgtaaccatagtaaagtatttactcatgactatttgtcttattcatgataattgaaaaaagaaatctttcttcatccctttgccttttcaagaattgtaagtttgcctggttgatgatctgaagggtctaacttgttagagaattatttagagtaatcatcagttacatcttaaagtttcttgaaggtttagatcttcttgaaacttatctttttgcttaaaatctttgctgttttgaagattaagaagatagtgaatgatactttatttaaatactctgcactaagtaaaacaattctgtgccttagagatttaggaacagagagcagcctacacgatccacattgggcagcacaattgaaagtaattgaaagagttatggtctgggaatcttttggtataatgtgttcccagtatcagtgaagattgtttttggctgaaagtaacagaatatctgactgaacaatggcttaagaaaataaggagtcacatttttctcatacaaaaacaagtatgtggctaggtatggtgactcacacttgtaatcccagcacttcaggaggctgaggcaggaagcacttgaggccaggggtttgagaccagcctgagcaacacagcaagaccctatctctacaaaaactttttaaaattaggagagcatagtggtagagacctgtggtcctagatactcgggaggctgaggtgggaggattgcttgagcccaggaatttgaggctgcagtgagctatgacggcactccagcctgagcaacagagaaagaccctgtctcaaaacaacaacaacaaaaaaaagcaagtatgtgattcaaggctgatagggtggcacttgcagtgccatcagggattgagatttcttctcctagacatgtttcagtgggttgtttttatgaggtcacagcatgggcgctgccccctgccttatgtctgcatgccaagcagaaagaagggaaaaggtgaaggcaaaaaggacctgtcagcttatcctgccactttttcataggatcttctgcagcacaatcagactgtgtcccatgatcacctgtagctgcaagggaggctggaaactccaaatttttagctgagcatatggccactctctataaaattaagcttttatcagtgggtaaataagggataaatatgctggttgacagttagcaacatattccccattatttttacagatgagaaatctgagctagccagaaccaagaccagaaatcaagtctctagttcagtgccttttttgccatatcagtagtttctacctttttctcccccgactgggagaaattaactgcatttatttaaacaattactttgttttcacattttttatgagtcaaagtcataacatatccatctagatcttttgataatcataatataacctgtgccatcacactgagttttttttttttaatagcagccataaacaaatcacttagccttttttattagtccataagtccttgctactggtaaatttgtggtttctcttaggtgcacgccactttagagacagtttttgaggtcagtttggcttttttcaatattgtattagtttgcagatacctattactatctggggacccattaatttttttccacaaatatttatcaggctcttacagtgtacaagatgctctagtagtagagtgaacaagagaagcatggattctgtcctttgagtgcttgcctcctggaggacgagaggacaaggaaaccagcagttgcactgctgtgctagaagcacagggtgcggtagaaaatgaggggaaggacatccttgtggacaactacagtggcatctggcactacgcaagtccagacacacaggagacccaaccgctattgtcaaacagtttgccttcgcattatgggcatggaaaacagaacaacagcaaataaatcatgctcttagataactaagtaccaaagaattcagacatacgaaatgcaaacatgaggttaaacccccacctctttatgagtcaaaaaaaaaaatacacgatgggagtttagaagtaaaattgcctggattctgaaaatacgcctaagatacactaaagcaatcaccatataaaccaaagatttattgtgcagctttcaaagaatcattccagtttctgtttggagaggtagtcagaagtttatatgctctataaacctctctaagtccatgatcctcctggcccaaatagggatcttgctctcagtgatgaaacatctgaaggtctgaagttaacaatatctcccagtttggccaagaaaaatatactgcagagaattatgagaattaagatcacctttcaggaagttggggtcaccaagaaaggttagaggagtgtggattcataataggcatagacaataatagaggagcggggaaggagaggtaaaataggagggtgacagtcatcactagatggcagggcctattagggcaaggaccacacctttatcatttatctctgaatccctccgccttgtgcccggcataaggaaagcactcaataaataattgtcaaataaatgaatgaatgaatgcatggatttgattgaagaaacagaaagtttgagaataataggaagttctttccttctccactgtgtagtagtataatattcaaatgcatatattcagcagcacgtagaaagaggcatggcatgtttaagtgctcagtatatatttgatttgtttgtttatttgtttgtttgtttgtttgtttgtttgttttgagacagggtctctctctctgacacccaggctggagtgcagtgacttgatcacagctcactgcagcctcgacctcctaggctcaagggattctcctgcctcagcattccaagtggctgggactacaggcgcatgccactatgcctagctaatttttaaaatttttttgtagagacagggtctcactgtgttacctaggctggtctcgaactcctggctcaagcaatcctcctgcttcaaccttccaaagtgctgggattacaacagcaaataagttatgcccttagataactaagtactgaggatttaagacatacaaaatgcgaacacaaggttaaaccccacttctttatgaatcaaacacacacacacacacacacacacacacacacacacacacacacacacacacaggcagtttagaagtaaaattgccttgattctggcaggcgtgtgccaccatgcccagcctaatatatgtttggttttaattaagatctaccttgatagaccttaagagaaatgagctcaaaattatttggtcccctatttgtagaatatttcctgtggcattttaagtttttctctccaaactaaggtccctccagaaagaacgtcccctggcgtttcactactactgtaattgtggcaccccctcccctggcctaggcccccaagtgctaggtttgttcatctttctcctatcacatccacaaacttctttgcctcttaggaaagcttttaacttagttggagaacatgctggtgatccactgaatctaatttgtctctcctggtttagtgcaattgaatcatctcaggaaaatgagaagcaattaggtacctgttgctaacaaggcactgaaataatctgccaacagacgcacggtgtttatttattattggagtatgtcacttgagcaaacattacgttgcctttctccaagaagaattgccagaattgattttcaaatgcaggcctcatagacctaacaagtaccacctttaaggagcatggaacagagaagcaagagggcttgtgagcctcgttcagggttagttcaagtgccagtgcctagcctaatgggcagcgttgtggatgggatttgaagttgcaggacactaaagaaaaagcagcttttttcttttttttttgcagaggtcctttaagtcccagttcaggaaattattaaattcattagccagatacttagaaccagctattactgcccagccaaaggaaaaaaagagtgccagcaaatgttttaaaactacaactaaacaaaagtcaggaagcgtgtaattaaaactgtacctttattgtattgtaaagagtttcactgtgacatggaaaatatttaaaggagaaggctgtttagctaatttgtctgcaagtgaactgcctagtggaactatcctaaattaactgtaaggccacccaccgagccaccctcataaagagccatggctgctcagcttgggtttgtgtaacgttcaataattactagataaatgcacaactaaaagctctattacactaataatttgtactgtgatagatgtgtgggacaccctgctgggttaatttgtcatccctgcagcaaacttctaaagagagctcttccgtagtggaatcatgttaatatgttgtccctgggaggacaggttagagcagtgagaccacttggctccttaatctcttaaagaggcaaagggcctccagggtgagtgctgaagagaatagggtgatgaacccaggggacctggatttaaactcatcttcacaaaagaagctgctttcccttggaattcctttgcccctttctctctgtccctctcagtcacacgcaggcctatgtgtcccagtggtgcatgtgtgcgcacaggcacacacaggcatagacccacgtatccatacatagtgaaggcagtggttctgagcaaggtttcttagaaaccccctcattttaagacttcctggtatcgtacgcttggactgtaccttgcgtagtcagataagccccgttctttctggtttagcttaacctaagttgattccatgtatagactcattatttattttccttttttcagcatagaataaaaaattcaagattgaacttgtatctcctctttatgtggaatggtttcttctgcctcgccctctccctctctctctctctctctctctctctctctctctctctctctctctccctctttctctccctctctccccgtctctccccctccccaaccccacccgcacccaggtctgctattctctgtgtgagctttgtgcttaggctaaatatcctcagactgtggcccagatagccacagtgagcagctccagccttaatttccaccaatttaataatcccaagagaaaaaagagcagcttttcaacaacagatttagggaagggcctactcctgcatgcttatgattctgattatctgggtttgggtcatttgctcacttttaaaataacccttatgtttaaaagacaatggagtgcctcattggtgtgacccggcttccctgtccacccatggagtcagcgggttaagtccatcctaaccacataggctgaggctgagggacagagagttccccaaagaaacattagagctctgtttccagaagaaggggtgaagaactgctgggcaggcaaaaataatagctacccccaggagataacagcaaagctggcctgagcactggccaatgggctcagcttactcactagctgtggcttgttcctgcagttagtgtttgcagagcacaagaaaaacccaggcctatttgttcatgccacagacccccagggtcacttgaaaacagttcggctcttgattctcaattagctggtgttacctcattgcattgtataatccagattacttttcatgtatctctatttattctaaaaacaatcctaagaatattaaataacccagagtctagcatgctgtttggcacacagtagattctcaacacatttgttgaatgagtgatcctactatgaatgaggcacctgtgtacattaatgctaatcctcagaaaagcctttcaaattgcgctattctttcttacccccctctgccccacccaagacagagtcttgctctgttgcccaggctggagtgcagtggcacgatcttggctcactgcaacctctgccttccatgttcaagcaattctcctacctcagcctcctgagtgtctgggactacaggtacacgccaccatgcctggctaattttttgtatttttagtagagatggggtttcaccatgttgaccaggctggtctcaaactcctgaccttgtgatctgcctgccttagcctcccaaagtgctgggattacaggcgtgagccaccatgcctgaccaattgctgctactatttaaagataagaaatttaaagataagaaactgtaggtttggaaatgttaaataattttgcccagattaacacagggagtgaatgattttacaaccagaagagtcaagctcattttgtagtagaggacactaaggaatataggaggctggcgtcttgctagtcaatacccaagctgacatgaaaacttggtaccctgactttaatcactagactgattattctgttgcttattccattccttgtgtgaaatttacccacagtaggattactcctcaaatcctatggggtgaattcaggaagatacttcaagttcaggaggatgccttgaaagtagtctttggctgggagcggtggctcacacctgtaatcccaacatgttgggagaccaaggcaggcggatcatttgagttcaggagtttgcaaccagcctgggtgacaatgaaaccccatctctactaaaaatataaaaattagccgagcgtggtggcacatgcttgcagtctcagccacttgggaggctgaggtgggaggatcgcttgagcctgggaagcagaggttgcagtgaacctagattgcatcactgccctccagcctgggcgacagagcaaaaccctgtctcagagagagagagagagagaaaagtagcctatgctttagtaatcatgttgcacagaaatagaggcttccatttcagtataaatctgacaatttggtggagagaaatgctgcaaaataacccatggctttatgtttgttatgagatttgcttttctgtctgcttattttctgtgtgtgtgtgtgtttttttttttttttaatgcaggaaaagacttgcaacagcctagatccagcacttggtcgttacgcaagaagcatctgcatggatcttgttttttgaagtcctctttcacaggactgcagtttgtaattccatttcacttccaacaggtcattggatgattccctccctttttctgttaatctctggaatcatccaatctatggtggttagttttcttctcaagtaattgttttgatttgtttttcattcttcatttagtctcacagtagtatcgcttacatgttacgtaaaagttcaagttcccttcatgtaactggattcttgtcaactttgcctattaaaccatcactctaaatatttccaataatcacagctgttgcgtggcgtttgaacacatttcacatcagccatcatggaagcttaggcaattagtgtgagaatatggtcaattttgattcaaagaggccctgtcaggacaaaggctggggctgtatttcacagagcttaaagtagcacactcaggtttttttaaactctaaatattacagtctccccaaagccaaagtatcttaaagactgagtctagatatactgtacaacttaatatcccataaacatttttaaaatcatttgttttaaaagccttccttatttcaatttttagattttaattttatttttatggatcagttgtactatttgtaaatgtaatcccagagactgaattctatacatccactagagcttaaactagatgagcttcagagagtatttagtccaagctgcttactgtgagaagagagacctagggagagagaagccacccacatttataatatgccaggtagtggcagaaactaagttaaaacccaagtctctttatctagtctgaaaatattcctaaaaaatgccctagatcttctgaaaagcatttgtttttgttactgtttttttgtttgttggttggttttttagatatagggtcttgctctgtcacccaggctagagtgcagtggtgtgatcatggctcactgcagcctcaaactcctgggattaagcaatcctcccacctcagcctccaagtagctggaattacaggcacctgccaccacacctggctacatttttaaaattttttgtagagatgaaatctcactgtgttgcccagggtggtctcaaactcctgggctcgagtgattctcctgcctcagccttctgagtagctggggttacaggtgtgagccatcacacccagccgaaaagtatttctagtagtcaatatgtattagatttctgataagcaaactcccaataactaacacgatgggactttcaagggaaatgatagagatttccactgtttccatgttttgggaggccgtggggaggccatgctcagattgtggtgtggtcagaaacgtgcctgggggccaggcacagtggctcatgcctgtaatcctagcacttggggaggccgaggcaggtagattgcctgagctcaggagttcaagaccacgctgggcaacgtggtgaaaccccatctctactaaaaaaattcaaaaattagccaagtgtgatggtaggcacctgtagtcccagctactcgggaggctaaggcaggagaattgcttgaacccagaaggtggaggttgcagtgagccgagattgcgccactgcactccatcctaggtgacagagtgagactctgtctccaaaaaaaaaaataataataataatgcccggttggcaggggcctacgtggtgaagagggaggtcagtatggacactcaaggattgtaggtctaagtgaaaaatagcatctaaagggagatggccccatagttctaagcttctgggttaaatctcacagtctgaaatttaagtaaaggcaggaattcacagtatgtttggtcagcaaagactatttgtctaggtctttaaagaacttttatctttacttagatatctatggtatctatgattattaggtcaagattgttgctactgctgttgttgcttttacttttcattttgttgtttgtggaattattttcaaggccctcatgtcatatccatgctgatagtatatactattttatcaatatttatgtacttttttgtccaagagacaggcgagcaacaagtacctcttgttccatcactcctttctttcatgtattctacaatcagaacaggtcctagcacacaggagcaaatttcaatgtattcattgcctatcccattcttgtctatgatagtactatcatactacaaaagaagctattgatcacttaattgtgtgatcagaaactgtgccgtgtgccttatatacattgtctcatttagtcttcacaacagcgctatgaggtattattagccccattatacagatgccaaaactgagttgtagagaagctcagcaacctgaagcatagctcgtgatagagcttagaatttaaactcatgtctatctgactccaaagccctggtccttatattatactgcactgcttttctgagtcgtatgtttaacttagaattatatacgcacacacacggatgtggtcagccagcacagaccaaggcatattaagtaatggtgaagacagacaatcaaaagtctaccgtggagagttaatgagatatcaaaggtgaccagattgctttggaaagcttcagaaagctgaggtggaattggtattgactgtcaggggtctgactcacagagcacagcaggtgcttggagagtgaacaagaattttgtgggtctacaccagggactggaaaactattgggcccacagatccaatagccctttgcctgtatttgaaaataaacttttattggaacacagccgcgctcatttgtttatgtaatgtctgtgactgcttctgcactgtagcagcggagttcagcagttgcaacagagaccatatagcctgcaaagtctaaactatttagtatctggtctttacagaaaatgtttgccaactcctggtctagtcagggccttgagcaacaaaggtcttgaagtagctaaaattgatctagataaaaattttaaaagactttggccttctgttttcttgtgtgggtctttctttttctttctgtttttccaaaagacattagaatttgatctcttagaaaatcccctgaattcaaatggaatagactctatcaaccatcttggaaactaaccgtggcataaagttactttgtctggtagcagtaatacaaaaacactggtgttttgcaagctgtcaagccatgtcatatatttctctcaattgacatatctgggtcctttcacgtgcatcttcgtgatgttaaaagatatgtaccatatgttttgaaaaaccttggctcacctcgagtcaaaagctttgttatttagaaaaggcatcacctcttaaaggtttgaaaagcattgccaattcttctttcctgtatctctgttaaaataaatcccttaactccaaacttctcagctttcatcaatggcaggcctgattcatgcatgatttataaattagggctatggaccattaagatagatttctcagctttaggtggggtataatggtgttatatagtgtggttttgaatttctgaagaagcaagatacatagtagttgacaacccaagccatttttatgttctatttacccttatggaaagcttcttttgttttttaagtgggatttttttcttcgattttcttttccttttgaagctttgccgtattacaaatttttacttctaattatgagtagtcaagagttcttaatgccacccttacgctatggaagtggtaactttcatctaaagaacatcttatttctgaagacagataagaaggtttttcttataatggcgctaacagagaaaaactgtttggaatctcacctgttgccactgcctttgtattcattaacactaagactgtgaagttttgcagatgccagggctcaggagtgattattcgctcttgtgagggaagaagcctgtatataacactgccttaagagcacactgtgcctgaaggaggattatattttattgtttgtgttgctctcttgacagcttttctttggagcctcccatagaagagagactgggatttaaaggctgatgccagaaagcaaaagctaacgtgaaaagaatccaagtctctgtccagtgtgtgagaatctgcaacggttcatggacaaggaataaaacaattaaggcaatgtcagggttataatacagaagaacatatttcaacccataaaattttggtttgagggaaaatgtgtgagagttattagagttcttggaggatgagcttgagaaaaactactggaaatactaagagattactttcttcttctatctctttttcttccctaagacttataaaagcagaaaaatgcaagattccaagcttgtctggacacagctccctgataccatcctatttcatatggcccacgcttagattttctaactagttctgactcctcttaagagcactcttatgtgtctacaagacctcctccccatagtggactctcagaccaagaatcactggttgtattatagaagtcttgcaacatatccaataatacaataatgatcctgaccttctcctttctcagtcttaataaattctgcttttaacggaagaagcatttttgagttaaacatgtatatgtattttttcaattgtttgaatttttaactttttctcctttaaactaaaaccaagagaggatttttaagaactggtgggctgctggactggtggggagggaatgaacaagtaaaccaacctgactgacctgctttcgtttttcaaagtatccagtaatatgatcattttgtaataaatagctgagtattacaccctttgggaaattgtggctctctgtttcttttcgttgtggctactttgttcaggatgtgtaggcagtgccattgcagccaaagaaacctgatcaaatttccttccttcccatcttatttatattctttgtgaaaagcccaaacagttgttttaaacaagtctggccactcgttaaagtttaaactagtagtgagatccatcaggagtgaagtgtttctgacactctctgctgctcctggcctagggtactaagagtattagatgccggaagcagccaattttgtagtgtcttttaatacacaaaattgtattaacatcaatgtggatacagatggatgcactgcaataaactgtaaccacttgagaaaagcctttattgactctcaagtaaataatgcacattttaaaggatctaaatatgcatttacataatgtgctataattttttatggtgtcaactactcacacacacacatccataagacatgtttttcttcgtcaaaaatctggactcataccattcttcgtgcattccattagcatcatgccaaattcataatggtagtttttttctataaagcctgatctggccacctcaaaatatagttgatgaattttactctttaattgatttaaccccagtggctctttctaaaatgatttgagacaaataaaaacttaggtacagtaaaaacatccaagatgaagagagaaaacaagaaataggagagaagagaaacaaagttaggcaggcattgatgacatcttaattctgagtttcagtgggtttcattgtctggtagaagaggaatagcaggttatctagagaaatagcatctatttaataataactagagctttgtgatgtcagtaacgtaactattttctgtttgaagaaatgaaggttcaggatctcgaatgatttctctccagttgcacagtgaactgatgactgaaccagaaagtccaaagcatgagaaagtaagggttgcaaaggatgaccctttaaaatgcagactcagcaattgcccaatttgaaactacaggctaaatgatttcctggtattaattaagaattaattgattcttataaatcagtcattgtagaattaattccatatagtaccatatgttcttgtgtttgtgttaaactctgttccacaaggaaatggtgaataaattgtttttagtaaaataaaaaacgaaggtctaaatttaagttgctaatgattgtcttttacgtatttaacaacaacaaaatgagggaaaggatgtttataacagttaatgaggagatgacagggtgcttttgagttatttcttctatctcatttctttaaagatcagctctgcttgatctttgctcaagtgaatttcttttttgggcagcattttctgtaggccaccgtgatttcataatctaacaattacccatcactttccattgagcacctgaggcagcggcactttatcttcaaggtcagcctaccaggggctcttgtcagcagaattggcacctttgtgtttggcattctgcaaaagttgagtgtttcgttttgttaggctcagtatattctcagcctagtttgggaaatatcacattctgtccttaactagtgactattccatcagacgcagggtaccgagtacaagttttttgccaccagcaaggaggactgtaccatgttggatgaaaaaattcctttgattcttgaaagccaatggcataatttgcagagtaagagatgaccagagccatttaactttttagcttgtgggttttaacaagcaacaacaatagatcccaagatttatcattcattgcaggaagtcctaagttttactcatttttcttttttttttttttttttttttgagacggagtctccctctgtcgcccaggctagagtgcagtggcgcgatctcggctcattgcaagatccgcctcccaggttcatgccattctcctgcctcagcctttggagtagctggaactacaggcacccaccaccacacctggctaatttttttgtatttttagtagagatggggtttcaccgtgttacccagggtggtctcaatcccctaacctcatgatccgcctgcctcagcctcccaaattgctgggattacaggcatgagccaccgtaccaggccagttttaccgatttttctaaaagctccctggctcttgaccaggtggagaaaccaagttttggttttagcaaattttattctatgtttaacggtatgattatcttattaacctctgtttattcagtcattcactgcacattcaacaaatatttattgagtgccagactcagttctggggatattgcagtgggttgaaaaggtatttacgaagatggagaaggctgggagaagtgtaagcttgagaggagaaggtaatgaaaattctgattcaaataggttatgtttgagacatcctcaattgtatgaccgatggcaaaatttcatctgttttggctcagatttgtttcttgagcccatagtaggagcctatgaatatttattgggcagattaaagattgcataaattaaagggttgcaccagaccacctgcaagacatggattggaaagttgcttcccctccaatcgcccatttccagtctttttgaaaactacagatgtcactctgaaccccatagcatgagccatttcagtcattagtcagaaagtgccccaatcatgaggagatcccggtagggaacaaagaacctatgcccagcaactaatacagatgcattctttttcacagcctttagccatgcaagtgggatagtggtagaagtgatggcctgtcttactgagtttctcttcagtattatgagtcattcttggtattggaaaggtcttattttccaaaatgtggacattcctgtgattttcagtttaaagatttaaaccgaagaaaggaaagataaatactttcatctcctctaatttgggagaggtttctctggctctcattgagaagcaagagctgctgctatcttggcttgacttggtttgaatatctgcaaccttcccatgcactgctcttatcctccagccagttttatcaatcatccttctaattcaagggcaaaagttctcttagagaagttattaggcacctcacataagtttttttaatctaatgtaatcttcttgttcacatgaaatttaccagggttcaaatgtaagggagcagtagttgtctgagtcttttatcagtttttatgggcacagggccaacattttagcaggggtcactgcctgcttaccctgtgggttcccctgctgtaacatatgtgcatttctgagtttgtctttgaaatggcatctgaaggcgacataaaccatccgtgtaaagtgaggcacccaaattgcatgggctcattaagtgatcatttactacatacttcaaaaaattttcatcctgaattagtccctagaaatttccttgaaaggggtataagaggtttaacaatgaattattgtctatggatagctcagcgtgaaaggggatccatatgtgcaaactagaatttgtcatatgtaatgtcagttaagtcaggtctaatctaccaaatacattttttattgcttgcttcattaaaaaggctcttaaggtaatgaataatcttcagcctcaccaaggattattaatgcctttataactcatgtccactgaaaatagaaagacagcttgaaactctaccctaatctaacctccgtgtttgtcttagagccttaaggaagaaaatctgtcagacctatccagtgttaaattcagtcacatgagcaatattgtgaatcgggccaggaagagaaataaaggaggaagttgaatcgggttcagctatgacaaagcaggtctttcttttcataaccctgatgttttcttttcctgcagcaagtccgcatgcaacaccatcgactcttcatttcccgacatcacccattatccagcagcctgggccttacttctcacacccagccatccgctatcaccctcaggagacgctgaaagaatttgtccaacttgtctgccctgatgctggtcagcaggctggacaggtggggttcctcaatgtaaggaaacctctttttttccatttctttagaaatgttagccgaatataaaaataacaaggggagaccttatgatcatgtgacgttgtgctctaatgttgtgctgactgactgcaggcaaatgtcatatttattctagattgtgggaaagttaacttggtctaagagtgattagtcagggtttaaaaacagtgtttgtgttaagtttgcaactgtcaagtttatggatataaatcagctcaagggtgaactatataaccttctaagttctgtgggctgatcattccacctcgtgcattctaaccccagggctcatacagttaacaaaatagaaagaccaagtagttttaaataatgatttggggtggtagagaaaggtagggagatgaaggggacagatgtttcagatcaactaagttgatatttttgaaaaatacagtcttgtaacactttagatcaagttgaccagtacttgaactcaagatgctgaaagtacagtttattatggtttgttatttctgcaagtcattatctttcccacttatcttggtataaagctaaacagtgttcaatagcttcacatgaatgtttttatttttcctcaaataaaccaaataatcacaatttgaaatggcattccaaatgtaaaagtgatttttaaaaatcagaaattttatttcaaatataggattagatgtttacagtggaaagctgtatctcaaggccaataataataaacaacgaccagcataaagccaaatttgattttccttttctactaataactgtgcatgaagtcacagactagccataattattactggccaatttaggatagtatgtcacaccatcctgtcaccgatttttttcacttgcagaaatacctgattctgcatatctgcgccagaacaggcagctttgactaatgtctggtgatgtgttagcagatacatttctgtctagacaacaaatcaatatggtgcctcttttctttttgcttgtacattcatttgcttggcttattctaaagcattcacttatggactctcagcccactcagaaataacgcaaaggcaaggttgctggcaagaaagcacagcattctgatcgtcagacgaggtagtctttgaggagcaatactaaatatataagtactaaatatataagtaaatgttgatgggggagtgagactgcctctgtagaattattaagcttaaatgtaaaagcctgggacagcagaatctccttcaaccgaattttgattggggactaaatgtgaactgttgtcgttggttgaatagaggcctcttgggaaacaatgaaaaaactgagctgatcaccagcatcaagcatctgacttctaaattattaaccatttttgtaatagtcctgacaccctatataactgtcaaatgcccagttttgcattttgatcagaattttataggacttaaggcaggtctcttcatgaaactattttgaaaaaattgaaaataaaatgggttttattgctctctttggaggggaattttttgttaaagagctgttatttggttgttttaacatcaggcagcaaaataaatatgactcttatggcatatgcttatataatttaaatcaaaattagaagtgatatttttccctagcagacttctgacagctgaattctaaagtttctgtgcctgatgttatacaatatgtgaacaaaattttctatgttcacttaacacatttattaaatgttatataatatcaactttgaagagtgaaaataaaatattacttttttatctcaagtgcatatttaggaaaatttattctatctatgtaaagaaacatagtggaataatgccacagtccataaaacacttagatattaaatatttaataatcatgagaaagataatgaaggtagcagttaatacagaaaaatacaaaagattccaagcaaaagttggttactcaggggacaaatccaaagtgataattggcaggtgattttatgaaaccagatgcaaagaaggacaatgtagttcaagagataagtttaggatgcatggagcacatgtggctaagagtacttttgtgaaatgccttaagaacagaacccaacaatggacatttccgtatgggcttatggaagaattgaagcagctagatacttagtaatttacattaaaggtgcctgatgaatattttgttttcagaagcagctaatggttgctgtctctttcttctttttcttgtacgtgtgttttctgccccccccccccccacagcccaatgggagcagccaaggcaaggtgcacaacccattccttcccaccccaatgttgccaccgccaccgccaccaccgatggccaggcctgtgcctctgccggtgccagacacaaagcctccaaccacgtcaacagaaggaggtgcagcctcccccacgtcaccaagtaagtatggctgcgacaaggcgccggtcacttctaaagctgtatgcactggaatccacacttaggctttgtccctcactgtataggctctagaaagaggcacagatccccagtgatgttgtagcatgagtttgccagaccgagaatcaaagtgaacatgactcttgggtactccaccagatgaggaaaacactgggtgttgggtggatgagatggtgtagctacatacctaggactgaagtcaagttatgagctattacattttgtatattatttgagggatttcaaatgctattcccatcatcaagcagcagctacttacatggattctgcttagaaaaagttcctcattcttacagacagccctgccttccaggaacttgcagtctaagagaaatgcacttgaaagttatatacctcatacatcaaataggagaaaatgtctagatcaaagcaccaactcaaaggtgtgtacactgaccattcgctgagagtaagagcctggcagaagatcaatgctagtagccctggcagtcgcatggtgaggtttggcagaggttggggtaggggctggggtacggagatagaggggagagtaggatggaaggaggagagaagtcttggctcttctctgaacagtctgagaacatttaatcaaagaatataagatttcacaacccttttagatgatgggaatgattacttgaactagagagagagtaattctccagatattccctgatgttttagatatggcaaggggatagaaatagtttgaatgcacaaatgtgccttttattagtgcctggaataatgacaaaaagagtgatggctggagttcctaggtgatggatgccctagccttgatagatggtgtgatgagcaccttccctaaagctgtaaagaggcagcaaagtataagagaaggataggagctgtggcagtgtgaccctaaggaaagccttcaagggggttgtcaaaagaagtgagactgaggcaaggaatctacagaggaaaggatgtaagagcagcataggaaaggagtgttaaggccaagaacttgaaccacagtaataggtgtagaatggaacgggacatggtggggagtgttttgtagacataagcatcgggattggacagtcctctggatgaatgcggtgaatgaagattctaggcctctcagcttccttaccttcagtattggaataataatgatagtgaatacaggagggaaagagacaaagaagaaaactgagcccctgtttatgccatgttcatagaatttgattctgggggcacggaatccagatggctagaggccctcatggacacatcagagagtgagctttgggttatccagtatttatgcattttgataatatatgcagaaatgagcagcactgtgcatagattctgtatcaatagccaaaagattgaaggttcaggggcaatctagggaagacctacttctcttggtaagaggtgattcaacacttgtcaacaaaggagaaaaccctcagtgtccaatgacagagaagcaagctgggcttggcccatggatcttagaagctcagcttagaaggaaagcctctgcttctcagaggtttgaggcttgttcaaagatgtcacataaatacacaataagtgccctgctcgttgtgtatttatgtaacatctttaaacaagtcagagaaataactgccccagactctacttacatctgttccttgaggatgttggcttacagattatgcctactgtgccctgtccatgcctctgcataccattttctgctcgtcttctctctgtctgtgcaggacattgccacagtcttttaaaagctgcatagtaatatgcaatcaattccgtggaaacagatcctcacctccactctcaatggctcgtgtgtcctaatgagtttttcagtaacgggaatgaggctctgctgaggcacagcagaagagtggaaatagtaatgtgtggctgttcaagtctaaaggatgggggctcaaatgcccacctttcaaattactaactgtgtttctctttgaatcaatttcctcttctataaaatgtagatgataatatctacctggcatgtttgttgtgagatcagttctgatcattggagtattttattatctgcccaaactcttacatagtggaagactccaggcttgggtaatggtaaaatatatctgtaggacttggagaagctactcaacccctaaattgagttgatgcctttgggtccacagttctagactccactccgtggattgaaccaagtgctatgtataagatgatacctatcatcctcttgtgcccagcctcaagcatcttgtcagcactaaggggcaaagggcagaaggagtcttggcagatccaactcatatggttgcatgttagagcagcacttaagatttggggtggggtgggggtgagagaatatcaggagaaagagtcccagagcttgatacagataatttgatacttactttttgaatcatgggattctagaaatatagacaaaacaaaatgttctaccgatgacacagaaaggtttttatcatcattcattttagcccttgttcagctaaaggcttttctagggtatgatgaattcatagtaatatgtagtttcacagcatactattgcttaccattttctgctttcttaacaagatggtgttaggctgggagagctgtaatttatagcgtaggagaagcctttcaaattaaaaatcttgaagcccactcatccttatttggaggggatttaagggccctcattttaaaatatcgtctcccatgccctgatttctaaaccaattgataaataaaatatttttttaaatcagaagacaaaatatcacctttattatgagagaatttagtttataactgtgggcagggcacttcctaacactgaacccccaattacatcgtcatagctaccaggtcgctggcaggactagaccacagcagcccttcctacatatggtccgccctagcctgtaaagctgatggcatgaaggtgcgggtggcagtgtgcttcccaccagcacctgtccccgaagaggaagagacagggtggggtggtagggactagtcatgtccagtttttcctttgaagcccttacaacctagagagtaacaggtgagagggtggagagaagccaagagtagatggaagggaataaatatcaggagtgaagtagcttctccctcccttaacattcatctttgatgactgcctttttcattcatttattcagcctgcacctatcaggcatctgtgacacggcatggctgtgttagtgtgtgggattcagagatgatggatccctgctctcaagaaatggggatctattgagggaaaggtaaacaggcagtttacacaggatgacaccgggataaaggtgtgtataggtgccatgtgaagacatgggagggagtttggtccagtgtgggcctccaggtaaaggtattttagaggagttgacttctaagctattcagtagggatgacatcctggtgtcttaagagaagatagaacttttcttctgaaaccagctgggggcctaaaattggattaccactagataaaaatgtagggcaaaactatagtttcagaaatcaggtgctttcttagaaattaaacacacaggttgagtggattctgtttatcttgtcagcttatgagagctcaactttagcaagaaggagcatcatgacagggtattcagtacatgtgctcagcatcccaacagtttgatgtctgaaatggaggctgttctcaaaaatgtaaactgtatgatgtaaaacagccttttctatttaggagtttgagatgacttgcaataaaatacaattctaaaaataaatatagggactgggcttcgtggctcacacctgtagacccagcactttgggaggcctaggaggcggggcagattgcttgagctcaggagttcgagaccagcctgggcaatgtggtgaaaccccatctctacaaaaaatacaaaaattagctgggtgtggtggcgtgcacccgtagtttcagctacttgggaggctgaggcaggaaaaatgcttgagcctaggagcttgaggctgcagtgaaccaagatcacgccactgcattccagcctgggtgacagagcgagaccctgtttcaaaaaatatatataaaaataaataaaaataaaagtaggaaaatatgccaagtgtcttctgtattatcagcttttctagacctcaactcccttatgtattgatggaataacactaactgctctactcactctcgtagtcagattatcagaacaaacaggagtaacagatgtgctgtgctgtagacggttaaaagtccaaggcatcatttttaatatcttcttataatgaaatacaaatggatgccagcctggagcagagtatgtattttttaactaatcagttgcctctggcactaatactaaactttgcagctgtggccagaaaagcagggggaaggcagatgtgggggaaaaaaaatcctgtgaaataaatacattttaatgggaaaaatccttaccagcgccctaagaagtagggaagtgggggtggggcaagaataatttttataatcttgatttgtttggagaaagattgatagactgtgccaggtctctttaggatactatgacaaatggaagcataacctgtaagagcatttcacaaccaatgtgctccattcccacagattaactacctgtgtgggttttgatacctactgaaaaaggaccacttctttcatttattcaataaatgtttattgagcatcagctgtgtgccaagcactcttcttggtgctaggattcagcagggaatccctggccttatggaactttgattctagagagggaagaaagacagtgaacaaaatagtgagtacgaaaggtacgtaggatataagatggtgatatgtaagtgctacatagggaaatcaagccgagaggggagggatgcagctctaagcagggtgatcagaggagggctacttgcgaagggcaaatttgaacaaagtctggacaaagacgagagggtgagcaaggatgcagtaggaggagaggtttccaagcagaagaaccagccagtagaaaggcagaccaatgtggtgagatcagggaatgaaagcaagggggtgaggtcagagtggagtgaggatgcatttgggaccttggggatgtaaattacaccggttcttataggctcttataaggacttcagcatttaccctgagtgagatggggcagagaggtaatgccacctagattttaatagatacatcctgaaggttttgttgaaaatagattgtcaggagcaagaattaaagaattaaagcagggagttaaaaagctggatttttccaataaataaaatgagcgtcttctacatgccagccagcattctaggtataagggatataaaagtgaacaaaacagacaaaaatcccttgccctggtggagattacattttagtggaaggggataaacaataattaaaatataagtaaattagcgagttaaggaccagtaagtacaatggagaaaactaaaacaagcagggttgatagggaggggcacttattgcaatcttccaggcaagagttgctaatgacctgcaccaacgtgggagcaataggggtgatgagaagtaagcgggttccaggtatatttgaaaggtagagctggcaagatttgctgacacattagatgtgggttgagaagaattggtgatgatgcctgtgtttatgacctgagcaactaggatagagttgccagcagctgagatgggaagaccacaggaggggcatctctgggtgaggggtggagatcagaagttcggtttgaccaaattatgtttgagatgcctattagacatcttactgctggacttatcataataagctgcctttcacagctctttgcaggtgactgggtttttctgtgtgtatcatctcattaaattgagaagggactcctttttgaacatgtagtacaatgaatgaatagacctaagagtcctgagaacagctctggcatgggacaaagctttcattatgtttgggtctgtttgtgctgtggtaattcaaaatacacaattctttctggtaactgtactttaagttccaatttttatattgtagattggaatcaatatactataaaaatggacttttccagaaaaaaatgaagattggcatcataatctagagatataatagaaagagaaaaaacacttttgaattatgatggaagataaaacatgcatatttttttaattaagtaggaacacaaaaactcaatttaaaaatgcatgaaagacctatcaatatgtttctccatgccttcttcactatgaactttgaattttttcaactagaattctattaaaatagaagcatataataagttacctttattatttatttttatatctttgatgaatcttgtatatattcattatacaaatgaatatgaattcgttagccaagaacctaacaataatctatgactgggatttaaaatttctcgtataataattaacatgtgttcaatgctttttggttaacaaagctctttttacatatgtattatcttatcccatcttctcaacactcctatgaggtcaggatttcataggcaaggaaactgagattggaagatggaggttacattcccaggttagtttggtagggagtcaaatacaggcctttccatgctctttctactacctcatactgtaactgaacaaattacaaacaatgtcactagatttctgattctggggggaaccacagctgtctgctactgtcagaaattaacaacaacaaagtattttgctttttttttttttttttttttttttttttgagatggtgtctcgcttggtcacccaggctggagtgcagtggcattatctcagctcactgcaacctccacctcctgggttcaagcgattctcctgcctcagcctcctgagtagctgggactgcaggcacccaccaccacacctggctaatttttgtattttttagtggagacagggtttcgccatattggccaggctggtctcgaactcctgaccttgtgatccacccgcctcaacctcccaaagtgctgggattacaggcatgagccactgtgcctggcccaagtattttacttttacagatgtgtcaggcacttcacaaattgtttttttgtttttttgtttgtttgtctttctgcaacagagtcttgttctgtcacccaggctggagtgcagtggcgcaatctcagctcactgcaatctccatctttctggttcaagtgattctcatgcctcagcctcctgagtagctgggatgacaggtgcgcaccaccacttccagctaatttttgtatttttagttaagacagggtttcgtcatgttggccaggctagtctcaaactcctggcctcaagcggtccacctgcctcggcctcccaaagtgttgggattataggcattagccactgtgcccagcccacttcacaaaatgtttttatatatgtattatcttacttcatcctcagaataatcctatgaaataaattctcttgttagccagattgagaaagacaaggtatggaaagataaagtaactttctcaaggtcattcagccaggatgctagagtcataatttccatccaattcaccttcaacctagagctcataggcttggctgtagcatgaggatctttgctttagcccaaagcttcttggttttttggttttttgttttgtttttttttttcagtgaaaacccaatgggagaaatacagaggaagatgttagtagttgtttatacttaagtatgaattggtttctgttccagagagtgcatcttattagcaggtaaaggaagagagcagaaagtttgaggggaaatataaggactgtgtttcctctgtcagagaagaagcagtagattttaagaaagaatgaaaaaaaaggagttagtggcttccattcgcggaactgttttttttcattagtgacgcctggactatgttactgttctttttcttaattttaaaattttacattcaataaaattcactctttagtgtacagctctgtgaatgttaataacattcttgtaaccaataccacagacaagatacggaacaatccccaaactctttcattgttctcacctactcttagtttaaagtctgatgtcacttagtgccagggaacttattttactttgcttgatttccatgttgattttaattcctctaccagtgctgctgctatcccattatgtttcaaaaattgagagattatgaaagagacttaaatacgtacagtattttaatctatgataagagtggcattttatattagagaagcaaaaggggttagtgagtaaagtatattgggacagtctggaaaaaataatgtttcttacatcaaaacaaatttcagccggaatcaaaaatataatattaagccataaaatagcacaagaaaatacagggcaaatttttatactattggagtaaagaagggctttctaaataatgccaaaaaaccagcatccatgaaaggaaagtatccaaaatttatgcatggaaaaaacaccatgaacaaagtcaaaacacaaaagatagaaaaaaaattgtaacagacgtgacagggctaaattatctaacatataaattatttttaaaagttagtaagagaaagaccaacaatccaatagaaagacaagaaagggatataaacagaaaaggaaaacatttgaaagacatctcattcatgtatcatgagagcaatactgattaaaacttgagtgatatttttacctattagattagcaaagatcaaaaggtgtcttaacacaatattggtaagcatgtggaaaacagacattctcttgtgctactaaaggactgtaaattggttcaacctctacagaggacattttagttttttatatatataaaatgtaaatgtgtgtgataaagtttataacacaaaaacatgtttacattttgtacctatattagtacatatataaattttacatgtaagccgtgcatacatggctagggcatatgaacaaaaatgtacataaagtattgattgcaacattgattacaataagagactggtaataactgaaatacctaccaactgagtattgtacattaggagctctttaaaaataaaaagataggtctgtctccatgaattcatggactaatccttgagttatattgttacattaattcagcaaaggagagtgctaagaaatatgtatggaatgctgcatgggagaggggatgcatgtacgtatcagactgtatgtggaaggatagaaactaatagtggtttactccagggaaaggggcaaggttgttggcagacaactttttggtgccttatccagtgagaaagatattgctaagttttcagtcctccttttatatcaaatattatgatttctttattcttaaaaatatttgtctagtgatctaataatcttgtttatactaaaatgatgacagtgatcaaaaccacatactcacacatgggggagttcataaaatccttggcaatttttatacatctagcttttagctgtactaacctgaacttttggagtgattccaaaaatgtgtgatttttctagtaaaaaataatactcttttccccctcacagagagcatggggttcagtgtaaggtgagcattttcattcacagtagctattagttggttgcaggttctgccttacgaacccattaaatataaatgtacttgtactatcttataacataattggttataaatactttttagagtattttaattttgtgtagtctaatattttggtgtttaaattttttaaatgaaaagaaaaagaattattaaaaatcaagcattttgataggtattttcatatgcattaccttagttgcatttgttattataaatctgcacaattggaattattagccccttttaaagaagatgaaacggagcaaaggttcagatcccagtctgctggactccaaagcccagtgttttctactctaccaggacacatactatgtttagaggtgtaatatcatgcagctttcctttgaaaatcttaaaacaccccattaaaaatcttttacattacgtcaagaataacaccatcctgggtacattgaaatagatgaaaaacatggaaaccaaagcaggaaaaagattaagagataagcattacaaagaaggaataggaaaaagaacagaacattggatgattccattcatttgggtcgtcataacccagtcaactcttgtgttcaccttagttttttattatttcagatgacagatgagtttaagtctttctttataaagataatatatggcattttaggaaatttgcaaaatatagaaaagcataaaaaagaaaattatattctcccattatcaactattaacattttggttttgtttcctcatctttgtgtgtgtgtgtgtgtgtgtgtgtatacacatataagatgattgtgaccatactgaatataatatctagtatgccattaattcacattttatgccttttcgtactcaaaaaaaagttaagaaataggattttaaataatttttacctatattcttactataggacataaacttttcttctaacctatggagtatgctccagcatatccttagacatgtatttttgtccccaactctaataatttttttaggatatgtttctagaattggaattgctaatacaaacagtatgaacattcctcttgatacacattacttcattgctttcagaaaggttgtgccaatttacaccttttcaaattgtgtacgagtatgatcataacattaacccttgagaagtttgggtgttatcttttttaattgttggaaggcaaatgtgttggggatataatgtcccttatcagatattggaatcagtagtccctgatgaaatgattttagtgtttttctttacttgtatcaattatattaaaattggaattttagggatttcccatcctatttgcaaagcctctccatagggatcaccctttggactgttcctgtgaagagagtgacctgttggatatcacagaggggtaaagccttagttaaagggctgggagattggagtaatgtccattatactggactctatatagagaagttcagagaggttaactggcttgccaagatcacatttctaataagagatctaatgaattcaatccaggatttgctggtttttaaaatttattttctatttactatgttgcactgtctccaaaaaaagtattatttgagatttttaggttccatttgtgttttatttaagattaaaaattactggaagttatttaaaaatcatccataatccggctgggtgtcatggcacacacctgtaatcccagcacattgggaggctgagacaggaagatggcttgagcccaggagttcaagaccagcctgggcaacataatgagacagtgtctctacaaaaaataaaaatttccaggcatgtggcacacacctgtggtcccagctactcggtaggctgaggcaggaggatcacttgagcccagcaggtcaaggctgcagtgagccatgttaaagccactgcactctagcctgggcaacagagcaagacccatctcaaaaaagaaaaaaaaaatcatccataatcccagtcttcaaagacaatcactctctgtgcatatttcccagtcattttctgtgcatattttaatcataattgatcatgatatatgtgtgtattatacagttttgtaaatgattcttattttgtcttataagcacattacattattattttaagatattattaatggctgcaaaatattccaatgtatggatgaagcattaacttataagttggttccaatttgttgctcttataagtaatgatgtaatgaacatcttgtagcataaacctttatctgtattattagtatttgtggaggataaattcctgaagtagattccagagttgcactgccttttgagaggctgcagaagtctttcaagagggagcaatccaatatattgatctaagtttctttttttagcaaactccagctgaatccagggtttattccctgtggctatttaatataactttcacctgtccctacccatatacatggttgcttctgatcaataaacattttctgtcaattgagcaacacacagcatacacataaaaataaatgacagtcataaaatttggatcagccatcagaagtaaatttaaatgaactgaaacaaagttgtattcttagcctttaaaaactattatgagaaagaatgttacaggcagttcagacagacagactgtgggccaggtgtagtggtttgcccctgtaatcccagcactttgggaggccatcgcaggaagattgcttgaaaccaggagttccaaaccagcctgagcaacatagtgagacccctacttctacaaaaaataaaagtaaaaaaattagctgggcaccttggcacgtgcttgtagtcctaactaccggaaaagctgaggtgggaagatcacttgctgcaatgagctatgatgacatcactgcactccactccagcctgggtgacagaataagaccctgtctctaaaacaaaagattggctacaggaaacactcactgcactcattgtaaagtgccttcttcttgcacagattttggtaacataaggtcaaagcgtctccagttgaagggttactctggtctcctctctgtgtgcacattataacatgaattctcttgcacctccctttctatactttttaccccaaattctgatatagcttgacctcctactgcccttaggatccttaatacaaacagaaatactaacagagcaaagccatctggccagactatttcttttcatggtttttgtgacttcttggcaccttagacatgccatgcaaatagttagcatacacgttaagcattgctaatatatttaagttagaattcattagcttttcaggaaggaagcttgtgggtatgttgttctgtaattactagcgataaggaggcttttattctgtgccctgagggttgtgagtttttgttgttgctgttggtaacttgtttgtagagacaaaagatttgcagaaataataggacgaggtagctgtacagatgtgatcagaataatagaaattcggcgtagttatcctctagatgctaaacatctggataaaaactacaacatccattccatcatgtgggggtttctaaatctctgaatattggatcatgtgtaagtaaggcctgtagatttttaaaaggctgtttctctagctatctaataatattactaatactaacccaggccctgtaaacttgtcgataccaattgatttctttgaaggagaaacactccaatactttctagcatttcttttgtgaccttgtaagaaatagtgctgttcaaatttttaagtgagttcagttgtaatggtttcatatagaaattagccgatatattttctaacagtttctgcattatttttagaaatgaaagttttctcacaggaccttttttttttttaaatagcatgacagtgcagttaaaagattcgggacattatttcaatgaggtatttagccacctccttgtttcagtttgcaactgaatgcttcttaggcacgtttcctttactgccaggagtcactgataaacatttaataaaattgcaatttgaatacccagggttctgtttaagtctatattcctgaacttgttttgattacttttgtctaataactggcaaattttgagcaggtagtagaatcatatagtaagcctattttgaataaaattgaattttcgactagctttagagggagactcccacacatgaatatgtctgagtttctgaaaacgagggaacacatgaaggtgcatcttgatatttgagatgagaagggaaaggtttagagtggaagaatgtctagttgccttaacagtgtttagaattgaaatttggtgtctgtttattttgtaaattatttcctcctcttaaaataaattcaacaggcttcttgcccgtcattttcaaacatttagatccctgatccttaaaatactacctttccttgctgtatggcaaaacgtaatttgcaatttctctatcttctcctttccctccacaattgccagctccgttccctgcctctgttcctccaattgtgctgtgcccttggtggcctcagtccactggaacctgtcaaccaacacatctttcacagcccatcccagaggcccgctccatctcccctgtaaggcttgtcctgttcctcctgccagtgtcacttttctgtcctttacaccctgcagagttttatttatattactttttaggcactcatgtttccatcctctgtacttatctctccccattaggctgtaacatgttggggatagcagcgtgtctcactcgcctttgcatcctccatagtgctcagtacagagcctggcacgtagcaagtgttgaaatatctcttggagagagagaaaaaaaatgaatctattaaaatgtctctatgatgcactgcggaagctagacttggtagatcgagtttaagggaatgaagagggggtgaatgtttgctacttccgtatatttggagtatttgataaaacagaagaccagtttctcttcaaacttcatgtcggtttgtaggccaggctgccagggtttagggtacctcatcgcttcctgcatctggaagtaaattcagaacctcaaagctcaccctgccgtatcttttctgccaaggtgcctcacattttcctcctagctgcggccagaggagctggctgtcactcaagtaggtcagcctcaggtgaaaccagccacttagcctccttctgggcaccctgtgggtatatggaggggtgtttgttcaaagagcagctcccctttcaggtttaccctttacacggaagaaatctggctaaattttctcccttttctgcctttctgtgattacatgtattttagtgattgctaaatttgaactaaaccttgaaactaactgcctgctttcaaaacaaaccaatgtgaactcacattttctagtttgtcagatttggggaattttattaatattatttttatcttaaagaaacatcaactggctgagtgtggtggctcacgcctgtaatcccagcactttgggaggccaaagtgggaggatcacttgagcctaggagtttgagaccagcctgggcaacatagggagacctcatctccacaaataattttaaaaattagaagggcatgatggcacgtgtctgtagtcccagctactcaggaagttgaaatacaagaatcatttgagctcaagaggtcaaggcttcagtaagctgtgttcctgccactgcactccagcctgggcgacagagccagactccatctcaaaaaaataaagaaacctcaactgacgttggcatgaatattttaatatcttaatatcttcttcttcagtcatattttttccaaagacaagctgaaagcatctccactcaaatcagtttgaccacgttttcaacaccatgttcaggtataatggttgagtgaaggctattacaaactcaaaactaattcatctggaaatgccatggttcgtttttgcagatatatcccttataccttcccatttggaaaaagaaaaaaggaaacctaccacaggaacaacaaaaactggaatttgtttggctagcagtcagtaagccacattcatttctgaggacgtagaggccgttcagtcctctcagggacatccgccatgataaacagcagtgcttggtcccagcaccttgggaggccgaggcgagaggattgcctgagcccaagagtttgagaccagcctgagcaacatggcgagacccccgtctctatttaaaaaaaaaaaaaaaaagagcagtactgatggatgattcccctactaaccctctccaccccactccctcatgtccatgtaccccacagtgcccctagagataattcctagcatcctcagaggccctgtcaaactattgttcataaagagagaactgttcttgagccattccccgactgatcttagggaggcaggaccggtattgtctaagtgaaggattatataattagcaatgcctaccataagggggtaacacagaaagaatgcaaattttctggatatgggatcaaattctggtttgggattttgaaacttactgctgtagtgcaggccaaactaagactcttggataatgtgaagaaatacattagagagagagagaaaatatggtcagattagtgcaaatgagatctggccagaagcttcttataggaacattcttcaatgttaggaaaatggttcatagcgctattgctaatataggtaaaatggctgctaaaaaaaaaaaaagcaaacactttctgtttcagaagcagccaaataatcaatgatttgatttctaatagtcatgtttgccataaggattcttataataagattaggtagccaagttggtttccctgttgactttatcagtaagtcatcaagtacttctgaacctcccctccagaatgcccaaaaatgtcctacaataatctccccagaaaactattttctggattttattatttttcatagttctacctacagctttgattattgctgttgtaaataaggcaagaattgtaattaagaaagatatgaatatgatataatatcatagtatacacagttgtatgtaattaattaccttattgcccctttgcttgattttatattcacattgtaagctcttaactgtgcatgtataattgattcactatggtaaatgtggttgttttaacaaaaagtttcaattaaggttttattcaacagtgtaattcccttatccaattgtttctgtaggaaaatcaaattcaacttatgttatatcatttttgggactatatcctgttataggtaactgccctgctagaataatggaagatgagtcagaatttctttcttccttcctttattttccctgtgtccttttcccagaagctagctttctatggaataaacttgcctgggcaccatttgtcccattctttcacttgagtactcaaagactagtagacttttgtagctgttatatatgaatatatatgaatatatatatatataaatgcaaaccccctagcacctctcttaccattgttctttttcttaaagaactagaatcaaatttctagaagctctggtaggctttgatagcatgaaaggccttctgggatgttctgaaactaagactgcaagttttgtcccatgattgaagaagagaaaatatctgattgttggcctcatagaaattttgtgtagctaaagtatttgcatgctaaatctttcaaatggagaaattgaggttaagcaaaaataggtgatgggatataatataaatacctttccagatttagcaagcttgctatagtgaagctatcttcacaaaaaatgacacccccccctcaacccccagaatggcttctgtgttgggatcagttagcatgcttgttttggatgtccccagtatggtaagaatgtcataggaaatcctgctatgtgtctatgatgagcagcaggcgagtgcacactgttctatcagggccatcaaacatggactcacgtttcagcgtctgtcatcaatcactcatagacttcataccttaatatacccttcattcctttttgttccttctcaacctacctacctattcatgtgtgaaagaacacttttttccctaaccactaacaggttcaacaggttatttcacctcctagcttcctctttatccctcccacatcctctttgtgctctaagagcaggggaacacactatcagataattatagtctctccttttcaatataaaaactttatgttgctgtttctcaaagcatatcaaagtaaagccatggggtgaatggtacacttaatatagattattttactgagcttttaaaaaaattaaattacccccataccagtaagtgagaggtacaggcagaatggctaaaggcagaggtatttctcaaatctgttcaaattagtctggcatagcatgggctagagacaaaatcagtagatttacattgctagacagtatgacatatcatacatttagatcattttaaataaagtcattactgaatagatcctcctaaaacaaatactattaccacaaaaagtttcttatttaagagacatcagggaccctcatgctcagcctctgttcagtgccgttttaacacagccatgtccacatccatgtgaccattgcagatctgtttgggtggcttagctcttaccaaagacaaccaacagggtctgggccagatggtggaaattttatccctagatttgtttaatgagagaaacaagaagtatgagcaattttctgtaaaacagaaagccagagtaagaggagcagatgatgtcaataaggaaaaaaaaaatctggcaggaatttgatatcatgccctcaattatctgtgttttaaaaagttgcatatcctgattgtttcttagatggtgtttgtctagagttagcttaaaaacctagattgtttcttagatgatgtgtgtctggagttagtttaaaaaccttaggcctttttaattattgttaagacatttgaaatttttaagtaacagtctaaagattctagtacagaggaagaatgtgaacaaatccttggaggtgatgataaagaagtgaattgaaggacaccaaaaaacaaaatgtacctttggatttatgagccagtgaaacaacaaagccactgaattttttcccattaaagtagaaagaagctcttaagtacagatacaaaaaccaacaacaaaacttccatgaaccaagaaaggatagtaaactgaagtgtggtacctgaggttccagtgtgatatcttagttgataaagggtcttgatagtttatgcctgaacagaaaggttctaggatgggaagactacaaatgttaatatgaaaagcatattttgtgcatcataaagattctagacactacagggcctctaaagacagcttattctgaatggttttctatctccttcctggagaacccattagttccttctataaagattcctcttcgatctctagctgtagaggcacaggaccatttcatgattttttaagagtgtaacggtgtgaaaagcaagcttgtaaaatgaactgctttcctccccttcctacctaatttctttctccctctgctctaaagaataggatatctctttctgactccagagctcatgtttaactcagaaagtatactttgcaaatgtcctgcatgttctaatttgtatggtagaaggagaaaatagctcgtctgagcattagtttgacatcattttatcccaacagtctttggaagccaatccctcttcccccttttttgactgtctgaaatgcccttgctagccagacccctttgctagctacagtgtttgcacatttccttgttaatcagctgcgtcggctcggagactgtgtgttttggtgttgtttgtgtgtgcaatctcgtgccgcttcctgaacgcatgtgtcccttcccttcacagcctactcgacacccagcacctcccccgcaaaccgattcgtcagtgttggaccacgggatccaagctttgtaaatatccctcaacagacacaggtgggccgctctcatcttttctgtatgtggtgcagcttgtattattcatcaggtgcattttaacttgtcttttgcacaaaaggccacattttccagaccctgtccagtcttccctttcctcctgatcccaccagccacatttccatgtgttctcagaaatcacagaaaattttgcctgcaatttttgcttcttgtattgagtgggtagaagaagaactgttttagctatggcacaaaaaggtttcccagtgttagctagtgtgtgttccctcttataggaattcatggtcctctaaatgcaagcagacagaagcaggcccctacagaacctgaaagtaatatctggttgccagtgacatcagagtgcatgctgggcatggagggaccagccactcctctgtattcattagagggtccccaggcacctggcaagctttctaaaagaaagagggagaaaagggtatatgagccctattaagttgctggtgttggtccagaaataagacgtgtttattagtggttactgctgaccactggggagcaaggtgcggtgggtggcaaggggtgtgtatgagtcatatctgaagcaggtgattgagagaagaggactgctcagacatccagagcttgtctgcccatagacagttgtgttttgtgctagtctaggtcaaggagaagaaatatttttgaaaagttttggaatggctgctgtatattgagaaacagtaaaaggctttttaagttcaaagttagtataggtagaggcatttagaggtttgtgaaatagaattagattcacgttttgaaataaactctctgatttcctaattagaacatggcgatattttatcataattaacataaggaaagtattttctctgtaaggttcttagcgcggtgtttgaaaacattcttggagcaattttgtgcacatgcctgtgtgtggaatctccagatgcctaatttataactatttgcctctgtttgtaaaactatggccaggtgctatatgaatgggatagatttgccttcctgggtccatttgccccctctgtaaagggctttggtttattgctatgtcgacagcacaggttaaactgcattgtatctgaagccttcctcacactgaagcagggtcacagaaagtacagcatcagcagagaaggcagctgggaggacagggggagctaaaaggggagggagaaggttaactcttgaatttcccacctctgctgtttcttcttaaactggcctgcatatggcgtctgatattaaaatctcctattcagtacctctcacaaaattctttcagttatttgcttattctcccataccttcaaatattcaaacacttttctggtgaatttgaagttgcataattacctgtaaagcattaaaacagaagaacataatttaattttgtacatttggcgtaagtgtccaagttcaatgagagggggaaaactggagatggtggctctatattggatgattgcttttcccaaagcacgaatgtcctcaagttgcttcattaagagcctttaaaatgcagctttgaaatgtcctgtttgtattttacatagtattttttatataagctgtgattcacagccctgaaattgtatgctgtgttcttttcaatttatttctttataatcaaaatgtattatatgccactgtggctttccttcacaaatgccttacttaacccagaatctgagttttcataatgctgaccacaaaaattcaattcttaaaaatccagattttccacgcatctggatgaatgatgtcatgtaggcccagtattggcatctggaactgaattttttttttttttttttggtttctgttaaatatttggcgtcatggggacaacagcttaaatgtttcttaccatagtgacacctgccacatttggcttgaagaaagtcattcccaattgtctaatgagaaactatgttaatggagttgtcatttttcccccaaaaaaagatatcttgaggtaaaaattatgtgttctaaatattttaattttaaggtatatatattaactcttcccttaaatgaggaactattttctgggaccacttaaagtgttagatatacgtagatatagataataaaaataataatataccttaaaaaataagttccctttcaagaggacatcagttcagaagaggaatttttgacaagaatttttaaaaacataattagaacatggtcggcagatttcctaggcaaacttgtgtttttctatattgatacccttgttacaaagcatgacatttatattaattgaattacaggaaaagttatctgggaaaacaaaattttgctttctacctatggagaaataagaattgaagagtcacccaagcagatacttaagctttctaaatgtagaagcagtatcttgtacataaatctataaacagatgcaaaataaaatgggctttctgctcccaaaggccagtgtccagtggaaatctcttaaaatgcctgaagcatcatcctgtagaagatggaactgatggggtctctgttttttcaagtgggtagaaattgaaccaatgcagacattataagtaggcagcttcagactatcataagatcttttttaagaaaaagagttatttgattgtatatagcttctactgggcattttctatgtactaaatccatcaagtatgtgatgcacctaatctttatagtcacctaataggatagagctctactttatagatgtggaagctgagactaaggagattgttgattttcccaaggccatacaatatagtcaggagtggagcaagaatttgcacccagttctgtctgacagcaaggcctgtgctctctaaccactgtattatgttactgccttatgagctggtgagctcttttccctggggatattccaacagcaactgatgctcacttctcagggatactactggtggagtccctgcttttgtccctaagactgcattaaaatataatctttagcgtatacccccaaaaatggcaagcaaagtttcaaagagatatttgttcacttgtggttgtagcagcattctccacaatagccaaaaggtggaagcaacccaagtgtccattgacagatgaattggttaaacaaaatgtggtctatacatagaatggaatattactcagcctttaaaaggaaggaaattctgacatatgccacaacgtggatgaatcttgaagacattctgctcagtgaaataagccagtcacaacaaaataaatactgtatgattctacggatgtgaggtacctagagtagtcaaattcatagaaatgcaaagtagagtagtggctgccaggggttaggggcagggcagaatggtgagttagtgttaaaggggtacagagtttcagctttgcgagatgaaaagagttctggagatggatgttggtgatgtttgcacaacaatgtgaacataccaaatcccactgaactgtacactcaaaaatggttaagatggtaaatgttacattgtgtgtatttcaccacaatttttaaaacgtgatcattaaaaaagttctaaagtccttttcacctcttaggagtaaaaaattctgtaaaacagtcagagcaagtggactgttgatcagagtaattgtgtgctgactgctcagaaaagcactaattatcatgcccagcacatagtgggtactctgcatacattggctgagtctaaatggttcagaaagaactttaaaaatatgactttttcttattatattcataatacatgttaattgtggaaaatacagttgagaaaaataataaaaatcacttgtagtcctactgttaacatttctgtataaatccatccagagtgtttctgtgcatacaaatatattgcaaaaagtgagatcatattatatacgctgtttggtagcctgctgtttcttccccttaacaatatattatggccttctttccatgtaaattggaaaaattgaatattggcttttattgcatctattcatcatctgtaatgattggtggggaaagataacgtggataattgaaagccatttttcctcctctttcccttgtagtctgtttttttctccagagaattcctcccttgactgaagcagaattgccttctctttagccttgccttgagctagttttctttcaaactgccttccaattgcattgtatatctggccctggctttcggctttgttcgaacattcctgccgagttatctgtcccattcttccacctcacttgtctgctacctctgctaccatcatttgcccctcatttttttcctccttctccatattgtaactgatcactgagatgagaggtggccacctccctacagcctttagaacacccatcaatactgagaaactgtggccacttgtcccaccttgaatctcttatttttcaacgttgtcccgtgacagctgatattaacatatagaaaggtctctggggcatacagtatttacttcactttagacactattaacgtgccctgcatgcccaccgaatggtataatgtaatgatagggaacctgccattgtttcaaatagcagaaagccaatggccatttcaattgcatcccataacttaatctgatccctgaaaatgagaaccattaagaggaggcgtttacttaaagaaaaaaaagttaatatttcatcatcaggtagtaaatagaaataccagtttccacacaaggggactgagcaaagaactcattttgatacaggttctagtttaatcaaaaggtttaaataaaatgcttaatctacagaactccaatgaggactaattctttaaaatgaaaaatgggtgcaaacaatattaaaaacaggcatttcctccttaccacccaaatctatcactgttttgcatcaacagtatcatggtacccaaaatgctatttaaaaccaaattaccatttggactattagaagaatcacttggcatggcatgggcctgatttgttgacaaaaaggcacaggtgctataacctttgcttaataaatcatttagctgcctgacttgcaagcagtgtgattgcctttgcctcatgaaatttacaaatgtatgcacaagccacacacttcactgtgctggaagctggctgatctggagaggtccctgcatagccaaattatgggcatgacacccgttgtctgcctctggtgggggtgcacccagaatgggagaggtggagatcatggagagcattttgagctgttgccattccgtgtgtcatattcctgaagctctacctgagaaaccaaagcttagaccatctgtggaactcttcataagttcctttcttcagtcatttagtgtttacttaattgcttaatagagcctcaacacctacaaagtacagggaataaaaactctcctcgagttgttcaaagtctagcagaggaaacaaatgtgaagaaataatggtaatgacaacaccaacatcaaaacagtgtaatcgcagtactataaagatttgtctaagaggctttaagacaacagagttgggtataggaactttccaaagagtggaagcagcagaagaggctggatagtttttctgtccttgtccttgtctagcttgggcctaatgatatggttcttgtacacttttccctatttttttttttttttttgccaatcagatggtagatcgtgttctaacccatcccaataagagacatgttcagttctgtcttccctggaccagataaaattagactcctttactgctgcacaaggctcagccagaaaccccttcacccctcatttccaagaaacacctcctcctggtggtacatcctcacttgcccacccaagctcacttgagattgcatttcagttagctgacgccattcccgggctcctgcccaccctgacaggagctgcctgagtgtagaaggttagttaccacacagaagttcaaggagcagctggagagttacaaagacaagaaactcagatttccttagagggaaaaatatatatgtgtgtatatatatatatatatacacacacacacacgtacacacatatatatacacatatatatacatatatatacagagatatatatacacatgtatatatcccaccctgcaaccctacctcatcttctaattagaagtggatttgagcatttcagtttcaagccctcacagctgcaaactcccaagattagagaggaatggcagataaaattccactttctcctgactttgagccaagttaaaagtcttattggccaaatgaatattctacagcacccgtgcatgctaggttctgtgcctacactcgctgcagtactcgagagccctctaaggtgctacatctccattttacagatgaggaaaccgaagtttcagaagagtacatttgtcccatggtaattgaagtagctgagatttgaaccagtctccagaacttctgtttttcacaaatacttatctgcatccccagttgtttgtagtgataggttactgaccattttctctttaaaagagtctaagattgactcacactcttatatcaaggaatcagaagccttgaagttagtcccagtgctccctggctccagtgggactgtgctgaacttcgttcttctgaagatctgccccggtctcctgttagttcatgtctctgtaaaaccaagactgaattcattctctcatcctgcctgggaagaagacctttactaatgatattagtctgcatctgtgggaacagctagcctttgtccagagaccagatagcagagcagctaagataactcctttattttcagattttagttgaagctttattccatcacttagaagcattctgtgtgttttatttttgttgttgttggtttcttttttttttcacagtaattcaatttatctagcctagttttttaactgtaaaatagtgaaaatagtgagaaataaatatgtgtgtgtatatatactcacacacacacacacacccttatggttttgggtcttaaattctgttagtgtaaaaaaagtgtttaacacctaatgaatacctaacaaatgatagctttcattgtttggttaataactaaactcttattttctggattacaaagtattttctcatttgattataagagttacactttgaagtaggcagagctattgttattattgttatccccactgtataggttaaaaaaaactgaggtttaaagaggggaagtgactttcccagaaccacatatccagaggtcagtagagtcaggacacaaacccacttctgattccacgtgtcctatgaaggaaggacttgtgtataagccattcagcacctgctgctctatggtcagaacctacttaccaaaagcaaccgtctagcaaattaggaagcctcctactacccactgcaaaatcctaaccctgtaggttgttccactgagcatcaaccttacaggtgcccaaaagcctgtttaaattgggcacagctattcttcccttgtacaggcagcagtctaagtgtaccattgcttctcttacgctaaattgtgcctgagaagggccttcccaaggggagacaatgtctctgagagtggtaaggactggcaggaagtgaatgcacccctcagaatctaaagggaaaggaggtacctaaatcgaggtggtgcctggtcattttttctcgtatgttctcagctccagtagcaggtgttgaatagtaagcaacacctcgcagagatgagttactcatgcaatctgcttcccctccctccatactactgtgggcaggagtgaatcgtcccagcttccccagctcccacaccaacctgtaagttcttgacacattctcttcacatacacttggcggctgactcactgacaggctatgagacactcttaaaataaatttttcaataaacagagtctttgtctttcaagttttaatttggcagcatgtcgtagacatccttggccacaaacttcacttctggacaaagttcgagccattaattctagatactggtcaccttttctctcagttcctgttcttcctgtcacctttgctccacaaagatttgggggatcttcttagttgaaacaaattgatgattattgtaataattaaggtctctgccatagtatctggcacacaataggtgctcagtaaatattgcttctcttcttgcttccttttttttaatattaaagtgagaacagtggcaatagagaaggggaaggtaaaaaagagatttcacaggaaattttacattgtatgggagaggaagggaatagaccaaaaatctgctatccattaaattagcacttggaactgtgggaaaagggggacagaaaatgatgtcaggaaaagggttggaaaaaggagttgtgagttggtggacagaactgacaggaactagatcaaaagttgatgatagccatgcatggaacttagaaaaccatagtgccaagtgcagaaatgccatcaacatttctagcttttaggtgggtctccataacaatgcttctgatcagtgacattccagggtactaagggaaatgtactgggtactcaccaggtttctctgggggaacaggaggaaaagtcatgattcaaggagtaggacagacctgttctgacatcctggctgtgccatttatctcagtgatcttgtgtatcttaccctttaaaattcagcttcctcatctgtgaaatgaaggcaataatagtatctacctcatagaagaaaccccaattaagtgtggtttaagccagtcaggattattttcctcccgtaacaagaaatctgtgagtgagtggttgttggcattgtttcagcgctgcacgaggccaacaggaacccatgccgttcctaacattctgctctgtcttcctcagtatgctgcctcttcagcctcatgcttagagcctctgacggcaagatggctgctgcagctccaaatagcatagtcatatcataccttatttttcctctaatatcagggaaaaggccctgctattcctcctgtgcaccctgctagcaaatttctttgtaggtctcattggctaaatctgggtcacattttaatctctagctgcaaaggatgctgagaaaaccagcagaagattatcttgattggctcaaatcatgaccgtcacctaggaccagtcacatttgcctctctaagcaaaattgtcccaaggaagaaggcgcaataggtagtggatagactgttaataggatctgccatattcttttttcctattccctgataggtttcatgcacttttcaactccagtagttgcacttgaccctcttgtctctgaatgcttggcttattattctgcctttcctccacacactccctatgtgtttaggagatgtagatgctatgtgcgtgactgtgcagaggtcatttcttttcagcctctgtttgaggtccaggatttgggcagaagtcctggcgttttgtgcagacctgctcccatggggctgggtcaccgtgtgctggttaaacatggactctgaaaaggctgagttggaggatatgtgcctttgtggttgcaggggagctctgtgaaacagtgccccctgggtgccctccagagtgcttaccaaacaggcagcaataggttctgggtttctcttttatgacttggaaccagatgcttcctttgcaaaggaaaagagcctggttttgcagagcttgagtcaacacaagttcagagaacaggaaaatgagttgactggccctgctgcatgaactttgaggagagaactcaatacaggtggtgttctcgctgtccacaaagtccttgcttgtgaaaatcctatgcccaagaaattggccttaccgaatatttctacactctaaataatgactgttcacatgaggaaaggattcagcattaggaatccttttggacctaggctttcccagggcttctaatgagtctaaggccttgaaagttccactgacacacacagtttcaagcccagagcttgctgtctaatgtgagatccatcgaagatctcacgtgaggtctcagtgattcttcctgccacttttctcacacccacctgcttaccttcctgtttgtttattgaggacttaggcacattctttgatctgtgccctgtctttttgggatatagcctttctattgagtctgttcattgagttacattccacagcacacacctcccccaaaatatttgcatgagaatttttcttaaggtctcacattgcttcctttacagcagagatgaaataacttagcacttctaattggcttttcactttccaaacgctttacacatttaactaatgagtcacatgagcttgtgataagccggatcccttgtcttggagcagggacactgggttaggacaggctgttctggccctgtgtttctcaccctcaacaccctccttcctcagagtctgaatgtgttgagataatggggatgccaccaggcacagttgttctcagcacagggcaacctcggaccctcacagtgctgccttaataatgtgggaagcaccctttgctgccctccagggctggactatgctgcatatctcctgttgccttgactagtgaagggaagcataaggccagccctcatgacatacagcttctgcccctctcaagcgcagtcttccttccattggtccctggcagtgtgtctgtgcatatatggggaaggagtggtactagggggatagaagaataacatagtaggtctaataagggaactgaccataggagggacctatggtcttggtacacagagaaaccctggactaggagtttttctacatcttggtacacagagaaaccctggactaggagtcaaaatacctggattcctagctcatctctcccacccgccagctgcatgattgatcttagagaggagaaagaagccagaatttattgagcacctactatgttcctggcaccatactaagctggaagggaggctaaagatgtacattattcaatccctgccgtacatagctcacagaaagaaaagtaaataaactaagatgtgatcgatgaagtaattgaaataggtataatccatacagaagagtcagtaactaactctggggagaagcatggagctcatggaagatatgccagaggagaagacacatgagtggttttgaaggagacagatatacttggtggggagaacattccagaccaggcaggaggaacagtgcatgcaaaggaacagcagtgtgtgtctgaagaaccctattctgtttggtgtatctgtcagtttacagtagacggcagaaacattagatcagagtctagtcgtgaataaatacatacctttttccaagggtagtaaagcacttggactttattctgtgggagatgggaagcaggtgatgggcacagtgggatctctatatgtgaagaaacctctgccttgcttggttcaatcctcctgagatacaggattttataggcaatagtagcattgagacctgtggtcatgaggtaccttcctcttctgggcagcataatgtagtggaaaaaatagaagctttggagggagacagacctgagtttgatctcagtatgtgaccttggaataatttttagcctttctgaccctcagatgtcacatctataaaattataaatgaatgcctgcattccacttagagttatgtaaagactcagtctagttaggatgaaaagccctcagcaccctgcccagccagtgtgtggtgctgccttttcagccctcaggagggaacctctgtgagcactggaggcagggtgctgctcatttatctttaggacaaggggcctgtgaccacaaagaagaaacagaaatggtaatatgatgagcaccccggaggtaatctggtaatgttctccctgagctaaatctcttctcaccgcatcctcccgtgtccattttccttaagttgtgccattaattctctcattacccagtggaatgatatttatgtattaagatcatacttagcatactcccaaggagcaagttaaagttcaactaacgtcgccagtttctcgttgtaaggataaatacactgaggaatccatacggagagcttctgtgtgtcttataatttcatattaaaaaaagattaaattttatactggataagagagggaaggaaaaaaaaatcccagtgcaaaaacaagttgtgaacctaggagcacagtttctgaatgtttattttgtcagatacacagctgacatgattagttctaatggggtggtgatcctcattgaattgcagattggtatgagtgactgaaataccgcagggacttaaataagtggtgcatatggtattacttaggctgcatcctttagccaaggtgaaggcttcgttttctgtccattcctaacatgcatgcagacacacacacacacacacacacacacacacacacacacacacctgctacatatgcgtccatctagtccagaagctccacactgaacatcaattacctatctagagtaaggctggctggcctttacttccttccctttgccctgtgttacctgagtgcacccccaagcccccacactctccagtgtagataatggtgtatcagattagtctgccttgctgctgcatcaagacccagatcaatttattgactctgccagagtggctggtacagtaattgttacaagagaagaatagaaagtgagaacgtgtacacatgaaaaataaaaatgacgttttgttctctcctgccccctcccccgccttttttttcctcatagatctttatgtgtttacacagcagagagcactttacttaagttaatcagctccttctacattattaattgtgacagggtgccacatgacaggacgagtattatgggaaacattgatctcactccgatggtgtggacctgagcaggtttggtattcctctccctatctcgctgctttggggtcccatcaaatcacatttccctgattgacaacacggaatgcctcccatcaatacgattgattttgtgaaaaggacaaggaacatttttcaactggagagagatgaattgtggttatgggaaagagagcatctcagaaatctttcaggttagaagcctaaattgggaactaaggtattcttgtcatcccaaacacaagcataatttgtaccccctgaaaaatggtattaggagaaacttattacaagtgaaaaatagacttagtggaggccagcaatgaacctgaggacataatggctgtttttaaaaggccacctgctaatttttttgtgaggaatttttggttaagtgcacatctttgaaagacatttcattaaagttcagctttcatggcttatacctgtagaccctaacataaatcctgtgtgaacggacaaaactgagtgggtgtcatttgtgacctggaaataaaaggtcaaccattgaatttatagcttttttagtgaaaagaacataaagattcctgccaactggagtcaatccatattttaatgtttcctagttaagattataaaatcaagggattaggatcgtgctgctcaatgaaggtcaaaaattaaatgtgatgggctaagtgtcattcccatggggcagaagttaatatttcaaaaaccatttctaccactggcagtcaagaaatgaattgtccatgatcattaaccaagttaaggggaatcccactatcattactaaatttaatgatgattattatactaatcaactatattattaaattactctgctgttctgtaatgtccccaaacagtaatagtgaattgattgctaccaagtaattctcatatacagttgagaacaagttgagatgcaggatcatggatgaaggcctccttttgaagaaagaagttgtggctattttatggataacagtgataacgtagaacgttcttttaagatgaagagtgagtggcactacagacctgttattaactataattcattagtacatgttttttaagtacaaaaaaagaacacgtatttctctttattgtgtttttttttctctttcagatttttgtatcctcctcccgatgcttttttttttcttttcttttctttgggaaaaagaacatctattttgccagattcctttttccacaaatttttagagctctggatactgtctactttggatttttatgaagagggaagaaaggatatttaaatgtctttatatgatgactcagacacatgtgccctgtaccattttcaaatccattttaagatgccagtatttttcaaaagttttagaaatttccttaaagctggtaatttccttaaagattatctactccagactcccatcatttttcagatacaactttaagaatattttggaataaagttcatatcattttaataaagtagcacctccaaataagaggggccaaagcctggggaactgaaacaacttgcaaggccccaaagctaatcagagacagagcaggactgaaatgcagggacctgttatgagtgaaggaagggactaatggtttaatatgtggcttagaaaatgggtgcatggtttccattttacaaaggtgttttataaaagcccaatatcattagactgactcaaacgcattgcaattccaaggaacaaatgcatgtaattcagaagttcactttgcaggatttactttcatagactgccgtgcaggggtgtgtgtgtgtgtgtgtgtgtgtgtgtgtgtgtgtgtgtgtctgtctgtctgtctgtctgtgtaacctgtgcttccgtctatgctcctggacagcttttttttgcatattttcctatcttctgatcttcacagtgcagacaaaggtcaaaattcccatctaccttcacaggcaaacactttaaagtgcttctacatgaggcaggttgtagggaggacctttgatttaaagttcagcatttacatttgtaattttgactaatttctgtgctagcattaattaaattgaaattatttaattagaataaaactgaaattgatcattaggattaatttaacctgatagactttgtgtgcctttctagacaaatattatgaaatatagtgataatgaagtagtgagaggtataatttcacatcttataatgattttagtatccagttgttctctctgatatctagatagtgctgaatattgctctttgttacatcattaccatttagctagggccatgctgtatctcttatttggcctcttcccaaacatttttttcctgtcttgaagtctgaagatgtaccaaactcccttcacaccacccccctgttaacgtcattgttccctttcccccacccccaccgtcttccaggaaggcggtttgcttggctcatcccttgggtcttgcattgcagtgacctttgtaagccaagaactgccggatgaaactcattatggaattcgctaatgctcctcagccctggggtcaatactgtcaaatctggactatcccctcgcaccccttcctggctgcttgctttgagtcagaagcaggcacggaatgaagccctgacgagggatgccaggcactgagtaggtaactccaagggagtacaggagagaagcgttactcctcccggtgccagattcgcttccaggaaatagtttcccctcttcatcccacaccttccacatagtttgatcaagcaaacacgcttccaaagttggtgccctctgtttcttaaagaaaattataggtgaatgaaactactattttaccagaagaatcagtataaatgaaatgagattagatctgaatctacctacccacacatgaacaagtataaaacactttgaactatcaactattaaatcaactatcaaattattttgtcttcaaaaccattaggatccacatgaataaattaaatcctcaggaaaatgtgcaaaccattttaagtttcaaatttctcccattcaccattttgtcagagttgcttaaaaaaaaaaaaaagtaacattagcagttatgtttaataggcttcctgtagcagcccttattggcaggggtccaaaggacagtggaaaatgaaccaaagtttgatagatatttatgaaaaagaaagaagaaaaaatacacaaaagaaagaacacatgattttcagtcatttggaattgactgaccaatgagaaattatctcttatgcaaattatcttctttctggaaatcaaccaatcagtcctggctaaaggctgagaaacttaagattgtaagcccaaattccacccaatcactgtaactaaactgctgctcccaaagaaaccagttttatcatccatttctgcagaacgtcatctaaatggattccgctttcattcatgtccttatccagtaagaggaagcttctgatttttccagcagagggttttatttagaagcatattcacatttaatttggttttagaaaacccttaatgttttttaatattgagctaggttgagttcaggggattgagaaaaaagactaaaagctttgcatatagctagcatgctcgtgctattattgaacatgcaagaaaagtgacggctcaatattgcactaggttaagaaaaggccatgatctagcacatgaagatgaggtttctgtcttccgccagacagagaggaatccccttcccccaccccaacaactccaaagataaaaaagcatcagttacagtcctgttaggagacaaaacacaaatattagttcatttcatcctcacaagcaccatgctagctagcaaggtggtcttcatcctttcttagcagaggtgcaaactgagatccagattcaccacacactcctagtccatccacccccagccatgcaattgcttctctgaaccccaccacccccacagcagtgcttactcttgaactatttatctgacgcatcacatgtcactctgcagggatgcagctgctgaatctgggtactgggaatgccacaacctgcagttttgccaggtatgctcacctatcaggaaaggactgctccagtatgaaaagatgctataaagtaactcttgagcattgccctgaggttacagttactattagtatcattgatttattactgctgtacccacttgcttgctgttatagataaactccaattcagagagaagttgagaaggagagtccttggtgctctttctcctgtgccctttccatttctgcccatgaagatgatggctgctttctctgaactccttgacccttgcttagcaacaagattgagtcttaatttcaataagccaggaaatcagctctctccagattggttccctgtgggcatctgagaaccccttcaactcttcctgcttctaaatgaaaaatagccatttcttcctctctgatgcacctttattggctggaaaatccctgagatctttttgacctcaaaaacctcttaggtttaggatctcttttgggctgggtacatttctcttcataacttaatcttcaaggcagaaaaaccatttaagcaaacccttgttttaatatttgaagagaatcaacgtgcattgaccatttccacagaaagctgaaactcattgcacagaaattttaagtcatggccatgagattctagaatctacatctagaagccattttcaactataatgttaactagaatgccttttagggaaaattaagaagcaaagttctcctggcccctgccctgcctttctctctgtccttctttgcctctggagtagacctgaggaaatttttaatactaacgagaacttggtgctgcgtagcctctgagtctgaaatgcctgagaaagcagtccagattccaactgtaaaacattccttcaccaagccttggaaactaacatacagaggccggcagagttcagagggagcacatgtaaatgaggctccgttataaactcctgaggagtgttttatttagtttaaacctgaacttgaacttgtaaacggtgttccttgagaacaatacagaaaggttgatgcagtagaacaggaagtcacattttagctcagacattttactcctttaaaagaaggaaactatcttaaagtatttcttaattgaactgtcttctagaatagcacaaattggcatgtctgcaagatttttgggattgcagaatcagaatggaagtgtatatgtatatatatcatttgaacttaccaccattcttgcaaaataaacaatagaatttcctatccatatggcgatttaacaagaggatatttaaagagcctgtccacatataacagtcatgccatctgtaattgattttattaattgataataaagtgacagtagaggtgtgggaccgtttcaaactagcactgtgtgtgtgtattgagagtttgttcccaaatctcagttgctggtagagcactaccaagtggaatttatccgaaaacaaagtgagaatgattttgtacgcatgctcaattttataaaacacattcttgaatcagtcttcaataatctttgcttgcgagatctccatctcagaagtcactactaaaaaggtaaaaaataaattaaattgtctgtgttagaatgatattacctctctccaagaagcatagatccctgacagggaagccaagcagctctgccaatcacgtatgctatgtacatgtccaggttgttggtaaggcccttcacggagactgtcaatgctataggatcttcaccttgcacaaatcccaaccgcagccccatcaagaagcctccccctcatatcccctggaaatatttgggaggaatctaattgtttgtagcaacgaatattgcttagttgtaaatttaatctacaaatttagaaggaaataaatctgaacataaaaagcatttgctgtttcagcattaaaaaaaaaatgctatcatttgaaactgcaaactctcccatgtgggtttgttttgcaagtcacgtcttaacaaagacaagttttgttgccataaaaccctaaatcctaccacatcctcagaaggaggagaaaagtattgttcactggttccgggtttgggctttcaggataacacagagctatgaccgcgcacagggaaattgtttggtatttatccagagttgttggttcaggtgaaaccctgacacacacatacctcccatctagattatatcagtgcctcatgtaattatgctccttacattttaggcctgtgtctgaaagtcgttttgtatttttaactttattttttccctcaaatgatgtgataactagtatcctgaggcctgttttgcagaaaagttaaagttggacccctgactccctacaaactaggatttagatctctgactccatgatctgactttttccatagccaagctcattctgacctcaatgaaagataggaacagttttacctctcccaatatcccatctaccctgtgaacgattagaaaaaaaaaatgattcctggcaccagtgatatctaaaagcaggtgttcctagaaggtaaagaaaggcatagcaacaggatcttgtagtatccttagagagatctggtgaagttcaggcccctcagcaagccagtgactgaactgggacttgaaccaggccaccagacccgcagtccagtgcttaactatcttttctcatgaatctgaaaacgcagatgccacagtttcctttgcattctctccaaatgctgcctgtatgtcttgtttctttggctcacaacagaagccttccaggggttgtggtttgcagctcaaggccttcttcacttcatcttaatccttagggactgttggtctgcatggcctgggagagagtaggggtctgtcatgattcctgcacagggattaaacacaggtggagagggagggagacactaacttgaggggtgggaggagatagagaatggaactagaaagaccaggaacagtggacaggggagaattaaagaggtaacgagcagacctgtgccagggcttgagcgtggaagtgcctgctggggtggagaagtccaaaggtggcagatgctatccagtgtctgaagggcttcttggctggaaaggttggtttgggaattcatttctggcaaaaggccagatcttctggcatactgttgcaggatgtatctgggagaatttttgaaataactggactttttacttcaatgttattttctctcttactggactttatcttcctgcacaatccacactaaggtctccttgattgattggctctcaacctgagtcatgtttgggaagagcaagagcgaggaggcacggagtagaatgattattacaatgtggccacgctctgctgagctccggcctccactcccacgcctctctttttaaacaagaaaggttacctccctgggccaccattgggccaaccccaagtgtttctgtctgcacttgttagacaacaggcatttaattaaaattggaatccgatgtgtagaaaacatacattttttcatttcatagctccccaggaagtcatattcccttccttccccactctcctcaactctccccctgccaaaaaaatttaaaaaaaaattgtgaaggaaaagattattttaatgtgaaaatcaaaaattacaaagggctaggctgcttcttcattttttgcctttgggggagacattagccaatcataaagcctgtattgtgtcttcagaccaggagccagcttttttatggctaacttcccatatggaaaagggtttgtcccatttcagggcattaaaatacagcctttaatgaatttgtaacttaaatcttttatcttgctcttatgcgatagaaagtgtggcctgtcttctgatatttgttggactttgtggaatcaacaaatacaaagaaacagataataaacatgaggcccaagttgaaaaataaagccgcgaaaccccgtcgccactgcattttccgcagcagagccatccactgcactgtctgggctccacccagaaaatccggcagtgccatcatgaccaaatagataggaactctggacaatttcatcgggtcattgtccccttaatctccacgctgcacctcagatctcaagcagcttccgtggcgcaggctcaatttaatggatagaatctatttttcatgaaaaagcaggaaataagctgtctctttcataaaaagatttacaaaatgtaatcattgttgaaatattccctttgaactgccgtgtccacgggggtctccggctcccagagtcgtgcttcattagaaccccgtcataagcggctccagaagggcaggtacgctggtggtgcccggctttgatgtcttgaatgaatgaaagaaaagcacaataaaaaagagctgttgatcaagcataaaatactctttaagctgacagaatagcagcgttaacacaccctaagctgcttttagtttttcccttttttcctcacattttcctgtgctttgtgtacagtgggggtttgtattttataagaagtctctgatctatgtagtatgccattcgctaacaaaaaccaaaataggattgtttctgtcccacttggttgcctgactaccccctcccttcctccccttttctcctcacccccaacctccaaggcgtgcagtttagccttgcaaggcaagggcccaaatgcctttcataaacttgagccaattccttttgtgttgtgggtttcaccgctctgattttaatatcgcaattaaagacagatttttattttctcaagaactttctcttgcaactggggaaatggaattgacgcagctgctacttttaactaagaaattatatcattaaataagagaaagccgccttgtagagtgatttgctttcctggggacgttgggtctcacgtggaccctaaggccccagaaaccgttcacagtgagagaacccagctacccctggctttctggctttctgtagtagcccctagccaggcatttaatccccacaaaaactgatacagttgttacctccatttcatggagtctaaaactgagacctagtgatgctaacttgcctaagattatctaactagttcataatggtgccaggatttttgtcattcggaccccagagtcctggctcttacggctatgcacacagctctctagtaggatcttggagcaaatgcggtgggccggagtgcagtttttaatccagcagtctttgatttcatgaggtaaaaggttacgtgatgaaaaatggaaaggaagggagaccaaaagaaaaatgtacttggtggtaagagagacactagggcaagctggaatctcgtgaaagattcagactttggatgaacagtcagaataattggattgtgtatgcactctcaaggtttggaggtactggatggcttattgggtaaaaagattagtgttttcccgtcttgaggtctgaaccaaacggaggtcttggctgggagcagcacagtcattctccagggattggtggtttggacaacttctctgagcttgtagtaagtaggcagcagtccatgttacaaaactattgcacatgctactgacgcagttggccgcaactggccccgctgcaacaactctcccgtcggaactgcctggagtggcttgtggagacttgtgtccctcgagggagagtgtctgtcatttggggagacatggtcatgtggcacgagcatgctagaagtcatccatccagatgccttgctttgccctcattggggtgactgacaccaggctttggtaacctcggatacagcttgttcttccttccctcctttatttatttaacagtatttattacatgcccaccctggcatcccttagatagccagcttgcctgggatgaaaacaggtaattaaagtttagcaactgtgacagaggagaatcctgagggtaaaggccccaagaaagacccctctgaagaagggacatctaatcttagaacccaaggactagtaagcattagcaaagccaaggagtgggacagcctgtgcccaggcctggcagggagaaagcatttggctttgggggatccggaagaagtttaaggcaacaaaagtgttgaggacaagtggtgaaaagataaggccacaaaggtgccggggccaatcccggcccattacggttttaatagttttctgtacaataaacaagtcttggttcggagttactgaaaacagactttctttaattaagaaaataaaatcaggcaagaaaaatgattacagagatcaaagcccaaggctggcagtaccagtaactaacacctgtgtacagcatgacacccttttcagaagaaaccagtgtaaatcactgctgcctctcatgaatacagactggtcctcacaagactctgagggtcccaggacagggactggcttgcttgaagtcacactgctggtcagtggaaaaagtgacaccaatcctgagtcctttggacactggatactgggcatcgttcattgccagaagtttataaaatcctattgggagaaaagcaggctatctggtatcatgaagggtctagaatctagccactgcttcctgatagacaagaaagtcctacagggcagggactatattttactcattatatccccagagccagcatacatagcacctagcacatagaaggcccttagtgcttgttggatgagtgaataaatgctcccaaatggtttatgcgaatgtgagaaactcagagtccactgagagacctcatccatttctatcatattgagatgggcagaagagactactgggcttttggctgatttgccaaggacaactcatttgggctaaacagtaggctttagtccatccacagaagtgcgggaagccaaaaatgacccactggagtagtgtgaagtagtagtgcaaagctaacacctccccaagagagaatgcacaacagcgacagcagctcctggagtcttggcttattggttggctgagtcctctttgggggctgatgaggagctgggcctgcagggtgcggggaggccagcctgtgtttgcacatttccgttttatgtgtgtgaatgtcctcaaataacccaccttgcctgcagaagaaagccaagtgtcacacccagttctggattccacattaacaacctccttccgcagtgttaaactttgcccttgttgaggccttttgtttaagtttttaatctgaaaaacagattctgctgcatcacagtccactctgccctctgcccctgccaccccagcactctctgctccttttaggggttaaagtaaaatacaaaatacaaaaaatgtttctcagacatttttctttttcctctagaatgtgcatcctgccctcttagtaaaaagaggatgtaaaaagccttttaaaaagttgttgcacacattagagcatttgttgctaacgcaggggttgaggccatggcccgcatcagctgtgtcttcagcagccccatgaccacattttggaagacggcccctgtgttctgattgctctctgtgaggcgtacgaaatggaagagattggcaccgtcagaggtaccttctgccatttcaggcttcctgtttaggatgcagtcggatagatattgtttatggttcataaaacctgactactgtgagtattccagaatcccagcggaatgggattcgaactttcatggagctgtaaattaacgggcggcaagtgtgataaaactccttagagaactgtgaggggaaaaagtcgtgctgcaatggttaaatgaaattttataagcacattcagtgtggagctgttttgcattacatgagttgaataccttagagacgccacatctgcaggcactttattaaatccttagtcagcacttttccaacctgatgagattacttcttcatttgactggagaaaaggaaagctgagctcttgtcctggactgcagatttcttttgatgtttcaccttgaacattgaaagaggacagtcaccccacttccctccccactcccgctcagcacatcccaaactctagacattgtgaatgttaccgactaattttacgtaactggagccttggtgggagtgtggatttgtggacctccacaacaactatagctgaaagtttctgaggaaaaaatagatcaaagctctgtgtttacttaatgtaaatgtatcaagataacatcatcctatattgcattgtaataatgccactcactgcacatagggagggagattcctttgtagtccatttggatacagtagggtagattaaggggctataaagtacgaaggcagaaagcatatgaaacctaagcttatgtcactaaatgtctgaggatagtttttgtttaatgtgttaccattttcccagtgatttgctgctcaaccccaacgatcgaataagctcagatttcttttatgtttttcctatatgacccaagaagaaaatatgcagaatcattcttcaattaatgttctaaaacttgtactgcttgcataatagaaattataagaaaatatcacaagagaaaagtaggcttttacaaacattatattgtccatctggtgttactagcagctcatggaagtttctaggaattgactggcttacacatgtgtgactgtcacactcatcccaatgggattatgagtgtctttacaaactgattaggagaaaattcagggagatgtatgaattattattattattattattattattagaactatctgccatctctgcaaataaatgatttaatcagagacttcaaaaaagaaaaattccctgtgtggttcccctaaccaacttcctgttctggaaaaccttggtcaagtagctgggttaattgtcatgaagattagtgtgatgttgaaataagtactaatggtcaaattataggagtgaacaagtttaagaataggttttggtttgggcctgaaagggttaattaaggttttttcacgggttattaaagacccccaacctctgccttcaggagtcatattgacaccccaccacagggcagctcagcccctctgttgacatgttgctggtcagagcacaatagccttctgtgtctgcaaatcattgctaaaatcatctcaaggaaaaaaaagtttgaaagctttaacgttagacaaaagcccaagagttgcagcgtgcagcccaaaaacctggagtcagcaacttctattgattaaaaactaacctttaaagtaactctgagagtgtgtggttagcatttaaatttaaacatgtcatgagttgatttgtgttactgaataccaactcagaaggagtaacattcacatcgcattttttttttctaattcccttaagcagctaaagtatttcatgaaatgtcaatagggcaaaaagaaaaagaggtggggggctgatgctgggccttgtagttttctttcccatgcaaatatccaccccccaaaagaaaagtgtgcagagtgaaacacaataattagtcctttgtctaactttcccaagtgccagagaaagacagattaattaaatatacaacaatgttggtttttggagtgggggtcttgcttgctgtgtaggtcataaattaggcagaataaatacttcaatgtgtttgcagtgggcctgctacgtcagaaccactggaaggttggtgggaggagagcagagggtttcttgctaatgatagtcacgtctgggtctgtctggttgctcttagcaaccagacatgatgtaacaccaggatgaacttgaacttgggggacttgaaaagagaacaatagaccagagcaatcaataaagcctatttcagtgaaggattacagagctgctctggggtaaccttgtcggcaaggcacatactgaatagtaagatgtgtgaagaaacttttttttttttttttttttttttgctttgctttttaagagaagtgcagaggcactgcagatttttgtagtgccctgaggtctcgtccagaaactgtggtgtggagaactgctccccctgctgactcactgggtgccaggcctttgcttcaagaactaccttagtgtcagattgaagaagtctggaatttcacaaccgacttagaaagtgtgaaaacagaaatagtaagcattattccccgcacccaaagtttgaacctgttttgtagaagggaggaagcggctctaacgtggatgagagtcagctgttaggtagaggcctactagaaacacagtttggggtttgctttctctctcctttctctccccctcttctttcttttgtccagctagatttaggccatgtgtatttgccaggctgatttcctttcaggacacaagaggctttattgtgttcctcaaagcatgtggtcaaagaataacatctgaaagtctacaggatgcgtagtttttcggtctgggcttaagttttttaaactcctctggaaatcaaaggtggcttgtgtgactaggaaatcttataccaaactccatgtagctatcacttagccattcatccctggggaccaaatgagtccttacattacctaatggaatctcttccacagggatgatccttcacctgcctgaagcaacccaattagaaccctttctgataccgtcaacttaaagaattcagaagcattggtttttgttaggccttggtaatttttctgtaaataatgataaatgtagtgaatttgtcaaggtatctctagagaaaagtcggcaaaagccacatacttttttatttcactggagaaactaactctgatgttagtccataattgctcattctgtctagctaacagaaaaagaaatgccagcagataaagtgatatatgaccagacaattgctcaaagctaaccacctaaggatttacgaaaggaaaaggtaaccagtaactgggcctggcaggcacacagaaggctctaaataaatgctgcatggacgcaagcatgaatgaagggtacgcagtggcctcatttttcctttggacaatgtggtacttaatagagtaaaatcttgatcctacttagttattatgtttcatgtttgaaaataccattttagatatattgggctgaaaggagcatcttccctcataaaatcctacatatgtaaggaaggaaaaatactgtgacttgctcaaaatcacccaggaagactgggtccagcactttttccaccttacctccacttattcttgtgtcgctattgaccatctgggcctgttaggagagtgtcacaatcatggcttcagtgcctgcacctcatttgaaaggagatgttgaaaatcatcagagtagccattcattgccacatgaaacccctccctttacccattctccattcattcaactcttcttcattaagaacgttctgtattccaggcactgggctaggcactgaggattgaatgataaacaagatggtcaagtttcctgccctcctataactgcccccatcagttaacaaaacccttatttgtatttcaagtgaacagaaatacctcattctgtaagatatactcagaatgttggaaaaccccaatgaagacaatgaattataatttcagaagaataagatcagtttcagtgtcacaggattttttattgtctgtcgtgcctttacttttcccagcgaatccctcccgcatccctaacgtagatcctgatttcgtggttgaaaaggcaacttctaaaacacacgtttttacaaattgtgattttaattgtatttttccttttgtcttccagtcctggtacctgggataaaagttgcagcgtcccaccatccaccagacagaccacctgaccccttctcaactctgtaacatggacgcaacctcaacccagcgcagttacaacttcactatcagcggaaggggagaaaaaccgattcaaatcaacttgtacatggaaacagcaagcattatggtcaaacagcaaaggccataaccttttgggatttttttttttttaaaatactttagggactgttgtaatttctcatatggtgctggaaatggttgggctttgtaacatttgaagtgtttccatggtagcgtgagcattaggtgacgtggctagcggaggactacccttgctcactgacttcctgttgtaacacactttccttacggagcctggctgtttcacagtatttcatgaatttacccacacaggtgtgatcctccttgagcattgaggaggcacatggagaactaaatcttttgtagtagctgagatctgcaatatataacgggacagtcaaagggcaatgtttttctgtaacatattggaaaaagaaaatgcagttatattccttttttatttgttcctttagtttgttttggttcagcagtcagcagttaagtatataacatggcccgcaaggacaatgaatccactcacattgcagaacaattccgaaaatggcaaactactactactactgttcagttttttaaaagttttgaaatgctgcacttacatttaaaaaaacaacaacaacattttttcaacaatttcaacaatgacacaaaaattcacatggaaatggggaagatggtctgttttgacagaaactgacaggaatcaatcaaaacaatcgaattttgaattgagtaaagtgcaatttcattggatagctaaatatctttgtaagatagagattgttgaaaattctatttttgtttttctagtcctttcaccccaggactctaaattattggggtaaaaaacagccttgcaagaaaaaggggagctatttttgctttttatgttttttattgttaaacttgtatccctttaaaaactgaaggaaattaaaaaaaaaaaacaaaaaaacaaatctaatggtgcttttaccacaatatgttaactacattaaatgctaattaattattttctgttatcaaagcacatgactaaaatgaaatcatggtatctgttaattttataagctagaagtcactataatggattacgccaattctaaaaaattttacacctatctggcatcataggatttatcagttatcagacacctcattgtaccagagattgtccagaagttttaaagacctttgcatccctgaactgggctatgggaaataataatagtaataataataataataataatgatgaaaccaatactgacacaaatgctggtgcccattcagatcaagggtacttgttagggaaaaaaaaaaaagtttgcacccccaaacgtcctgtatcttatgaaaaaaaaaacaaaaaacaaaaacaaaaaaaaaacacaaaaaaccacagaaacaaaaacaaaaaaaagtgcaagtgatttttctaccagacagcgaagcacccctttgcttcccatgcgacttcaagaaggtttcctatactatacatatatatacgttctggttggcaagccctgctgatcagagaaagtctctgcatgttctagtgttagtaactaatttttatatagttaatgtaggataaagtagagtgcattaagacacaatattgtaatccctactctaggcacttgcctttaaactatgtttttcagcccttcagaagggttctactactgtcctatacaatcaagtaactgaaattcttgggaagacactttgctcctcatctttctccccgaaacaatgttgttttgttttgttttttttccttaatttgcacgaaaacaaaaattccatatcaatgtgccttgccctggatagcgattatttgtggaattgttgcacatgctcctctattgaaaggggtttttccctagtcaagcatttggagacactttttgtaaatgtgacttttatgtcagccatcgtcagtttcaacatctagaactaaatagaaagctagttgttccgcagataggagtagtctttattgtcctgtacggtcggtggcagtgctattctgagatctgtagatgcttagaatatcagtattttggatgttgctgcattttacaatttatttggagtcttcctttattttcccccagatatatgaaaatatgcaatacctgcttatatcatgtagaaaagcttagcaattattaatttttcttttatttttttttatttgaccaaagtcggtgctgcacttgacgcagtgtgttttaggtgtttgtctttgtacttttttgtgatttttgaatgcacgtgcgcaggaagggctcctcttagagaagcagtcaaactgtgaagcactaagctgaccctgcttcaagcaattttgtttttacaactgttcctttcacaagcaagccttaaaaaaaaaaaagacaacttcctttttcttcagctcccacaccccatttttcttagcagactgcagtcaatccacattcaataaaaagtatataatgcccatttttatatgcacgtttttaaacttccaagttctgaaaattgtttactggttatctctatttaaggaaaaaaaaataaaataaaacattttggattttcatatgtgtctgataagtggttgaatagtcgtttggcgctgttgtatggtgtgattgtcagtgtatggtgtcacttcctatagccagccagcatactttgccttcccctatagcacttagctgggcattactttattatgacatatgtgcactaaaaaatgaaaaaaaggaaaaaaagaaaaaaaaaaagaaaaaatagcagctttcagtgcttcacagtgaagggaaaaaagcctagacaaacattttgtcagaaccttgcaataagccaaggtattaccagtaaattggttgtatatacaataaaattgcacccttttttaaacaaaacaaactaagcaatagtttgggcagttttagttgtttttagtgagcatgttgtagtcatgactgcaaagagagagaataaactgcccgctcagaagatatgtaatttgtattgttgtatagttttattgattacactgatttattctaccctattttataatgcaggacttttgtaatgttgtttaaatgaggaaaaatttctgtcaaattagcctagtaaaatttctgatcgttcattataaaggcagcgttcatagaattgcttttctttctttttaccccccctttgggaactggatttaagtttaaaactttcctgtttcctttttttttttttttttgtaagtatttaaatacaattatttttttctctcaatggtatagcatattcctatgcttgagaagtataggtctactgaaaaaccattgtaaatggacgttacaggtatgctgtatttttgaaggtattttgttgtattaagtttgatgaagctaaaattagggaactctgaacagatttgcaggaaaaaatgttttaaaggctttaaaacattagggaggcagtctagggtgataacgaacaggggttaagtattaaatacacgaagttacatttttgttcatgtttcattgtccagaaagcagcaggaaactattcagttgtgatcaagcaggaaaaaagaaacaccaacagttgccagtgtttttgctttttagcttaaaagcatagtgaagatgcttgaggaagactttgctacctggggtgtgtagacagacagactgagagctatcagcatttgaaggcccagcccttgactctgagacacatttgaattttttctttcccatcaaatggcattaacaagattgggcaaagatgagtccctcaaatttctgtgttttttgtttgtttgtttgtttgttttttctttgggaactgaagtcagaggcacgaacactaactcttagcatttttctgtagactttttcttctggcccttgtccctgccagcaaaacgccccttttctgatcattcgtgcgcagagggcctcccagtaatgccacgctctccatgctagagagccttctctttcctctgaggtttgaactgatgttctgtgtcttcacaccctggcatgacagttacgtgtggtcagcccgctccccaggcccgtccctgccgccgccaggtgtgggctctaggcaggccgacaaggttacacctcccagagcttgtgatcttcattttctgacagtcaaagtgtgaaggaacccagacttccccgagccacggtgttcagtcagcccacaggaatatgcaagacccatctccaaaagtttgtctttgattttttccaagcccttagccccataagctttgaatcctgtagttacagtggcataaaggactgacaaaacctggataaggaaaaaccttttttttctatgaattttttttgttttttaggggaaagggattctaagaatgtcatttaatgtactttgcatcatgtctctagaaatatctttgtccatagtggtggtggagtctctctctctctctctctttttgtttgcttctgttttctttcttgtcttcattctttcttttcttttttatttctggtagcaggcctccatagaacaaatctaaaacacaaccaccatagtaatgtaaggagagcttcagtggcacctcaaaacccacccttcgagatctgtccaaagacagtctcagaaagctgcactgcccaccggctcagctttcattcaaaaaggcttccaaggccaattctgtcttgaagtcaatgcatgtatttactgtttgacagtaaacccgctctgccttctccacgtccaaggctgtgcattcgtctaattagcgtcgtgtatgttttccttttattttttccaataaaaaagcagtgggatgaaaattgctttgatatatagcaggtaacattgaagctattccatagcacttaactgtagtgaatactgtgtcaccaattttgaaatcaatttaatgtttaatgcaaatccattacatggtgctattataggctgacaaaatgatttacacaaatgtgacaacttgggctcaattcactctgctttccaacagtgtaaatgcatagcagtgtttatctgcatgagaactatgcactaatctatctgaagaaaaaaactatatcaactttggtatctactttccgtttacttcaatccttgcctttttggtcattgttataatgccagctttaggacagaaagaattataagaaaaccagcataatacctgatatattaaaatgtagtgcctgtgaaatctgtattatattgctcttctgaagtaagatttttctacaccggtagccttcgctgtctgtcagtcaggaccttctggtataggtgatgtaaaataaccgtacaatattaatgcatgcgattccataatgcttagtgaactgtatgaatattactcaaagttatgttagtctttttttccgacttggttcttgtcagctaggtttaaaggtatttcactgagaacgcaaattctgtcttttcttgatttcggctgttttcagtattttggaggtatacatttacttaaattcagtattactcgtgttttgtttttgtttttgttttttgttttctttttcctaggggacaagcatgggtgtttgatttcagaaatcagtacctggcgagatttttgtctcaaaacgactatttgaatttcaagaactgtgctgcgaagacactctgagaacatttgcaagtcaggggcattttccttgacccttgactgatgctatgcggagactgatacattttcttaatggacaatgttcaagccaggtacccatgcttgatctgtcttcacaccagacctcctcatattaaaaggaaaaataagaaaaaaaatgtaagaaatcacatggctatttagtttcatgcacagttgcaatattttcttcaaaaataaaactctgtacaaactttgggcccgattcataagaaaaagaagtttgctattaacacgggatttttttaatatactttttttggtctaaatttgaaattacttgcttcccaaattaaataaatttcatctcatttttttccctaaaccagcacccatctgccttttattccccaaagagttacctttcccagattagggggatggtatgtggggagcagatagcggaaatgcttagaaagataagggggaccacccacagctggtcgtgagaacagggagacagtgtgtgggggtgggacctcatctgtgtgcctggtatcctgagttttacatgtagatgcattcgcctatttgattcagaaaaataaactttcccaaaatgtgtctgaaccacaagagcatacagtggaagtgctacctctaatctaaccagagcaccttcatggtggaagacacccaccaggtcatacaatgtgaacttttgtatctctgcagtggtttcaaggacaaatagtgtccaatgtattgggccatttttcctgctgtttttatactcaacttctcaaaatgaaaaaagcttttatttttcctttgacttatttgtgttgttcttattttttaaatttttattttttgataatagtctgtaagttagcctttttgggttttttttttttttttttggcttttttttttgtttgtttttttttcttttgacattgcaaccgaaggtcataaggccgctagctccgctgggacagaggcttgagagaactaacggctcggtgccttctccctggtctcagaccatcgtctctgcactgcgaaggcatttggtagcctcgccactgagatactaactagacctagactaggagctttatcaggttctaggaggtcctttaggaagactctcaaaggcaaatccctgatcccccgccccacccttagccctgccctctcaccagagcaaaattcactggggacttttcccaccacacatggaaatctgtccactcggaatacctctgttttccatttcaaattgtagggggaggggatggaacacttccagtgatggtaagagatctgttatgaaacgaaacaccccccgtgttaataacttggtctgaaatctgtttttatgagccgggccccctgtgcctctagtatacttgtattgactctcatagttacccttttagttttactgtgttctgtgaaaatttgtaattggttgagaatcactgtgggcgtccattcttattcaactaaatctccacaggttttttgagctggtgtggattagtttaactcttgtattcaaccattagtgctaccaccttctcacattacaatacaattactggaagcaagtactgcatttcctatgcaacaaaaaaggaaaaataaaaaattgctaatgcta

SEQ ID NO: 2055 - DNA, 380482 bp, Homo sapiens
cggccgcggaggctcgggacccggctggccgcgcggcgccgcagccgccccctcccccacaccccctcccccccgcggcggcggcgcgagcgggcggcggctgtgcggtgcggtgcagagcggaggcggaggcgggcgcgcgggcagctcgcgggcacccggccgggccggcgcgggagcgggaaagggtgcgctatgcctttaacacccgcgtacagtaggcatgtatagtggagtgtagggaaactctaggcggggttaaagttcagctcatggagcggcaatagcgctggctggctggctgcagttgagccgacttggaaatgtgaacgcaagaagcaggcttgatttttttttctccccccttctctctctctctctctctctctcttcctctctccctctttctcctctctcacccacactcacgcacacctccaaaccgcacacccagacgcacacgcataccccagcgcccggcagttatgtattctccgctctgtctcacccaggtaagccgcggcgtggatgcggagggcttgggggccggggcgccgggggcagggctggggctgggtggggggcaccggggccgtcgctccggccgggcccagggcgtgcgtctcggtgtgtgtctgtgtctgcgcgtgtttctgtgtgtgtgcgcgcgtgtgcccgcgggtggggggggggatcccgcttaaagaaagtaactttgtttccatgcgggtgcattcctcttgcacggccatttgtgtgggcacatggctaatggcgccctcttattaatgcgttaattaatatcggggcgacggactgcggaacagcagtgttttcggacaccccgcacgtgtttcggcggggttgcagtccatgacacgcagaaatctggctcagcgtttctgctgccgggagcagggattccgtagtgccgcagcgcccggggagggggccgccgacggagcccaccgctcaccccgcacgctcgggccggctgcagtcctcgggtgcggggagacctcgggtgcctgcgcccaacggcccgctccccgcagcctgcgctgccgcagccccccgccgtcttcccgaactcttacttttgtttattgtttgtcagccttcggggtccggccgcggaaaggacgcgggctcccgtcccggccccggcccggacagcgcccctcggacgcgggcaggctgcggctagccctcggctgagcggggctacgtggacgcgcgttcccccgcgccggccgggtggagcctgcgtcctcgccgcgcgccggtggcccgttggctctcccggagtgaaagtttcggggccgagacgagcccacgttgtgcagggcgccgaacgccggaggccgcgggccgcgggccgggtagcgccgggcagagttgggctcctagccgggagccggagcggcggcccgggccggacacggctccccccgccgccgccgccgccaccaccaccaccgccaccgcgcgactccggccgctccgcgcgcaggacgggggcaacttttcccctccgactcaactcagagcatggggctcttgcgccccaccgcctctcctttccgtgcccccctgtccattcctcccttgtctacccacccccaggcaaaatattgctacttcgagacttcaaatccggtcccctttgaatatgttatttgttttccttgactaaaaggcttgaagtcaaagtggttttgcgctattttttttttaagcgtgagatttcatactgctttggtacattaggatctgaccattaatcacctacatgaagttatatgcttcacataaaatgtttattcacctctcccttaaaaaacctaccacttcttgccttcatttagtaggagataacggtttaaccggaatagtttctggaaggctaaaaagtatcagtagttttcgctctcctctctagattctggatttatttcccacatgacatcccttcttattgcaatatctaacagtaataataccgggtatttgatctcagaagactcttaaacgcatcttttatgttgaaatggtctgtttgggatttaggcctagcattaataatggatagcagttacttttagttactgtaaaagttttttttttttttcctaacaaacttccaaagttcctattttagtaacttgtggaagtatggaatgaaacttttccaaccacttctggcaaggttcacaattgcatatggataagatgcaaagtgtaagataatttgaatgaattacggactatagtgaaaatgctgagattcgaaggctgaagttctagctggcagaagtttgcaacacacagaacttgtagataatatcagcgagctgcaataaagggaaaggaccctaacagatacattagtgtcttctcaattgagctctgaaaagataaatttatatttgggaatggtgcatatatgagggcacctgtatatccatgcaggcctagggcacagtcaggtatttaacaaagttggcctctgttggttcatgaggtattatgacattaagagagtttttttttttctttttttttcggcttacatattcagcagcgttgattgatgcattcactaggccttcttctggaaacaccactaagagaaatgcttatttagtgtaacagtttgtaaagaaaatgtacaataaatagtgaatgagggctcatattttatgggttctgcttttaaaaatttatttacaatttatttaacttgctgggatatttataatgttttagagccagttttaggaagaagaacttcggtagtttattgctcattaaaaaaaatcagtaagcacagtgatttctatcactatactctaaatgaaactccatttaacttgtaggcaatttaaaaaaaaactttaccaagaaaaacctagacatcttattttaatcaaatatgggcatataatcaaatcaggtactgtccatataatgataacccagcagaaatttgtaggtgaacttttaaaaaaagtagtttccagaaatatcagcattcagtggttcttaaacttggctcactttcaaacagatcaatgtttaagatgctgattcaaagtaataccacttttgaaacaggttttcaggtttgtttttattggtggcctataactttctcactgagtacatatgtaaaacgttctttttttcctcttgaatgttatgaaatagtacctagcttatagcgatatgttcagcaacatgaattataagggcacactactttttttttttaactaatcatttatgctattcctggacatttcttgcaagctaatgatactctttagttttgatattctggaatattttaaatcatgacttgagaaagatacattagaaaaaatcaatactttaattgtgcatatgagtaaagttatacaaaatattgtggacttttactggcaggttcttaacctttggggagtaatacattgtaaatacttttgatgcaaaattggggacttaagttattcttaatgactaattgacatagttgttcttgtttaaggatttttatgatgagatatatgggcatttggttggcaggtaaacagaatcctgttggacacgaatgcatgcatgcagtttgcagttttttgaaaagcatattgggagtatctacagacacttaaaatgccatattagaatgtttattttaaatgcttattatcattaatcaaacttttaaataagataacattttaacatagatatgaatcgtttggagctaagttatactttgcattataaaatggggatgaaactttaaaatgaagtcctccttttggtgaaagctcacttggtagtttaaggtagactccaggagttttttgcataatacaacagagtcttggtccctagcatgtcttgtatatataagaaaatcagtcaatgtgaagttctgtttcaaacctaaaatttatgtattttagatcatttcaaggatgagctcagaatttagtaacgtttagatgctttgtggtttggcgtatacctttgcagataaactgtgacttgccccccatgcctgtcacctaaagtatgagaataagaaatattctcaaacatcagaaattttaaaaatgttaatggtttatggcaagaataacaattcctgtatttttttctattctctctctacttaaagaatgcacacgtgttacaaaagctgactacttctcttttggattcttttattgaaaaagagcagttttgaaagctaaacttgaaacatagaacctgaaatttgtgcagagaggaaaaaagtcagttattgaagtaatttattatgtattaatatatacttacttttaaaagctcagtcatatagagtgtttaaatgattgattataatttgctaaatttttaaacaacacgactattaaatattttaccttatcagttcacatttgaacatttaaaaatttagtaattgtgttaataataatattctggacattactgctacctgtgccttgaaagtatatatttagttagatataacaaactgaaaaagaatgcattttataatatttgtctgtcctacaccatttagcaaaaaagccatcgaatctttctttggtttctaatcctcatttatttgaaggtaatctatgttttggagagggggttatgtggcagagagaagttatgtaacagtgtggattagttaatcaaaagttagacgtactccgaaagctttgtggaggttactgcttaattttttaaaaaatatatttatatttcctaagaaaatgtcatgtataaggatcaaacattttaagcaaaacagaaagaaacatttaaatatttgaaactcaatttttttttcaattttaagaggcatctatgagggttttcccggcatcttgtaaatattgaaaataccaggttctgattccctatgagaaaaatcctgaaatagtatttgcaaaaattaaataatctattttttaggtatgattattactgaaagcacttcacaatcatattagtaaattaaatgtattcatgtatgcttttctttgtttttttttcctctttcttccccctttttgtttcattcccatagtattagcaattatgtcttgggcatagatcttttattttagcctaataaatatcaaattcaatccttcttttgtatatgaacctcccaaatttgtcctagtttttgactaaaaaaattatatgtagttataatatttaaaaggggaatttagacactagcaaaatgagtaagaaacatatcagaatctacatgcaatatttttagggggaaagcctttgttttcattgattgtagagatgattttttgctcctagacttccataaacattgactggcatctaaatgtttaggatttgccaatctggcggctgggccctggctgtactacaagtggtgaggtcaaggctgggacaaaattagatatgccttccttgaaatagggttaagattatacattgttataagcatttagataaacttcacttactatctaaaggatggggagctaggcccgacagtagtagctggtgtaccctggtgaacatattaaaacagttttttaattttcagcagtttttttatttccgatcataagaaatgatactgatagttttctctcccaccttcccagacttcccataggatcctgtgtatgattttggtaacagaatgctctaatcaaatttcaagtgaaatgaggaatttctttcttaaggtgacccgctgaagaaaagttgttttcttttgttttcattctacttatatttttctttttgttcattttcctaggatgaatttcatcctttcatcgaagcacttctgccccacgtccgagcctttgcctacacatggttcaacctgcaggcccgaaaacgaaaatacttcaaaaaacatgaaaagcgtatgtcaaaagaagaagagagagccgtgaaggatgaattgctaagtgaaaaaccagaggtcaagcagaagtgggcatctcgacttctggcaaagttgcggaaagatatccgacccgaatatcgagaggattttgttcttacagttacagggaaaaaacctccatgttgtgttctttccaacccagaccagaaaggcaagatgcgaagaattgactgcctccgccaggcagataaagtctggaggttggaccttgttatggtgattttgtttaaaggtattccgctggaaagtactgatggcgagcgccttgtaaagtccccacaatgctctaatccagggctctgtgtccaaccccatcacataggggtttctgttaaggaactcgatttatatttggcatactttgtgcatgcagcaggtaagtgcgatggtgagaattcctcccactttcttgtgtgtgtttctttcctgatggcctccgcgttatgccggattcttcctgagctccccaagttgcaggccacgtacatgaagccagtgtggtttcaaagattgagagaggtgccaccttcattcaggtgaaaaagcatagctttgagcgaattctcactaagttcagctcttttggtaagtagtgttttcagaggcgttggtaatcagatatgtgatatgtttaaatcacattttttgatgaggggatgagagaagcctcgtgaaaacccttttaataaagagtatattttaactgacaaatgatctagtttaaaagcatttattttggtattgaggcaatatttttagttggttttctgctgggagtgtttttaacctactgaggcctcttgaaccccttgccaattaagaagttggaggtagattactatcaaattgctgatcatttaggaaggaaaaataatcacattaatacgcagacttagtagctttgtatttaggaattcttagtgttgtctcagatagctaagggaaacaaaccagctctttcagtaattgatggagaggttaatattaaaaataaccaacctgtatattgcatgaacacattgaaaaattgctattgataattgatgtagtgagttgctttgattgtaaaatcttaaattttttttctgttttttcaaggcatgtcttacctgtgcatgtttcagtgtttagaatagcatgcaggataaaactattgaggactggataaaataatgcatttttactttgttcctttcgtcttgttttagacaaaaggctcattgtgctatgtgaacgctcaggtcttgtgtaacttgttgactttatatatgtacatatcggtcttgctagattaccttcatggcagttacttgagccagatggaagaaagagggttgtggaatcctaccagtaggttgttttggggttcaaatatttaacgtttttttttctttttttttttttttttttacaaaggagagatgttacctgtaaaaacactgcacttttcttcaaaacatttttaattctaaaaatgttagtgagtttttaaagaagccagctgatagcctgttctctattatttttctcaatatatgttttagaaagagaacttttgttatccatctgcccttacataagaaactggagaaattagctttgcaagcatgtcacatcatcatttgcattctgttggcaggggatagatgagtattttagaggatgtgagctgtaagtgtttcaaatatttgggttttcaaaaatgtatacttaattataagaattgccttttgctttagccaattctgggtagcaagaatgaaaagtcagcacctctcaagtgacctctaagcaggaataagtagcccttttttaacccactcttaaccctgttgttgttcatttgttttgtttactgaaaaagtaaagttaaaatttttaaaaaatgtgtctgcatatgttaagcacagcaaaacgcaaaaaaagtataggtgttacaggtgctttcaagaagcactctttaaaatcttgtttttaccttttagatatttagaaaaatataacctataaattatcccgaatagatgaccaacatcgaaacttgaaagtgccaacaggtgatgcagatcatgatgtgtgcttccatataagataacatcaaaatgaaatacctgtgaagtttttgtcggtgtaagcagtgtccattctaagttttcgtcttaaacatttctctgttatttaaagaaatgcaatcttttcgctgttctcattacgtgccttctttttcgtcgttggtttgttactgtgctattgctcccaatccttgaactaacacagttgttggttgttgcaatgcctgaaggggttatgttggtaaaatgacatttagaaggttacttaggagagttagcatccttattgcttatgaaagatttattgacagcagcatagatcagactactcttcggtttggttttcctgatgtatcccagaatcccttgttatgcctgaatgccagccaaatgtttggccattggttttcacgggaccgcagtaatggctgcttctctgtgcgcgcaacaggaagactgtaaaagaaaatattaagggtcttttgtctgaaaatatttcaaatttgatttaagagattcagagacctgttatttgtggaagggaagctgccaatacaaatatgaggtagatcggtcaacttacatacaactgatttgacaagcatctgttataatactgaagatttgtaaacactaaacaatgtttttacctccttaaaagttttgagaacttgccagtattggcaggaggcagagactctgaaacgtgcttcaagatacatgccaaaaccattgtggccttttcacctataatgcgttttttctcgctctttcttttaaattgttatatttttttcctttccagaatgcctttttttccccctagatggtcatagaaattagatcttcttttccttctgaaatttgtgtgtaataattcttgctttatgtgtccacctttctttggtaggaagttgaaatctcagaacatacgtgagaatactagaagcaaatgcagaatcaatctttttttttttaaagcggaggtgatttattctaagacttattgacatgctaaaatataatacataaactacattccagttttttccctctaaatccagtggcattagaactgtgaattttgtggctgataagcagtaacaagtgtaatgaaattggagtgatttcataagcctgagaatttcatcttgttaaaagaacaaaaccattttatgcccttaatttggtctcaatttgagttgtccttcccatgtatcatatgacaacttggggatactatggtattgtggcaaatggttttctttgtgggtgtgtaacagtaaagctaatttatgaccagtctttaccagatgatctgtatcagaatctacaatatacccggcacgtggcaaggtcacaatttaagttgttaaggtcataaccttagccaccaggcatttgaccttttagataaagttaacctttgttcattagtaggcactcaaccgagaagtttctggagagttgttgtttttttttttttaaccacttctgtataaacttctggtaatgtaatcagattctagaaagattctcagtcaaattagttagattttgtgaaaggttatactttttaaggactcatttcttggatagaggcaggttgctatttttaggccatagaatgacagtttcacaatttatatttgatattattacctgccatggggtagaataaaagcttggaggcagctgtgtggggacatttaaaatctaaaattaaacaaattaatttatgtttaattcaactaaggcctttgctaattttcaagtgacattaggcctaaaagctaaatcacagtgagccatcttcactttttgcagatgaggaattttctaacattagaagtatttttagcagtcttaaaattcagtttgaaagattaataagtgaccacaatttgtcaggtaattgctttaattgttaattagccagtgacaaagcaagttgctgttgtcctaatggcagcagtatgagtacttgttagttttaaggtagaaagagaacacttttgcacggtaatcttttagtgcagtagttactgattgcttccatgctgctaccattattacctttacttaattttgcttgcatcaggaatagcaaagatcctttcaatcactgaaggagctgtttcagtgtctcggaagcctgatacctgtcctataaacctactcaacagtattactgattaccacattacctgtaccatattgttcacttaattatgctgacatgaatgctcatttcaaattatttagattcttgctagttttgttctgctgtacctcatattattccatttcagccaaaagagagctactcccattcaggtgcattttagttttattttggcttcgtgattgccattccttcatatagtaatagagaaagccgtgatatgcagatagaccagatggtcatgttgacagattgagaattcacttcctactgcttcagagcaggtgtaagattaggagtgtctgtgtaggggcgtgtgtgtgcttcgtgtgcatgtgcgtgcacatccaggctgcacagagtgctgtttgagcaatgggaatgatttcttttttgaaatgctagtattttaaatacagtgtaattatacagataaggttttcagtgcatatagaatattataatttttataaataaatcgcattagattgttacagtttataattttatgccaaattaattatgaaaattattttaatttttaggtaacttcctacattagtttgaggcaacattgcatatccaaaatatattcaatatattcttttagcagctacatgtatgtgtgtttacattcaaatctaggactatacgtttttgtaattaaactttttcagtaacttaataaacaccctagtagaaagttgtgcagttacttcctgtgatttgtaattattaataaagtgtgtttggaaaaagaatatacactgtatattgtatacacaatatacacaatatacactgtatattgtaaaactaatatacagtgatatttaaattaggagagtaaggatcaccctatcaaactctagctttaagctcaaggtggattttttggctgatcaagctattgtaaattattgatatatggcatatttttagaaattttaatttatcttttaattcttcaaaaaagatagcagtagcagtcaacaaatttgagataaatattgattttacatccttgagtgttttctgtgtaacttgaggatagtaacaatatcctttacctagaatgtagtaacaaaatcctttatctggaatgtagtgcaaaagatggtagttctaaggcagagagtgtacaggaatagggagaaatagttgttctggagtaaacctttgaatggaagtcagttcatttatggctaagaggttgagtgtgttggtaagaaaatttcccaatgcttctggcttggattttccttgtcttcttttccaccctgtgatgaatagcattaatttaaacctatttaaggctagtgtgggagaaaccacagcctttgttgtggtcactgctgtacacagtaggactgggtgtttcatttggttaaggcctcaagctgcttccagaggacacgggacagcctgtcggcattttaaatcttgcacagaagcagcaacaattctaattgctcacaaatgtcaatatagatttttgaaaccaattttgaggattagactagaagaaaaaacataaaatgcagattgagttcagtgaatgtgctaaacactgatttattaccattttagtaataattttcccatggttatttaagggttagagcttgcttttgaattattataaattgtaaacccatgggggttgagtaagggaaggaagaagtcaggtggaggaggaagagaatgaatgaactcgtatgctttgttaaagagaaacataaaaccctgaacttaatcacaaatggagataccgtaaaagtattttggtttcagtaatgactgtaaagcagtcttgggcagtgagctatcaagtggagaattttataatttgtcttcccacaattttttgcatagcttttttcagactaagacactatttagagctttgggagtttttattcaagtttttaggaaaaggttttgcaaaaattctttttagaatttaggagtccagttagagacatcattgcacacttaagctcagaaaaggggccatggagatgtttattctttttactattttgctttctaaggtggcagttcagagtattgtcaaatttttggctctttcccagtaggcaacggtaagatactcattattgatccaaacttttgggtccctgaacttaacagaattatttagttgctgcttagacagaaatgacttttttccttagattttccccaaaatattagaaaacaattcctcatgttttgttttaactccacagcgtaaagcatattttatctaatggaattagtcctcccgttagtgttctagctaaataaacatggcttatgaagtgaagaaataagtccaacaaatgacaagttgcagcaactctgaagcagaagatatttttgcttttctgtttgtaaaacaagctaaataagataaaactgagaaaaagaagttcatttgtattgtgtattttggcaaatcttggtcttctttaaaatgttgctaaccctaaaacaagaaatgatgaggataattatgataactagagattgaagtggaataactgtaatgttctttgagaactttaaacttacttcttttcatgtctttcaaatacttccctagtggtagatattttggacctagatcaattgggagtagagaaaaggagatggaaggaaggaaaggaaataacttttattgaatgtctgttctgcagcaggcactgagtaaggtttgtcatagtcatatattgtagcttgctgtcgctttcatagcagtattatgaattagtaatgcactctctatttgaacggatgaggatagactcttcagagtggccaggttacatgtccagagcaagattcaaacccaggtcttctgatttcaaatcttatgctcttaaacaattcaaattcattttgtatccttctttatatcttattgtttagggttggatgtcgttttcatggtatcacacacctgtcttgaatcaaagggaaagtaaaaagtcaaaatccaaacccctcccattgagatatttcactgtcaaattcagatgttagccacagaatgaggccacacttgataaagagagaaatgatgttacacttgtcactgttagggtcaaaatctgaaatgatttgttcttttttgtttttataatgttgaaatttagtgaatagaagcattatgacacaggtttaagatttttagttgttgttaagacaaagttaaactaattcgttctagatgctttgagaagcctttgtgtattaaactaagcactattttaaaaactaaattgcatgtaatttttactatgcagatttttgtacatggttttatatgtacaagacataatatatatttctaatttcccctatacattacatatatttttatatatatatttacagacagagaaatatatatctatttctaacttcccctaatgattggattttaaaatgtaaaattcactttgctctgaaaaaatcctttggttatggctgtgtgtgtaattatttaaaataaagccaaaatcatgtttgagaaaagaatggaattttattagtttaaaattaaaaaattaaaataggaaaaaaattgaagatggacatgtttcaatttcgtgcccttaaattagtgaattagtgagcttttttttgttgttgttgttgtttgagacggagtttagcccttgttttctaggctggagtgcagtggcatgatctcggctcaccgcaatctctgcctccctggttcaagcgattctcctgtctcagcctcccgaatagctgtgattacaggcatgcacccccatgcatgtaatttttagtagagacagggtttctccatgttggtcaggctggtctcgaactcctggcctcaggtgttccacctgcctcggcctgccaaagtgctgggattacaggcatgagccaccacgcctggccatgagctttgtttctaactctttaaacttagtcaagattagttctttttttttttttttttttttttgagacggagtcttgctctgtcacccaggctggagtgcaatggcatgatcttggctcactgcaacctctgcctcctgggttcaaacaattctcctgcctcagtctcctgagtagctgggattacaggctcccaccaccacgccaggctaatttttgtattttgagtggagatggggtttcaccatcttggtgaggctggactcgaactcctgactttgtgatctgcccacctcggcctctcaaaatgctgggattacaggcgtgagccaccgcgcctggcgacaagattagttcttaatgatttcagtgcaaaaactcaaagcctcactcaacataatttttataattgtaaatagaaaaagatgaccaataagtataatttatactatattaagtcattatacatattaattcttctaaggtttaatttaaaaataagcagctgaactgaacttacagcaaagaaaataaaatagctttctttttaagaaatattaatgaatcttaaagttagggttgtgtagcatcagttatgctagaaagggaaaactgagtttgaggcatgtgaagaaaagtgattaaattggttaaaaaaatagtactcatatcctattgtcaactgtatctagttccatactgtatgtatttttatatctctggtaagtgcttatggtggtcccaaataacttgtgagtttccagacatagacagttctcagagcatgtgtattcatataaatttttaaatggctattgctgtagtgctctacaggttaaaaaaagtgaggcgaaattgaaacatttaaaaaatactgtactatttaaaaatttgtatgaatgtctgtgtagcagctgccattttcaggctgtctttgttgctatggtttggttgattttatttccttttgtaattttgccagccagtgattgggtagtacattgcattcatgctgttggggaagatatatctgtggtgagtcagatagcttgatctgagtagtaatttttagtagggaaaggtatttgtcagtgggtaatagaaactgtagtgttacattacccatcttcatttaattttcaaatttacagacatgtcacttaatatcagaaattcagaaccatctcttttgcagtgatatgtacttgcctctctccttttgtcctgtcagatgcacttagaattctgtgtagtttaatcttaaagggattagttatttaattttaagctcctacataaaatgaatattgtacatacagggtcccatcattgtcactttcaaatattccattgcctttcaaaggagctgacatgacaagtccttaggttgacaaattctcatcaacttttatgaaaatgttggctgcagaaggagtaaagtcaaaggagggccatagacagatggctttcagtgttgagatgacatcaagcccttcttcgtggcattttttaacattccaaatgaatgagggatggagatgcttaaagagcttactatagaataagtaattaagatattgtgtatctgcatgtaaacccctgttgcatactattaaacagagttgtgcaggctcagatataatagcagattaacaatgacaattgtaaatatcttttatgctgaatgtaactcataaataatattacacattaacatgttgctgatggaaaactgtgtacctgagaacatattttcaacattagataattgagaactaacgataagtgggttaccagtgtttgaaatgaagcaaagattctagataagaacttggcaaaagcttatttgcataagaaattttgcgtctttatatgactatgacaagatttttttggatggatgcacaccatataaaaattactaagttactaaagtttctgatggattcatttagttggctttcctccccctcttcttttaaatggtagaggttctcttttggagagtagtttcaagtaacttctgagaatgaagtctttgtaacgatgctgttcaacagcgtaactattgttgtgcattcctgtcagggaaagatagtcattgcagtacttttattgtatggcctcttaatatgtgacaaggacttttattaagaattcttttcttaacatacttttagaagtctctccttttcccacattcaatcagtaactacagttttaaaaaaatatttaaatgaacttttattgatttcttagcttactgtatagacaaaaatcttacgtttaaaaaaggttttaaaattaatgtattttagagtttcagtaaaatgaagtgggaacaaaaattaacaaaaaagtgccatctcattggatccaggatatgtagtaatacacacacacagttctatgtctgtgtaaccatatatatatatgtatacacagttctttggagaatgaggatatttcagtccaaaatgttatggttgaagaactaattgttctaaagatatttgcccctggccccagaaaagacgacaaacatgcaaaatggataaatgtaatcctttgtacttttaccacctacatttttaaactacagtaactctgatttctctagaaaggtcagaggtttcagacagaaagctttgtaattcttcaaagaaagacattttcagtttggctgtataaagactgattatgcatagctttttactttatgtgcggttgaatcttggaggtgctggagtggggtggggacgatgaataagtgaagctgtgttttgagacattagaattggagggaaacagacagattggagaggaacatagattcatatttttgggctttttactatcaagtcacccagtctaaaactcaggacagagcagcattaaccattcattttgctttgtgatagagcattcgattaccaactctttaaactcttttggcaattcaaggaggttgcctatctgggtaccatttcttaggatttgctttgttggattttctaaattgtggatgtgagtttctttggttttgcattttttaaaaaaattttttggtcctttttaacttttccaagttttggagaatttttcatgttgggcggtgttggagaagtagagattgtagatgaccttcgttgtggcttactcctgttatttgggaaatagacgttcagagagcatctcacttgaggccacaccaacagttaagaggcaaagccagcatttaagccaactcccttagatcccagacttttgccctaaaactatattatttaaattatcttttcttatgtgtttttaaattagcccttcatataaacttcaaattttaggtaggggagcttttatggttccctttatgccagtgaggaaacagccagagaggttgagtaacttgtccagggttatatggttaataagtggttaggattagtaactaggccagacccttctatggcctgtttttatctctaagatgatccccagtatgttagacttgaaactatggatggagtgaaaaatattctctgcaaatacatcaacactctgaaagccattgttttctctgtttagaaagtagttgaaaaagtagtgagaaactagagctttttcttttctggtgttagtttcagcttcctaccttgaagggaaccttaaggcccaaaccttcttttttacatttgaggattctaagtccatgcatctcggaaactatggagacgggaacttcttgtgtgagttggagagcagttgtagaccgttatcatttccatcggtgcggatgctctttgggtggtggtggcatagaagatctgttttggttacctttattgacaagctctactgtgtgactggcagttcagttcagcagataggtttccagcactaatcttaggcactgtgatagattcccgagatgcaaaactgaagaaaataccttgagacaagtcagtgccatctcagatataatttcctcagaaatcaagattttagagcatttgatgtttttaaattagagtcctttcaactaatagcctgtatgaagtttttaaaacacttataaaaaatttatggtgattattattattttgagacagggtcttgctctgttgcctagctggagtgcagtggtgcagtcgtagctcactgctgcctcaaacttctgggcccacacaatcctcctacttcagcctcctaagtagctgggactaaaggtgaatcccaacaccctgggctaacttaaaaaaatattttgtggagatagagtctcactacattgcccaggctggtcactgaactcccagcttccagtgatcctcccacctcagcctctcaaagttctgagattctaagtatgagctgccaaacctggcctatatgaagttttaaacatttgtagaaccagttgttaacattgctttttttttttttaccataaaattggtatatgtcgaggaattctatcgtttgactatatttctattgtgttaaattttttgttttcttatatcaaaaatatttttgtaaatgtaaagaaaattcaagcagacagaagatggtgcaggtgctttctattatttaatagttcacctggccaggcacagtggctcatgcctgtaatcccggcactttgggaggctgaggcaggcacatcacctgaggtcgggagttcgagatcagcctgacaaatatggagaaactccgtctctactgaaaatacaaaattagccgggtgtggtggtgcatgcctgcgatcccagctactcgggaggccgaggcaggagaatcgcttgaacccgggaggcaaaggttgtagtgagctgagatcgcgccattgcactccagcctgggcaacaagagtgaaactccatctcaaaaaaaaaaaaaaaaaaagtagttcgccaccatagcatgttttctctaaagaaagctggttgtgcacagaaaagttctattttttttaaagggcatccttctagtaatgctgaaatataaaacaaatagcgttataggaaaatgaaacagcaggagaacgagagagtagaaaacagaaaggaagcgaaggccttggagagcaggcggtagtgaattcatttggcagttcctaaaacacagccaagtcccagtagcatagccacctaaattccctattttgctccttcttggaaaaaagttagcagtctcgagacttttacgctgaagtggattttaagttgtcagaagtgtcaagctgatttgcctttttttctctcttttattaaaagaaaagagatacatactacattcagacagaaagcatgtaaggggtcttataagtgtgagcatgtgttagtggattaatgggacaatgtgtgtggatggtgatagaaaatatgagagaactattgcttggctgataaatgaaataacaacaagaaaaatctggtggcccaatatatattggatttgttgttattctctgttatatctgctggttgttcaatctgaaagtgaaatctgtttctccattcattaatacgtgtgcttttctttgtatagagcacagaacaaattatttgttccataattatttttaaaaagcagaaaatgtgtttgtaacatttaagaaatggcatgggattgtcatagaaactcattctgaacactgtaaataaaaatggttggggattagtcacagtaacatgtaggacatcatgaaattcaagacagatttctttgtctaacagtcagtaagagacatgaagcgaacttgatatagttcatgagatattagcagttcagttccttcagagaaagagaaaaccatgttgcttcatattaaataagccatctgtatacaaatctcacaatttacttgatgattttagcaatatttgatgtttcctttcagagtcttatttccaaataatgaaagcttaaaaaatttgaaaatctctctgtttttgctactaaatctttagaaccatatccctccttttcttctttccctatcttattttttggtaatcttgaatagcattttaaaagttttagctttattctgtttcctttagttttcccttacttcatataatatgaataaaactgaacacattaatgataaatagccttcaataatactatatatttttaaatatttcaggttagaattatgagtctgcagtattaccattaacatctttttctgtttttcttttaatccagtatttagaaggaaattgtttcagggtactttttttctccaactctgtccaacatctggaagaacgattgcctgtctttaaatttggaattaatctccaattgcatactcctgctaggctgatgtttcagtaaattctaacgcatcagcctcagatctttgattccttgagcttttggaagtagaagttaaagtctgagagggtgtttcaagacttaggaaacttagtgctgtggaatgacctgtgcatctgacaaggcccctttaacaatgttgtgtgtcactgcatgttcttatttgtaatcaaaacagtaggtacaatatttcaataagggtaagtgtatttagacaaatgtagcctgataaaagtggataaattaccttttgtggttgagttaattagtgaacacaacgaaccttgaaactggtgggagcatgtgcaaagacatatgtgaaaatgttggtacatggaacatatggaaccatcttgtcttcctgcctgtgtacacaggttctattgtagtacaggtatatgcacgcatatttttgttttattccttgtagtagtcctacttgggatgtcctcacccacctttacttggctaacattatttatactttaaggctcagctgtaacatcatttcctcaaggaagctttcttttccccccaaggttaggctaaggactgcttccctgcctgcccacagcatccattagcagcatattagtacttgccattagcacttcctttatcataataaaactatttgtctacatctgtatttccagattgggctgtgatttctttctgagcagggactgggttgtattcagtgtttttgtacccccacataggggtgcatagaacctggcacttaactgtgcactcagtatctttgtttagctggtgactagatgagaaatctggattgaacaaaacaagaacttgagaagcttataatatggatcttaaaactaggtaacatataaaatagtttttgggcatttaccttaggactgaatttaagcctatgttttttacagaatgattttcctttctcaccctaccatgtcaatggatttctatttcttcacccaaatccatagtttcatattaacccaaaggaattattgacatgtaagtaattataattctgaaaacaaaggtctgatgatgctagacaattgatgatgctaaaccatttaggctatctgtttttccctttaagatcctggtcttgacttttatttgagctttttatctagaaaagatgatttggtgatgatggagtaatatagtaactgctctagcttatatgtgagggtataatctttataccaataataatttatcaagtgcctactatgtgctgggtaccctgctaggggaggaaataaaggatttcaatttaatgctattgcatttttaaagagcacaattttgattaaaaattgacccattctcttcagagtggacactcacattttttgtgggttttgaatcacatagtgtcttgctgtgcaggaaaagggcctgtcagtcatgtctttatttctcttgagcatttgtacgttgtatgtctgtcctcacttatcagggtgtttttggcatggttacttaatcctaagctctgagaggcacaggaagtaaaagaaaagttaaagatgacaattaaggtgttgggcccagttagatatagtgaagtcagaattttccctcattaaaactgttagaccaatttcattagacggaaatgcacccacatatgtaaatcttctttgtttaattggagacctattgattgtaggtaacataagcctctctaagggaaacagaacccaactgaagataagagtttcttccccccaacacatacagcattcatgattttatttctctaggcgtgttcattatcaaaatcattctactgcagactttcccataaagtgtttctgtctggccctgttttcatatctaaaagcttctagtggtttcagcaagaaatgatggaaacattttgacagaatatatatttctttttttaaaactaagatcttaaaattaaagagaaacaaaaacttacaaaatcacatgaaaatataatgctttaaagagactgagaataattgtcttcttttgtgctttcatagaatgctaaaagaaaccaaattctgatcttctttggtgagcaatcaccaaaaatattgcagtggggaatgaaaaatagaatggatttttaaaaaaacttacattctaattaggtctcaatgctgcagagaaaatagtgtaccagtgcaaactctacactgtggtataaggcacaggattttcccgctgcgcttccaaggatagggtcatcctattataactgtttaataataggggattgtgtgtattttcttatatatcttcttgcaattccatgtttctgaagtgtgagattcaggtcaaggtcaatgtgtggccagttgtttataaagtattaagaatctcatgaaggagaaatacagtttagatgtagattttcttacgataactcaaattatgtttaaatgacaaaaactaggtaggtattgaggaggtaaatatctctatttttcatttcttaacattacactacaatatgtgtaatatttagaatttgaattaggaagaactttaacttttttattccttagggtattactgatctctaaacaagatgtttaattagcagaattatagcatcttagataaaattggttatttttaacttaatcacgtagttgatgctacagaaatgaattcatggcctttcttgtggtgctcgtctttttcttgtttgatgttgctagttgaacacatctcaggttgtgagaagtgcatatttagatgggaacatcttggagagatcttgattggtagagagtaactttatatcagtgagtataatgcttatcagtgaaattctaactcatttaattattacttaattttctgattatgtttttgtatttgagagaagattatttccattatggcaaagtatggatggatggacattgctattgccatttcttgacttagcacacctaggaaggcattttgaaacatactttttaaaaaaagaattgcatatctgtgcacctacaacagtgggtgtgctgaaattctgacttgggttttgatgaaagaattccccaattcagttaaattcatccttgactgtcgtgtgccactcatgttcacttggttaaaaaaaaattgttttttggagattatttgtagaatctcggttctgtaaccagatattgaatattaccactggagggaagctttgaactcatttatcacccttctgccaaaccacaaaaatcctctctctctctctcatgcatctatctatctatctatctatctatctatctatatcttactgatttattcatatatatatttcttcatatatatgatatatgacactgtatatttacagcatatatattacagcacagctatttacagcaacctggatcattcattcttagccccttctcaagaatggaagtttattttaaaccagacataaacaggacataaaatgaaatattaaaagactggataatgcattttaagtcagacatacatttggatagctgttgtttgagtttgtccatgctggagttacctcctcctcactgcaccctccctgtttgcatggggagctgagattagattttaactacaaattattcacattagtcaaataaaaaagaatgacatttcccccaaatttgattattattgtattttcttggagaaaaagatcgtgttagtaaaataattcaaaatggaaatccaaatgtatttcttttaaaatttttcaaatctgttgctaaaaagctgtagaatatcgtggaaaattcttttattgtaacaaacattcctggtttaatttcttattttcactttatttttaatataaatatatatgtaacttataacacatagtatgaactgaaaatctgtgaaccaagaaagataacaaccaatacctttcatttacctgtgtgttcttttcctctcccattaccctgaaattcctcctattatcctgaattttgtgtttgtaattcccctcctataaaataaatggtttatcactcataggtactaaatatattgttcagttttgcttgtttttttaagttttataaaaaatcatatatacacacatacatatacatacatatatatatataaatacatatacacacacacttctgggaattgctttttttcactctacaatatgttcataatgtcatatatactgtaatttattattgtttcttgtgtaatattctgtgatggatctatagaaggtttccagtttcttggtcttagcaagtgctatgaactgtaacatgtcttctagagcaagtgtgtaaaagtttctttatggtatgtgcctaggacttaaattgttgaattacagggtgtgtaaatgttaagtttttttttttaagaaaagatagtgatattttatcttactaacaagttatgcctgtttatacgatcactcgctgtagcagtatacaaaaaattctgttgatctgcattctctccagaatttggcactgccagatttttctttttgccaatcttgaggctaaaaaagagtatttcattgtgtttttaatttgcatttataatttgattactaatgagactaaacatctttttgtatatgtatgagccactttactgtggaataaatgtttttgtcatttattcatttttttctattttattgcttattgtttacttattggtttgtaggagttctttatagattctgcattctaatttttggccagtgtacgtttgccaatatattttcgtagtttctggcttgttttaaaattttcttcatgttatctttgatcaacaaaaattcttaattttaatacagtaaaatttatcaatctttatcacatggttattgcttttttgtcttgttgaagatatccttttttactccaagtttagaagtatatggtattttttgtatatcttttaagtgttcatctcacattaggtttgtattccatccggaatttgtgtatggtgtgaggtagggatccaatttcattttattctgtatgaatggacagttttcactttatcacttattgaataatttctctattccccaaataatgtaaaatgatacctctgtcatttattttttatatttgtgtatgtctgtttttggattctttgctctgttacactgatcaacttgtctgccctataccatcaccacaatttttcacttactaagcccttataatgagtcttgataaagcaaaatttcacacctctttttgaaataaattttttagttattctttacccctcactattccatatatatcatggcattactttgtcaagttttgtgaaacatcctattgggactttgtttagaaatatattgaatctacagataaaggaaattgacatctttttttaactatcaaatattattatctatgaacatggtatgtctcttcatttatttagatcttattcttggttacactgaattttatttttcaccaggttttgaacacttttgtgaagctgcttttgtaaattgtttttaatattttgtttttaactctaatttctagtatagaaatacagttactttgtgtatagtgatcttatattcagcgatatttacatatttttagccaataatgtattggtaagttcttttttgtttactatttcgataatcatatcaaatgcaaacagtgagaaagatgttcatttctattctatgcttttatcttccttacccttctcattgcactgagatctgcaactcagtgttaaattaacctgtgatagtgggcattcttgatttttttttcttgatttcctatttatttttaatccctgaatgaatcagagttaatgccttaatatttaaatattactttcgctgctcacattttaatcagagaaaggacaagacctgacctagttttgttaattttcctcttatttttaaaaattttatggtttggtatatgctaccataattgaaacctcagattctcctcacaaattactttatgccaagtggtatagtatctgttaattagtgggtaaatagtgtttttaaagaatgcagtcatctaaaatttcaaaatataaggctcatttgtatgaattaattattttaggtatttcagggaaaagaattaccatatttcatactgatgagattttttgatactgtgttgtgtggctcagtctcttacgttttgatttgaactatagaacccttaagtagcattctgttttttacaatttaaaatgtctggtttgcatgggtttactttttcctttttcctcatgtaatttttgttaagacttgaatagattactcttctaatcttgtgagcagactgcaggaagacaactattaagagtagaaagctattaagcagtcaggggtttattatgctttagtgttttgtttaagtctgttcttaattggttgattaatgtacgagaagtccttttcccccctccatctctacagatggcaaatggtaggtcccaactgtcattgttcacaaaaaaggttatggttcaaagtcaaagattcagagataccacaataatcaatcataggaacttgtctcagagtgcccagccaggcaaaagttaggcagagtaataatatttactgagaatctcttatgagtatttttttttggtgtgttctttattttatttagaaaatattatttaattaattgaaatgcctctgaatttagtgacaagcatttaaataaatatgaaaaataatggtcaaaaagttttctgtttatcggttttatcagatagtgctagaatacataattttaaaatgggtgtaacacagaaaataacattcttaatatattgagattaacagaacattttcaaaggaatacctttttaccattttcatgtgaagattatttataatagttaacttccttttttaggaggaagagtagaattatgttctggtattgatccacaaagaggatttgcattttattcatactataaaagtacctttaatggagaccttgtggtaattgaatctatactgtgtatcactatcaaagtatctttttaattattttatgttatacaatttaagtcatggaaagggggatgactgtattgtatcttttaagtataatgtatagcctttaatattcttaaagtggatgttagttaaggacaatttttagttgagagagagtgaaagagagagagataaggggggcagagaggattccattacattcagcacagtatgaaactaagtcaaaggagttttgttaattaaattcaattgccatccattagaccagtggaatgagatgactctgcctggtgctgacacagcacaggtatgcaatttggctaaatggccatttccaaaccatagcacacatttgtctacttgttcacttttttttttttttacatgagagtttttactcttagaaaagtcaaagagtaacccagtgcttgtcgaggggtaaaggtatcatttttatgcagcatattgtgaagtgattaattttttaggtgaaaaatatatagttcacatagagattatttgggagaaaatgattttttaaaaaatatgcagtatctgcgggcaagcatacgaacaaatatatatacacacacacgtatcagtatagaaaaatgtgtacttttaaaattcagttgtcttaatctgaagctatttgagtcatattctctggattttttaaagcatcctacaatctgtatatataattaggggaagttgtaataattgcaggagttataaaagcgaaatttaggtggtgggtaagtgtatctacattttggcataaatcactacttttagaggatttatatgtcagactgataagtttcttaccatggtgaaatgacaagaataccactcaggcattggctgagacataattttgacagccagcaagcttgcagtgttgctgagtgcacagatttccacttcctgccaagattaaaattggcaaaaaccaaaaaggatattagggattgtcactttaagaagaaataacatgttaatgttctgcatttgcttaagaaatgtaagagtgatctcttgaactgtagtctgttgaaacttacaagtttgcaatcaatagaagagtttgattaatatgagcatcaaaaattaaaataagtagaggctctctgacacttgttagaattaagactcattataggtttacttaataggacataattactttccttctatataagatgaattcttcacaaaagctatgaaatagttttcctcacagtccctgaagaacaaaggcctactttaagtttgtagatttgaagactgaatgcttgctttacttcctgaattttcttattttttcctgtgtgagcagatggtttttctttttataagttgccagatctttcctataacaataactgccattattgagaacctactgtgcgcttattctgtactgagcactcagatcttcagagttttttcttacttaggactttttgtttaactctaggtgtaaaaatgaagaaaaaattatatctcatgttgtgaaagagtcagactctgaaatctgcttatactttgctatttacagtaagtacttttgaaacagctgtagacgttcaaatgaaagtagcaatgtggagtggggaatgtgggaacattcatttgtgaagactttgcatttcttcagctttatagccaacagaaaaggagattgttgtgcattctattaaatactgccagtatgattaatttaaagggttacattttattgaaccctggtgtagatgttctttgtcaacccacattcacagctagttagagtgtgtgtagcatttatcaaaactttctggagcccctctcacctcattagcatctgaatctctattcagcagttaatgtccgttactgctagagtgctcaattcttgttttcaataagccagttgtaaaatgtcagactgtcacttacaatataaaaaaccaaaaatgatggtatttgtaaaaatgttatcacctcataaaaacaaattgtaaagacatgaaagtgatcttgctatgctggtctttcagaagtgagttagtacagctactttaaataccagttgtgtagattcccacacttttctaccaatggagaggtttacacaagcataatttaagttacaattacactaattaacatctcatttgcataaattgttgaagtcaaaacaacaaagaattgtctaagaagcttaatcctatttgtccaaaatagaaagattttttttttttaaaaaaaaactatgctctaaaaattggcagcttaagtatgtctttagtatgttgagctgtgtccttttaaaaataaatgttttcaattttcttaataatatatttctctattctttttagaatccttcatttttagtatacttttaaaattgaacacacacaacactttggttcctaaagtaatgataacaagaaattaaaatcaaggtacagtatcatttatatgtagtagtacagagtaaccatgacttactaggtgttatgatgaaggtgtatgtgtgtgtatatgtgtgcatgcatgtagataagtgtgtgcatttgcacacataagagttttaagctgctcctgtcatttattgatggtcaaaggtttcttttggctattgctggactcttaagattgtcttgtaattgtctttttgttgttgttgaaaattaagggtgtatattaaaggtagtttttacccagatcttatatgtgtgatagctcacatctgtaatcagaaacttactgtttaatggccacccaattgccattagcttcctagagggtgatttaataaactatcttctttaaaactcatttaaaattagagacatgtttgcatacaatggattaatgacgttttcatactaacccacaaaagtctgctgcactttcttttgtaggcctaacattcatttcatatgcattgattattattgttgaacttgcattaattacatcgtgcatatatggacatacaatgtcatctgcagaatttaggattttttattgttaatttttatagtgactgtggattgaggaattaaaattagcatgcttcatttataatagtatttctagtgtttcattagccctaaaaatgtgataagatcaggaataagattggaatgaaaatttctccttaaaatggtacgtcttttgaaaacattttgtttataatatatagctaatcctaatttattacagtctttcaatatattctttaatttgattctataaggcttataaatcactgtctttgagataagtttcttaattcacaggtttgtatcagttgtactaggtttggtgaaggatgtcatcctagatatacagtgtagacgtgctttatgaaacatacttcttcttagggacatttttaaataccaaatgagaatatgtttggtgggccaggtgcaggggatcacacctggaatcccagcactttgggtggccaaggcaggtggattgcctgaggtcaggagtttgagaccagcctggccaacatggcaaaacccagtctcttctaaaaatacaaaaaaattactaggcatggtggcaggcacctgtaatcccagctactctggaggctgaggcaggagaattgcttgaaccgttgaggcggaggttgtaatgagctgagagtgcaccattgcactccagcctgggcaacaagagtgaaactccatctcagaaaaaaaaaaaaaaaaaaaagagaatatgtttggtagaaatctgaaagagaatttatgctgaattgagaccatttggaaggcttcttgggtaaaactgatttgagttgtggatgaaggattgtttggaaatgagagaatgagcagaggccatggtggagagaagagttggagagcaggtgaaaggcgtgagcacagctgcagaagcagacatatgcacgatttgtcctagagcaggtcggttggcgagtttggttagaatggggggtttacatagcggagggtattgaatgccaatttaaagatctaggcagtaagaatcatgtagggtttttgaacagggatatgacatgcttcaagaggttttttttgaaaggattaatcatgaagtccaaatgtagggagcattgaaaacaagagtagagtgacagacagtggaacagtagctttgtctcggcacaaaattataaatcatgatggtttttatttcctgtgccctgagtaatatcataaacaaaatatacaaaatggcaagagcacttttgagataatacatggtttctgattctgagtagtacttgaaacttcaaaaataacattatacgataaaacacatgttatttctttgttatcttaaaatagcaacaaattctatatacgtagaaagacctatgtagaaaaaaaatgaacattctagcctggacaacatagcaagaccccatcttaaaaaaattttttttttttagtcagccaggtgtggtggcctttgcctgtagtcccagctactcaggagactgaggtgggaggatcacttgagcagggagattgaggcttcagtgagcctcagttgtaccactgcactccagcctgggcaacagagcaagatcctttctcaaaacataaagcaaaaaacattatttcctttctcctttcagaggaaaattatttccagattattttttcttatatttttttaaaagttggctttaagggagcacgtttctctttgagggtggcctgtttcattgtcaatatttgctcttcattggaagctgaggtcatgtcagagttactcaggagaaagacctggacttttcttcttatcttttaatggtttatcattgataagtttggacatggtatgcatggtgacttttttcactcttgtcacttttctatatttaccttgttcatagtatgtaatctgagtgccttcaagacactagaaaagatttgatctcaaacaccacattttgggtattttaatataatcaggagaaaagtggatataatattcagacaggaagctggaatacactggcataggtagaagtattcatttcaacattaagtgaatatatatatatttgttgttgtttgttttgttttgtttttgtttattttggttagaatctcactctgtcacccaggctggagtgcagtggtgcgatcttggcccactgcaacctacacctcccgggttcaaactattctctttgctcagcttcctgagtagctgggattacaggcaaaggccaccacgcccagctaactttttgtatttttagcagagacggggtttcaccatgttggccaggctgatcttgaattcctgacctcaggtgatccacccacttcagcctcccaaagtcctgggattacaggtgtgagctactgcacccagccgcaaatatatattgataacttactggaagtaaggtaacatggtacaggttggtagaagaaatatagagaaaaacaggaagctgggcttcccttccagatgtccctagattcaaaggggaagaggcaaaatgtattaaatgctgtcttacacatagactacaagggatttacttggccagggagagaacagggttgattctgagctggagagaatgaggatggcttctgtgaaggagatgacctaaagcagggcctcgaaggttggcaagggacttgcagggacagagcatggagatgggcatatgtagcgtgtgttctggacacggcacgtggaggcagagcacacatgcatagagtgtgtaatgcttcacttccatccttgttccttcagcaagcacccgtgctttacctcgtgctgacccttgagcaaggctgcccgtgagaaacttcccaacttcatgggcaatgttgaaaacatttgtccacttgcccttgccccagagagggagaaggtccacatatggtgcctttgacatgttatcccttggcataaagtttggcccaaatgtacatttgaaacctcacgttccctcgataaatttaaagtatgaaacttttgaaactctaaaaaggtggtgaagaccacagttctccctgttctttttcttctttcactctgcagctggattctgcctttcctccagtggttatctgaggagtgtctgccatgtcttctgtttttttttttttttgccttgttttgaggagtccccttttttcctcccctgggagagtttaaatatgatgctgatttcttgtcatcttagggctcctcagctacaacaaagttaaatggtataaaagcaaagcccaaattagagaccctaaaataaccttggagaaggagagttctcagttatcagtagaattgtcttaggaatttgaggaagcccttgtatacagtgaaaatgagaccctaagttaattaacaaaatgaaaataacttacagtacatatctgccacttccagtactgctataaataattgcaagtgtaaggatttttagtgcaaatatgcagaaaacatgggcatagaaagtttagatgaccttaatgaagaaacagagttggctctgaaactgtgcttagcaggaacaacgttttgtgcacttgataaacactgtcagttgttaaggcatcttctgataggtgaaaagcggttttttgatgcagtactgcctggcatgcatcttctcgatggtctgttatcttgtgggaatgacattcgttaagttgttttctgtgtgcatcccacccaaataaagaatgtttcatcagcaaagtgaattgccgtatagtcatcagactctagaaataaattatcaacgatgactgcagtgggtgaggctgtttgtttatcacatcacttgagaacagagtaaagtgagtttcatattttcctgagtcttgaattctcattttagacatctgttcagaagctttctaagccatggagtattctaaatgagcattttgttaaatggatgaaggaagacttagttttccattgttaggtgaaacctaattaaaaattaaataatgaccttgtgttggcttgtaaattccttatttcctgcatgtgtgagtgtattttgttagaacattccattttaaagcatgccttttttatgacaagaaatacttttaaaatactatttgcttttgaaattacagtagggaatcaaaggatagtctcttgttgagaggaaggtattagaagcatgtagctttatgaactatattttctgtgaatatagcagaattagtttaattgttcaatttcaccctctccagcatgattgcacccatcagggcagttaacagagacaccgctatttgtgttatactaggaattctttataaacttaataaatgaaagctttttctcttataggcccgattctctagtggacttctggtgaaattatgtggctaccttccattaatgttaatggaggttatggatataaatccctccatagtgatggaagaatgagccccagagagaagaatgtttctaatgaatcactggattgtgatataggattaacttggtgtccctaataccatttttttttcctcctgaaagtttaaggtcttatgtttaggaactagtttctctccaccttaatcctttattgtcaagtctgcaataatgttaagaacaggaaaaaaaaatgtagattcctggataggcacagtttttatattaatgtaactatataggcatagtttttatattaatgtaactatacagcacctatttttgtgttttactattacttggcagacatcttgagtgttttacaaggttatcgtatatttcactaataatcgttgcttgataatttggtgtcctgacagactgcagtttattatttagtattaaagctctcaaatgtatttattgagcacctgctgggtacaaggctttgagcttagtgatgaaagcatatgacatagtctgtagcctcaaattttctataatctcgtgataaaagtaggtaccagttcattagttgctttccagtggggcacaaattatggaacatcgtctggctggccgggcgtggtggctcaagcctgtaatcccagcactttgggaggctgaggcaggtggattgcctgagatcaggagtccaagaccagcctggccaacatggtgaaaccccatctctactaaaaatacaaaaaatgagccaggcatggtggcaggcgcctgtgatcccagctactcaggaggttgagacaggagaatcacttgaacctgggaggtggaggttgcagtgagctgaggccgcaccactgcactccagcctgggcaacagagtgagactctgtctcaaagaacaaaaaaaaaaaaaagaaaagaaaaaaaagaaatattgtctggctaaagaaaggaaaagaattcttattcagaatcagcatgatcacttctgggaatctgaatggagaaaataattctatatgtaatgatgttttcaatcaatattattttaggtggtttatttattcagccaactgttgttggctgcccactgtataccaggcagtgtgctagatactgggagtacagcagtgagcagcacagagacagccctggtctcatggagtgtgcactttgagtgtgggaaacagtatgtgggtacataaacaaaataatttctaatgtgatagatctctaaaggaaacaggcaaggtgatagagaataactaagaggacctgctttagatgggaatgtgaaggatgaggccgcattcatactaagcatccaagtaaggagaagaccaagtgcaaaaagtttggtcgggatgagtgtgtgtgtgtgtgtgtgtgtgtgtgtgtgtgtgtgtgtgtgtgtgtgtaccagagactgaaggccattatggctggacagttaagggagagtgacctaaataaagttcatattggcgggagagcagcttgccacagggttacacagaataggcagtggtggtaaaggcagcatttgaatccaggtccatttggctttggaatgtgctgttatagcagcagagggcaagtgtgaaacataattcaaggaaataattgctgtagccatccagaccagaggaggatcgctttgatctaggaaaacatctcagtagtctttgaaaaaatgtacagaatatgaaagatattataggtcttttcctcctataatacaaccaggaaattattcaggctaattttttcagaaaaattattacaataaattatgatctccctttgaaaggtataatgtattcaaacctttttaattagctaatcttttcctgtgaaatcttaaatatttgcacgtataattggtaattttagcttttatgtaggtatgtttccccctggtgttacttacaaaacctggcttactcaaggcccaaagtccaccccactagtaaactctctcgtctctgttcctgtgccaagtgctcttcctttgttaccaggtccacataattaatagctttatcatatgaggtaattcagttactcagcaaaacaaatgatatacacttttagaaatagctctagaaagtaaacttgaacgtaaaattgtttagtaagaggaaatttctgtttgtctttaattaagagaaactgtatggaaatgtaagctaaggatgcattaatcagagaagttggcattgcactgttcttcatttttatttggcatagattgcatgggtgctcattaaataatttgtatgactgaaataacttgtgatagttcttgctaaagttttgcatggactcagactaaagaaactttaaaatttgaattaaaaaacattcaattcttaggtttgaaggtttgagttacttattataactgaaaatctttattatcaaaatgtgtgttcattatagtgtttgcttgccttcttgggtgaagaaatacttattatgagagtatgtagattttccgtgaagaattagtaatcatgcatcaggttgatacctggtgagtagatatttgtatttaatgctcttaaattttaacagccttgcctctgtatgccctgctcatctgtgtcttaccaactttgatattgtttgaaaaataaacatttgaaggaagaagtttgcatatttagagggttggtagttcattacctgcatgtaggttatgcccacatcgcaaagaaatctgatctatatgggtaacatatttggataatcaaggccaaggtaaagggattcattcccccttcttgaattttatggtttctgtatgtcaaaccagatttcattggtttaaatcttgtggtgtacacttggccattgatttggtttgagctctgtaatatttgtaattatgtgagatgacaagattgaattaacttaattgtagagttttacatagtgtctgtatcaacatcctaataaaataatatgaaattcaataagtaatgccaagtgggacagtgagccactcacataagcttactaaacttgatatattcttatggcactcctccagaatgtagaagaaacacatttatctaggtgattagtattctttctgtctgccagatttaaggattgtttggaaatattgttagaatcaaaatcaacgtttgttactacacagggttgagcattccaggcacactctggtcgttttgttattctaatgtccacttatttcatgtctgccgtgaccgtgacagttttcagtcacacagagctgccatcaaaagagtgataagcttgtaagtgaagcctttggggaagcaataaagtcatttttctggtcccatctcaaaagacattattggaaatttatttaaaagtgatcaaggtagcacatacgaggccttctacagtttgcattttggaagttattaacaatctgcagttaagtccatttaaaactgaaagtggctcttccacaaactactttttaaatagcttgctggttctaaatttaaggagaatggaaatattggaaattaaaagtcaaaagaaatttctggggcataagatcctttcaagtttacaatttctcactttagatttaaaacttgaacacggccatactttgcattttatgatatctaattagtgccttgtaatatattttgtgaacagtatctgttagccataatatcagggacagtttaaaaaatcttcagtacatttatgataaaagtattagcattgtaaggtcttaaattgacatctaggacattaggaaatcaaatttaaagcattgcattgtctgttactcaatggagtggactgaggacagcgtgtgacttgtgtactgcaaatgatgcaatagctaaatatcctagtgtgagttaaggttgattaagtgatcatctttaactctgcttttcccagggctctttgaactcttgttttattaggtaatatgctatgctgttattttattgctgtttaaaaaaccttctcttttgggaaagaaaacatgtgaattctttggtttctagatagaaattagcaatcttttgctcggaatgtaaaagtatgctgtattatcacaaactgaccctcctcctccccaagaattctagggagtaaaatgcgtgcacaggaaatcagaaatggatcaacagagttataggttttaaaaaaactgccttgcatttttgccctggaattaattttcagtgaaaattaaaatattttttctgttcatctggaatcagtttttacttcattagcaggaaatggtaaatatacattcagcacaaatagagttttctttatgggacacaggatttgtactccataggtagatgtgtaacataaaagaatctttctgctctccttgtaattttctccctcttaccctcaataagttaaaagaaaggaaaattttttaacctaacctgttaggaaccattttagtgtagcctctagtattttgataaaacaaaatgttcactagctggaccctggtggtgatagcatgaaggactggggtagaactctctttttcattttcttttaatcctgaagttacatcactgtgcagtcagctcaacttgtgtcattgcagtaggaagatatgtaggtggaaagctattccagaaggaggctggagctaccttccctgacaagaaaaaaaatccaagcaaatacatacataaaaagacactcaaagcatcataggatgttatagttataagggaccataggtttcatttaacgcacattttagcatccaggtcctacataaaatgtatattttgtgattgtgaatgggagttttccatatttaaaagttaagtttattaatgtgtcattttacccatcatgtatttgtggccatttttttaataccacgaatgggaacatactgtatcatagtttctttttatttgtctggatgcttgtgtatgccttttagtctactaatatgctcacatgtgcaaactaacaagagaagatggcaatccggtattataaactggtaaagagttatagtgcagtaagactggattaactgtgctttcagcagtcaagttgctgtaagagttatattgtaaagttttagactaacttgcatgtatcccagagtttgcacggtgttgctgagtgtctcgttagacatacaccctacctactattctctcctgacataaaaaaaggtggtaattgagctggcatctagaaagtggtggtagcactacagattgtatcactaatcccaaacaaaggagttgcaaaacacctttctttaaatattttctcttcatggtgcaactggggagggccaaattccagccttaataaagttttaacctgaccagttggtagaaatggcagagtaatagaatgtttggtccagaaaccaatgtgtggactgtgtctaggattagactctgcatttctgtctgttccagatgagctgctcatttcttttctttttttaatttaaatttttaagttctggagtacgtgtgaaggatgtgcaggtttgtttcataggtaaatgtgtgccatggtggtttgctgcacctgtcagccatcttctaggttttaagcccagcatgcatttgctatttttcctaatgctctcccccacccagcccaagctcttcatttctactcagtacgtatgtccatgtatccaggagaaatggagagttctacttttggattcttctagagagattccctgtgggacttctaacccctaatcagtattcttccgttgatgataatctacttaaatgatatcctatcatcagaatccctttatggaattatctttgtattttgcacgttcttccattctagcttctaaatgtaatttttcctcccttaaatcatttttctaatggagacaacattcaaatacataggacagagcccacagccagggcgggaaacctgcatagtgaggctggttttgatacgcaggccatcctactggcagctgttttgtaggcagcttcatgtaatagtgcagagggtacagagagagagacctacactgtgatttctttcgtttgtatattttgtattgaaattgtagattttttggttggaatttatttgagatgattcaagacattttgcatagtactcaaatataggtgaaagaatttcaagtttgctcattttggcataattctaaaacaaaagtgttactgttggatctgggcatgtgatgggtgaatgagtgtttcagtgaaatgacataagtctgtataatttggagggtaatgatgccttagaacaagaataaatctggagcgatggaaaggctccatattctagatgaatgcatgcttcctcttatgactctgaaaaataaaattaaatctttatttatacaaatccagtgaggggggaaggctacatggtttggcttaatgatatatttcagaacaggaatattagccttaacctctttcctcacattgcatatgatatttaatccatcatctttgttttaaacaaacaatacacaagctgttgctggcattggtataaagctgatggtccatctggagagcaggaatatagatcaggaaaataagagaattgaaattgggtgcaagggcagatttgcatgtgtaaaaacctttctgttttaccagcttttatcaaattatttaatactgggcaaaacagattcctttttcttgaagctgagaaagatacctcctcctagaggaagagttgcttcagtgttctaggaagaacaattggttttgaaagacaataaaataatgagccattaggatcatgttttgtaatatagggagttggtgtggaagaggagagagaggactgctggtgtagtgagttcttgttctagctgtgtatgatcattggccagtcgttcagcttcttggccttcagtgcttcctttgactcaagtcaattcagcaaccatttattgaggcaaatgtgaggatgttctgtgggctacctatttagctaggcattgtggatccatagacaagtatgactgggtcctatgcttatgaaactccaggtcttacaatggaaacatactgtggttgaacgatgtagagagtgttgtatatgagatatgggtgcacaaaaacaggaaaagtcaattctgtctggtgtagacaggaagaattgtattacaaatccttcttaaggattttctattttgacatgcaagaggagcaggcattccaggtatttgaatactgagagattcaaattatcagcaaggttctttccagttccacgtttgttgtgttatcagtgtaaaattatttgaatagctttccactgatgagttattagctgaaaagtgtttattgtcatggttgaaagaaaataataatgaaagaagaaacgattacctttagtgataaagttggggccggatgggacgaagcagtgcaatttttttctttataattattcccctatttgaaaaatcaacttgtatatgaggcagcaaacaccttgcagagcagcattcccttttagtttcaggacgtggtggtggatggaaccactgtaacctggcctccctccatgagaggagggaatccaggtggccatgttgaaatgtgcctgtgtgcagcaaggcttctgaaatgacaagagagcccagcagcttccaaagcagctgtgactctggatctcacccatcatctctgcttctcactgttagaggagtgaatctgtgctgccttaggaggcatggaacctgggacttttcttccttgtttaatgtttaattttattaaaataatttgtaagtgatagatgttgatctcgtgacaaaagagagattccctctttataaaactattctaactaaagatcttttgtaagcccatgtgttagaaataaaacttgaatatccccttttttgttgttgtttatgaatggccaataatttattcacatgtgacatttgagctggcattttttcctcctgagatgacagtagcgtccgctgtgttgtattctaaagcaaagtcagaatagccctttgcttttgtcccgattagtagttctgttttgccttcttgccttttccatttagaccttatggtatttcctaaaccttagactgttttgaaaggctttgattaaaatatgctgataaaagaattcgataaccaagttaggaacgacaaggctatctggagaagaccaaatgacttggcagcctaacaaattctattcagagcacacaaagagatcctggaacgttttatagggactcgtgtgtggggaatggtatgaactcaggttacctgcaaaatatggtgtcatatggaaacatttaagagcttatggaaaattctttgaaataaagtggaatgagctagcaagcatattatacctaagaagaaaaacaagagcattcattctggttttttaaggtagctgctcaaggaagggagatagatgaaagtaaattgttttctactttgtacacataatatagaagagatcacctaagcctagttttgctaaccagaccctagacttaaaattagaggtcatgatgtctagccaccttcctctgtaggaacctctcgtgataccctgaaagcctctgcttaaatacttccagagaaaagtgaggaaggtaggggtggggatgaaggtttgcaggaactcgtgttgagtacctagtatctgcaagatactagagtaggtactttatcgccatctcatctgacttatgtatgagtgcaggttttataaccctcaagtttacaagtgaggaaactaagtttatataagtgtcacgaaacttgcttcagttcagatgtctagcttgaggcaaatctgaaattagaacctaggtccatcttcttgcattacactaaactgcctctcaggatgagggagagctcccttcatggctaaggcaacctcttctgtctaataatgcagattctttaaaaattctttcttttatttaactgaaatctgcctcccattaacatctctcattggtcctgattcggcctcaggaggatcacagagctgatgcaattctctttccttatgcaggtatgtttgcaaccactgctgccaaaatggcctctgccatcttttacctagttggttttttttgaaaatgaacacacacacacacacacacacacacacacacacacactcacagaaatatcctcttattgactgcaatccatctttcaacatatggagttctttttgaatactagaggtatagccttaaagaatatgagtatcagaagatactttagtttcatctttccctgcctgattcatcagccaattgttagtatgccatcagtcaagccattaataaaaataatgaacaaggtgaacaggataggttaacttgtagtctatgtataagtttctgaagttgcatgcagaatttagcctatatgtgaatttttctggaaaaatggtcagtaactattgtcagattccttttttttttttttttttttttttgaagacaaagtcttgctctcttgcccaggctggagtgcagtggtgtgatcttggctcactgcaacctccacctcccaggttcaagtgattatcgtgcctcagcctcctgagtagctgggactacagatgtgtaccaccacgtccgactgtccgactagtttttgtatttttagtagagatggggtttcgccatgatggccaggctggtctcctcctgacctcaggcagtctgcctgcctcggcttcccaaagcgctgagattaaaatagaatcgcttgaacccaggaggtggaggttgcagtgagccaagctcgtgccactgcactccagcctgggtgacagaacaaaactcccatctcaaaaaaaaaaaaaaatgccaggtagagcagctcacgcctgtaatcccagcactttgggaggccaaggtggatggatcgcgaggtcaggagatcgagaccatcctggctaacactgtgaaaccccatctctactaaaaatacaaaaaattagccgggcatggtggcgcacacccatagccccagctacttggaaggctgaggcaggagaattgcttgaacccgggaggtggaggttgcagtgagctgagatcgcatcgtgtcactgcactccagcctgggtgacagggcaagattccatattaaaaaaaaaaaaagtattgagaagtactcagagtagagaacttactcccgaatgaatatactaacctctttgaggagagctccccaaatgaccataaattcatatagctcagccatcactagaccgtgtatttcagccagaagatatggtgaatggtcttgtaagatgcctgactaaattaaagtattaaagtatttcttgaattctcttgatattcctggactttgagaaagaataattatgcccttaaaaatggaaaaagagactgcaatattgttatacaggccttttaaaaaaaaagtatccttaaatttttagttacagagttcacttttttcccctacttttctttgttttagattataagcccaggattgttcaccagaaggttaccctttagtctgcaggaacctttgaaaacagatgtggtattgaagaatatctctgtaagcccagaacttatccattgtataaagaattttattttccccagtagaccgggagctcctcaagggcagggacctttgcaagtctttgactccctagcactgaacccagcatctggcaaatcttatttcatgtgactttattttggctgaatggcctaaaaatgcgcttgtactgagcacctaatacatttaatttaatttttaaatttttattcaataatgtagacgtggagtccccctatgttgcccacgctggctcaaactcctggcctcaaggatgttcctgcctcagtctcccaaagtgctgggattacaggcatgagccactgcaccaagccctaatacatttaataaattgtaaggaggaagaacagtggaccgcagtgagatatggtctacagggaaaatgaagaacctcttcaaaaatgatgatcttcaggcctgtaatcccagaactttgggagccgaggcgggtggatcacttgagcccaggagttcaagaccagcctaggaaacatagcgaaaccacatctctaccgaaaaatacaaaaattagccatgcttgtagtcctagctattaatacgtgggaggctgaggtgggaagatggtttgagtccgggaggtggaggttacagtgagccactgtaccccaacctgggtgacagagtgagaccccatctcaaaaccaaaaaagatgacctttattatgtttgacatttaaaaaaatgtagccaaagtaaaagtgttgattagcataaccccgatcacatgttgttgttgaaaatgagcactggcttgcataaaatggacattcatggacatgaaatggacattaatgattttacatatgttaagaagagaattttagacttgagaccttagggagatctgttgatagaattccctatgctctacagataaggatacttagtgaagggactttcctaagctcacagacccagaagagtagtactctttccagccaatggtgatgcttacttatgtttttttttttttttttttttttttgagacggagtcttgctctgtcgcccaggctggagtgcagtgacacgatctcggctcactgcaagctccgcctcccagattcacgccattctcctgcctcagcctcctgagtagctgggactacagacgcccaccaccacgcccggctaattttttgtatttttagtagagacggggtttcaccgtgttagccaggatggtcttgatctcctgacctcgtgatccgttcgcctcggcctcccagagtgctgggattacaggtgtgagccaccgcgcccggcctacttatgtgttttagaaaaatctttaaaatgttaaaagatgacaggtaatttctagaccatatgaagtagcccagttgtcccaggattagtttattatgtgtatatcagccattattttacagagtcatctcacataaatccacacaaccttaaaggattaaaggatggtttctgtgcaactgaaacatatgcacagaatgacaatagtcgtgatactttctttattctttttttttttttttttgagatggagtctcactctgtcgccctggctggagtgcagtggtgtgatctcggctcactgcagcctccatctcccagattcaagcgattctcatgcctcagcctcccgagtagctgggattataggtgcacgccacccgcctgggtaatttttgtatttttagtagagatggggtttcagcatgttggccaggctgatcttggaactcctgacctcaagtgatccgcccacctcagcctcccaaagtgctgagattacaggtgtgagccaccacgcctggccagtcatgctactttataatctgaagttaccagttctttgcagtgtttcacattaggggcattctccaaagggaactttagagataacaaatatgttaaaaatatcgaataaagttagagatgtggggagacattcctactcctacagagagcaaccataccttcctatagactgtgcactgaagaaagggcggaggggatgcgcctgttagagttagaatcttggcttgataggcaaggaaattgacccggtgtggtggttcttatattggtaagaagacccttctttggtttctttttttccagatagctaaagtcaatgtcagtgattgcttcaagcatgatagtcttaccagcctacactctaagcttttcttatgcttccagaatgacttactcagcaatcacttctactttgtattaaaacagttttggttattcaggtaggaagaagagaaaaaaaccaggctgtttccagttgtctggggtttacattatgttacctctcagactgttagtgaaatcagggagactagtggtttttacggcatcagagataccaaatgtacaacagacagatgtcatcttactctttttaagtcatggacaaaaagacagacacattgccctgtaactttcagatcttctgtaacctttttaaacaacataggagagaagttggtacttgtacccaagggaagagaaagttaatgagtagaaaagacagaatttatttaggaaaacgatggaattaagctctggacaaaacatgcatcagtgatgcataacatttttgttaattgggtcttaacaggtttctgactcatatggtaatcattgtagaagtgggtcttactagaccacgccagtggcaaattgcgaagctgtaagaactcttacctccctgtgtgtgtgcacctgagtgtgtgggggggcgtacgtttctgtagcttaatttaggttccacatacacttcagtggttaaacctgagctagactcaaatagtttgtttccattaagaaaatgaatcttttatgtggaccaaggtcaggttagttaatttgtttgcttttattggaataacttttcccattccaattcatcacttaattttaagtggttctactaaaatacccattaaagtcctttacatttctcacagactagggctatgacagattcataagacgtttcttttttcctcaaggcacaaaaggtagcttttctggtcatcaatctagtcttccttgttcctaatttcacaacagtggggcaacattttatataataccaatatgaactctaattgcaaagagactaaatgaaatcttcacacgaagcaagattaattaaaatataaaatgtgcttgactgtggtaaaacatttcttttaaaaaaaatagtatgacttttttttttttttttgctaaatctttcttttttgtacacctcaccctcttcttcactgatgcattttccagcaactggaagttcactctggctaggaaagtaactaaatgtgatgttatcattctaattagtgattacaaaagatcaattaatgttataattaaaaacagtgtctagatctgttgtttgtagtgaataaatgtgacaattactttgttcattgacatagatgtgttgaatttcctccctagattttaaggggatgcattttagtgctgatgtgtgcatttaactgtggacagtaggaacaaggcaagcatattaggggaagagtagggcccctaatgtctaagctacagacatattttagcatgcttgacacctttccttggtatatgatgctatatcagcaacttgtactcattggatctggagcctctagcttttaatattttatcactaaatgcttaagtgtttatgttgcaaaaagaaaaggaaaaaaaaaagattcccacttggactctcaaaccatgtgaacaggctactctatgataactatgtcattaatgattttggtttcatttatggcaataatttttaagttgatcagtcaggatagtaagtatgtgatttttgcagatctggttgaatttttttctgatacagaccaagctgtttttcatacattgaagcctgggaaagctctgttactgttaaaagagtaaccatatctcttcactgaattgttgccaagcagatgtagacttttggagtgtgcccagaaaacctctacagctgatactttggtgacttgttcctactcctggctttactggcacctatttaaatagcagaggaacataattgtgttttggtaggtcaaaattttatacacttctgtagaaaaaattatatataggtaagccaattggtagaaatgaagtaaacccaatttgcttgttgagattagcactgaagatatgctaagctttggttatgtcatttggtcaaaaaagaatgaggaaaatccctcagaaaagttatctgagagatcagcactgaacgtcaagccagcctgtccactcccattactaaaagaaatctccccttttaacttcatcccataaatggatcatgcttcctggatccacccgaggaggacgtggtttagttttagattcttagattacagacttccaccatcagtttcagtattcttttcacgatattaatgttatgaaaactgttagaaatgaggaaataccgccatgtcaggttcactcatggatcaagaaatgagcattttcttaaacatcagtccaaaacaacaaacctcaagtaccataagttcagataacttgggagcagttgaaatcctttaagccacaaagatagtgtcttttggcatggctggtgaaagaaggaagctggttgaattcattgactaactctgttgctggctaaaaagacaattaaggagaaaagggatggaagaagaaaagaaccaaagaaactaaaatctgtttctttttcaggaggagttggaagatgaggagtaacacaacactttagatatacatgttaaaaacttataacaaatcatagatcatactaaaggattaccgaagtttagaacatggctgagggtatagatgtcagattttcttacacaatagtgggtcttttgtttcagagttcactcttggcaagcaactccctaccactgcgttaatttcctgtcgatctttcattcagcaacagacctagagatggggagcagacactgccccccccacccaggctttttaagactgtgctttgtgtagattaaaaagacgaaggaaaaaagaataaactttttccaaacaagatgtccatgtgcattctttaagatcctgtgtgtgcttaaaacgatcctgtaaaaaagccctctccataattttgaacctctcctttttctaaagacttttataggcatttttttttcttcttctcagcatgtgaaccaatgtgtaactcaaatagatgttactttgctgtttacttagattgttttaaaaggctagctgtgtggaggaatgaggaaggaagggaggcgggagtggctggagtttttttttttctctgttgacctaatgaatgcagttcttaaaaaataataaatatttatatgtggtcttaatttttaatgagtctcataaactggctggtatagaaaagtgtatgaaaagccatatatattaaactatagttattataaatacatgcatatgtacactagaatgttttatgaggaagggaacttactagtcttgttcactctttgttttcccagtgtctagaacagtgcctgacatacaactggtactcagtaaatatttgttgagtgaacaaaatgaatgtaaattgacagcattgcctagtgggggtaccattagactagaattcagaaaacttggagtctggttccatcactgccattaatcaagaatatattgttgctgaaatcacataacttctttgctcctctgttttttataaaaaactgggactagcccagctattcaggagtctgtggtggaaggatgacttgagcccaggagtttgaggctgtagtgggctacgattgtgcctgtgaatagccactgcactccagcctgggcaacatagtgagaccctgtctcttaaaggaataataggggctgggtgcggtggctcacacctgtaatcctagcactttgggaggctgagggggtggatccagaccagcctggccaacatggtgaaaccccatctctctaactaaaaatacaaaaattagccgggcgtggtggtgcatgcctgtaatcccagctactcaggaggctgaggcaggagaatcgcttgaatccaggaggcagaggttacagtgagcactccagcctgggtgacggtgcaagactctgtctcaaaaacaaaaaacaaaaagaggaataatagtatctgctctccttgccttttgtgggtttttttgatgattaaatgatatctgagggatacaaaaatgctttggaaactacagggtgctttacagactgtgtgtgtgagtgtgtgtgtgtgtgtgtgtgtgtgtgtgtgtgtgtgtgtgtacagaaaatcctttatctctttgcttctcaatttcttttcttaggaaaatcagattatttaaatcccattatgcacagctctcctctgttcttactaagcctctgtattccattacctccagtaaatcagtaaaaggtggtgagtcaggctgtagtggaaagcggggtctgctgttttctcatgtccatgttactctgtgggactcagaaatcttgcttacatgtctcatgaactttcttacctgtttgaactatacaggctataacatatgacttagagtcttttagttatgaccactcttaagattgatgactaagttgaagtatttattagttgttattatggtggattgataatcatgcattttaacatagtaaactaaagtctgtgtcgtagaattagctataatttactttttaggctggatgaggttactgatgcttgtaatcccagcacatcgaaaggctgaggtgggaggattgtttgagtccaggagttcaagacaggcctgggcaacatagggagaccctgtctctattatcataaataaaaacaaatttttttaaacaagtgtatatatgcatatgcttatgtgttgtaataataatatgtcccagagttgcacatctggaagagaagaagatagcaactgaaaagaaaatagaatggtattgacaaagagaaaagatggcgtcattaggacaattactttttatttttggaacaactcgaggctttacacccattcttttcccacatttattttttctatcagaattcttaaatctaagaaacaaataatatggaggttctttatattaacacattgctttaaattaggaagaaaactgtgtataggctgcagcagactttaaaagcattgtaagactttagatttggaaatcaactttaataacatggaaactttagatttaagagatcatttaatacagctactttgatttggcttttaagagaactgaggcccaggtagcccagaccaaggatcttttgcaaggtcgtgctactgggttctttagcgtcaagactgtaacctacatctttaggttcctaaatttttatcatgccttcttgttacctaactgttgattgttgaactttcttttttcttttttgagacagggtcttgctctgttgcacaggctggagtgcagtggcgcagtcatggctcactgcagcctgaaacttgagctcaagcaatcctcccatgtcagcctctcaagtagctgggactactggcatgtgccatcacacctggataatttttaaaaattatttgtagacacagggtctccctgtgttgtgtgggctggtctcaaactactgggctcaagctgtcctcctgcctcagcctcacaaagtgctgggatttgaattttcttaaacctaaatcaatattataggcctcaccttaggagaactttccaaaatattgttagtgttgaccaccttagcattacatttgctaacgacagtcatccaggtttactgaaccaggaaaccaactttcaggttaataagacagtttcgtctatgtgccatccttatccttgtctggacatatccatagagcacgcattttaaatctgaaagaatatatgtagtctcccctaccccagctttttttaagtagcaagggctattgaaaaaaatcagaaccctccgcttacgctcgcatacatgtagcttaaaatatatgttgcttattgaaagcattgtttaagttgaactcacgagatatactacatcatgtaatatgtctgcatttgtccatgcattcttttcggaaacctgatcttacttatgtctgcatttaacagataggctaggttaagttatgttaaaacatgttgtactgaggttggattcaccgtgtcacagcctggctttcttccttgattagctttaatcaaactctctgcattccgtgaccttaataaagctatttttcctgacaactgaagactgtcttaacaagcatagttcatctgtgctgaaactaaggctgagttaagatggggtttaggtcctcattaaagtccacagcatggagtgtaagaagaaatgatgaaatggtgctccctgaaacatctcttctttaaatttaattagacaaattatacgcaaactagtagatgccctgggaaggcaatcaacattagggctaataaaaagcttgagtagtataaaaaggctgggggaggtgctgtggagcctttctaacgcctatgagaggcaaattaaaaccaattgcgaaacatggaaactggatgaatttcaatattgatttagaaattaattttattatgttgttctaaatataaaaataaaggctatacttattaatcttccagaatttgacatgttaacacctatgcacaaagcattttatggatctttatatgctgggagacacaattatgggctgacttggaagttttggcagacctgggttcaaattctagcaacttcccctactagtttttttgtttgggggggttttttcggtgcacattacttcacctttgtgaaatccaatttcatcatctataaaatgagataaataattctattcctgaagaggctttataagaattttagaaaattaaaatagtaagtatagaacacttggtacaatgcctggcacataataggtgttcagaaataggtaccccatatttagaaggaacttccactgagttaagagtggtttcaagcaaactgtcctataaatatgtgagaattggattatgaatgtaaatattgtgtgcgtaatcttatggatcaagataagtttaagggaaaatgctagcggacagaaacttatagcttttggaagaaaaggtgactcaaacataagaagcaaattatttgaagcccacagtagccaaatggagagagtaggttgaaacatttgttaagtgctgcatgccaaacatcctgtataccttaccatctcatttaatattgataacaactccacaaggtagttattactgacctaattttgcagataaggaaaaaagagattcagaaaggctacgtgaattgcattttagcatagaagagtcaggactggaactcagtgttggcctagttcttgggggtggttggatggcaaactagtgcaggtatgttcataacttgtaagatcaaatttgtcatataaattacggggatatgtaatctctctcccttctggctcttttcatccttgggtgagttctaaataaaactattttgtgttatttttttaaccctcattccattgctttcagactctggttctcaaccttggctgcccatttagaatcacctggagtgggatctgggcgttagcattttttaaagctcctctagtgattccaggtaggcaacctgcactaaagacctctgctttaaaatctctctacctcaggcgtaggtgttttcattgcccatagtattaagcctagcttttagcagagatttgccaaggttgattatgatcctcttgcttgtttggaagaagaaatatggaagctgtgaaatcttttccagttgtgatagatgttgtttatgcattaattagcatgtaaaaattaaacactgtctattcttaatgttagcacattttctttctctctctctctctctcccacctctttttttttttttctattgaaggaggccaaattagatggagtgaagagaaaagtgattatggtaacttttcccttcagagaagtcaagagcaagagtatttttttccaatttcttagtaaaacaaaaaatattttctttccttttttcttttttgtttttgagacatggtctttctctgtcacccatgctggagtacattggtgagataatggctcgctgcagccttgacctcccaggctcaattgatcctcccacctcagcctcctaggtagctgggactacaggcacacgccaccacgtagggctaatttttgtattttttgtaaagatagggtctcaccatgttgcccaggctggttgcaaaccaccagactcaagtgatgctcctgccttagcttcccaaagtattggaattacaggcatgagccactgctctggccaaagttattttcaaaatacagtggttttaccccaccacccttagaggtagaaagaatctttgaccccaccacccttagaggtagaaagaatctttgttgccggacagatttgtggtaaatcctggtttctcactttctgataaagaattagtcattttatttgtttgtttgtttatttatttatttatttatttatttattattgagacaagatcttactctgtttcccaggctggagtgcggtggtacaatctcagctcactgcaacctccgcttcctgggttccagaaatctccctcctcagcctcccaagtagctgggattacaggcatgtgctactgcactcagactaattttttgtatctttagtagagacatggtttcaccatgttggccatgctggtctcgaactcctggcctcaagtcgtccgcccacctcggcctcccaaagtgctactattacgggtgtgagccaccgtgcctggctagaattagtcattttaaattcactggggctgggcgcagtggctcatgcctgtaaccccagcactttgggaggccgaggtaggcagatcacttgaagccaggagatcgagaccagcctggccaacatggtgaaacctcatctctgctaaaaatacaaaaattaactgggtgcctgtaatcccagctacttgggagactgaagcacaagaactgcttgaacccgggaggcggaggttgcagtgagctaagatcacgtcactgcactccagcctgggcaacagagcaagactgtctcaaacaaaacaaaagaacaaaactctctgggcttgatttcttaatctgtaaaacagaaataattcttaacacatttggttactctgaggataaaagtggaggaaaaaacatgcagaggatagtccggaactccccatgtagatcccattattaggtaactgaggtacaagtatcttaggctactggtccgggcaggctttgctgaggggctccgtgcagcttgctggtgcagccgagcaaatgggcctgtagccgactcttaatccaggttggtgctattcaaagagatcatctttcacccgagggatttctgggcatctattttgcggatcagaaagtagagaaagaaggtaactttgccgaaagctagtctggggagttagtagctgatacagatcagcatttcctaactatgagatttcataatattctctcttgtctcgattctgagtcactggtgcctgctgtggtggcattgttcatgaacatgtacagttattgggaagtgatcttgtctttcctcctgccttcaggcactgctacctaaattacaccccgacagatgtattcccattcttctttaaaagactatgtcatgagctgaactattaagttttaaagttgataagcatcaggctaagcatatttttcctgccatctcccacggaggtataacattgttttctatacttagggaatttaccaaaaaaaaaaaaaaaaaaaaaaaagttggtatctgctaatgggtcaaattagcaggatgttttgaaaactcagtggaagaatagctcttcctgcagatgcatgacctggtagaaatccagacattgggctccaccaaactcgaatgatacccaataaatgatgagaggaatatccaaagagttaaatgccatgagaccactcaccccctaaactctaaatccttgtatgaccctgagacaggcaggcagtagggctgcaaggctgagataagtactgaaaattggcccatatacattttgttttaacatagctccttcctttacacttttctgtacccctggcctgaaggctctacagcttgttacatactgatagctaagtaaatgcaatcaacattccatgctactgcctgcagaaaaaccgaaattgtttactgcctccaggatgttggtaaatatctggctgtattttttttttttttggcgggcgggggcggggggaggcaatgggtaggagaaagctagtatacagtgtcccaatttacattataaaatgcaaattttgtactccagaataagaaacaacttagagtagacctgtattgttccaaaactaatgagaaattatcatgttttctatgtgtagaaaagttttctcttcgcaatggctttacatattttctgtagggaaaaattctatttataaaatagcctgggatatggagaactcagtgataaaaggggcaagaacattttcagattgttttaccctgctggaatgtagcatgggaaagctccttccaaaaggctattacctctgggcattctggcacagttggggagtgaattggtaagataaaaatgggacgaaaatccctattttctgttaaatacaaacaggctcagaatggggcatcctgcatttaggattagaaacttcattatacaaaagcagggtggagaaaccctaatttgacagctaacccaagagtgtatggtgaccacaagattaacaggggccagcagtgtgacattgccattcaaaaagctggtgctgtagttgggctgtggtctaaccacagctgggtttttttttttttttttttttttgcccagttttgggcacagaatgctaagaggaacgccaacagaatggagactcgatgccaatgaattgggaaatcatattatgtgacgggcagttgaagaaggcatgtctgtaaaattgaagaagagatttcttagaatgacctcagtaacaagcttaaatatttaagtgtctggtgaaagtaggggtgggatagtctctgatgtgctacaagatcgaagaaggagttaagtccttctctagagcctcaaacccctgctcagcatgaaaaaaacaacagaaacccaagttaacatctccttgcaatatctgatctgtttttccaatacatctgctcatcttgtttcaaaacaagtagctgtcaccattcttaaccctgtcgtccaaaccagaaaccgggcatcatctttgactggtcccctttactcagggggaaaaaaaaccatgtcttttaaagtcagcgcctataatactggtctttggtttatctccaataactcgattgttaacagcccttgaaggggaggcaatactgttaaacttgataatttctaaagagttttgagctatttagcacgaagtgatgccaagaaaaaggaatactaacattactcacagcagagggaaaaattttatatcctttctgaaggccaaggttaagttctgtgtgactcagcacattgactttctatatgaccctaaatcccttctatttcctgatctacttgtcttgacctgtttcatttccacaccaaaatagtttcattaacacagcgatcatgctcaggagatagtggctaactgatgtaattaactgacatgtcaaaggctattggtttattgcatatgcaactgtctttcctggtgggaagatacagtttctgctgacataataggtatgcaaacatgccaaattgcccaataatctgcccccgtgatggtgaggtgtttgcggccattctacttacaggaacagaatggcggatctgttactatgttctcctaaaatgcagctggccaaaggtgctaattggtaaacagttaaaatagaaagaagagaaggcaattcagttttgggccttagtgagttttttttccttttctttccttaaaaaaaaaaaattgtgcttttggcatgctaatgcatgcatttagtctctgcaagaaatttccatttaagaaagaatttaaaaacatgaagtgctcaatccatatctcctaaacaactaaaaagactgcaatttcaaatgagaaattatgttgcaaagaagaaaaaagttgtttattatggctcaaaattttaatcacccaagggctgtaaagttaaaaatagacaattctgccttctgtttatggtaaacttggctgagtcccggcaaatttcaaagctgaacatactgtatgttatttttgcttaattttagattccacattttaaaattatttcttacaagaagcatatttcaggatataaacttagcctgaagaacagtattcttgatttttgcccatattgaaactcctttgaaaatagtaaactatggttttgggattttcctattcccaagagtccaaatgggtacctttctaagtcttttacattatgaatgaacacaggattatgaaattgtaaaggttactttctgctctctaattcctttactcgtaattttagttttcttaacggtataacttgatgcaaatatatacacagtagatactaactttcactgaagtgttttcgggagggaggggcactttacaagatgtgttgcctttagtttttccggtaaggagacaggaagacacagacacaggctcttagggcacatggaaagcgcctgcccctgtgccaagaacttaagagagagccggggatggaccctccttgctgtggctcctgaacagtgcagcctctcttctgatgcactcaccctggcgaggagaaccgcttgtgtggcgactgcttggcccaagagcgagtaggattgttgactcaactctcttcgtgtctcctcagagaggaggaacacctggcttcacctgtttacataactcttgttgattcttgtccctaagctcttccagaatgctcttttgggcttttcctcaaaaggtttttagaagaacaagctttttggggtggcaagaaatttaggatggagatttttgtttttaacctattagtcagcgtggcatcagagaaccacatgtgccccacagtcagtggcatgctcagtaaatatttgttgaatattatttaagtgaatgactgtttgctgaagaacaagatttctctgatgaccttgacaaacgtatgtttgtgattaagttaatcatagctaccacttagaacttcttactcactagacatgtagctgaacacttcatatgtcattctgctttttgtttttttaaagacagggtccctcccactctgtcacccaggctggagtatagtggtgcagtctcagctcattgcaacctctgacccccaggttcaagcagtcctcccacctcagcctcccaggtaactggggctacaggtgtctgccaccacacctggttaatttttgtatttttttgtacagatggggtttcaccatgttgcccaggctggtctagaacttctggactcaagtgatctgcccaccttggcctcccaaagtgctaggattacaggcatgagccactgtgccttgccttcatatgttatttctgatccactaggtttggaacctatcccaggacacctggccatatagagtagctatatcgagtctatattcagcaagtgcagggtaagctctgattccatggtccttccaatatgccataccaccgaggttgagaaaggtggtgttaacagtacccatacgttgacataaggcctctgagaggccaaaggatatgccacagtattctttaaggtgcttaagcccttaatcatgaaatgttttcctaggccacagtaagaatctacttagtttacacacaattctaataaatccggttatctgtttttcaaatacaaagcagattgattcattcagcaaatattttctgaatacctattatgtgccaagtagattgttctagatacagtgaacaaaaaagaatccttgctctgacagaggtgatgttgcagattaatagatcagtggttctcaaaagtgtagttcctggatcagtggcattagcataacatggggacttgttagcagtgcaaatgttggtccccacccccgacttactcagtgagaagctctaggggtggggcctgattttaaacaagccctgtagatgattatgatgtatgtgaaagtgtgagaaccagtattctagaagattttaaacaatttgtgttcctatggcagatagctctctggagaactttgtctcctgattcattcccagactaccgtgtgtgtgtacatgtgagtgttggggtcttaccttataacggcatttagtgattggcaaagctcagatgctgggcctctatggggcagaggcacttggacatttgtacctaaggatgtgggccctggagttacatgtacctgaattcagattcttactttgccaagcacagccacaagaacttgggagagttaggaaaactctctaagccttagtttcttcattgtgcaaatgaggttgacagtaataggaccatacctccatttgtagcatggctacttggtacaaagaaaatgtccagtaactagtaacaattgcttttctctctccaggatccagcacctggcctggcacagggtacatgctcagagaacaagtctttgaaagaatgggtagatgtttattttcctttgtattagccattagctcaaggtctgcagctacttaattccaacctgggtccatttttagcagaagaaaaaagaataatgggactcagcatcaaggcgcacctgacacagagtcctcttggaaatgtgtgacctgcctcagtttagccactgcttttacttcatcctcatcagtcagagtatgacattgccttcccctttacctcttaattttggaatatttcaagtgcctctaaaattttatttaattaaggggcttccaaatctgcttgtagatattttattcttgaaatgcttgtggcattaatagtaaatcagaatcagacctccacctattttgtgccatttcagcactaagccaaggagaaaaattattgaggaaattaatgcttcccttaagcacagtaggaacacgaagctaacatactgccgtataacctgatttcactggtattctttctgaaatttttgtttttctatttctattgcatattggacttcatggctaaaacaaagtgcaattatgaggaggatgttttctcaaaatctgtagggtctggttggtcacataacctttcagaagaaacattatctactggatgacttagatgttattcaccaatagattatcaaggtttatctccagatgttcattaattcactaagtattaattgagtatctactatgtgccaagcatcgtcctaggtgctaaagatatagcagtgaatgaatgggacaaaagtctctgccctcttggtatatacttagttactttctttttcacacatgggcatgtgtgtaggtgtctctggagtaatgcgttatatgcaggtgttgagcctagggtggtgttgggtgcatcatgggcactcacatgttaatttcctgcactgtagatgattgctgattctcagtgatataatccagtcaaaccatttggcgttcttctgctttaaattttattggtgaggtttaactcttcattaatgaacgctgtcacattttctctcttctctgacatgtcctggtgccctgggtttgtggggtcaagtcactgccgatttaattcaactcttctttgtatgactacaagtcctgtgttttagtttcctattgctgctgtaaaaaatcaacatgaacttaatggtttacagtaacacagatctattccctgataggtctggaggtggggagtctcaaatccagtgttactgggctgaaatgaaggtgttccgaggactggttccttctgtaggctccaggggagaacctgttccttgggccttccagcatctagaggctggctcttcactgcatcactgcatttgagctccgcttccttctcctggacctttgaccctcctgcctcccacttaaggagccttccagttgcatcattgggcctgcctgaataatccagggtaatctgtctacctcaagatcttcaacttgatcacagctgcagagtcccttttgttgtattcatgcattctggacattaggatatagacatcttggtggttggtcattgttcggccgatcataccttgtgagaaattccagtgtccctgggctgagctgctaaggagcaggttttattgagcagtctttcccattctatgaaacccaacccaggagaaaacgctctaaaatgcaaatgttgctaacttggcagagcctaattatatgtgcacaactacctaaaattttcttaataattgctctctgttccacaagacttggctcaaaaacccctcctccaaggagccttcctgaattttcctgggcttgtatagtactctgtgtttgtgattctgtgtcacgctctgtgtaagtgactccatgatcaaagctttcctgttgtaattgtgtggatttacttgttgcccactgtccccataccctccacccccacatggtgtgctttctccagaaagggactacttctgctgaccacacagaagacgtgtgtaaagtctgtgtatcaatgaatggattctcatctttcatagttttttttttaaatagttttatgtgtgtttaacttaatttcacttaaaaagatatttaccagaagctgaaagtagggtgtgatgaggttgggttcaggaaggactggtatcacatggcttccctaagttgtatattacattgttaggacacctgacagagctgtggattagtgaatcttacggatggctcttttcagttgaatataattctgaagctctgcaccattcttcccactgtgttgctgttaatctaccataaaccaggtagattctgcatagttggaagtgatggaaatcaaggtgaatgcctgattctttaaatctttttttttttttgagatggcgtcttgctctgttgcccaggctggcatccattggtgcaatcttggttcactgcaacctccgcctcctgagttcaagcaattctcgtgcctcagcctcctgagtagctggaattacaggtgggcaccaccatgcctggctaatttttgtatttttagtagagacgaggtttcaccacgttggccaggttggtctcaaactcctgacctcaagtgatctgcccgcctcggcctcccgaagtgctaggattacaggtgtgagccactgcgcctgacctgaatctttaaattcttaaaatcagttttagtcaccaaagaagatactctgtagcttaataactttgagttactgtaacggaatcaagtcactggtattgagacatttttatttaaaaattttaaattagaatcttactatgtggaaaaatacggtcattgttggaaaatcattttgcctctttttaacagcattcaggcagtttttttttccctttgaaaatagaccttggtctgtgttgttggaaagcatgtaattttcatttgttttttttcacctagtagtgcttaatgataccatgtgaatttttatagtcccagctgcactgaagtgtgtgccctgaaacttcggttggattaagaaaagtagcttggtgtgagggctgaaattggtgaaatgggagaacacagggttgcatctatatatattgcaattaatattgacgagtgggcagaagtccaacattatcctagggggttggctaatgttctttgtacaccaatgcaagtgagtcttttccctccaggtgtgaatagtttaatttagtaggtcgattagtagaagcaaggggtgttttcttgtattccagtttacattatacactcaacattaactagctgtttaaggtacagtgcattgttgagtagttgtggtacaggtatcctgagacgttgctaacccatcttggtatctccagggcctggcatctaatgtagtaggtactcattagcatttgcaacatgaataggagaatgaatgagtggttgttgtggcaaagtctcttaaaaatcctggtccctgcgtacctctgtagccttctcatctccccaccttctagcaataatattctatttgtagcttgttaaatactccacattctttccggcctttggacttttgtacatttcattccctctgactctcacaccaccttccctgtcccctatcccctttgtctggctaattcccgctggttctttatgacttagcaccttctagaagacgttttaggaggcatcatagtgggtattttgttgaaggcctggtttgtttttcatatctctatgataacatatctctttgggtaacaacagagagctgctgactagtggcaccgttgaaagctgcatatctgaagcttcttttcaggagaatgtggatcatttcaggtgcctgcatcatttgcatgtacatcttccaaactctattggtactttccatttagatatgggcagaacatgatgctacagtaactgaaacagaagttaagttagcagcagattctcttccatttatagcatcagtatcagggtaaaatgggaagatgaaggaaaactattgatgaattacctttggtacagctgatactaaagtgggtaaacaggcaaaaagaagttgggaaattgaaccattctctttcttttctttttttcaaaattagagacagggtcttaatttgtcacccaggctggagtgcaatggcacgatcctagctcactacagcctcgaactcctgggcttaagggatcctcctgccccagccgcatgagtagcaagtgcatgccaccatgcctggttaatttctttcttttctttttctttctttctttttttttttttttttggatgagatatgggtctaattatgttgaccaggctggtctcgaactcctggcctcaagcagtcttctcaccctaggcccccagaatgctgggattacaggctttagcaaccacacccagcctgaaccatttcctttctgatttaacttaggaaagtttgctgcatagtaggagctcagctaacatttgctgaggatgaaaaaaataaatgaaccaagtttgttttgtttgcatctttttccttttgctttacaataatatattttttaaaattccctgtcttttctactacacttcttttggccttcatagctctagccccagactatacttagtgcttttgctaagactgactcatcttgtttgattgctttagtgatataagattcttgtatccataggaatggtgtgagactgtatgcctttcatgtttgcaaaaatgtaaaccagaagagccagttattggtaccagtaccaactaattcctcagagctatagggcagtattaaattactaagccagtgtggaaacagcatgatctaatggaaagctaattagcctttgtgtcagatgggtgtgattcaaatcttgtctgtactgctgatgggctgtgtgactttgggcaagtagcttaacttctctgagttcccctgtctctgttttttcatttgtaaaatggagtggaggggacaatattaacttgcaggatggcttgatgatgagaaatgataaatgtcttagtctatattagatcttcagtaaatggtagttgttttgaccactgttactgcaatgagccaaggtggctataagcccttcagtgtttcagtaaggacaagcttacaggtaaccaccaagatcagggcagaacagctgatttaggtctaaacaggttccatcgtgtgtcttcaaaaaggttttcctttttttcctctggagaaaattcagactggtttaagaaggaaactgagagcctcttccctccctatgttctgagtgtttcagagatggccagaaatggatactagttactaagcaagacctttaaaaaatacacgttacaaggcaggttggtatgaaggaaagagcactgacccgtgagttattctcgcggggccaggctctgctccactcagctctgtgttctctgccaagtccctttagatcaatgtgtcgcatgtccccccattgtgagttgagtacattggaccaaaggattatagtttgttttcttcccaggcaagtgcctcctcctgatggggagttagtatgatgtgggtggccccagtaggactgggctggtcttactgttctaagaagtgttagcagaaaaatggctaggcattggagtaaccctgtgatttgacattttggggcatcctttcatggtacgatacacctggccaaaagtctcccagctcagaaattctataactagaaatgctttgaataaatatatactgagaaggtattttggggggaaattttaaaattcttatctgacttggctagagcaactgcttacgacactggacttcttaggggtatcgataatggttgtctttgaatggggagtggatttctcagcttcctgggaacagcaacaaaattcccccaacaaaccccagggtgtctgaagcgcctgctttcttctcaaagagcccgatcgaatactcttctgtgggctcaagagctatcaacagtattgaacagttagactagaaggatgggttgagaacagttgctccctcaaggcttggaaattaacaaagaccatattagtaagaatggggagggaggtgggaggtgaagagaatgagggctgggaggagcaattcggaagtggagagggtgattggaggggtttgtttcccagacagttttcaaagaagagggatttgtgtagtatgccatgggactgaagatgcagtgcaagaccagttgatgttcttcttttaatcaaccaattaatttctctatcatgtttcttttaggctaacgaagtgtcttctttcctttatcatggccattgatagcaagagcttaagggaatcttgcctccctgggctcaggataggctggagagaaggacacacataagaggaaattgacattttgcagtttttgttgttgttgtttgtttgtttgtttttttgagacagtctccactccgttgcccaggctggagtccagtggcacgatctcagctcactgcaacctctgcctcccaggttcaagtgattttcattcctcagcctcccaagtagctgggactacaggcttgcaccaccgtgcctggctaatacagcttttttttttttttcttaattttatcataggtaagggaagacgatccaatgtgcagagaaggctcaggttttcattttagtctgcgggtgattgatttctttctttcaaggggctggttgaggaggtcagagtcttagaaagggagaagaaatcagggaaaaggagaaaagaaggaatgagatttatgaccctctggatcccagattttatgtcgcgtaaccattcccaatactggaagttcatgacaccctgagaaacagccctggaactcagagcagtgatctgcatgcaaaggcaaaattaaatagtccagcaactgctttgaccgagagacacacatagtactattctgggtcctgagtgctgcttccctttcatttctcccctaggcacagattccactggctcacagagtgatgagttagaccacccagggccacttatgttatactgagggcggatgctgatagtgcttatagaggaattatttcaacaatgagacttttccattattctttctgcaatcaccctctatactcagaatgtggaaaccttggcatctctcacttaagaacactgaattcatggtgttgctcagagagtcctgtcctggttccataacactgtgataataactgaagatctttaaaaatgtatgtatcttccatttttattccatatggccccttaggtaacatgacccaatggggccattaaatgaccctgcctacacttggattactcagtacaaagcaaatttatggttgtttattctctcctcctatcagctattagtgcctaatcatatggtctatcgatcatgagattaatcgcctgcccaaagaggcagcaggtcttgtggaatgctgcactgcgccagactgaacttcaaccttttatacaaactggaggagtcaaaatcatcattcactgcctgaaatccttgcaccctgggcctcctgcaccccaggaggtaaatccctgctttttcaaacagtgtactttgcacttcctttccttgtgtaaaactttacctcattgattcaggcaggcacttgtaaataaaatcctttccaaggcatcctataaataatgatctaagctgaaaatatgtgggctttattatacaaagccccatagtgctgccataattaaaggtctgtcagtatttctattataaattctcattttagaagatttatcactgggctattaaagttttctctaagactttccaagagtatcatgatctaaggccttttttttctttctgtggaatgtgttgctttgaagatataaaaaataaagtccagaaacattatcacataggagtacacacatgcagagattggacactttaaaatttgagctctgcctccactaaagtggcttctgtttgcctcttgtgttctcattgcatttatgagaacagagaatcattgtagggctaatactgtattgtaatatttgtttcctggtctgtgtcttttactctgaggagagagagggcagggagttaaatcatttgtctttctggccctggttccaccagagggccttggcaatataagcactgggtttgttcagtaaatgagccccagggtgagagtcaggaaattttcttcctagtcttcatctagtcattaaaggtgaggagtgaattcaggcagtgaatttaggcaagtccctttactttcctgaaaacaagttttctgatcaatgaaacgagtgtgttgagttcagggctagtaaatctgtttttggtgggttgaatactgccggcacagtgttttcaaacacttgaattggaatgtctttagatggaatctgtgccttctagtttgccataatccccactgttccctattatattatgttgtatcagcagcctgcttctatcatttgcctgcagagtctataagcatttatgattccttgtaattattgatcatgtggtcttttgttgctatactaagggtctaaatctgattcaggttagccgttgatgcctttgactgtaactgtaattctctaactttcaacccttttatcatcaaggacctcaactattattttttgttccatatttgaaaacttttggtgttccagacacactgcattggttaataactaattttcccgttgtaaaaacagacacgtgtaactgaacacacaaatgagccatcaacagtatgaatataaaagtgtttgtgcaatgagttggttgacgtttcagctagcttgttcagttgtttcatgggtaagtgtatagtttttgtttgaagttttgatatatgaaaaatagttccgaggtcttctgccttattagacatgtgatagacaaaggattctaggtgagaacttagtttattcttttatgagttgctgaactgccctggtcattagaacatcaagtaagttgtttatccacatgcagttcatgtcttttcagttgtctccttattggtcagcttagagagggctctacaaaacctggcttttacattcagtgagctgaaaagagcttcctatatgagtttacccaaaggcccttgttacattttctccctttagtcaagagtactttggaattttacattttctccctttagtcaagagcactttggaatttgttaaaaggattgggagacaatttgaaaacttggctctccagttaagaagaatcattttttacactttaactcagactgttggtgaatattgtaaattgacaatttaaaaacacacatttgttttattttattttattttttatttatttttgaggtggagtctcacaccgtctcccaggcttgagtgcgtggtgcgatcttggctcactgcaaccaagtgagccttggctcaccgcctcccagattctcctacctcagccttccgagtagctgagattacaggcatgcaccaccatgcccagctaatttctgtatttttagtagagacagggttttgttgtgttgggcaggctggtctcaaactcctgaccttaggtgatccgcccgccttggcctcccaaagtgctgggattataggcatgagccaccacacccggccttattttatttttgagacagggtcttactctgtcacccagactggagtgcagtgacacgatattggctcactgcagccctcgccttctgggctcaagtgatcctcccacctcagcctcctgagtaactgggattacaggcacacgccaccctgcctggctaatttttttgtatttttaatagagatgggttttgccatgttgcccagactggtattgaactcctgggctcaagccatccacctgcctcaccctccccaagcgttgagactacaggcagtgagccactgcatctggccaaacatacatttaaatagagcagatgaaagatctatagtgtagaagtaatctgcatataaaccagtcttaaattgagacgtgacctatgactgttaaagcagtccacatcacacaaaaataaagggcttggaagatagcagcctggtttaaccaggttagatataatttaacaggaagagatagtgtctacattgttgctaaaagcttaggctctggggttcctaatttgggtttaattctgtcttggttacttgttaattctgtcaccttggagtggttccttaaatctccctaggccttggtttcctcatttgtaaaatggggataataatggcttaccgtgtggaataaattagagtaattcatacaaaggatttatcatcatattggttatagaagaaacaatgaatattcatgatcatttttatcaagaatataattgaaatatatttctgagcgttgaggtttttctcttaaagaaaagtgtaaaggtatactttcttaagactgctcatacatgctggatcacccatatacatttccaggaaattgtatgttctagcaattctatgttccaaatgtgctgctttcagttttttcgagaaacaaatgatgtttgactttaaaattctagagttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggtgggtgcctgtagtcccagctactcaggaggctgaggcaggaggatggcgtgaacccgggaagcggagcttgcagtgagccgagattgcgccactgcagtccgcagtccggcctgggcgacagagcgagactccatctcaaaaaaaaaaaaaaaaaatctagagttgaaatttttctcttacatttccttttccctctagatcaatcccaattaaagtttcattgcaaaagtttcacaaactcatattggcattaattattattggtgtgctggtgaaagtcctaaagtgagttcattaagaattaaaaaccttggctgggcgcggtggctcacgcctgtaatcgcagcactttgggaggccgaggtggatggatcacctgaggtcaggagttcgagaccagcctgaccaaacatggtgaaatcccgtcactactaaaaatgcaaaaattagctcggcgttgcgtgcgcctgtagtcccagctactcggaggctgtgacaggagaactgtttgaacccgggaggcggaggttgcagtgagctgagatcatgccattgcgctccagcctgggcgacagagcgagactgtctccaaaataaaaagaattaaaacccttgagaaaactttaaaccctcctggactcatagagctggaggggacctaagaggttatctcctctaagccccattttccagataaggaaagtgtattttccaaggtaaaataagttttcaacagtgaatatccttcataatggctttttaatttgtactgtcactggagtcagccctcatttgccatgttatgattatgttcttcttgtgggacttgtatgtatttattagagaccattgagacgtagcactgggcattacttttgtggcaaaggcaccagggcagtaatcattattaatggatttcattatttgggagagcattttactgactatagagaattcattgcattgatctattgtgccacagttttattataccgggtagtttaaaatgatattctctaaactgttaggctgaaaaattgtccagtgttggcagttatcccatcagtaagacattccttttactaccgaaaatacatagttctgtcgaaagagaccttttgactggtccccagtgccctgactgtgtttaaatccctcactagtgaaataggaggattactactgccatcattgttctaaaacaaacttccttttggaagataacagcagcggtaaatcagatgttgaagaaagtaccagcttaacttcactttgctttaaaagggtttcctctttaattgacaagtgtcatgtataatagggcatggcaactcacatagtaaaccttgtgtggggctgcctgctggggttggagttcttaatgaacatacaagtgaatacactgaggcaaaaaaattaaagctctccaactgtggggtattcattctgttcactgtggccagtgtggtgatcagtactggccacaccagtggccaaagagaactgcattcatcatgtggctgttctatagctgtgagctgtggtgactgttatttttcctagtgatagttttcagtgacagcatagattctggtatcatatccaaggaataaacaaacactgtttttggctttttgtttttttgtttttgacataaaaataataagctatttttggcatatgcagacttttcacaaagtgattgttttcttgagctctggactacttggtaacattcataagttccttcactttgtagctccctctttccttccctccactccctgcaaaagagagcagaactgatttttcagaggtgatgtttacaacagttcaacacactcgaatgagcacttagaataatgtcaatagaggaagaaaaaaaaggacatattattatcaaattaagtaatggatgggcagtgatattttatttattaaagcttgtctgagtaccattggaaacagagtatgttggttctgaagtgcacagattagaaaggaatgttgagtttggaaacgtggcagcctgcagcactgtgtatggtttaaattaaacctttttttggaaagcagaatagctgtaggccacatttaagggaaaagccacagcagagtgagctggctgtggtttttcttttactctgtaaccggcccactttcccttgttttaacacagaaaaagactttggactccttcagaccaaccacatagcttctctgctgaccacaaaaaggaagcttggcgtagaagccataggattaatacccactgtctcttaacccaacagagtgtgaaaactttcataagagatttctctgggcagactgacactgtggttggactttaaacattttaaatcaagcacaactttgaattgcattatgccacagtgctctgtaaattgttatgtgtgatcccactgttaaaagttatttacatgaatccccaggtttcagagggataaaccactaacagctttgtgtatcttataaagaaatacaaagagaattaaaggtatgcctatgacacattatctcagatagagtaggtagatcatagtcagattttattattcttaagcaaatggaggcaattggcttttggcagaaaagccttttcatctttgaaaataataggattaagattgtggattctgttaatcacttgatcagctttattaattaaccacatttttaaattagaaaaaaccctttttactagatgtgcatctttcttaataattttacattgcaggttttatttaatatactgatctactcaggtattataaatggttgtttctatgtcctgcacattaattttaataattggaatcctactaccctgatttactaatcatgcatttgtacaaagcaactctgaaatgaccaaaaataaccacaaaaaaaccttttgtgtttgtatttatatttactcattcagatgcctaggattaatatgttttacaagaaatcatttgaatttacatcttaccatgttgaattaatcagcttttcataagtgcactgtctcagtattctggtttctatttaacagagaatctcaatggaagagattgatttgaaaagttgaaggaaaaatcgtgcatacatgtttcaaaactgtggtcttacagtaaccacagagttaattcttggttgactttatgtcgcgagaggggttgatttgctgtcattagagaaattggtctgtataacacttcctgtatgtgaagaaatgcagttgtcatcatgcctagaccattaaagcagtatttaaatacttccagttgtgaggagccatgcatttattttggttattttcccaggtgtcttaggagcagctgttttgtgctttactgaacttaatagttgaagaatgtgggaaagaaatggtgtactttctgggtaaagtattttagccaccctggagtagttgcattgcatcttgatcttttttcatcttggtagaattatactgtaactaattgaatccattgatcactgtcttgttttttttccatcttcttctccgaggattcatttcataggggtctatacatcagtcaagaaaatagctaccgaggaattaccgagactagtaataaaggtaatttaacctagtttaatattttttttaaaggcaaaacactgtaaacattttttacctggtgagagttaacttcttaattaggccatgttggaaaacaaatcaaaaagacacttactggtagttttcagagagtgagagaaaaaaagaggcaagagaaagcattgatcttggaattagatgacctggtttctaggcctatctaccccaatgcttttcaaacttcaatgtgcatacgaatcaactggggatcttgttaaactgcagagtctgaatcagtatggttgcagtgggcctgagatgctgcatttctgacaagctcgctgagacatccctgctgtagaacctctgaccacaccctgagtagcaagggtctgctttaccacttagctaactttgtggctttgggtatactgtttaacaactctgcatctcagtttcctaatctataaaattgggatattaatctttgttctgcctacctcattgggttgttatgagaataaaattagataatgtagatgctttttttttttttttttttgagatggagtcttgctctgttgcccgggctggagtgcagtggctcgatctcggctcattgcaacctctgcctcccgggctcaagcagttctcctgattcagcctcccaagtaattggaattacaggcgcctgccaccatgcccgactaatttttatatttttagtagagacggggtttcaccatgttggccaggctggtctcaaactcctgacctcaggtgatcctcctgcctcggcctcccaaagtgctgggattacaggcgtgagccaccgcgcccggcctgtagatgtaattttaaagtgtcaaataagcataaggcagcaaggacatttgtttatagatacagacattctttggatacctttcatcaaatcagtgtgggctgttctttaataggaggggcctggaactgtgaggcaggagaagggaactggaatccctgcctccctagtacccattctgtgcctttggccaaatcatctcccctggtcccctgttgcgtcatctttaaaataagggcttgacctaggttagtgctcttaaagggtagttgcaagactagcagcatcagcatcactgggaaacttgctagaaatgcaggttagattcctagccccttccgagacctggtgaatcagaaactctgggaatgcagtccagcaatctgatttctaatgagctcttcaggtgattctgatgcagctaaattttgagaaactttctgaagtgtcatccaactttgaaatgagatatttaagccttctctttataggttcagccaacagagagcctatctgtgtgatctctagacactttcccatctcccaggtagaggaagattggggaattgaaccttctgtgattgtattgcattgagcatgtggtaaggaggactgaacttggacggttaaaacctcacctctctggaactcggaatagattataattgcattgacttacactggtctagcttatccagttttggggctgctttagtagcccacaaacgctgactaatgcagatgactgtacacactgagaaagttctcttccattttagtttcctccttactctcttcctgttccccgaatggttgtcatcatgatatagcaccaagtcacattttatagacttttcaataactttctaaagttgatcacaatctagattatttgcattgttgtgagatgagggaaactgagaaagtaaaatacatgttttgttttgttttgagacagagcctcactctgttgtccaggctggagtgcagtggcacaatctcagctcactgcaacctctgcctcccaggttcaagtgactctcctgcctcagcctcttgagtagcagcgattacaggcactcgccactatgcccagctaatttttgtatttttagtagcgatgggatttcaccatattggccaggctggtctcgaactcctgacctcaagtgatccgtccaccttggcctcccaaagtgctgggattacaggtgtgcaccaccgtgcctggcagtacatgtttttcttaaagtcatttacggttacgtttcctttatctgcagtttttgtttgttagtttgtacatttggaaatacatctgaaaacttaccaagttcaagcgctagagagcacaatctttatgtacagagaagacctcctcgatgaggtctaacaacttctgttctagacacaagtctgatttttcattccagagcagcaaataaagtcatagtggacagctgcttcagtctggaaactagaaacaaacaagaggtgttagctggcagctgaacaatgaagaaagacatggagacactgtccaagaggtcgagatggatagtagcttgagatcctctctttctctctagacatgcgccatgtgcaacacacacacacacacacacacacacacacacacgcagacagtctctgactttcaacggtttgactttatgatgagtttatcaggatgtaactctgtcacaagttgaggagcatgtgtttatgtgtgtatgtgtatccgtatacatttacatttatatatacacacacacacacccctctataatcctgtatacttaaattcctaaatagttgtttgggtgttcactatattggaacgctttaacttgtgttcttaataatatctttaggaaaagattaaagcatgtttctgcatataataatattagtaacaaatgatggaagattttgctccaaaatgagttaatgtagaaaacaggtagtgattaaagtggtgaatgtaagcaattttgtaaatttataaagtcatagacatctgtagttatgaaggacctcatagataattttctccagtggtttcaaatattatttaaataggaatgtttccttcaggaccaaatctgtggagaagctatgtacatgtatttatttttttaagttgaaaagtatgcgagtactggatccatattattaataactttggcccacctgttctttctcccagaagcagccccagttggaatcagcccctagagcgaggagtcacctgggaagcttgttacatgcagattctgattctgtgtgtctgggaaggcacctgagactctgcatttcagataaactcctaatgtgttaaacatgcattggccacattttgagaagcaaggccctgggggaaactgtgcacgtagttcgaaaacctttgatgggttaacttcttcatgtttcaaatgtgaaaagacagagttataaatgatctgccaaaagccacatgcttacctggggtcttgagtcttgggaaggctgtgttcttttacccaaggcctgggtgggatggctgtgtccttaccctttgggctgaaggaggcatcctagtaccagggttccacgggcactatccgtattcttagtttctatcatgatagattatgctgggaacttgttccttttagcccactatctgtcccatggaaaacagtactctgaatcagaccccatggagggtggaacattctgattagccagcaagggcagttaggcccgtagctgtggtgtctgctgccacagcagaatggataagcagttctcagccaccaccccccacaacataatccataaaactctttcaacctttttttttttttttgcatgtctagtgtttgcaaatggaaaatggctgaggaaaaacagagtgaaagtttatataaaatatttataccttaaagatcttttatcttgtgtcattcaagagagaagtgaaaaatgtattgggagtacattatcaagagtacattataaatttaaatctcagattgaataatatcagctgctaatgtgtggagctttggaaatgagtcacttttgaatctcaagaacttaactgtaccaggtcagttacacttaagaaggaagtgccttttgaaaaaagaaaaatcctataccggaataaagacttatactaatgggcattaaagatcaaatacttgacataatattcatgttagaatgtagctacataggaataagttgtaggatctgagacactttatggaatgtttctcaaaaacaatcaaataattttggtcttttctttgtgaagcaatataacctgtggttacgagttatgtgtcttagaaagacttagatttgaattctctgtctgctgcttgttagctgtgccattttggatcagttcttttctttgagactcactttattttaaagcaaagttaatatacctacctaattggttttttttgtaaaggattaaacatcatggtatttgtaaagcattcagcactttgcctagaattttatagttccagtaaatagtagctatttttatcattattgtcaccatgatattgtttttagacctaactagtattgcatcattctttggtgacctggtggtgtgctatggaagcgaaattggtgtgcctgttgaaaaagttagtagtcagaaaaaaagacatacttttataagtgagactgtgactattatgctggacacctgcattctaactagcaaaacagaaaatactttgttggttttaatggtgctttgtttttatactgcatggtatctatttttgtatgctggggtcttaaaatgcttggagcatctagagaggtaactaaaggaatgaagtaggccatagacatagcaacagcccatgtcccattgaaaggccatgagtcccagttgaggccccttggctctagccaattggtgctgtgtgaaaatctgggcccagtgttgtcagttcttttaattttttcctaagaatctggaagtgcagatttttacatgaatcataggatgctttaaataattgcagctgtatcttgagaatgctgttggctgcaagaaagaaaaattttagtttaacagtggtctaaacaaagatttttttttcttacatagcagtgagtccagcagtaatagctagtgtttttatttgctcactaataccaacaagaatttagacactttccatttttctgtcctgacatgcttcatttgttgacttgaaaaaaaaaagtgcttgtcatttatggttgccatatgtatgttgaaggtaggataatgaaggagatacattagactagccttatttattccatttatcaggaaagtgaaaacttttccagaaactacacaggagacatcccttatgatttactggccaaaactgggtcattctggctgcaaggaagcttgggaaaatgtctcaagctttcttttttttgttgttatgtgttttttttgtttgtttgtttgttttttggagatggagtattgctctgtcgcccaggctggagtgcagtggcgtgatctcagctcactgcaagctctgcttcctgggttcacgccattctcctgcctcagcctcccgagtagctgggactacagccgcccgccgccacgcccggctaatttttttgtatttttagtagagatggggtttcaccatgttagccaggatggtctcaatctcctgacctcatgatctgcccacctcagcctcccaaagtgctgggattacaggtgtgagccaccacgtccagccaaatgtctcaagctttctagcctctacagtgggagatggtgaagaagtgggaaatcattgttgcacttactagtgaacagttgctgtctggcacagcagctaactcaacatgaaacccaactgcaggacctgaagaccctgtggcctgcagtatttatcaaaaatcttcagattggggattataaagtgaaggtatcatttgggtggaaaggaggagggtcggagaggcagccagtgctttatttttttgtttaaatggtttcgtattatatatacgataggtcattgctaacaatgtgcaaactgttgagggaacattgtataaatttatttcttggaaaagtttatttagagttttagtggagaagctagagaagaaaataccatttaatgttatttctgtactgctatattacattttaatatatgaattactctattttttaaaaatgatggataaactacacttccctttagttgtttttattctgagataaatgcctgttttgtaaatcattgttacctgattttggtaatctctattagaaagaaatctctttttattaatatctgtatacttaactcagacactgggaaattcttgcaaaatgctttacaaaagcagccattttaagctgattaaaagtatattctatatgcatgtatgtagttgaagtgctaccaaaccacgtatgtatttagttaactaaactcaagaatcatggaagtttgaagaactccaaatcacagctaagaatgcactaaaggaaaaccatatctgtttgactccagcaaattgactcgtgtgatatttttgcttacacctttctgcagcttaactgctgagttagctgttctttaatgtccttgacaaattcaggaagtcatcacatgtagataaattgagaaaaatatttctgccaatttggtcctgatcatttcttcttggggttataaatttgggttttcatgatctagatgttaataaaaaagaaccccagataatctgaagggttactcctcaatattactatgataagtttagggtctgtgagttggctgcctactgagtacctaaaagcatgggaacttttacaacatataatccaatacgtaatcactttgtcaggctgagcaagttagtggaatctttagtaatactacgataattaaatagttaagctataggataaaaggcaaaactgttttattagggaagactatgcttagacagtcttttagaatgattgaaagggtatatagatatgagaaccagtctgctattccaaataatctagttaggattaaaaataaaaattttgtccagatgctgtatgaaaatctactttatagtaggattataattattgctttgttttaataggggactcttagagacaaggaagaaaagagtagggaaacctatttgtataggaaaatatagtacatttccattcaatatctacctataatgtgagagattatgccagacgcattgaaattgctgtctttaatcttcatcccaatcttataaattagcttttgttaccactgtttccttgatgaggatgccaagtccacaccaaatgacttgcctgagatatgtattcattacattttggagttgagctttgaacccagctccgtctgtgttccatactcatttcttttccctgtatcagaagatccacccacactggccaactgagaagaaaaatagcagatgggcttaaatatgggtaaatgtatgataatgtacttagtgaagaaacacctaccaaactacttatagtttatagactcttaggtgttaattttaactcatgaaagaaacctgggagtcataggtttctttcttaaatatgggtaaatatatgataatgtacttagtgaagaaacacctaccaaactacttatagtttatagactcttaggtgttaattttaactcatgaaagaaacctgggagtataggctctctcagcatgattattgtctcttccctacagtcaattcaggagggtttattgaggacctactttgtgtgaggataaatatagtgttcttgtacttaaagaacttacatcttttccttccttctggccgggcgcagtggctcacgcctgtaatcccaacactttgggaggccaaggcgggcggatcacaagttcaggagatcgagaccatcctggctaacacggtgaaaccccatctctactaaaaatacaaaaaattagccgggcgaggtggcacacacctgtaatcccagctactcgggaggctgaggcaggggaatggcatgaacccaggaggtggaggttgcagtgagctgagatcatgccactgcactccagcctgggtgacagagtgagactctgtctaaacaaaaaaagaatttacatattttcccataagacatttcttatgttcccatagtgagaaaaataaccctgtaaaaacctctttaagcaatatctcaatctgtatggcaaggaagatagatgagtgtactcatgtatgatcgtgtactgatttggagtatgttttggaaatgaagactaaaactttcactttaaaataaggttacttttctctaaaggaggcattttctttgtagagtcattatgatattatttcatagctattaaaatttgctatcttgatgcttggttattcactgaaaggaatgaaatatttattaaggtcatattactgttgtgtacaaagggagccacagggtgacttttatgctatgcctttttggtagcggtgtttctgctgggttgcatcaatgtctgtagattttattgattataattaagtcagtctgcattgtctctgagaatttacatggctttaaaaatcaatctctcacatactcattttttgaaataatttgaaaaaggatctcagtagaagggacaaatctacaactattaatcctgttgttatttgtttgagccaaaaatggtgttatttctcattaaaacatttgcaggttttaggtgttatgatccttttagttttcttttaatttcattttctctaccaccaagctttcaaaggcattttacagcttatttttatctctggtagatttctgggtatgcctggcaaaacccctagctcaaatcctgaaggttatttaaattccagtgttggatgctctccacatatatagattttgatgtacacttaataagattaggaagattttatgccagttgataccttgcatgtacatgatggatcagataaaggaccatcagagggctagtgggtctgagctttgattgcaggtagtggggaacattgtcagagctttttttgtgttactttaggtatacatttttaagccaagtttagcacatatatttatgttaacttggggcattaataatcatataagcttgtggaattaacccatacagatatagaaaagcaaagccctaatcaatagtgcaaagaccagttgtgatttttaaaaaccactgcttctgtggaagtgcaagcattgacttatgtttacattatttttctaaagcaactgatttcagtgacacctacttctgcctaaattggctgtctctgcgtgtgcatgtatattaaaggtatatattgagagatatatttgaaaaagttatagtttttgaaataaaaaataccctagtaaattgcccttttatgatggggaatgattaaataaaacagcattatttataacattaactagaattaaatatacagctgggtgagactttgtttgtttggaatttcttaaaggaattagcttcagtttcctaaactagagatatgtgaagattatgaacaccaacatattcttatgaccttgatttttgaaggtgttcaatgaaaaattcttggattatattccttaaaattcaaaatatatttggaatactccaggactatttcatgcttgtaagatggaggttatgtatctcttttctaaggcttgaaaaattaagccctggctatagcaatcttggtgttgtctacaaacccacagctttggtcacagttttttgaaaacttaattatgaatggctgttaaatatttttcatttaccaacttatcagcatttccttttttgcagcaagacttacttcctttgcttatggaaggccctaagtttgtttagaaaacaaagtctgtcttatcataattttgttggtgagaagatgcagctatataaaacaaagaacaaacctgtgaaacttctgctcctcctatcaggctctgtttgtgggaagcctaaatgcataaaatagcaacttgttaaacttagccttgactctgtttaaggggatcttttatttgcaaaatttagtcaattcctccctaaaggaaaaaaagtcattttagtggatcttgaaagcttttagataaatattccaagttttttttcccctgctgctgcaagcttaaaaggcaacatagaaggtctgaagcctggtttttccagctgtgtaacaagcacagaagagaggattctaaatatttactcctttttccttcccactattctgtgttccagtcaaacttgatttcttgctgtttgtttccaggacacttctcaccctgcattctcttagtttgtccccccaaggaatgctcttctttccatcctcacatctctgtccagtagaatcctatttgtcattcaatctgcatttaaaatgctatcagctcttcctgaagactttatggacacccccaaccaaatgtggaaaggggtccacaatttccagtgcaattaccttacctactttttggctggactcagtactctcattctaccttgtgtgttaggtgttcgtgtactcagtaatgttcggtggtcaaccgatatttactaaatgccccttattgtcaaacactgtgttacttactggggaaagcgaacggtttaaaacatggcccatgatgtcagtaacctctttcttgttttttttctccccaacttggttctgaattcccagttggtagaaatggccttataattctttggtgttctctgtgaatcctggcttcttgcacatagtagctgctcaagaaatggtcattgagccatattagttgagtaaaccagttttcttctgattgaatttgaacagcaaagatttttagctttcttctttggtatttaaataaaagtaatgttatttgttctatttgccattatattgtgatttttggtggtacagaaaggaagatttttcccattacccctaccatgtagtcgttgggcatttgttgtttggaaggcatggtaaattagcacaggtcaggcagtcaattttattgagtacctgtaggcactgtgttggcctcctcatctggctatatagagctaccctggagatcctcatgcatagacaactgtctgactgcaacctctggacaccatcagctgtggctttcatcaagttcccaaaggcatccttgaccccagaggttaagtgaatgaatctcacacctgtctccctgaaagatttctaaaatgtcagtggcatttggacaggttcacagctgctctgatccacagcattttctagaacttccttttacctcgatgggggaggaggaatgcctgtgaacttgagctgaccttcaagacgctgtagggctcttgggcaaattatggacaagacctacattgttaggataggcccagaaatccagcttgctaataaatagccttgggaggtgctcacagtcgagtcatagcatttggcatttccctgtactctagcctgtgtaggatttctggatgcttaggactgtaaccaaacttgaactcttgcctgggaatatgccctcccccacacccccagacctttttttgccatctaaatgacaaagataactatcagtaacattttgaactttcctacaaaattgcattcttcgtggtgtatagtaggaagcatttctttaccttggaactttagaagagggtctgaactgagcaaaaattagtgtccctgcctttttaacggctggacacttatcacaaagctgtgccaacatcagtgatggtgcacccacaaaggtgtttggtcttgataagcttctaaagaagcagactttgttgttgttttaaacagtaatgaactgtttcagtttcataaaaaaaaaagagacattctttcttaaatagaaaagggcagaaagtttatagagaataatgtctaacttgctaatgcagtgtttgcctttgctctgtggcatgtgtgtgtgtgtgtgtttatgtaggcatgcctacacggctgcttgtgttaatacttagtataaagccttaaaatggataccagattggctatgtaaccttggaagatttatttacactctcagtttcttttattcccaatcttttatcaaatggtgtttattatattctctgaaaccattaaataaaaaggactgtggaaaaattctaaaatgctaaaattattccaggctaaaaaaagtattacaataggatgatgatgtttaacccatctacttgaaataaaaagccgagcaaatcgaaatgtgatatattttagaaggtatttcttagagaaaaaaatgtttaatgttccttctagactgccattattcattgtatttttattttaaacataattatgaaatattttgaaagtaatcaagtaaatgtggtgacatttttttctctggttgagccaagtgataataacagataactgttatctataatgcatactacgttgactcattaaagcctcatctttgttaaaacattgaatataggatttgagaagaggagaagtttccttatttaggaaaggtttttggtaggtctttcttgaagaaatggagaaaatggcctgctgatctaatctgaggacgaataagagaatcctcctccctgtggctatcattcctatggtgctatacctgtgtgggtgtggatgtgatggtgtgtgcctttgttgggggaaagagagcacagattgtcataaggttgtacccttaattctcatcttctgtacttataggaactgtgtgcttgcctagagacagcagcatttggtccttgaaaaacgggatttcctgtgcaccccttagaaatcctcaggggctgatacaaagagtaatttcaaagagtttaccttaagagctttgtcactgagtgcagagaaaggaatttctgtgatgattccaaacttagagtcagtgctaaggaagaatccatagagctccaaggacttcaacctcaggggagaaaagcagtaatttatggatctttctagaaattacggttgggttctttcccctctcaacccaggcttccttagtcacgtgactggaatttaattatcagtgccataaataatcttgtgaatggaagcagtgtatttggcagtgaatttctgcttcctaaagagaaaggaacctttagaagttatttgaaataattctgtattagccacgatcctggaggcaaatggtcacagaagcagaggatggtatccccagagaaaagtgggttttagatgagtcagataatgtggatatgtgctggtgacgaatgacatgaaggttggatgtattttttaaaatacaaatttaaagcaggctgtatttagaagtttatttataattggttttaggataaagccagcctgttgatgcataacagagttgatcttttggttccattagcacccttgaaatatttaacaagaagctgactttagcatctgagcccttccaaccactgttggagatgaggcagtccatgttggataattcttgttgtaaaacaagcagacacctcctttgtttttccatcttgccccaagccctgtgttctagactagggaaggtcagctctttttatagtcagaggtctgtatgcctttgaaaatatccattcccttacctgtcctcagccagtaacaatttatgtcctgaagatagcaaggagtgctgatttaatttattttacaaacagtgtcctttcatgggagagagcaggctggtaaaattgtttcaagaatcagaacatttttcttggttatttataacataactcgacaatctagctacacagggcttcattcatttgagaaagactattgaatccaaaaataataatcctttatatttgtacagtatttgcagttttataaggaactcttcacgttcattttctcatttgatttttctgacaactccattagggtagagagggcaggtattgttacctccaaattacagatgaggaacctgaaacctgagtgcttgtaagtcctacccagggtttcacagccactcagtgactgggactggagccccctagattttaccctagctcaaaagccagtgctctttccactattccgttttgatacccttggaaagttcactgcttatctaggaaagaaaaattggtagttcttgctgaggaacgtggaaatctgaaggagagacagatctgagagagtcacattggctagtaagtaaaacaggaaaagaccaagggtgtctagggacctggcctcctgccctggttcattcactgtgtgatcatgggcaagtcactgacttctccttgcttgagatttattttcttctcttttcttttcttttcttttttgacagtctcattctgttgcccacgcaggagtgcagtggcgtgatctcggctcactgcagcttccacctcctgggttcaagtgattctcctgcctcagcctcccgagtagctgggattacagacattgcaccactatgccctgctaatttttttgtattttaatagagataaggtttcaccatgttggccaggctagtctcgaactgctggcctcaagtgatccacctgcctcggcctcccaaagtgctgggattatagatgtgagccactgtgcctggccctaattcccctttatgttttctctcacctctctggccagggctctgaagatattcctgggagaatgagggtacatgccacagagggagccttgggtttacagtcagcatagccctgcccatttccagctgcgtaaccaggagaagtggtggcttttctcagcctcagtttattctgtacagctggggtgagggtggtacctaagagaattaagtgaggtaatggatgtagggtccttggcatagtgactggtactcaatatcctctaaataaatattattctgtgttagggaaaagtgaatagagataaatgctaagggtagaggtgacgagagaagtggatggagacaaggatggcttttggatttgactgttttctccactgtaagcactgtttgttatctttcagctttcattttgtctctcatcttttcccccttcagatgtgaggtgtcttgaaggaagagacatttagaaggtgagggcattatgcagatggagaggtcggcggctaaatgtggttactgaagccctgccttgggtctgttcccagccttccttgattttgaaacacatgcgctctcagcaggccagggtagtttgcaaagctgttgtggaggcttttcccaggcagtgttacctgctccgaaagctgcaagcgtgcctacacacacttcacaaagcagatggtttcttttgctttccatgtggtctaaaaatcaaatggacttttaatggaaaggttggggaattccacactcaattatgaatccagtgcagtgcaaggggcagagagatggtataccacaccttttagaagaatttgttactcctggtctcatctggcattggagtggggaggtgagaaagaggaagtaagtaaataaagctgctactctgtgctccaaaactactgagtagctgacatctgccatttgcattgaaaactgagaaagaggagtgtggttttgtttttgattccacaagatgatgtggaagggcaaattgttttggttctatgtgataaactttgagtacctcctgtgtgcctgatactatgatggatacatatgcctagggtaaaaggatgagaagacacagatcatgtctttgagacgtttagcttgagtcacatttgctgagactgaagttgggctttgcatttgaaaagctagcatttttggatgcacttttgatgggacccaacaagagatgatttgtttatttgggaagaatcctggcatgcagtgaggagcacctttgtagctagaacatgcttagattttggtattcttgaaaatgtggcctcctccccaatgccagtgtataggatttaaaaaaaaacaaaaaaacacatctcaaaccttggcatttattgaatattaacaggccaggcaccaaagcattattcagcattgacacttaaacttttctgtattgattattattattattattattattattttttgagacaggatctcactctcttgcccaggctggagtacagtgacataatcttggctcactacaacttgtgcctcccaggctcaagtgattctcttgcctcagtcttttgagtagctgggactacaagctcgcaccaccacacccatctaatttttgtattttttgtagagacgggctttcaccatgttggccaggctgagctcaaactcctggcctcaagggatccacctgccttggcttcccaaagtgctgggattagagtcatgagccacagcgcctggcccttatcatgattttgagtttatgaaaaatgttgtataactatagatgggaaaaactattattgaatgttgttgtcattttctaccattgtaattgttagggtagagtaccaaatggtatttagcaaggtaacaatgccatacctcctccaggtcctcaaaaaaggcagtattaaaaatgaacctacactataggaagccttattctagtaggccagtatttatgcagatgattgttacatttatttattgtcacatgtcatagtctgtgtaagtcagttatttcacaggtaagctacatcttcatgtggttgccttctgcaagtgtctctttccttcttaggtcacagctagctatatagtcagtcacttcctcacttgctcatgcaacaatttttttgacacctactctgtgccacaaactgtaatagtcatgccatcacgaagctcatagtccaggggagaaagaaaagcaaagacaatacagcttgatttgtgatagaattaatgcagagtgccccgggctatctttctgcacgagaccccatcaaagccaagttgcagaggatgagtgggaattgagaggcaaagggttggtgcaggatggagataggaagcatggcatgtgtaaagaaaagcagagaggttggggagaacagggtgtgttccagcagttgtgcctagttctgcccaggccgaagagcaaggcaggagtccgcttaggaaagcctgcagctaactgctgtgtcacctctagtggaaggcttcatggcagctggtgaaagtctcctagcagggccatacttatcttttaccgggtgataattctcccccaccctttttaatttttgccattttttttattataaatgctgtcattttaagttggggcgtaaacgtagtatgcaggaggcaggcatgaattaatgaatagtaaagtcctcttaaattgccttataaaactaagtcctaccaggttcccctttcatctcagcagatgttttacaggatagaaataaaatctattttggttttttagcgtaccagaagataaaacatctggctgagtggattttctcccctctgattgcttacttccacttaaagcttttttcatataaaatttattgatatttttaaaaattctttcttattataaatgagtaatattatcttaagtttagaaaatttggaaaaagaaaaactacatagatgaatactacagttaaccttaatcttactacttgaagaactactataaaatgatagatggatattctttaaaaatttttttttctatgcttgtatacattctttaatatgagcagaatcaaattgcaataaactgatttttaaaaaattcatttattcaagagatacttgggctgggcgcggtggctcatacctgtaatcccagcactttgggaggctgcggcgggcagatcacgaggtcaggagatcgagaccatcctggctaacacagtgaaaccccgtctctactaaaagtacaaaaaaaattagctgggcatggtggcgggcgcctgtagtcccagctactcggcaggctgaggcaggagaatagcgtgaacctgggaggcagagcttgcagtgagccaagatcgcaccactgcactccagcctgggcgacagagcgagactctgtctcaaccaaaaaaaaaaaagagagagatacttgttatgtttccgtgctttatcttcatttttgcttggtaaaacctttcaaatgccctacagggaaatctggcaattgttgggaatatcaaacataggaaagtagaagtaactgtatttccctccttcccacatttgggtctctctatttatgaaaaaacgcaaaagaagcttatccggagatagttcaaagattgctttaaatgtgtcaagttatttcaatctcctatgccttctgtacacatcttcaacaggatttggtgaattcacagtgagagtcataataataatcgtgattttgaaaagtaatagttgtctaacactttcccatttatctagtgatgctatatgcattatcacatttaatgcttaaaacttgagctattgttatccctattctaacaagataatcaaagcatggagaaattaactctgtcttgctaagatcctcagatatgttctgaatcataaaaggttatgttatatttagcacagtgtttatagtaagaatgttttctctattgtgtgtgtgtgtgtgtgtgtgtgtgtgtgtgttggaataccattataatctataagtctctcttgattttcagctagtgtgactcccctttccataactcccacctcaaatttgaaccatcctgaatagagaggagctttaataaaccaactctattattggttctgtaagaccttgacatttgcaaactttattttttgccttttctcccacacagtagccactcttgcaaatcaaccttgggaagttagcattcttaatgaagatctataggagactttatccttagacagtaaatcagctctttcaaggcaccattcatctcccttcgagcgcatgaattggtatatggcaccttacaagagctcatttatcttatgtgggtccctagttattacttttgcccacttcccctagatcgccagagatcaaggcagaaatgaagtagaggatggctttgcactttgaaaatttgccaaggtcagctgaggtacctgtggcattgacttagagctggtgttgagtattacccataacttttagggtgatatcacccacactggcaaataattagtttagtttgtcaaagcatttgaattgtgcttggttaaataaaaatggctagaaggtaaagtaataggggaaaaagtttgttaccttgagaatttttttcctctttaacatttgtccaaatcatattgacatacttttggcttccatattagtgataaggatgaatttttactaagtgcctaggctatatgctaggtgcttttccaaatgccttaaaaaacaattctaccacgatataggagccattatcctcctttcatataggaggagctgatcatcactgatgttaaataacttgctgaaggatatgtgtaaccagataggtggaatcaggattcaatccgtgtatctccagtgtttgcccctgtgactgtggtaaggctgcagccttattggaagtcatccacttgtttaaaaggatgatgcatactctgtgcataatgtttgataacgaattaattgaagtggaatagcatgagcttacagtttgcagtggaccccgaagccaggctttcattgctaaaggagctaatacttgtttctgtggtttgggtttcctcacaagcagactctgaaacaaggttttgagtgcaagtattatagtttatttgggaggtgatcccaggaagtatggtgagggcatatactcaataacggatgccctaatgagcagattatcactgtgagagattgggctccctgcctgtgggcacctccctgacagactgtagaacatgcctcattgtttaactgagaagcaactccttgtctttcactagttgagagttgctcctgagtgcattaagtcccctgccctttcagcctgccccactttgccatgtggacagagaaagccctgaggcagagagactacggtgtttgtgcttcaagttggacagcatgtctgccccagctccaggtgacctccacggagtgtgagcagcatgtggggaggacaccaatagtttctgttacatttgcttttgaagccagcatcagtgctgataaagatgcatccagactgatgcacctggctttgggggtgacaaccttgtataaacaagtgagacaggagaggaggcagtgaagctaggattcctcttaagagaagaaggtaggatttggaatcaggcagtctggggtattgttcctagttctgtacttactagctgtatgctgggcaagtcaatttgttcgagtctcagttttctcagctataaagtggacatagctgcctcacagggatcaaatgcaatgccattcgtaaaagcgtttgtaaatgataaagcgacatgccacctttgagtcattgccattggagctcctgattgaggaatctggtggagtactaggtgctagcagagctttgagggcagctgtttgctttacaagacacacctgaaggctgctatcttggctcaagaagcctgtcctcaaatatcctgacgctttgaaagtcaagggtaagggattcaaaccctatgtaggcccctttctctcatctggtttctggcctactgagagttgctaaccctgctttgcaccaggtgagactgtatttccaatagccccctatcgagtgcagagatgttttggggggtgaaagttgattttgattggatttacaaccccatatatcaagcactagactaaaggtccatcagcctttagaagaagccacagtggttttcatttctttcactctgtttatcttctgaccaaaggctgactcttccacaggcggctgatatcgagtcaatcaggactctttatgcattatgtgaatttggccctcacacagctgagaatggcctgaatagctaagagagcatcctctctgcagcacctcttgactcctcaggacgagtcacactgaaagaggcaggtggatgcccctgattgtgtcccctcccatccagcatcatggccagcactgccattccttcaccccacccaccccagttagcccctggcttgaactccgtcactcaagagggaacattaaaaaccccacacctctgactcatactttgattttgtggcctaaagaggcaaagacgccgtaaggagcttttaggggccatcactatggagcctctttattgcccagcaaaagccttaaatgataatgggaaacctcactattgattggctgactcttaattcttcctctttgggttttgaagtagaagtgatggtccagaatatttatattactcattggatatattaaattaaacatacaaaagtcctacagccatttaagatggggttgcagcactggtgaatacgactttattaccaagagagaagagtagcttttagttgtggcttagctggaatatattgatgataagaatggctcagcagacagaagtcttgggactctcaaaaaggctccaagtgtgctttcttttaaaaaagttatttaggcccatcctttataaacacccaagtagatggtctgatggggtcatggtaacaaagattcagcttctatctaggtggatggtaagacccgctaacatcttggcaaaccgtgttattgggccattaaggaccagtgcttgaattctggggctgaaaattcaacgtattcccttataagaaaatgtctgctcatgataagaagtcacacaaagtacaacctcactatagtacaggatttagaatctttatttctccatctcatcttaaacccattggaagttagcatggattagagggtcggttgactcttctcaatgacggggctggcatataagagctaaaatttttattattgagttactactcaaggttttaaaagattttgacccctggaaaaaaatacagtgcttgaggcagtgaaatagttaatatgactgcctcccttacaggtttccccagatatgcttacttgctgtacaatggataattgttagctcttgttgtgcagatgctgttgcagatggagtcctgtacctgcatgcatagcaaatgaattagactggcaatcccctttataaagcataaatatgtaatttgttcagctgttgtaattaaatatgtatgtgtgaaacagccaccattcaggtcattaatgatgcgccatgccaaattagagcttacagacagtaatgtacattgttgtgcaatgagggaattgcaaataacatggctaagcctttcctagtaaagggatgcattcagcagctttaaaaagaatatttacatttgtaacataatttttatttagaaggtacatttttgttcattgtgaaagtctgtaagatggaattactttcatctccactttagttttattattgttttaacattttatcatacaaatgcaacagactttattaaacatgctgcttggtgataagtgttaagtatctacttacatataaaacagcagttacccctggttttctacatggctgtgatagaactgatgtatcatagcactgtggaatgtcttgataatttcattgcattaaaaaaaccacctcataatatttcaactctattccctactgatacataaagaaattcctgtgatagtaaatagtatttttatttccatagaaattgggctgagaaaaatgcagttatcaaaatataaacaaataaaagtggtaaatgtgcctcttgtgctttaattcccaatgaattacttgtgaatccaaggaatttcctaagaaaagtgtcatatatgggtcagaatggttgctttttaaaatttaagactcaaagtttgttaagtgaatgcacttgggaaaattattgctttgtcctttttctccttggttttaggttacagtctttgaaaatacttgaagctgaaatttaaatatataaaaactatttttactttaaattctttctgtatttgtattttggttgcctgcagtctatttttaacatacatgttgttttgacggttcatactgtgactacatgagctaaccatcttgacctttctgtccaccagggcagcaggaggaagcatcttagagttaattctgtcttgttcacagctgggaacagaacattcctctgtgatccccttgcacatgattcactgggatctcttggaagctggacttgatactataagtcctaggcttctaaggtcgaacacagatcaaacttagtggcatgtttggttaagagttagattagacaaaaccaatgaagttgttaaaagtttcagaaacaattgaaaatgaaattgatgcatgattttagctttgcaacaaattcaactttagaaatatccttaagcctaagattaatcaagattcaggaccttgaagaattttcaaagttagaactgtaatttgtgtagggacgtaaaatctttattttcaacaaacagcaaatgtttccgttaaacaaatgtgtattttatttgaaacagatgaaatcataacagtttggcttgctttacctaagttattgttccataatatcaaaaaaattacttaaaataagttcttctcttcatattccccgaagtttttgtccagttttctgtatagctttttggttcagccaaaaagagacatttcatttgcagcattagggaaaagtttaattattgtttatgaagatagaaatgttatatgaatgacagtgatttaaaaatattattacttatgattgtagtcaaccttttccccgaatattgaaaaccatgaaaaggctttgccctgacagctacatgcttagcattaactatacttgcaagttttccaaaaagatttttttcaagacctgttttcatttacttcctttatcctaattagagatcgtaatcttttgatgggcagcttctcttatttctacctgtttcagtactatagtactggtaaaatggcacagtgtatattttggttcttggagggagacttgggaggatccattactttaaaatattttgttgcagccacctatcagaggtttcttttaatttcttttactgcaggaatttcagagatgcttaaattatagaattatggactacagaattatagaatacctagggatgggaattgggaggtttgtaggaggcgtgcacgtcagaaggtgggagccatgcagaaaggtcacaggtcttatctaggtagtttcaaggagcaaatgcttgttttgcagtagtggtggcagggtggtttggctcattcaagccccttgctctggaggaacaccgataaaccatcaggatgtcttttcgtcttgcgttaactgtggcaaggctgtgcattaaagaacataaccatcactaaaagggtgggaacaccccagcgaccagtggccagtggccaggtgctttatggtaacaccacagacatgcctggccaatcagatgtgatcttttgctggcacttgctcctttggcccccactgcagtaaacactttcccttggatgttggttttctgttgtgtctggcagccacacagggctgcttgaactttagccagaggcaaatatttatacatcagagtgtgcagtgttcaactggtcaggcctgagagggagagggagagacctccgtgccttttagccaaagaggatatgtcctttttttccccttccctttccaccgtgacatggtaaagtgggaccatactggatgtcatttgagcttgctgcatgtgcttctctccaaaacgtacacgtgcgcaaacttgggatgtgctttcaaaagagaggacgtcctgacatttctgcctgctcctttaattcctcttggaaagtttacggttaatattttccctggaacattgtcaagcttttgacagtgcctgagtgtatgccgaactgtgaaattgagccggagaagcaagttgtgagaaatctgtttctactcagatccgtaaggtttatgggggggggaaaaaaaaccaaaaaaaaaaaaaaaaacccaaaaaaacaaaacaaaacaaaaaacaaaaaacttcagaggggaaactgagaatgggactcggcttgcttctcctggtgtgggttcaggccgccattttaaggagccagtgaagggcgacgttccgctccttacatggcggctgtatttactcggccgcagccaatcagccggcagtgccaagccacgtgacatgccacgagggcacgcacagccatttccttgtttctaaaaaacttgctacctccacagagtactttaccttgttttgcatgccaaatgttcttgctgaatgtgtctagcagactggcatttgtccataaagttattttagtaggtaaaaagtctctgagcacttgagctttgtgcattctttatgtaaaatggatttcccttcttggccagaggccaagggtacagcacactcgctgggtgagaagagagcttctctgctgagaaactggtggaccgacacactctaattttttggcttctgaccaaacaagctagaaggatgccaaaattcaacaaaataacacattattgtgtgataggagccgtgctccaagagagcaggaactcagaggaacttcatactggccccttttaaaaaagcattgtcactttggggagctttcttagagaaacgagaggaaaatggtaaaatgcaacctggagagtaaggtataatttgcacatgaacacgaaggaaggaactgaaagaaaacagaggagtttaaagttacttctatgaacttttcccagacataacacacagttctctgacttgacttacattcttttaaccctgaaagttccatctctgtgtctgagcagaatgctggactgcttaacgttaatatgagaactaatgtgagatttaaacacttttaaaaggttttaatgtctaaggatagctgcaaattccaaatatgaaaatttggcaggcttttggggggtaacagaaaactttttaaacttacatgctttatctttgcaccctgacatgtgttaagtgagtcaaatcttcctgttaattactcttgtgacattagcaagttatgtaagcccactatacctgtttccacatatgtataatgaagacgttaaagaagataggtagtagtcttctgagccctaaagaaattgaatttgaataaacaactggaataagtataaaatgcatttctagtttttatgtggaaatttgtcaatcaaaaggaaaaaaaggggaatatctccagttgaagccaccatcatccttacccagactacttgggtaatcctgagtattccctctttttccattcttgttccttcacaccatagccagagtggtatttcaaagaagttagttagtttatatcactcttctgcgtaagaacctccaatgttttcttatgcatctagaataaaatccaaacttgttgcattggcctgcaaagacactgcatgatctgtctggcttctgtatctacctttctaaccccactttttttttttttttttttttaaccgtgactccttagatgctccagccatactggtttcctttcagttttcagaacctgccatcccatttgctacttgtctgcttagaatgcatttttcccagctccttttgtggctggcttattcttacctttcagttctttcagttcgaataatagccctgtaaaagagtgttctgtctaaaattgtccttcctgtttatattttccataatactaataacagtctgaaatgctcttgttaatttatttgattactcattttatttatttatcttttgcactatgatgtcagtcccacaaggatgcaaactacgtttactaccttcttttctaccttttgcacttttcctaatcacattgggaataaaatgttgggcaagttagaatactccaaaatatttcatttaccttaaattttactcaatcctacattttattacctatactcataagaattgtattataaaatacattgttaaacgaatgttttcagtgctccattgagagtcggtggagcacactggttgggagaagacagagctgtgagccatccgtctgcctgtgcttgagtcttggctctgccattgactagttgtatgaactgccgcaggtggttcagccactcagaacctctgtaaaagtgagatgtaaaaacactttctacatcataggattattgtgaagattaaatgtgatatgttgtaaaattctggtcacacaagtattaacttactgttatttttgctgccactgctattaattaatggcagtgtggcggctcagtactaggcaatgggcgtgcaactgtgatgagaaacgcttctgtccattaaatcgttcagtcagtggaagagacatgtatgtaaataggtaagttacctaccatacattgtgccaagacctctcacattatgtgaacagaatattaaagaattataaaagagggagcaattgcctctgttaagtagacagcaaagatgccttataggaagtagcatttgagacagattaagtttctttttaggtaaaaatatgtcccctagagataataataaaataatagcaacggatacctatgtacttcttttactaatgcaccagagtctgttttacatatattctctcatttaatccttacagcaaccttatgaaacagtactgttatcaccttgattttacagagaaggaaagtgagccaaagagaggttatgtggcatgcccaaggtcatataactattaaatgtcagtgctgggatctcgtacattttcactcttaggacatctgtgctatccctgcttagtcactttggcatcccagtggtgctgtacttttgctttcataatacatggaagccctggaaggattcagtaaagagccagtttcaccctgttagcccttgttgctttatttgtaaaatgtcaactgtaaaagtatgcacctaccttatagggtgattatgagaattaaatgagataattcaggtaaagtgcttagcatattgcttggcatatggtaagcatttaacaaatgttccccgtaactactactacgactgctattattattattatgccatattgaaatgagatctgtgatcccttgtgacctgcccgagccccccttctcatgttagcatccatgctggtatatccacttccaaagagaacaagttcccagcagttgaaatggcatcctacccaggttgctagcaccatccctcagctgcttctccaactgccataactgccttagtcatttaaaaattactcttctcgttttatatttcaactcagaaatcgatgcatctgtgaggcagtttgttttcctggggaagtgtaaggagcggtggtggtggcatggagatgcgctccgtttagactcaatattgccacccactccctctgcagtgtcagagaacagtctcagaaagatctgttcctttctttctagactcagtaccacagactggcctatcctctgcaactttgcttagcagcaggagtagagaagtattgattgcccacaacttgcctttaagtcttgtttctgtggtgcaggatttttaaaaagcatttaatgttttccctgccttgaagacttcagaaccgtataaatgccactgtttaaagtcctgtccctgctgaaaaccagggcaggtctcatcacagccccatctccattttccttttgttgaagtgggtctgtgtgagagcgggctgtgccctccttctccacagggtggggaaaaggcagccctgtagtaaggaggttgaatagcctcgctcactttgcctcctgcttgaggtggactccgtgttcccagagatgttgggcctggtttagccagttgttaaactgaagcagggttagcttacccttgaagtgtttttgtttgtttgtttttgttgagacagagtctcgctctgtcacccaggctggagtgtagtggtgcgatctcggctcactgcaccctccgcctcccgggttcaagtgattctcctgcctcagccccggagtaactgggaccacaggtgcgcgcccccacgccagctaatttttgtatttttggtagagatgggatttcgctgtgttggccagcctggtagttttcttacatgaccatctttagatttcagagaaggaagaacatgatcccagaaagcacacagagttacaacatagcaatagcccctccgagctcaacaaaaacatctattgtgtcatgggctgcaaagaaagaggtatgctgggaaccaataacaagatgctaggaatttttttttctgttctattttagcttgaaaaacttgttttccccatatgagttgtgcatttactcttggatcttaaaagaggacaatttattaatctgggtttaaatcctggcccagccacttggatgctgtttgattttaggcaaattatttgactttgtgctattgtgtcgtcatcgacatcatcatcatcgtcatcttttagctgaattctgtgactcttctagggcatttatggtagacagaaatctgttcttgtaatgtagaaatcagtcatttagtgtatctgaaaattcccatcttcaaaaactagggccagatttagtcattcttttactcttaactgttgctaccaggtcatacctaatttgtatttttccaagttacgtatattaaagtcatactaattggtgcctgagcaagttttcagattcctgtttgtccgattccatctgggtcaaattacttaggtacaataagtgcttccttgtctgtaaaataaggatagtagtatccatttaataggcttactgtgaaaatgacacatgatttatataaaaaatggccagtatggtgtctcttaaaaattgtggggcattatgaccagtcaggcaaataagggaccaaggagataactgtaatcaaatcaaagtcctggtatcaggaggtatagtagggtaacgggtcaaggaaaggcatggtcttctgtggcccagagaaagcagtggtcttggcaggtcgtgggctggcaaggtatggaggagacagattcagaagctaagcagacaaggacaaggagccctgaagattagagtgtggagctggggcctgaccttagggcagtgactcttgcccttctgcttctgttctgctctgcttggattgcatatggcttcaggccctggagttacaggtttggagagagtgctctagagtgtggttaaaagtcattggctgggtgcagtggctcacgcctgtaatcccagcactttgggaggccgaggtgggctgatcatgaggtcaggagatcgagactatcctggccaacatggtgaaaccccctctctactaaaatacaaaaaattagctgggcatggtggcgcgcagctgtagtcccagctactcgggaggctgaggcaggggaattgcttgaaactgggaggcggaagttgcagtgagccgagatcgggccactgcactccagcctgggcgacagagcaagactccatctcaaaaaataaaaataaaaaaggctgccataggttgcgtctccagctttcaagtcagtagatctatatcagtaagttcactgctagtgttttactatgcagactcagtttgcctatattaaaaagacttcctgtcttcttacatccgaggagactggctaagcaggagggctaggcgtgttgaatcctagaaactcactgaatacttactgatgaatggactgggtctgggtcacatcttggatctggggaactttagttcacatttacagtcttaggataaggaataatgtcacgtattgcttgttcttcttaccgtgctgtttgattttaataatgatatttagtgaatttaatgaaattaaatgtgatattaaagaataatgatattttaatagcattggttgagtgctgcaatgtggcacacaggtagcgttggaagcctctccatcagttacctcatttaatcctcacactacctctttagagaggtggtactatttccccccatgttttactgaccaggaaattggcaccaggcaggtgacactagaggccacggtcttaatgaccacacaacatggtcttcatcagaatagattccatctccatgatgctttgcactaattaattctttccgcagcagcaccatgaggttggcggttcctttatttgccagctgtttattatttctgtgctaccaacattatgccaggcatggattggagtgtggaatcattcctggaagccaggccatgttcctgagttgtgctgctgtaagaattgggatttaaagttccaaatgtgtggcttccagtattttccttctaaaacagacacacgtcttatcccatttttatggttacatcacaagaatgattcacatttaatcaaacaagtcaggcagaatgatagctaatctatctcagggtttgttgcaaatgttatttacacatattgtgatatacctgattgtgtctaggcatccactgaaacaaacaaacaaattttatgacctgtagttacacagtttctaattagaatatgtgggaaatcagggtccaggaatatgagttgaataacatacattcactctagaccatatttggttaccctggtacttaaaatcttagtcacatgatttagacttcttgcaacaccaacttcttttcttcctttctccatggcagtctttgtatcatttttttctgctgagcaccaaactcttctggcagtttttaaattgaggtttgtagttttaatggtctggtactataaaaagccaactttgtgccaaaatttttccaagaccagacatgggttttgacaccacaataaattaaagataaataaagaaactggcagtgaaaatgaaggatttttttttttttcaagcaagcaagggtagcctatttgtaaatttcaggcatgttttcttagtactttagctcaatgttacaatgcttagctacattaatctgttactgggtaactccagaaagaatgttagaccaaaccattaagagattggcgatttttttcccccttgagcattattgaaatttgacaacattctcatagtctctgctttcttttaaggatttggctatcaaaaatacgggtaagtaaaaggaaccaagagaaactaatgaccaaatgaatagtagtatttaaagtctcaagttgctatgatacaggcttcaccgtgacctgagtggataaatgctaaacgggatttgctttccggagaatctgggtgcctgttccaccaattctgtttgtctctagcctggtttttttttgcctcctccctttcccagcaccatttattttgggttctgagaaacagcttcctcccattacaggcaccaattcaattaggcaggagatagtgctgaaggtttttgtttccatcagcttctgctgtgtagatagtagctctgtttgaaaaactttgagaagttgttgtgatgtgcctctttctgggttccgatcccttctcagcctggtgatgccatggcattcaaatcaatttgtttctcttcccctcccctaccctacatccatcatacaaaatgggggtggttgcactaatcagagatctgcttttttccccccacagatattggtaaattattaaaaaaccataaattttcttctagatgctaagtaactcttaacagtcttctgagtacgtgagtttgggatttggccttgcccttacagagacctgttaacttttcaaacccgtgacttaaaatttactaaaaataacaagttttgttgttgttgttgttttgttttttgtttttttttgacatggagtcttgctctggtgcccaggctggattgcagtggtgcagtctcagctcactgcaacctccacctcccgggttcaggcagttctcctcctcagcctcccgagtagctgggactacaggtgcgtgacaccacacctggctaattttttgtatttctagtagacatgggatttcaccgtgttagccaggatggtttcgatctcctgaccttgtaatccgcccgccttggcctcccaaaattacaggtgtgagccacagtgcaaagtgttgggattataggcatgagccactgcacccggccaaaaaataacaagttttgaagcatattagaaataatccaacaaaaaatttatttttctttagtcttctaaattagcaagttttaggccaccatgtggaactgaacctttttggaggtttaaaatgtcaaaataccttgccaggcgcagtggctcatgcctgtaatcacagcactttgggaggccatggtgggcagatgacaagttcaggagtttgagaccagcctgaccaacatggtgaaaccccatgactactaaaaatacaaaaaaaattagctgagcgtggtggtgggcgcctgtaatcccagctactcaggagacagaggcaggagaatcccctgaactggggaggcggaggttgcagtgagccgagatcgtgccattgcactccagcctgggtgacggagcgagactcttgtctcaaaaaaaaaaagaaaaaaaaagaaatgtcaaagtaaggaaggagttgtgtgtattttcagtcttgacttcatttactgtaagtgccgaagcaccaagtgggaggtggtttgggaagtatttctgatctaaagaggaaactccataaatcacccatggtaatgtgtctcattagcaacactccaagtagatgaccaacattccgaggagatgttgctcattttcatcctgcatcttggcctttgtgcttacctggccctagcttagattttaaaatttaaacatttttgtttctcactcttgaaaactttggtactcagattcttaaactcctctgttaaatagttttcagattagcctagtatagcgttcaaaactggaaaccactgccagaatcctctaatgtgggggaaaacatggctattatcattgaatgtgcctccaaaacctatcaaagttggcagatgtccatgtgtttggcttggaccaatttataaaacgttcacatgcttatgaaaattgttatctctgctattcagaatagttgagtataaaattgagcagaaaagcataataagagaagaagctctgctatgacttgcagtatttttcttttgatcactgaatactacaagaaggatcttttgtttgcgtgtttgtttcaaacttttccatgtatagaggtgtcttaggtgaagtgacaactaatgacatgtggaagtcactctctctggtgttctgtttcttctataactaccctcccttcctgtctaaagagagagggaatagctcctgaattaggtgaaacaaatagtttttaatgtatggtaaaaataagtcattcttcctctgttggcaaaattcattgtaggtgcctttcagtgtagttctgcaaatgttttttccattagttggagtagaaaagagatgaaggattatcagttgtcaggtatattttgcttctaccaaagatgatacataaatatgaaatatttgcagaacaagctgcaaaaccactaggtcctagaaataaaattctgatggttaatgcatttactttataatatgaccactttttccttttaacattttccccagtatgtccttagtgcctttcctggaaataccaaaaggcaaacatcccactttaatagaagtgataattgtagtacacattcttaagagaatgcctccttatgcctacatttttattgagggctttgtctacatacatccagagtcaacttaacttttggacccaattaactgattggcctgatgaatttaattaaaataggggaagtgcttgtacagagaggaacagcattagtataatgtggtggttaagattaacaagattgatttgacttgataattaattaatttgattaacaagataatttagtgtcaggcggagacctaggttcaaatccttactatagatgaccttggttttaaactctttaagtctcattttttccccatccattaagatgtcataaaaacactgaccccagaaggtagtgagaactggggagataagttagggaagtgctcagcacaacacttgggccagtcactgatggacggtagtaccttttgttattttctagtatttttaaagtatgtgttgtctgaaagacaccatgtctcagatcgctgtcagatttctttgagtgaacagagtcacttctttttctgaagacatcagtagtgcaagcatcatgtctttgccttgtattttgttcatctttttgcagttggaacgtttctccttcccttatttatatcaactttaggtcgtgttaactgtccctatattttaaaaaataacattttataatttccatgcaaacttaattaattttcacaaaacccctgtaaggtaggcaaggtagatattaggttatagagataaagaattgtaaaactggaaagaaatatggccttgacttcaccctatcattttgctggtaaagaagcaccatgttcaaggtcctgtatgtaggaactggcaaagataacaaagtagatctgaactcagtgcccttcccactatcccatgctgatcacttttctttttaattaaactgccctgttcctggccttccattgacaggttgcttacagctcttaatttctagggttctcaaaactgtttaatgagtgtgtctggattaaatccagatactctgactatatagagctcttttcattttcaaagatatctaagtaaacacagcatagaattcttcacaagttcctatcaatttccccttttgaaaattatggctcttttctgtagctttctgagacatcaattctgtgaacctttgcttctttctctcaccacctcttgttgtatgttattctgacttcaactgccacattttaagtcatggtaaccaggaatctatactgaaatattttcattaattcttatttattcggcagcatgaacagttgcagggattcttggtgtacatttgtaagttttcctttcctgttgtattttatggaatgttaattttgctcaattgggattcctttgtcaaaactgctgtgatgacagggtcttacggcatcatgaatgtgttcccctattaattaatattatcttagccatataagaaaatgacaggcacatgcagcttgtaagtgaaatgcaacccaaggagccggaagtctttcacctaaaccttaattttgttcaatcgtttgtatttcaaggtctagtctgtaatttattcccataaacaatgttgttctcctgacctttcttgtgtaccctcctctgtctgtatattatcattttccttatttttgtctatattgtgtcactaagagttaagacattttaaaatgtaatttggctacctcatccattttatctgcatttaaattgtgtttgaaaattttacttttgcagatttataaatttttttatccccttacagttttagcctattcaaaggggatacttattttttgtaaatgttttataataaatttaccattttgtgaaaaacagtgaaaatttacatactttttagaaccacaagaaatatctcttttaaaagctactttttaataatgtcattttggaggctagaaattcaatttcactttttattaacttagttcttgtgtgagaaagaaatgtgacgtataaagaaagcagagtaaaatactataaccgttttaaatcagtctggattttcttacagagtaactgaatttttctgtaccatagatttgatctttttagtcagactttgctttatttctctacagatgaattcagaatccactaatgttgtttgcaaagtatattttaaactctgtaattaacatgtttacaagtttttaattttacaaagaaaattaaaagtcagtttgctttgtaggtatgtttgttcttgtcttatgtgtaggtgctttatatgtgttttaaacagagtttaatggtatcttctgagaaaattatagctttagtgtgctactgaaaacctcaagtagggaatcaatacctaaaatttgatttggataagaaatttgtataaactttataaaggatttttgcagggcaaaaatttgcatcctcatgcccaatattctgccttacttagtaaattcctaggtcatggctatggagctcctaattaagttaaagaaatcttcacttgaaccagctaaaagctggtttaagataaatttggaaaatgtctagaattgataatatattttcttttagttttctctgctactcttaagggtacatgtaaatacatttcttagcgtagagcaaatgttgcatgcaatatgactggccagtggcattttatttcaaagatctcatgctaatatataggagactatatattatttttttttgtatcagcatgtttaatttttttaaggttaactgtgtgcaaatgcatatttgctgtccaaactagttaatgggcttacaactgaagggtgtaaattctagtatctgtattctccagcttgaagcagtgttgtctgaagcctgaaacggctgatgttaatcttcagcttattttgttgatatccaaaaattaacttgaagtagaataaaatgtgatgtaaatcgacttctctgcatactcataacagtgtcaatagttaaaaaataaagtctatataggtcacactgtttaaaaccttaaaggagtgtgtgtgtgtgtgtgtgtgtgtgtgtgtgtgtgtgtgtgtgcgcgcgcgcgctgtgtgtgtgtgatgcatatgtatttgtgtttaattaaacagagggaattgctggcttttaatcaagttgatgaattttgaatttccacttcagtgatggctctaccttaaattcatttggctgatgtgatagcagtattcggaatgcaacgaagagataagagtttggaccccatatttataatattccagaagaatttcattatgtaatggctagaaactcagatttcccacagagttgtagagtgtgcagtttggcatgcttatttactactctggttcttttttttttttttttttttttgagacggagtctctctgtgtcacgcaggctggtgtgcagtggcgtgatctcggctcactgcaacctttgcctcctgggttcaagcgattcttctgcctcagcctcctgagtagctgggattacaggcgcctgccaccacatccagcttatttttctatttttagtagagatgggatttcactgagttggccaggctggtttcgaactcctgaccttgcgatccacttacctctgcctcccaaagtgctgggattacaagcgtgagccaccgcacccggccactactctggttcttaatagtgaaagatttatacctcaaaaacactctgtagataaagaaggattcaaatatgattctcttaatattgcatggtttggctaagaaaccttgttattattcaagttactgtgagtcaagggcttgcttagaaacagcagacgtaggcatggcgcggtggctcatgcctgtaatcccagcactttgggaggctgaggcaggcagatcaccaggtcaggagttcaagaccagcctagccaatatagtgaaaccccatctctactaaaaatacaaaaaattagccgggcttggtggtgggtgccagtaattccagctactcgggaggctgaggcaggagaatcgcttgaacccgagaggcggaggttgcagtgagccaagatcgtgccattgcactccagcctgggtgacaagaatgaaactatgcaagaaagaaagaaagagagaaagaagaaagaaagaaagagaaagaacgaacagacatagatagtctattcccacttcaagtagagtaaacaggcaaagtggggcaaggaagagcggatgaaaaagccacaaggcaattcattaacccattttaagacattttcaggcaacttgtgaagcttcaaaggtcaaactgaccaacatttaattcatcacagaaaaaaaattctgggagaagaaaaaagaaaacttgaccttcacggtttaacaagttttcttaaaatgtctttatacaatcttgatagagttctttgctaacatgattcatcttccaatctatgcaaatcagacttttaaatcatacttggttttatataagggcttccttctgattgactttggagcaggtaacacagagctcttgatggcagtgccttgctgtgtgttctgttatggtgacagagagagcaccccctgcaagggtgatttagtgtgaaagtactagggtctttgactgagaagtcaccaaaaatcaatggctgtattgttttgaatgttatctgggcttgcaactgagaataggacctgggggttttactctttttattccttttcattcgttcttcactctctatctgaattgcagtcgtggtcctctggcaggcagcgtctgtatgcgaccggaaggcagtgctgaatagtggggtgatgttggcagagcactttccaggcatgctagcacctagcgcacaagcagagaactttgcttctgccaactgtgacttcagaacccaggtctgttcctgaacctggatgcccagctgtcagtgtgtcgccatatgtcaccagcacatggcaccctaattaaaatttcaaattgcatgcatttgtgtttgctggctggcttgcttaaaaggcagagacctcaccaccccggcttgcccccctccttcatcactctgaagtattatgtttgccatccttaggaatgagttggaaaacggcctttgcccactaaaaaatcatcactctccaattctctcacctcccattttgaaataggaatagtccttattttaagggagaaggagtggtgtgaagaaacgtggctggtacccttcagtagaattctaaagaccagaaatgtggttctcgtgtttccagtggttcatacagatcactcttcaatgctgtcctctctttgtgaatatgtttagctctttttatgtttacatttgaaattttaaaataggattagatggagcattcttggaaaacagtaacaacaaaatttaatgaagtaggtcccttcgtgcaaagcaaaaaagacatactgctggttgaggatatctgttaatagctaccatttattgatcatttacaaaatgctaaggaaaaatgcaagtcgatttacctgtgttgcctcatttgattctcacaccacttctattctgtggcaactgctaacactctcattttagagatgagcataccatggcttatgtagcatttccaatcttatgtaccgtatctcgtgagtagtagacatgaaatttgaactcagatccgtttgacttgagattgtatatactacattgcttccttcctgggaagaaaatggaagttttttctggttccttctaatcgtagcttcatagatatgtggtgtgcttccaagtgtgtatacttttccatgtatgctaagttttggtgatgtattaaaaaaaggttgaatggccaagtacagtggctcatgcctgcaatcccagcactttgggaggccgaggtaggtgggtcacttgaggtcaggagttcgagaccagcctgggcaacacggtgaaatcccatctctactaaaaatacaaaaattagccgggcgtggttgtgcgtgcctgtaatcgcagctactctggaggctgaggcaggagaatcacttgaaaccaggaggcggaggctgcagttagctgaaattgcatcactgcactccagcctgcacgacagagcgagactccaactcacaaaatatatatatgtatatatatatatatatatatatatatatatatatatatatatatatatatatatatgtatgtatgttgagctagaattatgcaattccctattgacccttagtcaccatttgcagtgatgacaaactggggtattttaaatgacagcaggaggcagtgcagtcattagcagcatggactctggagcccagttgctgctttagatctcagctcccctttgactagcgtcatgatcttgtgcaaatcacttgaccgctcagtgcctcagtttcctcatctgtatgggataataatattatgagttaatccatgtaaaacacttagaatcttcctcctggactattgaaagtacccattagaggttagctaaaattaatcaacacatttttagacttcacacagaaaaaaaaagaaattaaggaagattaattgatccattctttagaaaattctgatactaaacactggcctttatatagcatctgattaattaaaatgagtcaccctcttgatttgatctgccagtcaacaattgctgatggagcttctgctataaaatgatgtatacattctccaaaataaaaaacagtatcataaaccttaaaaaggtaccagtcatgttgggtagacaagacatatctacttaggttccacaagtgctctagagttgtttacctattcagtccagtgaattatcacaaccacataattaaatgtgtattcatccccaagtaatgacagaaaagatgaagaaaacctaaacaaaccaaaaaacctccagaaattttaacaatgtgtataatgctaataatatttctaactgtgataatagcagtaatagaaggtagtagtactcatttaagtggcttctgttatggctgtagacaagttatttacacatttagcaaagttatgaaattctgtcatctataatcttttcatgtatgaatgattcctttcttataaaactcccatttattctgtagggttgctgaaacacagcaaagtgtaaaagggaaaacaacgactccctctacgttttattttaaaatagaaaattctgatgggaatctgcaatataagccaagatatgtagtaagatctcacatactttctcagatttggcttttttgttgttgttaccttaagtatcacataccctgatagcgtaaagaatcagtatcttttatcctatctatggaaaatataatgattgttgataattttatgagccattgtactaattttaatcgacacatccgctcctctatagcacacttccttgagataaaactggctaatagtatcaactgacctgttttctgttttttcattgaactttaaaatgtaattctttttctttttctggtgctcaaagagatacatttgtttgagtccttgtgtattttatgtatcacattaagaaaattataaagaacttaaaagcttaaggcaaactttaaaaagtgtcttgtcaggttagatttctctttcctttcaactaaaaaacaaaaaaaaaaaaggaaaaaggaaataagggaaggaggaaggggtgggggccatcaggtggtaaaagcctgtttaatgtaacatcagttgtggagaaaatattaggttcaattacataaggattgtgtgagagggagcaccttgagaagcataatttaattagaatgaatttatgagcgagaggtcctgagctattagacaaagcgaaggcagtggtgtgctctcctttcacgagagcattttaatgagtttccatacaaagtatttcaggtaaaagatttgtagcaagtgtgaatagaaatgtagctccaaataaaaactgtcaaatagctctagtagcaatttctgggctaagagtatttaataaagtatgctgacattgttatttcttgatgattttattgaacaactatcgtgtaagaaaatcttaaaaaaaaaacactcagattccaatgtgttctttaatttgccattaaaaattgaactgcagggctggccttgcttgacttccaatttgggcaggtgttagattgtgacttacataacattgcaaactcatccattgccctgatattccagaaggataggtgccaatggtaacttaagattgagatttcacctttatggcttgcttcctatttctggtaagagggaattaaagcgttatctccctatagtgtaattatggtcataaacttgattagagttctttaaataaaatccaactaggaaaaaggcaggaaaacactgtggtcaattttggggaaggaggatggaatacaggcatgaccttcaccttggtcaaaatatgttccctaagactctgggaagtcttgtatatataagattcatatggcagggtttttaaaaagttgacaggagagtacatccttgtttaaggatttatttgtgtatgatcctcacaaggtacatttttgagatttattgcaaataattctgttaatcctttcctagatattctgacatgccaggtggttaaagaaggatgatacataccaggtctatagaaatatcataaattattacacagtaatataagtatttttgtcatccatgactaacttttaaaatggcaaaattataaatatctgtaaagtctatgcgcagttgttactgattattgtggcaataatacataaagaacatgttttttgttttattttccacccttatgttttatttataaaacaaaaatttatatttgcacaggaggagaattagcaggatgtaaaataaaaatgaaagaccccaatggggagaatattttaaatgtcttgcagggagtggaagaaagctttgcttaaaaatgtcaccatatgctaactatatacagcacttcaagtttatttattgttaaagcctcatgtaaatcacgtcattctgaaaatcatggaaactgcacatttgtgcattaaactatgtaaacaacaaaaactggtcatccgtccaattgttgcttcacttattttgaattatagtgcaattttgtggagggtgaaatggggattacacaatatagcgatttcctgttaacacctacatttttgctgatcaagcaaggtctgttggtgcgagagcttaacctttattttatttccaaatgtgttttttattccgagtcccgttggtgtctatggtttcacttttctccatgagccacatgttaaagcctgccctgactaaatgaaggagtgtaagcagtgggatagacattgcaggcaggcgaaactgggataagccccagaatcttttgaacctatcagtaatattactaacagggagaaagtataaaagtgagcgcttcaagtgctctagtgtacatgtcaaaattaaagcacgagttccacgggatggctcaccaccctcccttatttataaaacagaagtatcttttgagcccgctgtgccctcctcccccttttctatgcctgtttttctgcctgggttgcctggtttttgctctgcttgttgaaaccctgctcatccttcaggctgcctcaaaacttttgtggaagaaggtagggaacacatatctcttcttttgtccagccttccttgattagccttcttcctctcccttctacccattgtacatggtttctgttgccatgtagtggttaaatctggtttacgttgtagttgtttgtgtgtaaggaggtctcctacaccgggccatgttttcttaaacactgggatggtgttttcttagtgcttgtgatgttctttgtaacagtgggtgccctataacttttgtttggactgaattaaagaaaaaaaagaaatcgactttagtaggagccggcctttgagtgataaagatacattgagggaactctgtacatccccaagatcgtggccagttgccaggctccatttggattatgggagagcttaaccccatatttcagggcagatatttaggtgtgtgtatgagctgtagttggtgaatactcatttttgaccaaagaagatactggtttgttttccaggtgttgctgtgacttccgtttctgtaaattccgtgggatgtattttgccaccaactgcctagcagtttatgaaatggtgaactggacgggggcctttctgcatccacattgctctcattaaagtgacccctgctttcctctggccctcttgaagtgtatctagtttagaacttcttattagtctgtggtcttaagatctttgtcatcttaggcataggctcaaaggaattaaacttgggttttgattagtgaacttgagccagttagctggtggactggatgttattcaggcataaacttactcctatgtagtttctagaaggttggcctgggccacagaactttctatagaatatctcatccatgcatctatttggatttagagcatggatgtaaatgaccctaaaggtagtacctaatgtgagatgcagcaggagggacctttatatttttttattttttattttattttttttaagaaacagccttttctatgcaatcctggatggttacgtaagttccattttatttgtatctatattccttataaagacaaagcagcaaaaatgcactaaaattagatttaatttccagctgtgggtatttgtattatgtctgccttagtccaccttctgccccccccacccttgggttgatgtggttactgaagatagtgaggctatctggagattggacattgaccttcactatagaacaaactcaactgttcttatctaccagggatggtgagttgaagacacctgtagtctatgattagtttattgtgtgagcatttttctgacatatgctgagtgatattgaaaacatttaggtagagcttttttctctaaaaacctgctcattcattcactccatgactttttacttggcacccaccattctaggcactgggattgtattctgttggcccaaacatacttcactttgttgagaaggtttagcataggactaggaacatgctagtatacactgatggatttaaagcccattgccaattataaattcattttcactatcaattaggtacttaatggctatcctataaggtaatactattattatctatctccattttacaaatgaggaaactgaagcacaaagaagtggatcagtttatcgaaggccatactgctaggatattttatagaaatgcgttttgaaccgaggttgtcttaattcccaagtctgtactcttaatattatactaagttgcctgagaattttagcaagacttagcctaaatgatgtagagcatctcaatttctgtgcaggtccatttaacagattttcttgattcaagaggtgtttcatcataactcaattgtcttagcagttgtataaaaagctagctctcagagatggggctttctcataggcatagcagtaattatgtcaacatagagaaacttctagaatcgagcaaatctggtgctcctggctgtggcctagcactcggtccagtgtcttcatattaacccatttatgctggaggttgcaattttttgaatttttgcaatcagaccttggcgatgatcttgagcagtaggatataaataacttccacatccttagtgttccaataatggaacactaggcataaatatgttaaaaagtgaaagtaggaagtcagaaagttgtgagactgggcagagttcaaacacttggttatccaacgagacaggaccagagaggtttgttgaattgagcggacgagaacttcaacaggctcacgtttagtccagtcagtgtttcagcactgacacaggttaccatgttttaccttgattcacagtttcacagtagtcagcaaatgccctacactgaggttttactctttttattttgcagccctttttttttttttttttttttttttttttgagacagggtcttgcttgctgtgtcacccatgctggagtgcagtgatgcaatcatggctcactacaccctgacctccctggctcaactgatcctccctcctcagcctcccgagtagctgggaccacaggtgtgcatcaattaacttttttatgcccaactaatgtttttaaaattattttttgtctccctttattgctcaggcttattttgcagacatttttaagacaaaatttttgttatgtaagactttttgttataaaaattgttatataagactttataagacataaaattttgtaatatgaggcttttcctggttgaaaagtgtttcatttttcaatgttttgtatttgtatgaaatcagtctttttgccagcacactgaatcttgtcagattggatgcagagtttctttctgcaacacttttactgtttggtaacaaccttttcttaggaggagaagctacagatactaccttggctgctaacaagttttcagattagaccaatttcacagtgttgactagggaagaaaactgattgaacttccatgggctttagactgaaaccaatgactagcattttatctcttttggatgtgagcatgattagaagtcagtctgaagattttctttcaccagcattgataattcttgtcagtgcgacctcagacacatattgccttcttttctgtgcatcctctgaccagatagaatttcttctattttggatgacatgctgcattttaaagatgcaaggtgtaatctagataaatataaattcattggatgctacctttggaaaagagctgaggattatcttagagctgttcttttcctctttttctttcagaattgttattttctgctcaagattgccctcccaagcctacctcatggcagcacacacacacatacagtcacattcaaacacaccattgtactgttacttgcaaaattttgcatatttgggaccaacatacctgttattctgaagtgctgtcgtatgaaagaataagtaaaggtactgtttatatctttcgatgtatgtctagcactaatgggagttaggggacagatagatgtcaactccatgcaaagaaagtcattatgacaatgaagaaggccaacagtggacttgtggaggagctggggaccctacatctgggagggaatggttctgctgaggtggttcagagattttgtagctgtgatgggttagaaaattagatgagaagattgtcaaaattttgtacaatgtacagaattttgaaacaaaaatttaatgaatggtttggggaataaatggcattttacgttgactgttttatttctctcaaatttagaccctcactgggaaattatttttgagtcataaacaatagacccatttcacatctattcatattttctctctctccatgatttttagatttaaaacaagaccacaagccaactttaaacagttcatctttcttcctttttttattgttttttaacttcatggttttatctcagataatttgctaattctagctacgggtgccttcctcccagctcccccagtgtggtagctgtcattcttaacaaactgggatactcacgagacatctagagttcagttgatgatagtccagagtgtgtgagcagtgcagggaaatctgtagctgtgagcactcatctttgaccacagaagcgctgttcagatgtggccagatggaattcctatgaatctctcttctgtgaagtgggatttttgtggcaccaacagcaaagcgattcatgagtgaaaagccttctctggtgctgccatttccatcactgtttctgcctccttttgcttttgttaggcgtaggccctttatttattcagacaaaagtttttaaaagattagagcatacttccatattaataacatcccatgagttaccattttgagggaaatgtgcacatttgtgtaggggttttgctgaggaaaaggaatgaggagtgaaaggagtctcacccagttggatagtggtatgccttggaaatgcactgaacctttttttttttttttttttttttgatgcagctcttcacagatggataaggtaaggcactgtctgcaatgcgtgaagcactttttaaaaagtgagaactcccagtagacctgtggtgttgcaggagcaggtcaagtgctttctttctttaatatttagctaagagagatcacttaggtgaaccgttccctataactagatcatcctttgctttttcctgttcacattatgattgaactcttgtttttgtacaccagtaaaatcttgcatctgaaaatcttattgcaagcaagtctgcccagttttatcattttttctgccatattccttctgagagcagctagtttggaaaagtatggtccatgccaggcagagtgagctcagaagaggaagggaaatatgtagtgttttaagagcatgaagaggaaaagactactctggtagcttttctatctgtatgtttgttttggcttttagtcttgaaaagactcaaattctctttcccatcctttatttctaaattcaaagggaagcagtttgacatattagaagccctgtctttggagtcaggaagacctgagtttgaaactgtgtgttgtgaccttagacaaactacttaatctttctgagatccagtttgctgtctgtacaataggaataatagaagtctatcataggattgttataagggttaaataagacattgcttatgaaccttatacgtagtggcttgctattattcttgtattaacaaggttgtcctggcatttcttcctactgttaattttcacaaaatatgatatgtcttaagctttattattgaaaataataaagctttaaacttttaataaacatgtctggagtctaagatggaagatgttaaaaagggctcagacgtgattggtttcttgatgattaagtagtgggcagtcaaagatacttgttttatgacacatttaggagaaagtactgaatgaagctcttaacagtaacagcccctttaattaggggaccagagtagaggagtcattcccagcgctgcctgggaggaggatgaatttcctgctgtactggagtagccctgggcaaaggacccaaaagaactgctgtattaaggaaacctggaaactaaaaaacacaagagttttgttttttttttcccctgtcagatattggtcttttgtattccagtggtattaaatggaaatgggttttttcagaggaaaagtaatacttgagagaactccattatctatcagatttatatattttgccttagagaaatgcaacctgttcattgtgtaaaaagccgtcgtgtgtatacagatttgctcttctggaagccatcaatagccagctagggttaaacaggtttcccttcccctaaatggttttgttattatttatttattttgtgttcttttaaaatttatttttccatataatctctgtgagggcagggatcatacagctctcaaggtacacatcacagtatgcagataggcccaaaataaacaaacatctttatttttaaagttttttaattataaaaagtaatacgaggccaggcacagtggctcatacctgatacctgtaatcccagcactttgggaggctgaggcgggtggatcacctgaggtcaggagtttgagaccaatctggccaacatggtgataccccatctctatgaaaaatacaacaacaacaacaacaacaacaacaacaacaaattagccaggaatggtggtgtgtgcctgtagttccagctactcggaagggtgaggcaggagaatcacttgaacccaggagatggaagttacagtaagcagagattgcggccactgcactccagcctgggcaacagagcaagactctgtctcaaaaaaaaaattaaaaagtaatatgggattattatagtttggaaaatacagaaaaatggaagagaagtcaggtacagtttcactgtccaaaaataattaacattaacatcttggtatacttccttccagcctttttctgttagtacagagctttatgctagctatttatgattatgaatacagatatatcctaaaagatcttctcatgctgagcccaggtgttgtaggatagaaactgatggtagccaggcaaagtgtatagacataaaaactgggatgacagaatcacggggaagggtataatacctttgggttccttagctcagggctgtctcatttctgcagcaggcaatgtggttttcctcaagtggaataagattgcaaaaggaaggttggtaagctcaaaagaaatcttcacattgcccctgtgataggtagcaaaggtgatgaaacaacccaattttgctgtgttatggtattcctgttttcagaaaaattaaaaaaacacaaaaaccatttctttgaataaattcaggctttaatgtacttttttcccccagaacatttctcctaagggcttaaattattatcacatatggagaaggagacttaaatatgagaggatgtaagatccttaagcatgtacaaattttcgtggcatctatcacagtcctgaatcctgaaagactattttctgttgagttagatctttccttataaatgctttctgggatggcccatgcatctctgacagttctcatgctgagtcataccttgttctgttaaatttatccattattggacaaagactggaagaatggatatgacattgggaagtgtgcaagacttccacagatcacttgtagagagggatgatttcattgtaatcctacctcactggacacctcaaacctgccagtctcatctgtaaagtgagcatttttatcccctttccttggctctcttggctccatctacaggcaacactcaggtggacttctttactgaagagaagagcgtaatattcttctagtttgcctagctctttggcatttagaaaactagagaaatgcataaatttagcaaaggatcagggccaatgtgatggctgaactggcatcatttcacatttttcatgctctgtatttatagcaataaatttcaagtaagaaaatagattgcaaggagtatgctgtattaggaaggaagtttgtacactttcgtggcttatgggtatcttagtataaccttttctggttgagtgaactgtgtcatttcaaaagcctgaagacattgtgatgactgctgcctccataatggctacattctaggggctttgccctgaatcgcatatattaactcaaaaaacaaacagtacccagtttttattgggaaaattacagtaccagaagttatgtttctcagtcattgagaccttatgaagccttaataatatttagaagattctggttccttgtcttccttttttgagtcagcagttggtcacagttcagaaatgaattacaaattacaatttattagtaatgataatatttaagtagtaatgatgatgataaatagtaacagcttattttttaaaaagataccaagctaaatgctttcatggattatctcatttaattgtctcaacaaccttttaagtcttatatttttatcattgccgttttatagatgaagaaagtcaattttcagagaacttaaataacttctcatagatgtctagagcaaataagagacaccaggaaatattacacccaattaaacatgttttctcccacatattccgtcaattagagacttgtagagaagggtgctatttttcttttcatttttatttttttcgagacaaagtctggctctgtcacccaggctggagttcagtggtgcagtcttggctcactgcaacctctgcctcatgggctcgagccatccttgcacctcagcccccaagtagctgggactacaggcatgcaccaccacacctggataatttttgtattttttgtagacactgggttttgccatgttgcccaggctggtctcgaacttgtgaactcaaaccatctgcccgcctggcctcccaaagtgctgggattggttgctatttttcaaatgtgagaaaactcctttagaagttttagtcttcatgagtcttatgcgcttagggtgtggatttaaattagcaaattgggttgttggatttgtagttgcagcagaaaggggttgtttgtggatttttaagtaggggtgatagcataggggcctgcttttaaaagagggataagcaagcaaggaactttcagtgcttaagggcacaggtggggcagaacatcaaagacagattccatctgtgctaacatttcacctttactccactgaaaattttctaagatgtcacctttgagacacactaaagcttatttttctagacaattaacaaataaattacatttactccaaggacagtgtaatattaatctataaggatattttagattttagaaagcatgagttttgaattctagtttattatgcagtatggtctgtgagccatgaattgtcttcatctttatgtccagcagataatgtggtaaggacttcttaaagctttttgaataattgaattaatgaataaaatttataaagttttctatcatctactaaacatctgcttgtgaattttaaagaagctcattttctataacattaaaaagaggctgtaaaacatcgtttttactaacaatttcattttatacattgcagttgtccttattgataaaagagaactttgtggtttgatgcataaaagaaaatttactattcagtatagttgggactgtatcttcaggcacagacactgcattcagacctgcagacccccaccctgctcagtgtctgggttgcagcccagactgaggttgagccagaggaagaaggaggccgtgtggttaaaccacttgtggataatcgaaagtagaccatacttattttcaatttggcagctgcattagttttttactaaagtgtgcagctttgcctggttctgctaatgttgccttcacactgtggcctggtcaccattagtggtctggcagagatatctgaggaggctcaccattgctcctcttgactgttccactgcccatcccagtattttccctgacttttcctatgttctgtggtatcaggcagttggatcaattgcagtgactgcatcgaaagaaaaagacaaaaatcgggaaagtataaccccgagggcaacaataatgaaattttaaatttaaagtgacccaagtttgatgtacaggatatgaaaatgctgtggttcctccagtggtttcatatactttgattcagacccttagaagttcctggtgggcagttgacaattgagtatcagtcttgatgctccagatttgaataccatttcagttggaggcatggtgcgcctgatatagatgacgtgtgaatgtttcaatgtcaacaggagatgcgggttgtgaagatatgtgttcacatgaaacagactgcaagtctaagtctccaaggatgagctgatatatgtaaccctgttcatgatgggcctgtgtttttttcattttctgttttcctctctggcagatgatagatcatttaaatctgtactggcacatggacgtggtttcccaccccaactgaacttgagttagaagaacctcagctctgtagtgatcttattttactgttttcccaggataaaatgcccttggtaccacatactgtatgcagagtatttatgattgcttgagtacagttccttggaaaggacacaaggggtttcataaagcggtactaaaaatctgcttttctccctagcatttaccaacaaccttgcgatccgatggcttgaaataatggtcagagtgcatgttacccaacttctcctggctgctcctactctgtcacactgcacacagatcatgcccgccaccaccctacactccccgacctcacccaccagtcagacagtttaagtcctgctgacgcaccaggcgtgtgttggctcgtggttgtacttttcatgagtagcagggaagatacactccaggaaggtgggatacaaattattgaactgtgtgacttaaaagctccagtgagtttcgtcggaagtataggagtttgaaagtgctccccagtcaaacccagaactacatagggtcagccgtggttgagctaatttctgcttacacatgtgtggagggtgtcattttctgactacgcctaggcctgagtggacagccgattaaaagatgtaaattcgtggattgtatcaaggagagcgggttccatctttgtggtcaggagggggcccactcttttgttccgcaaagggtttatctggatgttccttgctggaagttgcttttccagtttggatcaaaccacttaagtggagctccagcctcagtccttgcaataaaaaaaaaaaagtcctggaaagccagaattttgctaatatcttacatagaatctcaatgatgggaattgggagtagaaggcagagagtggtgcttggctgatggaagttaaaagttgggttaataataaactacatttatatatcagttaacagcttgctaagtgcccacatattatttgagcttcatacttgcttgctgagaaagaatggctattattatcattatcatcattaccactttccattttatagataacaaaactgaggctctgagaatttaaagagattttccccaaatcattaaacggtgacttctgaatctggatatatgacaagacctctgtccccagtccccttgctttcacctctataatatatagtagctaagctcagctttctgagaacttccctgtcttatgtcatatttgacattataggagaattgaagatgttttgtaagtacatactttgtttactacctcagtagccagtataacaaatggcactgaagttttatgctttgcttgctaaaaccagcaccatttgtgaaacaggtcttggctccgagttacccttaaatgtaactcctttattataaaatcatttgcaaagagctgcagagatcaaggaatacactcttcccacttccctaatgccaggtagtactatgacaggacttcatagtaccacttcttcaacaaaataagtgtctgcagtgaaatatttgttaaaatgcacatttctcagtgaatatatttcttttaaaactgaaaaaaatagtacctaacggaaattttatcattgctttaaaatgtattttaatgaagatattaaaaaatacctttgatggattcttcaatattgtcgaactgctcaaaatgattatactgttatatgaagtctaaaatctttcatgcaacttacaagaatatttttgttgtatgcaacacagttggaaaattctagtgggaccatgtccatgcaattactgattatgtaatgctgtaaatttttgataagcatgttccaagttttcctgttctaaaaacaaaaacattaaaatcacccactgttgaagacaaaagatcattactttattaggagatattattagatatgtttagaactagttaaaaaaaaaaagtaaaagactggttaaaaaattaaattaactccaccaataaaaattcagttccttctgtagctgattaatgtaaggttctttccactgatgaccactgaatagaaaaaactaaagtaaatttcatcatcattgtagaagtgtaacttattcaagtaaatgagataagccaattttatatctatcaagctataattaaataaggatgatactatttgacttataaatgacctctgttttatatttcctgtggaaatcagctaactacaaaggaattgtttattaacttacttcactaacatgatgaacagaagtatttcaggactcatttgccccttttttatgtgactcagcgtcagattctgccctttgctcttctgaggtcagtctgacccagtcaggtaaaatgaacagcacatgaaagtttagcgcatgcggtcagcattcacgtaccttgctttggttaaataaattcttgaaatgcttgatggcttatttgccatgaacttgataattccccaaattgctgatgttaccaggtgcaaggacaaatattgatggctatgaaccttgcatggtgctgatgcactgtgatagtcatatcttgttgtaaaccatgttgtagtgacatagttccagttcatttacccattccctgtatcagagagtttgggccattgttgaacatcgctgagttcagttcatggtgctgggtagttcacatttctggaagggctgtaaggtttgcataatcgtccagtgctatcatcatatcatctttgcctggaagatgcatctgcatagcttcagtagtttttaatgtcttgggatgcccaacccagtactgtgggtttcaatttttatctgtcatcgccacaaacccctaaattaaaaaaaaaacatgaagaatattcaggtgactataaacatttcaaagaaggcctctacttcttgctctgggtaaaaggtagatgcagtctcatggtggaacatgagagttatctcagttggctcttgaaatgagaatgtttcactgtttcagctgaactgaatagtcactttagtttttaaaaacctgctcaattcaacaaaacatgattgattgctcaggtaaattaattgcctctgagacacatgtttgaaatagatatctatactctctctgatactagtgtgtagcaataacttttactgtcctattttgtttaactgtctgtgtatgtatgctctaaaaaggggattgaggctggaagcagtggcttacgcctgtaatcccagcactttgggaggccgaggcaggcagatcacttaaagtcaggagttcgagaccagtctgaccaaaatggtggaaccccgtctatactaaaactacaaaaattggctgggcgtggtggtgggtgcctgtaatcccagctacccgggaggctgaggcaggagaatcgcttgaacctgggaggcaaaggttacagtgaaccaagatcacgccattgcactccagcctgggtgacagaatgagacttcatctctaaattaattaattaattaattaataaaaaggacattgattaaacttttttttttcttttttcttttttttttttgagatggagtttcactctgtcacccaggctagagtgcagtggcgcagtcttggctcactgcaacctccgcctcctgggttcaagcgattcttctgcctcagccttctgagtagctgggactgccggcacatgccaccacaccttgctaatttttttttttttgttttgtatttttagtagagacggggtttcaccacattggtcaggctggtcttgaactcctgatctcgtgatccacccaccttggcctcccaaagtgctgggattacaggtgtgagccaccctgcctggccgattaaacttttcaatagctatatctactgtatggactctattaatgtacataattatgcccagaagagaactatatgtcattattaaatttatggttagaatagttgatctatacttttttctccttagcattcctttagctgtgcttccagagctgctcagaaacatgagttttgcttaataatccatagcagagctgaagtcaagaggggaaggacccacaggacttcagctggatctggttgggaaaagctcaagattgggaaatggaactttggtaggcacatgtcagtatgaaacatttgcctcacagccccatacatgattaacctttactttgcaggggaaaggctcacagtcttactgcagaatgagaataaacctcatttcagtggtttataaactcttaaatgtaacagaatataggcctaaaattagacattgtattcagtctgagctctgccacttaagaattctgggactttgggcaggctgcttattatccactaacctcaatttcttcagctcctaaaagggcagttgtcatacctatattatggcactgttttgaagaagaaatgaggtaatgcctaaaagtgtttaacatagtcactggcacagagaagatacttaataaatgttgatttccttcttgttcagcaaaaccttaaggcagaaagctcctaaggcatgattatatatttcattctttcagtagcatttgccaaacatttttaccatattgttgctaagtaggtaaaacagaaagacacatatctaaatatgcagagacatattttgtaatggaggtaccactctgtttttgtaaggcgttgctgattctcacttcgcttctgcatctctgaatatgttacaattgtaagagatgtttgaagctttggggatcttctaatggaaatgggggttcttcaccgaatgttcatgtaccgacttcaagaggtcaaagaatcacgaattgatatacaaagtggtgtatgttggagtatagtcgtcgcttggtatctgcaggggattcgttcccagacattcccacagatgataaaatccacggatgctcaagttcctcacagtcagtccttcatgccagtgggttctgtatccatggattcaatcaaccacgaattgaaaataccgtcatcacgtaaaacttgtaacatacattctaggaaaaagaagaaaataaaatcaccttgggaaaataatccttaaaattttactatgtagggatttattcttccaaacatatatatgtatttttgaaatcctttaaaaaataatgctgtatcacaagcacctttccctattatgtattcttctacagaatcatttcagtgggcgtatagtatttcatgttattgatggatcatttgtgaaaccaattctgtgatggtcactgagtttgtttgcaagtttttattattataattaatgtggcaattaagatctatattgctcaaacatgactgtgtacttatagatcatctttgtaaaaaagcagcattaacttgtgtttttaaaacatttttaaacaaaactaagtgataagaaattgatcaactcagccaggcgtggtggctcacgcctataatcccaacactttgggaggccgaggcgggcatatcacctgaggtcaggagttcaagaccagtctggccaatatggagaaaccccgtctctactaaaaatacaaaaagtagctgggtgtagtggcgggcacctataatcccagttactcgagaggctgaggcaggagaatcacttgaacccacagggcagaggttgcagtaagctgagatcaggtcactgatctccagcctaggtgaaaaagcgaaactcagtctcaaaaaaaaaaaaacctctaccctttattattgcttgcatactttgtaaaagaattttttccaaccactagcctcaattatttctaaactatttttaaacatttattagatatatggatttggcatatataaggagtctagttaggcttaaaactatctaaggaactaccaactatctaacatttaaataatagaacaaagaagccgggtgcggtggctcacacctgtaatcccaacactttaggaggctgaggcaggcggatcacgaggtcaggatatcgagaccctcctggctaacacggtgaaactccgtctctactaaaaatacaaaaaattagccgggcgtggtggcgggcgcctgtaatctcagctatttgggaggctgaggcaggagaatggcgtgaacgcgggaggcggagcttgcagtgagccgagatcgcgccattgccctccatcctgggtgacagagcgagactccgtctcaaaaaaaaaaaaagaaaaaaggcgggcggatcacgaggtcaaaagatcaagaccatcctggctaacatggtgaaaccctgtctctactaagcatagaaaaattagtggggcgcagtggcccacgccttagtcccagctactcaggaggctgaggcaggagaatcacttggacccgggaggcagaggttgcagtgagctgaaatcgcgccactgcactccagcctggagacagaacgagactccgtctcaaaataaataaataaataaataaataaataacgcataatagcttctatttgggggtggcaggtaaactatggcatgtcaggtcccatcggcattttccgccaatgatagggaggcatgttttatgcccctgtctttctgttgatgagaaaggagcaagtgaagaactccttgggtcttaaggaacaaggactagaaaccccacaatattagtgtttctgttttttgtaatgatctgtcacctcctgtttgttttcaaaacccatgagattttaactctgcatgtgtgtgtacatgtgtgtttcttccctgttcatattgcctccctatccatcagagaatatcttaaatgccactgggatacttgatgccatcccctccatttgtgggtttgtgggctagtccagcaacaggctttggagaagttactcgctactttattataacatacttaaactcaatagcaattcaggccttactgggtatttacctaatttattgtggcaatgcggtatttagaccactgattaagtgaagtttgtcagtatagttaaaagaaattagagacactatcattgctaaatcactttacaattcaaagaagaattgtaaacatatgaatccatttaattataatagtgccaattataagagaaattgtaacgctgggaacagtggcttttatgtaatcataataatggcatgtatttatcttggtttggcaagttaggcctttctttaatacttggctttgcctaaatagaatgtggtttgctgaaacccacaataacccccacaccctccaatttgttattgcagaaaatactgaacaataatcatgcggtatgaatgattaatgtatgcatgggttagtaagtatatttgaggtttaaaaagtgtttttatttacattcttctgttggctgaaggtataaaacaaataaatataaatccacatgttaaatattctcatccctttccatacagatacttgcagtgtgaatacaatcatagctttaattcattgtttctgtgcttttttggtttactcaacacgtgtcttttaaatatatttcaactgtagtatttgatagtaatccattttttaatttactaagtactttgaatatagcttccccaaaacatagaaataatcaatttaataatatctgaagattggcaaacttcatttataatgttgtgttcaaataatactatcagaataacagttgtttgaagagtgtatgtataaaaattacattctctatttaataagattactattattattgaggaagaggtgctatctagtggtataaacaaaattattatggaattgaaacatttctacactttggtgtcagggttttcatttatttctgtttcctgcttccagaaagataatttgcagcagtttcacactgtgtattagtagatgtggaaggaaatcctactttgctgagaaaagaaggaaggaatttaagtttaaaagggatctgacaaaaacttatttaaaaatttttattttaagaataaatagaccttccatagacacttagcatttattgtaaaagctgtattttatagagaacagtagaaatccaaatcgttgatagttttgcaagacatagccaaaaagtgaagataaatggtggattttaaaaattggcatcctgaaagagttaatatttttattagttgaaatttgatataaaattgtgggcaacccatgacatggtttggagtacttgattattcttttctcaataaataagagtggcgtacagttaatttcagcactgtaattgagcaatgcattctgggaagttaaaaagcactgtaagatgaggaaatgttttagggactaatcatgagaagaaaggagcctttcatagcccgtatgatgctgttgtcagagctaaaggcagataatgattcggtaataatggcacattgtgaatatttaagctgaaaagatttgggcaaaatgaacagacattgttggtttgttaaaactgagcgtttggtctttgggcttcaaaagcactctgaactctgtacaacatttttgttcacaaattttctctaaaacaagatacttttaaaataagttatgttaaacactatcactatatgaagttttaaagtgatctacgtgttttaagttttactgtagaaatggatagtgtgggctctttgttatggagaagtttaaaaagttttacggttttcttacacatattttaaatttagttggcagaagcaacacctttaaagaatattctcatagcaatgatgtaaaatattaaatctaagtccaagagtatccagttgcaaagaaagtcaagtaatttgcattatgtttctaaggtttccgttataccgtttagagtcttgcagttgggtttctatgtaccttgccttttctcctcattagcatattttcaacctgtttgttttcattcttgaatcatctgttacatgcagatgtattcagctctagtttcccattttggggtgaatgttaccaggagtttaaaggttgagtccttatagtctttctttaacttaggaaaagaagagaattgagccctgagagctgagaggtatagtttcaaacttactaactttaatgatgggtatttagagtcagtaccacatctggtaaaaagctagattctgttttgctaaagtataggtaaaacactgttatgctgaaataatgctttatagaactttaaaaatgtgattcaattagaatactcctttagagtaggttttaagacagaattcaaccttcatatatgtaagatatgtatatctccagtgagctctcatttattatatatatgctacagtgacataaataattccaagtctggtatttcctttataaatatacttttcatgtgcagttttatacaaagactgaaatgaaacagatttctgaggctatacaaatgttttttcttgaggaagaaatgattacttattaaaatggcttcacaatttaaaccaaaataacttttttttgtttctgctctgaaatttttttgaagggaaaaaatgttgccgaatgtttacactaacattcatttttacccatatgctttaaatctgtgtatttgtttaaccaaatattgtttatttttagaactgtttaatctttctttttaactggaattttttaacagcagttctttgaaaattaaattgaataaaatttcactatttaaagaacattttctttaggagttttaaccaagaagtaaatcatttattaccattaggtgagactactctttggccaggaaatagagaccagaagcaaaaataaaatagagcaaatgtttaccaggaaaatgtgttgtaatccaagcatattcttgtgtcatttttttaaaaaaagtagctttaatgaaaggtgtcacatgcagctatgagtagaagaacctttccctgtactttgcaaggagacaaaatatggattttgatggacctgtacaaacttacagtttttcaggtttcataaagggaattgagaatataaaatgagactacttggaaactccacaaattttaacttatttttagaatataagataaacatttcaaattatattttaaaaattttatgatcacttgttgactttctctgagattccacgattccagaattgtttttttgtaaatattttgtctgaatgtggaattctcatttgataataaacagtaattttatttagaatgatagctatcctccacctcttctctgtatttctatttattaaaatttacattttctaattggacaactctgtgaccaaaatctagatcattagggtgctaaattctattaacaaatactttgaggttttctgaggatatcaactaaaacttcatctcagaaaccttctagaaaaattaaattttgttttaaataattaaaacccatattcagaaaccagcctgtttgaaaactgacctctctatttacatattaccagagggttcttgcctaatatgaagaaaaaagcttgtgttagagttgggttttatttggaggtggggaggacttttaatgctgataagatagaattttacttattgagatacatacagtaaggtcagttagacactgtgtttaaaatagggaaattattacttagtttttaatattagtttaatatttaaaaattagttttaaaaatatatttaaaattagtttattgtcttgaacttaacttttcaatttaattttaaacaagtttacttaagtctaacttttaaaagctcaagttaatattagccaaaatatacttcttaatgcttatctcttatgctccatagaaaaaagtgtgcttttttggtgaattaagatttaaatatgtatgcatactgttgtctctcttggagagagtcatgacgcacattaatatattagagggtctgagaactttgtttaaactagcagtagccaaatttatttgtcagtggaatccttttttcatgcaacccccattaacctcccaaaacacactttgagaaattatgcccttagccttttctctgcttttgagtgaagaaacttattctgattcagtcctgttggtgtaaaaatcatcttcctgctgacccttctgtttatctgaagcccttaaaaattaataacgctctagtctccatttggtaccaagtgcctggtggtgggggactctgtctcagaagcagtgatacttgattcagttgtctcacctcctctactcatctatccagtccattgcaatttactctaagtacttcaaactgtgtccttggaagacagagttgcctggagctattccaagttggcaaagggatgttctaataaagctcttaagtggtactacttgctgatcaagagcagaggataagggtgttgaaaatgtgatgctgcaaaggtcatttcatgaggcactaaagtccatttttaaaaggtctccactcctttcaccccataattttgagtattggaaagatttactaatgaagctctttgctgtgttatccctgccaagaaacagactttaaaaatatattattttccagattcatgacataggaatctattgaacccttccaccttaagtttgctccattcctcaaaatgtgtttctatcacttatatattttgttttttgtttttttaaaaaacaaaaaaaaaagtctgtgagaaggaaattgatttgaaggttttagcctaaaacacagtaaatactcaatgtaaagccattacatgagtttttatgtccatagtacttttttttttttgagactgagtctcgctttgttgccaggctggagtgcagtggcccaatctcagctcactgcaacctctgcctcccgggttcaagtgattctcctgcctcagcctcctgagtagctgggactacaggtgcatgccaccatgcccagctaatttttgtatttttagtagagacggggtttcaccatgttggccaggatggtcttgatctcttgactttgtgatccgcctgcctcggcctcccaaagtgctggcattacagctgtgagccatcgcgcccagctcgtactttttttttttttttttttgcatgtgaaagagatggagcaactatagcaggaaattttattttgtatcaccaaaaggaagtttgcttgttcgtatctacgattgacatcttcagtacttgctgaataagcacaaatgattccttttctatcgcaatatatatgtttgcatctacctaagagattttagatttgtgagtgtatggagccctcattagtatgagagattaatttatttcagtgtttgagctgttactgagcttaaaatcttaaaaaacacacacaatacaacaccagctctgtaatctttttaccgagtagactataataattccagaagatttaacatagtttattagatgaatggcttgcaactttaagggaccataaacttatatttaaaaattatcataagtaaaacaggattctgacagtaatgcatgtaatctaattcactaatgtatcagttgtgaatactttttagatatccagtaaactaaaatgaaacagtggacatacaacaaacatgtgtaacagaagaaaacccaactttagaagaaagtagtatttgtgtaatatttaatgtggtacgatagtagtagcattacaagattagtgatcagctggggttattaaaccaaagtttgcctcatgctgtcgacgttaagcagccacttggtaaagcctgggaagtaacatgtgcctcaacagttagcacttaaagactgtgttttaacgagtctccagatatgtatttacatgatagaccatactaacaccttttagtgttatctgtcaatcaagatttcataatattcctttacaaaatgtatctgctgtccacatccattatcctactctacttactttgtatttttatgtatttattaggaattcatagtcacctgacctcttggcagccatccctaaacttcacattaaccctgcttctcagggattgcaggggtcattttaacccccatgaacctgaaaggtccaaataattcagtccaaagatggttgaaaagggatctgcaaagtctcctcccacaaagaaatgctttatttcatgcatttggcaaccaacccctcccatctttttatttttatttttatttttggtaaagggattttacatcagacagatattattaaaaaattttatttaacactcagacacattttattctaaaacgaatgcttgctcaagagtctaagaaggcttcatgggaagagcaaagcaatctaagccatatgtattgggcaggttgccagttgtttgccaatatgcccaagccacctggctgtgcattcagccaagtatgccattccgaccagccagctttaacctcccggctgcttttcagcacttaggaaactccaaaggcctgggagctgcacttcatttctcccatgccaatagttttcacttatacaaactgcacagctacactgaccggtaactctcaaacgcccattttgaatgagctctccttttgtttaaagcaccattcactggtgttgaaccagtgccataagatgagtctggagatagcagactgaaacctttacccatatgccatagacagacactttgactgacaagcagcatttttttcccaagcctgtagcgacagggttttgtgattctggtttgctgagatttggattggctttatttgccgctggtttcaattttattttgggtggttctaacttttaaatgtttggaaacgtttgttcatttgattttccctttttgtttagtttagaaattggttgagctgtttcataatttatcaagcttgatttcataatctttggcaatctaggtcaggaatcatgcagaacaggcacgatttgatgatgggatcttgaagactgattcgttctttttaaaagtcacgatagagaaagctttactcctgaaaggcggtattctttctttcatcagggcgtaaaaattatataatgccttgtttccctttttgccttggctcccaagaaactcagagataagtttaattcttaaccttggtgaatatttcagcctaagtttttgcccccactacttctctaacccctgcagtttttgttcatgtttttcttcttttatggacttaaatgtgtatgtgtgctaatttactatatgtttatgaaccatctcaaattatttttggaaggtagatgaagtaaccagtaagtaaataaaacttcagattagaaactttagtctattcctaattaaaatctttaagtggccttgtctggtatcataagcaggtgtttcagattcattatctcaggttttaaatgaggaaagctgtgaatatttaagcctagaagtttcattattataaatttttgtgctagcctttggactgaccaatttattattttctatcactattgtggtctgtacattctcaagttgatgccatttccctcttcccggctcaatgaccactatctctcagatcttgaagatctgttttggcttggttccaatttaatcagtctgaatggatcctattgagtaacttgactcattcaccctgctaaagagagtctgaatacactatttctgaaggtttttttaaacctattataatgttcttttttattagaattgtcagtcatttcaggaaaaacatgtgatctgtatgtaagtgtgttttgagagtccatttttcatcccattaataagacccattcgaattgtagcattttggccaaagtcctgtgacacactcaacaaagccgtgagcaaggtggagttgcaccagctcacaagatggatagacagagctgggggaagtgtcccagcgggtttttgcagtctgtcagaggagctgcagctgtaaccacccatctgtgcatccttggcttggactgggcttcagtattgaacacttaccctgaagaaagatgttcaaagaaatggatggtgtggctcaaataataatggccaaaatgtgacagggttaatgttggaagagaaaaactattatgttccagaaactatgagatttagctttttggcatttctaaaattttaaaatttctgcagtattcaattcattcattcattttgtttttttctggacctggtagaaatactgggctttctgtattttttaaaaaaaatgtgtacatgaaggttttcggtgtaatgttaaatccaaaagaatcctgaagatcatattagtagtattttccctgatttatgtttatatcttatgatttaagctttcttcgttaggcagccacattgtatgtctttgctctctaatgtttattatctcctcatttattctgagatataaatttttcttttgaaaacatttgagtgcaacaataagctcaataatcctgaacaaagaaaagactattaattatttgtgcctttaaaggttaattatttcaaccttaaaagaatcttataagaacccattaataaaaaagaatgcaaatatattgcccaaaaaaatacacaaattattgtctttcatataggggaggaaataaatatgtttcatctgaattgtctgaagtaagtcatgaatggagtcagggtaaaagaaaaaaaaaaagcaacgtaattttttcctttattggaaccaaatttcttaattcctctgtacaaatcaacttgaccattttattgaactaaaaagcataaaatataagatcacgttaaagatattcttagaaagataaattactatgtcatttttctcaatataacccgcaaattactcagtcatatattctgaaaataaatatcttttgtatttatgcttgaaattttgtgatatatttatagtgcagtgaatttttcatcccatctctcaaatattttctcatgtacataggcctccaaaacatcattgttgctctaggtaagatcttaggaaatgttttattaaaatttcttgtatttgattttgtttgataagctcaaacaaaaatggaatgtgaaactagatgtcatctcaaagagaaatcaatattggttcatttattgaatgcctactatgctaggtgctataagaatcccatccttgctctgtgatcaaagtctgattgaatcaggagctgtgtgtctttccttcctccccaacatgcatttattgccttttcattcaaattttaaatattttaaatgttgacttttctacaaaaatctgggatacaggtgtgaaaaccttactaaaaatcatgtggaacaaaaagaatttgatacaatttagcattgattccaaattttttaaaaccagtaacaaaggagaatagtatccttaacaggataaaattatctatgtcatgtcaacagaaggaatcatactgaattgtgaaatattggaatcatctcccctaagatcaggaagaaaacaaagatggctgctatcaccattattatttaatgttcttctagaagttttggacaatgtcatattatatgacttagaaataagaattataactatctgaaaggaagaaatgaaattatcactatttggaaatgatagaattatctacctagacaaaaggtttaattaaaaaacatttggaattaataagaaaatttagcagaagatctagttaaaagataaacatcccaaagccaaaaattgtgttatataatcatctccaataagaagctgtgacagaaaaaagatctcattcaggagagcaataaaaaacagaatatctagaaataaccttaaaataatttgacagtaatttgatggaaagacctactgtgaagtgggtgttctgaattatgagagttatatgaataggaaggaatggcatctaatggtatcaccccttaaatatttctgtcaaatcataacctagaagttatctcttactcttctttcatgtttcatatctaatcatccactaagttccccgagtccaccttttcattagcatgcaaattaattcctatcctaccctatgtttccttcaattttagacctttattatttctaacctagactttgtaacctctttactcccagtctttcccaatcatctatcccttcattacactactgccagagtgatctttctgaaataacaactattgctcctttgttaacataccttcattgactccctctcaccagctgtataaagtccactctcctcacccgcatcccgtttttcacacttgggcacaccctgctccagctctgtgttctagctgggttgccatgcttacagtttaccaaggtgctgtgctttaccagtgcctcagtactgcagtgtcagtgcagggccattgcgtcttctggtttctctacaggacactctccatctaaatggcttcacagtgtggaaaactccagctcttctttacattcagtttaggcattggatcacttggaaaaccattccacacactttcttgcagttagggacttaccttccctgtttcctgagaagctttgtatacttctgccacagtacttatcacattatactgtagctactagtgacccccactagagtgtaaagctcgttgcatctctagcatgtagctcagtggctggctctttgttatttgttgaaatgtatatttttaacaaatttgatactcatgaagttctgtgtttctgagataattttatagttacacagctgttttctgggacagttactttaaaatttcctggttttttcttttgcatattggaactaagcaatgactggatataaagtatcactatacacatatttgatgtcaccactaaagtttgaccaatgtttaatggtttttcaggaataaaaataaagtcctatgaattaggatataaattgtgtttatgttgccactgcttaccatttctttgttagatgttatgcctagattaatgtcattagcttatatgctgaaaatgtaatcacataatgtttttaaaatagtaaatgacacaattattatatatatgtaaaattcagatccattcaaaaaatatccatgttcttttatatgcttaggactcaacttggtgctattgtatttagctattgtaaaatagctcagcctttaagaagtttgtatataaggtaagacctgcttatataacagccaatttaagattaaaaatagcagtctaagctgagtatagtggcacatgcctatagtcccagctactcaggaggctaaggcaggaggattgcttgagctaagagtttaaggctacagtgagctgtgattgtaactgagaatagccactgtactccagcctgggtaacacagagagaccatgcctcagtgtaaaaaacaaacaaacaaacaacaacaacaaaaaaaaacaaaacaagaaataatacaacagtattgcattctgagagggcctatatcatctattttatagataaggaaactgactttcaaagaaattctgtgactactatcattacccagctgttagtgacgggtttgaggctggaaccttagttttcagtttcttgattgagggctcaaaacagaactcaatatgcaaaaaagaaatgtaatgcattgggaaagtataaagcaagtccacaaagattaaacagaacagaacagtgattctggatttttctaatagtttttcccttaatttacttctacgtttgtagaagtaaatattgagtaggttatatctgaataataaagcatggcattgggtagcccttcagttttataggcattccacaaccactaattatgaataatccaagtttacaaatattcctctgagtgattgggctagactcattttaactaaaagggaaaattaagccatatatattatatatgtacatatttatgtaaagcatagtatagcaatattacataaaagttttattgccatgagtttgagatgacatgttataagtggtaaagccacaagtgaattatgcaggtcatctcaactaaatgccaaaaatgtttttactgtaccacatcatccagtattctgcctatgctacaaatttaaagagaaccaattttagaaatttccagagttgtaaaagtttttattggcactatatttcaaacttgctggcctgtaaatattagttccattaattgtggcaaaaattaatgcacagagatttttttaaaaaacacttgtgacaggagttttttttaaaaaacatcttcctttccagtttagtttagtttttcctgctctaagtataaacactttctactttcttccctttttatgtaagtttttttcttttttgaaacccatctcaagctccatctccaagaaactctctgtgggtacttacgtcaccccaagtttatttttctgaactcttgctttttcactcattgctcataaattcatttggcaagaatttttcgttgggttttaaccactcttttagttctggtttgttctatttttttctcagaattgtaattgagtgtatattgtctttgctaaataaattctaagctcctagagtgtgtatttagtgcctttatattgtctctggactctggagcactgctttttaaaaaaatgttctttcttttttccccctccctccttgcctttcacagacattgattcagtacctactatattcttgtctaagctatgcattggattttgtagatgaaaggcagcctagaaaaaatcttatacagaaattattctcaaactattgtgtgcacaaaaatcacttggaaagaattgttaagcaagtattttcccaagccttaaatgcagagattctgaactagaggccaaagatcatgctactgaataccaggtgattcagatgcagggagcccacagaccatactgagaaactcagttcataggtgacgggagaaagttccgtaagttgaccgtcacgatgctaagctatttaaaaaggcctgtggtagcaacatgctgcaggtatttgaggagcccagtgaaggggaacctactgaaactggggaagtcagaagagtctcgtcatagttggtgcttactacttgtgctgtgaatagaagaatgaatatttgaatttataattggaggaggtggttgaaatcctggggccttatgaccttgaacaaattccttaatttctctgagcccgagttcctttatctgtaaaattgggatgatagtaaccacctcaaagaggatttgtgagatgaaattaatagacataagtaaaaaacctagcacagtgccgacgcagaggtgctcaatcaataattacactttcccttctgtgccagcagcctcctggagatagctgtggtctctccttgggagggtgtttggccatgggtcagtgtatccacaaagctacaaaattggtttccattacattagtttcaatagttgcttggcataatttatgattttctactgagaatctataggtagatctacagagagctgtgaagagatccttgacctcttaactgtttcttgttttaaatcatctggtcagaaggggaagtgagagaatggctctcctttccacacaaagacctaatgtagaaagtggctcctggctgggcgcggtggctcacacttgtaatcccagcactttgggaggccgaggcgggcggatcacctgaggtcgggagtttgcgaccagcctgacccacatggagaaaccccatctctactaaaaatacaaaattagcctggagtgttggcacatgcctgtaatcccagctactcaggaggctgaggcaggagaatcgcttgaacccgggaggcggaggttgcggtgaaccgagatcgtgccattgcgccccagcctgggcaacaagagtgaaacgccatctcaaaaaaaaaaaaaaaaaaaaaagtggctcctgagaccacagacccagctttgtggttttgaatgcttgatgctgataatccttgcgttatgcgggtatacgtctgcctcctctgttccgattgccaactcttctgtgagctctgaaagtttgttctcttgtttctacccacctaccatattactttgcccttactaatcccttcataaatactagcatataaaagaaagtagtccctcagagaggcccctaatggttagctctagtcccagcaagagatgcagtatttaactactttaggcaaaaaaaaggttgtgcttttcgtgttaccataaaactgtcaatattccctcctttctagctgtgctgctttaatggtctgagagcggatgacttacaagttactcaagaagactgagtatgtattttgactgcctgcacttcctgaataggctttttaaattaaaaatacagtttatgttgttttactttttttgttgttgtttttaagtggctacatctgcattgtttcctaaaaacacaatagctgcgattggccataccagttggcatctgtctgtggttcccctggcttcttattttagttcctccctcttcctggtaggtcctgtcttgatcctagtcaagcctttataccccttttaagacttttttcttaagaaagaagctattcccacaaaaataagttgccacttgcagtgaaaggcataatggacaggaggaccagtgtttgttgagtgaataaaggaatgaaactactacatcacaggcaatttttaaaaatgaacaaaggggctgggcgcggtggctcatgcctatgatcccagcactttgggaggccgaggcgtgtggatcatgaggtcaggagatcgagaccatcctgtctaacacggtgaaaccccgtctctactaaaaatacaaaaaaattagccaggtgtggtgggtggtgcctgtagtcccagctactcgggaggctgaggcaggagaatggcgtgaacccgggaggcggaggttgcagtgagccgagatggcgccactgcactccagcctgggcaacagagcgagactccatctcaaaataaataaataaataaataaataaataaataaataaataaaaataaaaaataaaaaaaaatgaacaaaggttgggtttggtggcccatgcctgtaatcccaacactttggaaggctgaagtgggagaatcacttgagcccaggagtttgagaccagcctgggcaacatagtgagaccccatctctttaaaaaaaaaaaaaagctgggtgtggtgatgcacacctgtggtcctagctacttgggaggctgaggtgggaggatcgcttgaacctgggaagttgaagctgcagtgagctgtgatagtgccactgcactccatcctgggtgacagagtaagatcctgtctcaaaaaaaaaaaaaagaaaaagaaaaagaaagagacaaaaggtttttcagcttcatttgtaagaaaaaagactgagttggctcccccactcaactgaagattgtcttgctattatagagacacatagttgttttaggttagtgcctgacaatgtggatgacagatcagtggggaatgatatgttatttacatggttctgaacttcacttccctcctcttatccctactttggggctgatcttatgttctactgctgattcagaacacgttaaaaacagcctgaaatgggcaattcatctgcatccaattcaaggtatacttattgttttggagaaaagtccatcttaaaaaaaaaaaaaaggtggaaagagagggcagagagaagccaatttctctaggtcagtatcaacatgggaacagccatcctatttagagctgacaaacccagtagccatctgagagagttctttagctaaataggtgtgaagcaggggctgtatcttgagggtacttgtagttagggtccccaaacatatggcacaagctatctttgaacaaaataacagacggcagtgtttgctctgtgcttttaaggcaggtgttttatataatttttacgttatttatttgatatgatttctcaccaatgtacttcatcacatctaaaccccaaatcatgacccttacctacaaaaatactacacagagaaagagaaaatgccgaagttgtagggctaacaaacaccttccaagccacactttggcctaatagtattacttggatatgtttttaacaggtactaaacaggattttttttttttcaagaaaggacttctttcttgtttgtgatcattttgttatttttgcaacttctttcttttccttattgtctaaaatggctcagtgtattcatcagtggtattaacgtgtgaaggacataaccaaggacttagtccataggcagatatggtccatttctctaatcatttcctgcccaaagagctatggcaatcactcttttgcttgtcaccagtgagaatatcttaagaaaattaaattttctaagaagaaaacagaacaacctctttgaagccatagccaatgactctttcatacttttattccagaggctgaggtgtttcataattgttgaatgaattaattaatacatatctagaacccttcttctcaagtccagtctaatataagctcctgaagggtggggactttttgtctcttgttcactgctctattcctagcaccttgatcactgcatggcacataggagatgtgcctcacctctccaccaccatgttgaatgaataaatgatcaaagcatttcttaaccctaaaatagttggtgatatagttatctctcatttgcattattgagaacatcaaacttacatagccatgtcgcaagtcaaagcactctcccaactcagaaaaatatgcacttattattattttaattttgtatttccataggttattggggaataggtggtgtttggttacatgagtaagttctttagtggtgatttgtaattctgttaaacagaaggtaatatgagaagctcatctttgttggatgacattagcaacagaagaattagtttgacaattgactgataaatctctggcagagaaaatattgtgcttatgtatattaaaactgaaattcagaaaacaaatagtgttttcatcattggcagaataggtaaaagcaagtaaacaaacaaataaaacccattgtgggtgttctttaatcaacagaatcaacaggagataagcccttttgtttcttcattagttattccatgcaagtttttttcctctcccatcattgttttcaaatatggatttcaagatgcactattttgtgagtttactacattcttgttttcattcttgtgcctgctgtaggaccttgatttacccttaccactttgctgtgcctcagctttcccagatataaaattggcatcacagtactcatctacctagtaagggagtggggaatatgagacttaattagggaacagctgtaaaacctcttgagatagttctgtgagtcagaatggaagtgcatcattattaatcattattattattgttagtattttcaaatggctcaaagccgtctctaaatttaatagtaaaatgagtgcatctaataattctttgtatgtacatgctctgtggtcatgcatttcacaaattaaatggcagaatacttgtaggatatgattataatgatccaagtaaatgatcctcaaccaattcaagattatgtgattaagaccccaaggagctaaagcaagcagtttgctttgttaccttttagcttctcgaataacccattttgtgttaatttatgtgaaagggaagaagttagctctttaaaaattaacttagagttttctgtgtcattagtttggaatttgggagtaagtgggttactccttaatttccaaataaatctatctgtaacaccttgtccataatctacatttaaatggtttcgaatatgattggcctagcttcctagcagttgttgagtcgagcataatttatgaactttcagagtcatatgcggtatcttcagacatcatcggaaaagaaaattatatgttttagttttgcagttgttcccttgtctcctgtacccttctgtcaagaaactgcatttgtctctgaggttatgttgcaagtcaatggagaattgccttccaccgtacactgcttggtttcagcttgaattatctcagacagacatcctggctagctgcaatgcaagctcacagggctcaagcctgagaagacctaagtttggcagcgcactaagttgaggatgagaaaagaaaaaagaaattctgtcttttctggtgcttttccctcttggtttctccactaaaaatcaatagcgtggtcgatagttggttttgagttgtcccctacatgctggagtttttctgatgtaaacctttggtgtctgggcttcagacattataatgtgtcagggaaagtttgatagctgtcacagctctcctgggttacattttattcccacgatagcctttgtaatttgagaagggaagaatagatcaatttttataccatttagttgttgggggaatttcttttccataaattgatttttctttgaaaaatttacaatatttattttccttcttcacagcaaaagcaaataaaatgaaatattttcattaatgaatattttaaaataaaagcaatcccaatcttgctgtaagttgttaagactcagttatatcctgttcaggatttctcacgttccttttgcataacttggaatgacacttttaattttaaatgtatccatttgggaaaacctggtgtcttttcttagtagtactctagaatggcaatatcacgaagaataaagtggcacaacaacagctctaatgcttgcgtggttttaatgcagattttggtttctttgaaactaaatgattacttttatggataccaaataattatggataatgaataattattataagtgatgtctgttaaaaagtgtttatttttattttgagtcttttctatgaaatctcgttatcgggactatcagataacattaaatcattaattttctcttctgaaaatatttttagttgcttatctatctttcattctaatatgtattcttcttcaacataataactcttattagaattatccttgaaaaactttggggtaacttctagcatgttctatgaatataaggtgataaaattgtgtttgtaaggtggcttaaagtttcaaaagatagctttctgagtgaaataatgtttgtataaaattgtgttgaaacagcatcttatagaggagcaaatgctatgtctttaaacacttaatatattattcgaaataattgtcaaatatttgaacaataatatttaagaaggaacactagaattgggtgtcttttcatcagatagtgttagatatcaactatgctgtattaattgaaaggatttggtataatctcataaagaaacaggcaaattctggggtttcctctctagtgaaaatatatcattcatgtctttcattactgtgctataattatggtaagtgaagcagaacgagatcgatagagcaatttatcaatgcattccaaactattctagcatggtttacgtcatatctctgcagatactgtcattcaataaagagacatctaatagtataaagacttcagatggatccatttcagcataatgtctttctacgtgatgttctaatttcgatcatggtttaactaattgtttcactctgtatagtattaagtgaagtaaaatgttttctttgttgaatttcaatagaaattttaaaattcagctttcaagtgtaaaaagcactgcagtagtggaaacattgttattaatggatggctttagccttctttttcagtgccattgtaagttatatcaccattgaaactagaatacaagtcaggtatccatcatgcccccaaaagcattaaaattcaaataacaaaaataacagtcattatttaatgactgtaaatttttgtcttttaacatcacaagattcaaaattctttaggctttatcaccgtatttatgatttaactataagagtaggttcacaggctagctcatttagacttttttttccacaaaccgtacacaatggggtcttttttttaatcgtaaatattccccccatactgacatgatattaaatattgataatattgaagagaagatactgaagtatacatgaaagtgttatttatttcagtatggacaaaaaatattttcaaattactagattgtaattttcttttttcatatgttataaaattatcacccactgtcattttggttaattcagttttctacaaaactatataggtctggtaatgatgccagagtcacaccagtgcaaaattgtcatttgtatttcaggtttgtagacatcgagaaatattttcaaggacagaacttattttttattgagttagaaatgttgaaacgtaagggaaaagagtgaagttgaatatgaccactttgtcagaaaactgtatacgtaactcttgattttggaaaaatcagcacctgcaaattttgtcttttggggtttgtttttttttttttagtccagttcataagattacatgtttttggtttataatttctttacctaaggagagttttgtgctgcatgactccttaagagagtttccatgagctcataaaacatgaagtgggacagtctgaaatattgtgatcgttttctagaattatacctgatggaatgtgatgacagcacctctcccttctattttatatgttgaatttgaaagtgcttgggaatgtgttgatgtcaatcgtggctgtgtttttggccatctttctttccttataccttccactttcctactaactggtgcccctctgacattgtttcttaagagcttgtctgttaaagggttaaagaattagatttttaagctgctttcgtgcaatgtatttaagttaaggaaattgggatatcattacctcagtgaggatgttgtaaattgttttgttggcaagatttattgggggttattttacctgatatcacattgtattgtttaatgtggactatttttaactagcgttctatttaaacagtgtcagtgaattctgagagcttgccaaacaaattctcaaaatggttgccaagctgtaagatggctgccaaggtctgagcacattgaacaggttcaaaatggtgaccaacttctcagaatctgttggtcagattcccccactgccaaccccctccccccacacaactaccacccaaaaaggaaggaaaaaaaccacaaacccgaagatgcaagacttggcaccatctccttggcacgagtggctgtagtgtcatccagagattcaagtagtcaccacgtactacttgtttcacatgcttggcagaagactattcaggggaatacatgaggtgaaaaaccactgtaaaataacatggtcattttctttaccttatctaatatgcacaaaataattctttagaaaggggaaaagcctagacaaggcaatactttcaaagagctttctaaatgagatcgaagagcgttaactaagacttcgggctgtgcctttttgtactgcttgcctgaagtggcacaaactttatatacaacaggtttaagatttattttagttttgcatttgtttacttaagtttatagcaattgctttctggcagttgtggtacttagcagattgaaataaaatcataagggtgaattaaaacatactgctgttagtgctgattagaattttagcttagtgtaaataccggatgcagggtccaacttttcagacacttggcatgagctcaatagggatctccaggctacacaggagacagtgtgtgtgcttggatgcttttaaaattcttggataggtggagcatactacttctgctggcatgttggttcattgtgctggctgcataatgtgcttggattccaaggtagatagaagaagctgaggaaatggtaataagggaagatagtttgaacttaaaaaacaaagcctggaaaaaagaattttatttgaaccctctgcagtttgtactctgtgatatggttaattatataaataaccagtactaaactaagttgaaaatggcaggatttgtggtagtttgaagaatgacctagaagtgaatttgtttccacaagttgttgaaatttttctgtgtgatcctttaaaaaatagacagataaattaacttctccaggcagttagtttagtcagtgaattccttaaatagatcttctgtttaatatcagcaatggactaggttttatattctgattgagacctgcattcctaaagatagtttttaggtgataaaacattttatttaatgcttaagtagctgttaaaaaaggctggttgtcatgaaggtactggcgttttgtttttatctcaattggtagtggaatcagctagggataatactatagagcgatatagtttatatagcttgagttttgaaaaatctatagctttaggatttgttcagtcatggagcccttaggtggtgtgtacattttgtatattctctatcacaaggggtagtcaagaaatgtgacttttcggtcctttttttaatgattttctcctgccatttaggcaacaatgttagtagccatcaaagcttctcgtatgtttatttctagtcttttctcacctagtaagcaattgtcaaccaaggcccaatcattcaataggtaaaaccaaatgttattgacagagctgaaatctgaactctgtatccttcagcgtagaagatcaatgttcattaagatgcttcagttctggaaatttcaacataaagctatggaggcatttagaggttagcagggcaaatgtgtgatatgcaaggtgtgtagcagatcccttcttacatatttccagagtatatttgtaatgttacatgttacaaatgtaaaatagtttaattaaaagtctttcttgccaattcttacatattgtactgtaagttagtgacaaggaactcaaataaaacctttctttttaaattagaaaaccaagagtccacacctcattacagtaaatcatagtgcattttaaatcttcagattaagaatgtgtaatactgattattacttgtcaattttgttgttttttttctattacatattcattgatgatttattcagatgactaacgttgttgtagctgaggcaaaaattaaatcattttaaaatatgtcatttttacttattcgtaacaagttatgagtatgtaagcaagtagaattttttcaaattgcctgaagcatgacaaaattctagatttatagtataaaatgccaatcaggcagtgtttacgtaggtagaataaggcatatttttgcaaattcccacatcaccattcttgcttatatgaaaaagcatagtactttttagtattttgagagaaactttattcattttgctgttgtagacacagtccgtgttttaaattagtgaactgcagaaatcttttctttaggaaattttttctattagtccttccaaagtgagtattttactttaaaagagttgtttgtgttttaaatttatgtggtggtatatttagcattttacccttttctacgtagcatacacgtgtaattagtacatggggtgtatgtgtatgctggtgtctacccaagtatgtattgaaatataaaatttactttctatatagtagctttctgcatagggcaacccaaacagctgttattcctttttatagcttctttaatctatgtgccaacaagtcagtttacaaaatctgttttgttgatgactgctgcgataataattgtggtgttttgtggcttggcaaaaggctggggtctcctctgaggactcttgccaaaggctttgaaggggttgaggtggattcactgccaaaatgagtcaccactctctattttatttagtgtccttctgccaaggccttagacactgtctgttttcattcttttgtaggctttcctccccacattgtggttttcttcacagccagaggcctgggtctgccaggataggtgagagaggctgtgtgtagggaaactgaagggctaggggtttagctgttgtataccttgaatgtatatgtgagttaaattatatggttataagttacaaatgatggacttaaataatctagtaccttgtggtcacctgggtttgggtcagacattctcagaagagtattatttacttttaagtaggattcaaataatgtgacagtgttttcataattggtattgattatttaaaaaccctagattatttgtgagttctggctagaggcctaaatcttgaatttttcctcaaacaaaagagtatcatcctcctccttttaaatggcataataatttacttcacataaatgcgttttctacgtacacacctaatagacttcagggaattatgctaaaattttatttctacctgtctagatttaaattgtcaaccattaagtagactgagcaatatgaattgctggtctgttccctgagatatatttgagatttaaacatttttttcttcattaaatactttcagtagattgaaataaatggaactaaatgtcctcttgctaggtttgtccaactcaaacatgtattatgtatagaaaaatggctgggatgaatttgagtcttcaaaatataagcagaaatggcatttcatgcattagtatgaggaggacatacttgggtttttgctaactttcaacctataaaatttagatgggtttttcttaactaaaagctatgacaccatcctgaaatcttgtagattatgtatgcagaattaaattgaggggcatggtttttgttttgtaagtattcattcattgtgttaactctttaaacatcgtatacacaggaaaacttcattataacatcccctgaaaacatttccataaatataaagtaaattttcaaagttcaaagtcctaactataggcaacaaaatgttttccatatattatggtcgaagcttttgttcttcaggggaaaaaatgttataaaaatgattttaacactttgttcacaaaataaattctattaataattgattattatttttcataaatctttcagttagaaaacataattacgtaggtaaagagtgagataatattaggataaatactgatctcattatattctacaaaggtcagtggttagtatccactaagttaatatatgaaagtcctttgtaaactgttaaatatatagatatcaagacatttaggtttttatttttgttttttttaaaactttggattatcacattctcctctctgtgtatctacttcatggttttcatttaaaatagcaaaaataagaaaatagaaacagttactaaaaacttgtagtcattctgtgatataaattcatttggaatttaaatacttagagctcacggcaagagtccaagacagaaattcttttggatgatctataaaccactcaatccctggttaatgctcaaaccatgtgaaaagttccaggtgaaattcactatgagccttgtctgaaccccataaactgagggaagtcctataaaccctatatgaaccccaaagaatcaaaataactaaatccggcacataattaaaaaccactattttctagtggctgctttatgtgtccacagtttgaagacaagctttgcatatggaagtgaactattttatttcgaagatatgaatcataagctacttagtatttaaatatagttatcctgttgtgaagatctaataataatgctgtttaaaaagaggaactggaactcctttacaagtattaccatttccaggatctctcggaaagttgccaagacataaatatagttgtagtaatgattgttgttttaggagtggaattaacagtagatatgttcatcaacgttattttgaaaaagtaacgttatcttggatttgtactaacctttatgccgtatacttaaaatgcaactcttgataatcatttactatgacagtgtgggttgatagaagctaggtattatggttctctttaggcagaaagagaaacagaacccctgcatgacttcagatgcagtatattaatcttttgggggcatcagtttcctcttctgaaaaatgaagggattagactaaaacaatgtctcagattccttccaactcttaaaaaaaaaatctggaagcaactatctttgcgttattgtccataatatccccttcaaaggtgggatgactgatttatggaggacacattgtaaatcactaggctaatatctcttattaattattgcaatcagaagtataatcattgttaacgtgtaccgagtacttactcctagacatcacctgctgggctcctgatgtgaaattggctcactggttcgtctgtagttctttattagtagccttagtatcttagcatattagtgattttattaagttgactaagcattgtatgactttttacaggccagtgtcttggatgctcaagaatcctgaactcattccctttacctgtaaatgttgaccgtgaaccaaaatgagctctgtcagtctcttaaccattttacttttttgaccgtttgtctcatgataagttttgtaagcattaagtaattttcatacatcatctgtttttgcattcattcttccagccatctgccatgtacttggcttttgggcactgggaagagctagatggggtagaaatgcatcttctcttaaaaggagcttacaactcccaaagttacaactctatcacaaaaagagtgtcaagacacaacccaagttcatcacctgaatgccattgataaggatttccagatggacaaaacattaagctgacaccaagtgaaacgtgtacttcacagactttcatgtttcatttcgtgatatgcagtggcactctgaagaactgggctttcagaatgtatgtgtttggtccggttcttcgtatagggagcagtatctttggaacagtcacagcatacaccacaccacactaggttctatctgtggcagggtcagctcattaaagctactttctgggtcctcgttaatgtcatgcaggccttgtgacaggtgttacagctccccacctggcacggtccattgggggtgtgctgtaattgctcttgatgccacacttaatgggtgggggaagaaagtagcattatgtgtgaggggaggtgagagggatgccctcgggccgttgctgacatctggtcaccactcctgttttgctggcttgtctgtttggtgcctacaaatattgggcctttgagttgagtttgctgccaccattgggttccttgcagccatcattatttcacagctgggccatggttttaacttggaaaaagggcattcatctcagggccagaaatggtctactgccaacatgatcctgagaactttcttagtttaataaatgagagaataagtattctcatgagctcctgtatcaagtgtttcctggttttgagcttttttgttttttggtgagaatgttatctttcattgttatttctgaacccttaaaggactaaatttccttttcaagagtttcaagtagttcttgtacatgtgtgcggtgataagcaaacattagtctgagaaagttctgaaaaatctaattgagccagcatttaccaagcccttctatgtcagctactgaactaggtgcagggaaaaaaataaaggtcctcaactagctcaccctcaactagctgtccctccagctagagaaccaaacctctgcataattaaccataataatgggcagatagattcaagggagaatgcagtaaaatatgtaatatcatgagtgcagtttttatctgtgtgcacaattacgcaagccttttaactaaaaggcttcggtgagatggatttcgtaaaaatgcacagaacttcctgaagcacaaattagacagttccctaatattaaaacacagccctgagaggtagggtttcaggctttctggaacccccaaacttgaattggtccacagaactaaattagaagtaacaacctttccttatgatgtgtgatttctcaaatggtggcatcttcccagagctgtgtgttcttttgtttggagcacagctgcttcctattgttaagttgcaccggagagctctgagacaattaatgaaggggatttaaatgttatttaaaggtaatcccaaaacgtttctttgtgaaagatgccccttactgcagtcccaacttaaataccaacttaaataagaaacttccactctaggcatgctcaataaatattcagtgaccatttctggtttctggggcataactaaaactaaataactaaaaaattgccaattaaatcttccccagccccaattccacataacgcctatgcacaaccacttctgaatgctcatggagaaatagcattaaggctctgatctgacctcagtaattttacaaatgtaaaggtagcatctcatggtccctgtagggatatattattagaagaacatgcatacaattttgttttaattgattctcactcttaagtatgcaaccaatctgtgtatatctccttttaattatttatctgagttgtgagagaaaagtaggtaattatttggtgatccattcaaatgtcttgaaaggaaggcatccaacttttatgacatacatcctgaaagacataaaacaatacatttttattttataatttcatcagtatcaagtgtagtgtaaactattttaaaacaatttataaaaggtgcttacatacttactgattgaaaaaatggccacaagaattaagtttatggaattgaaaaaatttagaccacaacaacatggtaaacattgatttttttcagaaggaaataatttctacaaatcaaaaactttactaaccagatgttatagttaggacaaacaatgaaataatcttactgtaagaaaaataattcagccaacacgttttttaagtgtcttctttacgcttaacatgggtatttgctattagatgggggaggtggaaggaatgtatcaaaaatgaataatggccagatgcggtggctcacgcctataatccaagcactttcagaggccaaggcaggtggatcccagcactttcggaggccgaggcgggtagatcacttgaggtcaggagtttgacactagcctggcctcaaactctggtgaaaccccatctctactaaaaatacaaaaattagctgggcgcggtggcagtcgccggtagtcccagttgctcaggaggctgaggcacaagaattgcttgaacccgggaggcggaggttgcagtgagccagtgagccaagatcatgccacagcattccagcctaggcaacagagtgagacttgatctcaaaaaaaagaaaaaaagaataatattcgttaccatgttcctgctgacagtttgagtacacaagatacactgtgacatagtgaattcaaggaagcaaacatggtatgggttggaataatcatggatggatacttactgcaagaggcagaaaaacacatgcagttccttttctaggaaaatattggtaaattatgcttggttagtaaaagtgcacagaaagcatatggaagtttcaaatctattttccataaatttttccccaaagtatttctgagatgctgggtgcaaggtacggttcattgtcctagtcctctatgctgaaaatgatcattttaattggattgcttctttggaaacaagacaaagcgtacattgctaaaagcttctggaggccattttcaatatttgtaataatataagtgctagaaatgtgctttcatttatattcaaaggcaataatgccttctgtaagcatggcgtctctgtaagacttttataatgtctacttaaatgcaagcagacaaaattagttttcactttagattggaagacctttctccattgcaactttttggcctctctttttgttctgctccccaagagcaatgtaaatgttgctctttgttttgctaaaagaggaatgtttatttttacaagtaccatgccacttccatatgatctacatggtatgtgtcatgaatataatttctgtatgattggccaaatttttcacttttaattaagatgaccagacaaaaatttgaattgtaagaaaattatgggccaatttagtgcctgttgaaatgtacactggatattgaaatgttctacagagcataatgaatgaaagtaaaaaggctctatctcttttctgaagcctacttgaaaattttgctttcataacatgacattgaaaaagatactataaaaatatttattaaaatcatagctcgagttttttcttagaagtaagaaattatgtttaatatcaaggactttactacaggataacatgattgtgtttcacatagaaaaactttgttgaaaaatcagtgtggagttgagttcatctgggccctagctgaaactaattttacttttggatattccataaactgcatacatctctttcttactgttttgtttttctatgtatgagaaatccatagacacagaaaaaagatggagagccttcatttctcttattttcacttttgtcccatccctctgtgcttgttctttgtttaaataaacttttgttgtatgtctttcacacatcatcactctctgcttcaaaggcttcttttaataacttagccctggctcacttttcttttgcatatgaaattgatttaactaaagtgtatgtgtgtgtttgtgtgcgcatatgcctacatacacatgcatccgtacaaataaaaatttcactggaaagggaactccgtgatctctttactacgtacatacacacaccttgtcgaagtgggaaaacttaagtttggagttaatttggttttgagttccagctttttctcttagtgctgtctgtttcctcaccctgaaatgaagatggtaatgtttactttgcaaaagttgctgggaaagttatgtatatataaatcactttatttttattgctagacattcaataaatgctagctgttactgtgaccatcattattgtcatatatgtaacacaattatgtcatacatttattttgaagctgataataagtaaactgataaaaagcagaaggttgagattaaggcttcttattgctaaaagattgatcttaagtacaatcacgtgaaaactgatagttacataacctgaaaaatcataaaatactgaaaaattatgactgttatgtgattgttttcagttgtcagactacgtgatgttaaaatggcagttgattttttgtattaacacagtgcctctaattttaaaaactgcttcagcaatcatgtatttaatgaaaacagaagtaacgatacaaaataacaaaaatataaatagagttcagaatttgaaaatactgtattaggaggtaagctgactatttttcgtgttctttaaatatatttagatcaacttgaatattaagcctcctacagcaggtagatagaggtatcaattcagttaccatttaaaatacagtaactccaatgaggagtttcttataattatttctaattactttttgatattagaaattagagctataccagaatgctgggaaagatgtctttttcaacattgtatcacagcatcaagcattatgcatcaaacatcaattcctactcacaatatccattcaatgtatatttggattatattttctttggatagaccctcatagtagaaactctgtattaaccagcttgcaagatgaaccaagactttttgttttctttgtaatatactgattcctttggcatgttgaattttcatggccaacagttacctactaccacatcctagcactattgtttttaccagttgtgtgcttaccacgtcagttgtgttattccggacctgtttatactagtcttatttgtatcaccattgtgtaatttaattaaatttatgtgaaccaatggcatgcaagttcaaaatggaaaagttttatttctatgaaactaacccagtgccttggaaagaatcagtaaaggcaagctacaaaaatttctgtcagattacatgtcagtgagataactacagaagatgagagaaggttgtaaaaataagagttttgttagattattttagaaatatctttaaattctcccactacttaaagtaaatggaactggaaatcttttatgatgcattatagatacgcattatataagaaagatgctgtggagctccaattattaacagacattattaaatttaaatttttgcctctgcataaaaagattggccaaagaatgtacatacacatgctcaaagttaaaatgtttaaggtgcatatgtctcattaatgagtatcttcttcatccattttttcaaattaaccaatcaacaactggccctaacagtactggataaggtaacttctattctattttgtattcctactctttacagagttttagagatgttttgtttcctacctaccaagggaaaaaaagggaattggcagatagagtttatatcttgggatgagatgtgtaaagggccaggacctgaaattacgtgaaggttgatattctgggattggtagttttgaagttccataaagaagttcagtccagccatgttccaaatgctctgagtataggcactggctggtaagcttagtggagtgttatacaacatggaagtctaactggcagttcaatgtcccaaaagttggacagaaccaagaaatagagaacataagcagatgacagtaatccaggcagaaggttagtgtcagagaagtctgtcagtgggtcatagggctccacgtgctagcctgggtttccgtgccagaattttgttcttgggaggcaggtagggaaaagcaagtcaacatctccagttccagatgagctagggcacttgaccaaatacaggtacagaagttagtccttgaggtagagcttacctgttggagaacatggcagaaatcattgtaccaaaattggagcacaggtcagaggctaaagcatggcttactgctgtggctcatggtgaacttgagcttctcatggcccctcctatctcctgaggatggctgagctcacagatggggactgttatgtaatcagaggtcaagtggtttagctggggtggcagagagccaggtgaagactgaaagtgttcaaataaggaagagaacagaattgctttatgtctgccttcatgaagacaaaccctaatagccaaaggactgaaagtttgcccaaagagacctcaatttttgaaaggaaaatgcatcttctccttatgttagaatgaccacgtctaaataaaataaactcttttgccttttgttgttacttgtcttggtatctaccattgtttgacactaaaaaaaaataaagcagtgactaattattggctaatttaatctgtcatgatggcatttgtaattcaggtacatccttcattaaagcaagtataggcattattatttttaaaactttttttttctatttggatttcttctattttgtttgattatttattttgttgttactggtggtggtggtgttttacagtgagacatactggttagctcagctaaggtgtttgagtaagacttcataaacataaagtactttgtgtgggtttgttttgtgtgttccatcttacgtcatttgtggcactgaaaatgagattgcaattcccagagtactgggatagttcattcagaggttagcccacctaagtttatagcagttgtctgtaatagaattgtaactaatttccactgttgtttttggagaaaactgtagactataattatgtgttagcactttttaaacagctccctgcattgtcatatcattttaaatgggctctgttttaaaatgacctttcatgttttgattgcaaaaatatagcttacacaggtctgtagttagcaaaatacaaggatccagtaaatgatagagcattgacacaactctagaagcatgtgttaaacatcactggcactgccctaggtttaaaggggaagaaatagggaagtagaaattcactgttcttcaacactccttctgttggataggcaagattagtacatagaacagttatggagccatgtgaaaaaaaatagtagttatacaaatgtaaaatgctacacatgaagtatattgcattacctttttgtggcctatggaaagaagtctcagagcacagtaagattcaagtaccatctcccagaattggggtcagcaacaccattttatattttggcaaatgctacccactgtctcccaaacggcagatatctgcatatagttagtcatgtggacacacccttcctctgctacattgcattgccatattagtagtagaattttagtgttgatttaaaagacagtctgccttaaagcagattgcatagtttgcacactgtgaattgtaattaaagtgtaaggggggcttattatgtcaacaactggcatgagaacccccgagcagcaggtgaccctgaccatgtgacgtttgtgacagctaggatccccttttcactggcttagcgatctgaaagtccaaattgaaagaagcccagaggctgtatatttcattagatcccaggggaagtacaggatacagcttccttctgttttcctgggaggtcgccagaaagtttgtagagctctgtttctgtcagagactcaaaagagaaaagaaaaagcacacacaaaacaaaacaaaacaccatacacaccacaaaaccatccaccaatcacccccaggaccataaatttgacatttcccacagtctgagaccacagtgttgctgtgtcagcaatacgctccttgtttgaattgtctgaaaggaaggctcagtgttctagcttttaaaaaatgtgtaatcttcaatatgcagtgattctcttggtgtaaaaccatgagaaattatcaagtacagatatcatatgatttgcttgaaatacttttgcattatgcgttactttctcctgaccttctaaaatggggcataagtccgaatttagaaagaggaaaccacatgtgtaataagggaaacagactaaggagacatgccatgtgtatttcagatcttattgtgatgggtaaactgtttgaaatgtggtcacattaaaagtatgttactttgtgggagactcaaaatcttttacgagtagatttttattgtgttccatagtggaaatagaactagggtttggttttggtgggaagttttggtcttcaagtcaccttggcacctgactggcagttgtgaaactaagtagaaaagatacctcttttttcttggcacctcacacgggatcataggattcttactatcatacaatttatatatcacagaaatgaaaacttcggtactttgttgtataatacagatcttgtgcttgttgatttttaatttggggctcaagcttcccatgtcaactaatgtggccgctgctaggctgccctcgggtagaccaaatgtaagctcactaggaagtatttctagctctgtaaatacctagcatatcgtttagtccaggcatgtccaatcttttggcttccctcgaccacattggaagaagaagaattgccttgggtcacacataaagtacactaacattaacgatagctgatgagcttaaaacaaaaatcgcaaaaaaatcttagcatgttggccaggcatggtggctcacgcctgtaatcccagcacttggggaggccaaggcgggtggatcatttgaggtgaggtcaggagttcaagaccagcctggccaacatggtgaaaccccatctctactaaaaatacaaaaaaaattatctgggtgtggtggtgcgtgcctgtaatcccagctactcaggaggctgaggcaggagaatcgcttgaaccgaggagacagaggttgcagtgagccaagatcgcacctctgcactccagcctgggtgagaaagtgagactccatctaaaaaaaaaaaaaaaaaaaaaaaatctcataatgttgtaagaaagtttacgaatttgtgttgggccgtgttcaaagctgtcctgggctgcatgtggcccctgggccgtgggttggacgagcttggtttagtccctaagtgttgttcattttaaaccagaaagtgagaattttctgagcccagattctacctttatactgctatttgttatgttttggtcaaaagggaaatacagaaagaggaaagttaacagtcatggtttgtgtgcttgtatgttgtatactttcatgttttgattgcaagaatatggtttacacaggtctgtagttagcaaaatacaaggatccagtaaatgatccttgtatcatttatttaggaccctctgttgtaagggcccaaaaagactcactcacagtgccatacacatggcactgcatgtgtgtgtgcttgtgccagcctgggacgagaacttcaaggcttgagagaaagatgtaccattttcataaatttggtaaataaattaaaacctttcaacttagagctgcatttaagtgttataattaaaggactaccagttgggttttttgttttgttttgttttgttgttttacagtccatctattttagcaaattcgcaaataattagtttcttttatttatgtttttcaagatcggttcctctattcagccagaggaaaacccaatatccttagctgcgttttacctcaggtacccagagaattgaggcaagaataggttgtgggaatgtgagagaagtgtgtctgtgctgtctcagctcagttaactagtcctctgtagcaggataagcatgtttgtgcagaggtagagaattgtctccagtcatgattttgttttttatattttttactgcgttgttttttttttttttttttttttttttgagacagagtctccctctgtcacccaggctggagtgcagtggcatgatcttggctcattgcaacctctgcctcccggattcaagcaattctcctgactcaggctcccgagtagctgggattacaggcacacatcaccatgtccagctaatttttgtatttttttagtagagacggggtttcaccatgttagccaggatggtctcgaactcctgacctcatgatctgcctactttggcctcccaaagtgctgggattataggcgtgagccaccacacccagctctactgagttcgtaagtgaagctttttcccctctcatgttatttgaatattgtttccttcatctttgtttatttattatttatttttcaaaccagggtctcactctgttgccagaactggagtgcagtggcacacaatcatagctcagcatagcctcaaactcctggacttaggtgatcctctcatctcagcctcctgagtaactaggactacatgcttagctgtttttttttttttttctttttttcttttttttttttcctgagacagggttttgctaagtttcccaggctggtcttaaatgatgctctcatcttggcctcctaaagtgctgggattacagggatgtaatcctggacccttaatctttattattagttcatcatcttttatcatgtatactatgtgccttgaaagtgtgtattattttattatctgcacaattccacatcactttattgatattctgaatatacctgtagtatgttaataaatagcatctaataaaatgtagatacataaaaataagccattttcataacttttggctaattttggaaacagcattctcaactgcaggtcagatttttaaaagaatttaattttatctgtgattgtgtatacatcatgccaaagataaaagcaattcagttgagtgagatagggtgtggaaacaggctacatgttggagtttgttgccagcctgacattttcaacacagtttctagacccatctttttaaatgcgtgctacaatgaaaaccaaaaggactttttcatattgtatttgcagtcatctatagatgtaacttctgatgtctttatttttgttgctcttctcttctcattaacagcagacctgtagacacactagtcccaacatggttgttttacttcctcatatgtgtactgaagtgttctttgctgtctgatgtatattaaggggtcttcagcaattatgaaaccattgctgcagaagcccagagtcacatactatagaaatattctatagtaaggacctaacaggattcacattaaacagaacttgactataaactaatggattcctactacagataataggaaatgtggttttttttttatttttttgaaacagggtctcactttgccacccaggctggagtggggtgacatgatcatggctcactgcagtctcgactcctgggctgaagtgatcttcccacctcagccttctaagtagctgggattacaggcacacatcaccacacccagctaatttttttgtagagacggggttttgccacattgcccaggctggtctcgaactcctgagctcaagcgatccacctgccttggcctcccaaagtgctgggattacaggcataagccaccatgcctggccaggaaatgtttttaaagactctggttcctacaaaatttgcaaagaattgtgaaaactgtctatccacttctttaaattttaatttttgttggtttatatttcaaatattacattgtcaattaggattattatgaccatagatgacacattttgcccatccctgataaagagaagaaatttgctccctaatgtgtagccagtttaggaattttagccttaattgaaaaatgtatacttttttgtaactggactttgtttctgctaggagatagaaaagtctataagccatctctgagatagatttctactcttcctttaaaatcttgcccggactggcccttcccctctctgttcttccattcaaggctcacttattgaacatatattatgtgcaagcacttcatttaggcaagtacgagctgtgtgccctcaagggcttataacttgttgggaaggcacgtgggagttatatacacagagaaatgaattaggatctgagtcccattctcagtaaccagggtgtagggagccagaggaaggaatgatgagttctgccaagaggaagggaaaggattctgacgttatcttctacactggttagaatagaaggatggaatcctaaatttaagacggagatctgtgctgtatacatgtgactaacagagattgggaaagagtgtaattacctcctgtgcctaagaaggttgttggcgtaaacaaggtagaagcaaagccaatttttgggacagtttaaccgaaatcttttcaaatatttggtagaaagcattggatgaagtgttacaattttaattaatgtttttaaatgacaattgagggttaataaagccattgttgccgtgcagttgagaagagtagaatgggtttgtttttgcaatcccagtggggtaattaaacttgcagtgcctgtcactcattccttaggctgagggacttttgagattgcaatagctcatcttgtgttgcagctttgtttttaaatttagctaagttaaagcctatggaaaaaaaatcaagggaatggaagagatgagttttgaactagtgaatgtgttcactcaaggcacagggcctctttgaggaatttaggtcgcagacgtctttcacagaaaagctgtgtccaaactgtcacagttactgcctcagtgtcctgttttgttctgaaggacatgacacctattttccatgcactttttcagaaaatagtatttgtacccatttgttttgtcttcttaaggaacgttcatgcagacttttcgagcagtgagcaggcgccagagactatgtcactgttctgttctgcacagtgtagcgatttgcagttggcgaatgaattcatcagcggatgaatgtcagctcactaggtgacaagcttcctgtgatatagactgggtgaggacagagcttggtgagccttttttgttcacgacttcatctctagcactcacagtagtgcttggcacatagtacatgctcaataaatatttgtagttttatttgtggaatgatatgctgagtaaatgattagagtatattatcaagaaattactatttttttttgagacggagtctcgctctgtcgcccaggctggagtgcagtggcctgatctcggctcactgcaagctccgcctcccgggttcatgccattctcctgcctcaacctctggagtaactgggactacaggcgcccaccaccaggcccggctaattttttgtatttttagtagagacggggtttcaccgtgttagccaggatggtctcgatctcctgacctcatgatctgcccacctcggcctcccgaggtgctgggattacaggcgtgagcccctgcgcccggccaagaaattttcatagagtttccacttccttggttgctgaatgatttgtaatattgtaatcagtatatctatgacacaatttctaaagttatttagtgtttgtcagtgatgtctgaagctccatttgctcttttgaagtcatttgtttcttaggacctacaattcttaggaaaaaatgacttacagtcaaataatttaggaattttaggggaaatctggagcccattttatttagtggccttaaagatgaggtacataagacccaggctaacccagcttctaacagttgattctgaatcccaggtttcctgattctgaacttgatgtccattttgaggggttgttaagccaaataccttcaagcttttcccctctgttgcactcacatttatgaatacagatggtctctaacttaggatggttcaacttaagaatccacattccataaaaatgggactttgattacccatacaatactggttttcactttcagtacagtattcaataaattacatgagatatttaacactttaatataaaagaggctgtgtgttagatgattttgcccaactgcaggataacgttaagtgttctgagcacatttaaggtagactagcctaagctgtaatgtttggtagtttaggtgtatcaaatgcattttcaactgatgatactttcaacttccaatggatttatcaggatgcaacccccatcataagtcgaagtgcatctgtacttactttagactaaacaggaataataaagtactctaggagaagagaactcagtaagaggttaactttacgtggaaatgttacaggcctaatgtaaggtacagccaacaacaacaaaaaaagcaagctggcgatctgccttccatgcaaaggttatttttcttattacaacaaaactaattagtggattttctaatgtaagaaaatgttgctgttagtaaaagtttcctcagtgtgccagaaagcagatggtggcagtgaatagtgttttcttttgccaggttttgtatatgctttctaaacctgcaagagattttgcttttccagattcagatttctgatcttttttattttaaaacagaaatagaaacttatatttaaatgtacttgcatcatgtggtctgtttgacatattatggttacttgaaaatgttgagtaacatttgatgttctgcatgaatttcttctctaagagtcttgggacttttaatgttgttctatactctctctctttatggaaataaagagtttctgccttgagagtgctacaatggggagttttgagtgatttatgaaaagcaatgggtaagatttttttatgtgaaaatttgtattttgtttcactcccaattactgtgcaagtaccagcttttcacagtgaggtttcttacagcatgactttgttcattatgacttcagtgtttgtatacagttttgaataatttatttctgtctactactggtgagatgttactttctgctaatttaaaatgttttgcctaacgtttttaatgaaagtccttataaatatgtttgtttaaagtctgaaatctaaacatgtccttaacagtaccaacgaggcagcattaaaacaaaaggcatgttgattttaaggccaactggaagaatgtatatctacaatggtgtagacgtgaggctgtaatgagcatgagtgtagtcaagacttatggctttgttgactaaaacttaagagatgctttcctttctataggacctccatttagaggagaaaaggaaatcattaagtcaatagatgagttattaaagtataaagtaaaaatggaaaatgaaaacacactcagtgatttttttggaaatcatttgggcaaaagtatcaagaaagaattgtctcaaagttactaaatggaatagtctccttatggaattatgtgctattttgggaggtgatagccagaatcaaaggaaatgaaagaaggactttcatcccttctttcacctcattcccatgtagctctgctgtgttgttccatccatccccaacactaacctgataattcggagacaccttgccgcatattgtttcacctttaattcttgaataaactctgattcttacttataacttttcccatgtttgttgccaataaaatttcccatctcatttgaagagttgctatttctgtcacctgttcaaaggatagcacttcttttattactacctctttctttttccttttccaactatttctcctttgactttgtttttcccaataatgatttgtttttatcttctttcctagtaaccaaaaattaaaacaggacagagtttccaaaggaaatgtctgtagatgttaaccaaactgattgaatcactggttattctttgcttactttaaggctgtaaatctgcaaaaagacagaggtgatactggtatcactcacagccacaggttagtgccttggctgtgctgatgctgccagggtttaaacattgctgtgaggagcccagcacaggcaggagtgtggggtgaggatgtgtgataacagggcatgacgggcaggtagaactgctcgcttgtgttttacacacaggcgccccagccttcctataggctctttcttgtgaataggcttccaccatgaccaaaatgtttgaaaaaccgtaaagccaagagataagtaatttttgttgaatataaaatagataagccattacctattcataggaatatttacctcctgatagactttggcaagggttctaacacagagacactccatgttctcaccaccagtgaagacgagggaagtagctactctcaaaaaacaaatagcattggctgggcacggtggctcacgcctgtaatcccagcactttgggaggctgaggcagctggatcacttgaggccaggaagtcaagacaagcctggccaacgtagccctgtctctactaaaaatacaaaaattagctgggcatggcaacatgcacctggagtcccagctactcacgaggctgaggcaggagaatcgcttgaacccgggaggcagaggttgcagtgagcagagatcacaccactgcactccagcctgggtggcagagtgagactctgacttaaaaaaaaaaaagtgtaaacttttataaatgatacagagttgaatgaatggaattcttggtgaacatgatgagctatctcaagactgaataatgctttgcacacagtaggtgataacaaatgtttgaggccctgacataaacaagcttcctcctcctaagaaaggttaatcaatagtcattctttagagtgagggatccatgctgatttttgaaaagtgaatcagagtaaaagttccaatcgccctcttggactttttgatgatcagctattgaaatagcacgtatgttagagacagtcctcccagcaaacatgattttctattaaaatacatccaggtgacaaaaaagaagcttttagaaaaaaagaatttgactgagcgtggtgactcacgcctataatcccagcgcttcaggaggctgaggcgggtggattgcttgagctcaggagttcaggaccagcctagccaacatggtgaaaccctgtctctactaaaaaatacaaaaaagaaaaagagctgggcatggaggtgggcgcctgtaatcccagctactcaggaggctgagacgggagaattgccagaacccggaaggcgaaggttgcagtgagccgagatcgcaccattgcactccagcctgggcgataagagcaaaactccaccttacaaaaaaaaaaaaaaaaaaaaaaaaaaaggatttcccgaaggtagtttatttggcaaatcccacacaaactattagtagtccttatacgaagacaatttaattttgggattattactaagcaaattactcacaaatactgagttactgaaatggaaaatatttttatctccccccagtgtaactacagacaagaatgtagatagtgtacttaggtgtaaatgacagatggaatgaactttgggtgaaggcgagagcacagaagctcagtggtactgagctgggtttgagtgggtgggaccccatgactggttactgatctttgaaagcgtttcaggatttcaaagctacataagcgaattcacgtgttttagttatctaggtttgttttttccttgttatataggatgtttgcagttttcccatttgtatcaactcatacatctttgaagttttgtaattcagtatagctttggttatagattaaagttcactggaaaatcactgactaatccttttagcatgttccactgttccatagtataaagatacacagaacttgatggcttccaagtgtggttcaaacatccaaagcactcgagattagcaccatgtgaagaaattttaaaatattgtactgcaattaattttaaataacttagcactgcatatgtcagggagaaagccatggtagaattcaaacagaagctcctataagtgaaatgattcacttacatcatttaaataattttatctctcataaagacatagaagcaaaatatatgcctatttccacttaggaaaggcttgggtgaatttctgaagaatcagatattacctgaggtttattataatatgggaagtctgtggagcatttattggttaccaaatgattaactccctatattcatgtgtatttgttataggttcaaaaaccaagttattacagaaaagttattgtcaatgtggaaattgaaaacacattattttaataatataacgtagagaaggtatatctaaaatacatatttttaagtattatcctaaattctaggatctagattaaattctttgaggatatctttttagtagctcctgaaacacaaagttttctggaagacccgatgggtcaagatataaaggaaaaaacttagtttatggccttctgtggtcaggggttagccaagtcactgaaaataaacatttgcaactgttagtgggctatttgcggtcatttataaagtataataagacacagtttatgacttgtagtgattattgcactcatgttatttctaattgcacttatgatcagcagcaaataagcaaatatcactcagtgccttttgatgaaatgagagtcttagccttgaatgcagccgaagaccaacagctcaattgctagtgatgtgtttcaaatgtagaaaggctggaaagaacctttgctgaacacctaaccctcaccttcatctatagatattctggcctggagaggtaagaatttacatatccaagggaaaatgggtgatttacgaccagaaagtagacctcctgactcccatagagacccttcttaccacatgaaacataccatcttccagtcatagagtctcctccaaaccagaaagaacaccccaaacacctattgacctttcccaagagagaccctattgtattttatggctctgaaagagctaattttttttctttctttctttattttttattttattttatttttatttttgagacggagtttcactctgtgtcccaggctggagtgcagtggcacgatctcagctcactgcaacctctgtctcctgggtttaagccatcctcccggttcaagcaattctcctgcctcagcctcccaagtagctgggattacaggcatgctccaccacgcccagctaatttttgtatttttagtagagacggggtttctccatattggccaggctggtctcaaactctcctgacctcaggtgatctgcccacctcggcctcccaaagtgctgggattacaggcatgagccactgtacctggcctgaaagagctattttttcatctttgtatttaaattccatttcaacaaacatgtgttagtatctgtatgttccaggcatggtgctatctgccagtaaaaatgagacagaaaattaaatagcatgatgctttaaccagtctatatgctttagaaaacctgcttccaagcagtgaacagttagagaattatagccactcataatttacaaggcactgtaaatcatgccattcagtcctggtactctctagagtcaggtatttggaatgagtcagttgaggttcagggaggtaaaggggcttgcccaattcctcaaagctaatataaatagccaagaagggactcaaacccaggttttcttttatcatgccttttgccttttttcactataccatagctacttctggtagaactgtcatttctattaaagggaggataccaggcctaattcagaataacattctgtactatgtatgcaattgtttctaaggagaaaagtctgatttaaaaaaaaatatttttatacttttaggctgggtgccgtggctcatgcctgtaatcccagcactttgggaagctgaggtgggtggatcacctgaggtcagtagttcgagagcagcctggccaacatggtgaaaccctgtctctaccaaaaaacacaaaaattagctgggcgtggtggcagcacctgtaatcccagctacttgggaggctgaggcaggagaatcacttgaactcaggaggcggaggttgcagtgagccgagattgcaccattgcactccagcctgggcaacaaagggagacttcgtctcaagaaaaaaaaaaattggatactttacaccatttccagcaatgctagttatgcagtaatagcttaatatttcacttaaaaaaagattctgcctaaacctctctttatctcactagaagagctaaccctaaccactaccaccgccagttagtatcagggctgctgtaaattgttccaagggtacatttagtggtattgattgctgctaatagtaaaagaataaaagcaattatgaatgtacacaacaacttgttgctctaccccagtttcaccaggagataggatttagtcaagaggggatgtcacagaatctttatcctgattaggagctttttgaggggagggaccttgccttttttcattttgtatctccaggtatacagggtgaaaggcaccatagtagatgccaagcgaatgaatgaatgaacgagatggataggcccaaagacaactaaatcaaaaaacctgtgttgtttcagaggagaatgatccagtatcatttcccctttgggtaggagtagtggtatgaatattgctatgactgcagaatcccagacttgtctagaatctctagttatagctttcctcagcagtgggattcaccaacacactgaaataacctgtctgtggcaaaactccatacacaatcctgttttctcaaatgcttcaaggggaaaagaaattcctgatttacccaaccacagaatcttcaaccttctcattaaggcttctgcattttttaggcaaattgttactgtgccattcttactcctatcctttcacagaattattttctgattatggatatgacaagacccagttgattttttcagagtttagtcatttattctgtggtttcaaatctcttctaccatgttatcttcctgcccctctactcccctgcccccaccccccgacaccaattcttaattccctttcttccttttattctcaccaggaagggatatgtcacagtaaaccctaccaccttgtcatccaaaatttctagggagccttagttctgagggtcttcttcttgaggccttaaccttacttttagacagttgtcattatctttgtctaaaggtcatagctaaattgaataaaaggaaagctgtgttttcctgttgatgcacaaaggcagtattgacttccctaatccagtttgctgaggggtgagagaattaaattagatatctaagcacagaaattgagagcctttgaaaacaaagataaggagacaagactgtattttcccttttcctgggagctctgggctcaagattttgcaggtgtgtcatctgatccatggcttgcatcgatcaaaactgtgccaatgcatatttaattagcaaggggaccctggatgcattatagccatcatccctatattgaatggactgtcagactctccgcacacttctccacccccaccgtcccctgaacccgtgctccctcccttgcctcgttgtttgggaagcttctgcattttgtctgagcagctaaaaagtttctttgtttttagctgctgatgcatacagcgccactgaggagaatacaaacaagtagagtcctaaagtgtttattttgtctaggaagacaagctaaaccaatttgattccttcggtaagattttcaaaccctgtagaaaaccgacaagaaaagcaaaaagaaaatgaatacactgttcaactcttcacgtatagaatttaaaaaaaaaaaaaagaattggttatattaggaataaagaagacttcggacaaatattttaataatagaattaaagaatactttctattatgatagaaggtattttattttaaaagctctgttttgatacttaaataagacatttgttgttggcaaatattttattgatcagtctaatttgcttgatgcaattcaccattctgacatgaatctgtcattaccattaggaaatccaatgcctgtacaaaagttatttatgatagaaggtgacaaagagttagagctggatgtatttttttttaaagtttctaaggttttgtgggtgtttctgttggtgagaattcttaaagtgcaggaggtttggagttttgccacagacaggttatttcatgggattatggtcactgttcattttcacacaggttccaaagcttgaatatccagacagtgttgtctgataaacagatgtaatgcaccaagtctgcttagaataaagagcaacagactgtgagcacatgtttaggactcatttaaactcatcagcatagtctagctcatagttctctgtctctagtctacttttgaggtagcttcttgctggtaaagtaacaaggaattattttttctctgctacaatttgctgcagagactcatgggaaattcatttgcatacatcttgttacaaagactgactacttcctggcttagacaaagtgttgcctgataaacagacttaacacacaaatgtctgtctggaataaacaacggcaagctgagatttacatttcattatcaaagataatctctttcccagtatatgagaattaagaacctgttctttaaaaccaggtctgtgctcctgatgttttatactagaatcacatcatgtgtcggttggggttgattttcacaaagaaacgaaaaacttgttgggatgtgaagatctgtagggcagaggtaaatgtacattttggggggcctttatgagtttcaaaaccaggttttcttgctttattttatttgaaccacacaacatcctgttaagttaggcaaaatcatcagtagtgtctccattttacagatgaagaaactgagatccagcacagttaaattatatagctgaggtttctaggacaccatctttttaccatttcatactcttttcaatggtggaatatgaatgcaagaaaattagtactttaaggtgctacctggacttaaatagcatgtttacacttgatagagggcattttattatttcaataaaagtttgtgcagacatccaggtacatgaaaataatgcatgtagattataactcaattatccttcattttcatttgaagcatgtattttatagtaggaaagaatacagggacattttctacattaagtagtatagatggctgtatgagtaatcttcaagtatatatcatcctgttgaagaactccaagaacctagtgttaagattaattttgattgtgaaaaaagtgactaaatggggaaattaagcacaattctgctatgcaataatgttgcagggatggctttttaagcaggtctttgtttacatgggagtgggtaggtgatcgggtagactcaataacttgagttctgaattaatcagcaggcaccgctgtgaacacagcgcctcttatggggaaaacaaaattcaaaatgattacctagacattttagtttagtttagtcaaagcgtcttctcaaagaaaatgtgagaagttacaaacttagtcaaagtatcatgtttgcctgtcttttataatcaccagcttcttaccattgacttcatttataacatcactgaaaaagctgatcattacttgaaattcagcctcatgcgaagattgaaggtttaatgattgagtcattttgtcattactttcagagtgactgaatttgtcatttttaaagcttagaaatgatcctcccctcactgtcataacacaacaatagttatgccatttcatttttttctcaacgtgttagaactgtgtatcattctgcaacctccttgtgcatgtagaaaaataacacattgatgagtaggtgataaggcagttgactcactcttcaacttaaacagtcttatcatcgtacacagtaccgactaaacagatgggccctggaataccaacattaatgaaataccagaaaagttgaatttctgtaaatttaatatttcacaaacttgtggccagaaaggcattacaaaaagaaaagttttgagaaagaaaatggtagtaacctagattatgtaacagtcttaagtaggccttgacaatgcggtacaggggagtgactaaggggtggatctccagagcagctggcagcccccagggtggtctggtggagggagcccttccaagtggctgctgcaggaacacagaccttgctccctgtctgaatcaggagtagaggagatgaggaccaatgcgtgcaaactagcctggtccttttggagctaggagttcccctgcaccccgccacagctccccatctcccttcgataaaggacttactctgcatacattaattactgcagttaccgtgtacatatatctagacaaacactcaattctagcttgctgggaaagttataaagatgaaattttgtatttaaaatccagtaatgataagatttcccatttaaagaaccacagagtgtttccatttttaaagcttaagaaaacttttatggtatgactcacctcatcttttatctgttttaggaactcggttattgtacgttaattttcattaagcgggccacagttgtgtacattaattgaccttaaatattagtttggttattcactgagcttaaaagattttattcattctctgtaaatgctaatcataattgcatattttcggtggtccggatttagtaatggtgttacagatttctgtttgttcttaaccagaccatgatggataatattatatttagctgatggtgttgtattcatcaatgtttacccttaagctacaaattgtatatacatgtgtacacctgtacgctgacattctacattctcaaataaggtttttccaatattttcttcacacgtcagtctttaaggtcacggtcatactggaaaaaatagataattttcctaaatattacaaagtattacaataataatttcttttataactgcagctgtgagactaataagcaaaatgtgactattatagttatttgattttctggatttcgttaatgtaataaacttatggtactggctgatcaaaacagagtaattttaaaaattatgttactcataagaacagaattatttctctattacaaccttatagatgtagaaaaatgaattccttggcctcttctgcagagtacttatcttcccaaaccctcagaaactaaaacttatctaaattttgaacatctttaaggtctacagttgtagagggtaactgcttattacactcagagtgtaatcacccttactccttactttcttttacctcagaaatgttcctaactcttcatttatttgcaggaaagtattcactcctgtctttgccttttagtttttatactacaaacaactctagctcatgagagtggaattttcgctttatttctttcactaatatttttgggtttggatgccttctggtttcttcataccgtcttttaatttgggagatttaaaactggacataaaattctaacaaaggctcttcagacttcatctttagccaaatcattatgcatgtagggaggctgaaacttaggctatattatttttctagtggaaccagaatttgtgcttttatggtccatagactttggttgctatcgtgttgatggaccaggaatgacatcggtttgttttagggtgggaagggttcctcaccagtgtgtctgcttttcctttatcaagaaattcacaacagcagttgtgaggattttgaggcagtctacaggcaccagaatatggtgggtttctctaatcattgtaatttttaaatgtgtgaaatattcctccatcattcatcattttaacctgtatacatttctggagggcctcctatgtgtcagatacggcttcagctcagcctctgtgctgcttgggccagtggatcataggaggtgattgtctgcaatttctaaacactgtgtaagatttccaaaccactcacaaaccagagggatatgccctatattcccttgccaggtctcaagaagcaaggcatcaagcagagatagaggactttttgcgctcctttctcatcttagaagtcccactcccctttcaggtgtaagcttagcatatttttcagtcactgacagtggttcagtatcagaaagctgaacaacaattgaaatttcgtctcttcagttcagcagttattgaactccttggctgggccaggcaccctgtggaaagtaccggggataagagaagagtaggaaggaactcctttctttagaagctgacattctcagatggtttgaactcaccttactacagcataatattaatcacactgtaagagatacatttgcaatgaaagagggactggagaggacaaagtgtttaattctaggtgaaagggaagatttagcaatattctatctttgtttattgcctaaagaacataaaatacatggaagggatatttatatttttgcctcactcattttaccatactaacatgtttttgtcattcctcaccttccccaaaggaatactgaagtttcattctgaaggggagtagacctgaggtttgaggagccgaatatgtgtacatgtagcaaatccagtacaaggtttccgttcttgcattgtacaagcgtttggaagcagagacaaatatgtaggcatcaggatttattttattcctttccctagtgattacgttgacagtgaactatctttgtctgagtactccagcaatatagctgtaggcgccataaaactgcataggtggatggctaccagttcaattaagagttcttaacctagcctcccatatgcaaaccctgtctattttaggtttaaatttctgctcataaattttttaaaaatccaaagaaacattgcttttcaaggttaggttgaagtctaagtttccttaaacaaaaagcaaatccctagatagggaaaaaaaattgataaccctaatgtacttccttacaagagcatttccaaccccatcctttaaacacagtgtaagtaaaattctcttcattgtaatatacagatcttctggctttcaaccagtaagccagagaaactcactggtatgggagactcagatacaagaagaacatccagttctatgcagttgggtttgttttctgaggttcctaattatttaaggtggtagaaatcaatcaaccacgtgatatttgtccgaaagagtaagacacaaagttaccttggcttctgacaggtgtctatggagtatataaaggagaaaagtgaattaattgttaaccttcttgatagtgttttaatgcaaatgtttgagaaagagatctttcatttgtatcaattatacctgggtagaaattaatttataattttggtcatctggttggctccacacttaacagcatcagtgaccttttgcaataccagaaagagtgtccatgcatcctcagcagagaatagcactaagactgggtagttttgctccttcttggctgaaaaagaaaatggtattgaacggccgagggtagaaaataattattgaagttttgagatcatatgcattttcttgtagatctttggctttgcttgccccttagcaggatggtgcattttagtatgcagtcctcagatggatagcggtgtctccagcttttgaataaaactagaaaaattaaattccgttttcagtttggctggatgccttctccagtgtttgtatctgagctttcacgagaatgcggcggccccttgcagaccaactctgagcattttcttgccactcactcctttgctgttggtttgcttatttttctgtggcttggaattttaaactttctttggacatacctaatattcatcttttattgttgttcatgttttctattattatgctatgtatctgtaaaggtaggtgacaaatttaaacaaaaagtgaaaagaagaaagaagtctgctttcagattaaataaaaaaaatttagggtctttcctgatccctttttgctttaatattcatggataaatatcggaaaagtaattggctattgtatatctaataattgagataaaactattttccatttattcatagagaagtgattaattataaagatattacacatagaagtagtacatggatagagatgtatgtttgctagtattattccaaagaaaatattatgtttggcaaaattttatgtatctgtttcgggacatgatcaagaattttaattttccctaaaacaaaattagatattttgctttcattttagttatagaaattaatggtttaagattttccagaacaaaaacaatggaggcatgtctttctcctaaaatacattgaattactactcaaaatatttaatgtgtaatttctaatggcaaaattataggcttgtttcctagaagaaaaagaaggtagtcatgctgtattttttaattgtttgtgatatatataatattaatttatgtagttaaaattttaaatatgggtcaatgtaaatttgtttgcatttctaatttttagtctaggttttgtatttttgtagtttattctgaaggatttctttaaaggtttttggcatataataatacattttgtttgtgtcttctctgtggcaattgttacagaacgataaaagctgtcactttgccagactcaaataaaaattcactttttagcatcttctgttatttaaacctttgaatcaacatagaatttttgctatagtcaccaggttaagattatctgaaaattttaaaatggatattttttgctatagcactttcttataagtaaaatcttcgtttgcttaaaagcagggagtcttttaaagtaataaattagcatttctagacctaaggtcactagtagtgccacttctttctgcagcatctccaagaaagagaagggtgatgctataactcagttgctatagaagtaatattttctgtttaatcacagttaagtgtcatgaccttttgaccttacattaaacttgcagaaatgtggttaaatttcaggcagctaattcaaaacctgtgaagtcaagttgaagttaggatgcaagctctccgcagatacagaggttttgttgaaaaaaaatttttgtgtttgcttttgaacaatgttgtaaacgacttcaagtctcagaaaacgctttatttttaaatcaaaatttttccccttgaaacattttgcctgttttttctctcctctccccaaaaactgtaccataaatatgcttgtttctaattttgtgaaattcttttgatctaagttaattttatctaatttaaaaattaagttactttgattttcccttatttcatttagaaattaagttaatcaaattccttttttagtttgaaaatatgattatattttttaaattaaaaaatgtttaattctatagaggtgtacaaaaatctgtttttgcaaacaagtccttttaggatctcccaaatgcatcagtacaagaaaaaaataattcttataaagcaggggaaacttgtaccttcagaaagacttctttgagttatgcagttatttcaagaaaatgtgatggaatattaggactctagtatttaatggtgttagtctgcgtagtctgttgctggaatgcagagctaaatatcaacagaacttgttactgttgtttgggttgcttttatataccagcttcaaaatatgttttgacactttattatgttctgaatcaagcttcagatgtgtgtaatgaaggatgaagtctttatcagactcgagtgtataaatagtggagaagagcagtttggaaatggtctctctaagagaatggttgctgaagagcttcaagttgtgatctggcaaaagccaatgccaccgtaggtgtccgcaaaccggagcgtcctctctaaaggcacaggctgctgctgcatttccctctctttcttttctctttccatcttttctttttttcatgtctcatgtcatttctgtaatgttccctttcttagtttataggttgaaccttttgagaaagtctggcacctctgatgcactttcccttgcagaccctgtaatttttggctgtatttttatgtttttcagattcaagtcaatctgaaagtcccagccagccaagtgacgctgacattaaggaccagccagaaaatggtaagtttagcttgggactctagctgctgctttcagagtccacagcagccagcaggccgactaagtgtgaggatttgggggcctaccctataagtagcccacagtaggaacaactccaaagactcggaaaaactcaagtagattacttttaatagggcagcttcttgttctcgggatcaccccagcagcctcaggacccccggccctaaacactattagggtgcccatgagaacctgaattcccaagaacgttgattacccaattaaactatgagaagtggggttaatttaccaaatcagatttttttttaatagcattaagtgaggagtcatggctttttcatttcattttagttctttaatgtggcaaatgccccatgatcatcttcactagtgatttaagatcattcattcacaagcagttttaagccttttgggagctcaacactttgccaattcctttaagaaaaaaaaaaatatctatgctttgaaggatttttctaccttaaattgtctaaaataaaatagtgaggatacagggcagcattaaattccactgctgcataaatatctaaattttctgttgcagatgctttattaaaatagaacatacattatatatgaatatcatagtatctggtaaaatttgaattcgtggcaggcactacaagtatgaaaaatactgtcatgggttggagttttatattgaataaaactatcggtttcaataaaaacagagacttcagtgaactagcagtgcctatcatataacaaacattgtgttacatactttcacagatatcatctcataaaattccaaaatgttcttctttgctgatagcactgaggactctggtggaatgctttaccttgaagggcctgtggggagaatatgccattgtgattaaaagctcaggctgtgggctgggcgtggtggctttcacctgtaatcccagcactttgggaggctgaggctggcagatcacgaggtcaggagttcaagaccagcctggccaacatggtgaaatcatgtctttactaaaaatagaaaaattattcggtcgtagtggcatgtgcctgctgtaatcccagctacttgggaggcttaggcaggagaattgcttgaacctgggaggcagaggttgcagtgagctgagattgcgccactgcactctagctctgggcaacagagcagaacatctcaggggaggcggggcggcggaagctcaggctgtgacctgcattcaaattctgcctctcctatttcttacctgtgtgatactgaataggttatttaacctctcagagtattgatttattcctctaaaacagggtaataatattacctgtttgttgaagagttaaataagataatatgtgtaatgtgtttaccatagtatctttcatagagtttatgctttaaaaatgtcagctgtggttcattatgacttttattatttttcttgtcaatataattctgtcatactttgtttttcacccactttgaatgaccccattgcttgagtctcttccttttgttgttctgtacattgttccatgttgatctccatccaatcttttggaaaagataggcaaacggaattatgttggtattgtggggtgaaggatcaagtttaccacattagctatcctatcactgatttttcagaatatgtttcatttcctacccatgagaaatttgattacattgctggattctagcattaaatatggactgcctggcaattcctctcctcatcctggtattttggtgatattttctttatcaaagttgtctttttaaagcaggcagttaaaaaaaaaaaaagagagaactctggaggtttgtttttagtgtcatatacagctacatcttattttttgttgacattttaaagagtggtatttatagactagtttcgttctttattttccacttgacttgtaggtgatgtcttcaaagtttcacttttttctacatattgtatttgtgcataatctccctaaagatgtctccagaggtataattttattttcatcttcaaaaatgtgtggactgtacgggtgtgtagttcgcgtatttaggtctggccgcccctctagcaggcctgtgattcatctgtcttcataaaatggccaacaagctgttcacatgcaaatataaattgagagcatgagaggcctggcatgcctttctggagctgcctgcaatcccaatattgtgtgtttcccattccagaaagcaaccaggattgagcctggattttttggccaaaggcagagagatactagccaagttcacttttaacctcagatcacttgatgctactacctcaaggatttacactatcattttggggaaatcatgtgagttcaaagaaagaaagtattaatatctaggagataaagtaataaattcctatctttcagttttctatttgtttcaaagaaaaagtagtagaagctggcttatcttagccccagttgaagaattatcagcctactcagttttctgcctcttgtcaatctcagatgaagttagtggaggaaaaatgatttttctcttttccttaaagacacgtaatcccaaaaggaataaatgaagattcagggctgggtatttacatgcattagataaggttctactctctggtgttgcgttgatcaagagaatgtttcctctttttcattacctcaggatatgaagatgaagtgtgtgtttcgtttttgttttgaaagagggaactctcataggtgtatcaacaaagctctaagaaattttggaatcttgctgattgaagaagtaacagacttgattcttcaaataaaatgggaattcattacttcacatatatgtatgtgtgtgtatatatatatgtatgtttgtatgtatgcgaaaaaataatattctttttatcctagctcttgagaaaggtaatgggaaacgaatggtatttccctagtaaaccatggagaatgaatagacaaatggtaacacgctgtttcatcccaaaccgtaaactgggccatgtaactttacataaagtggatgcagctgtttcttccctgtccaactagtctgctttttctgtggaatttttgctttcttttcttgtactcccttaagactcaactgtaaaagaaaacaaatctttgtccaattagagcattagatgggaattttgaaggaattatctgaagcccagcgataaaatatcagaagctctgaaactcaaaattggtataatataatgggtaaaaactctgcctctggagtcaaaaagacctgagttcaaattaaataatagctgagtgactgagtaaggtacaccccaatctcagttttcttaccagtaaaacagaaatactaaaaggaggccaggtgcagtggctcacgcctataatcccagcactttgggaggctgaggtgagtcgatcacttgaggtcaggagttcgaaaccagcctggccaacatggtgcccgtctctactaaaaatacaaaaattagccaggcatagtggcacatgcctgtaataccactactcgggaggctgaggcagcagactatcttgaatccgggcagcagatgttgtagtgagccaagatggcaccacttcatccagcctgggtgacagagcaagactccatctcaaaaaaaaaaaagaaaagaaaagaaataaaatactaaaaggacgtatctcatgagtggtaaactgagaatatgcatacaaaatagcattctgcctggttcacagtaaggactcaaaggaaggttaccattactaccttccagttaaagcttgtcgtatttacaacgagtacgtatattcaagaggtccaaagctgggagccttggagtggaaggggatggcgtcagaaatataccaagacttttagagacatctttagtgggtacttaccctgctctgaaatgtcagacatgggtttcccaaatccccacaatccccatggtgccacgtctgttttcccattttgttttatcctcacaatctgttcatctcccatgagtttgagaaccagggaattgcaaaaaggattcagagttgctggaaccttcagaatgagtgctcaagaaggtgattctggaaagaagagacttctcctagatgtctttaattttagctgagtttttccttggcacaaaccaaatagaatctggcttattaaaaactataagctgattaagggtaggatttatgacaaattccttttaaaaaaaatcctgcacagcccgtagatctgtgccttgaacttaatgggtacctagtacttatttgcttaatgaataaaattaataagtagatgaatatattgtcattactcccaaatatttttggagtatctgttcactcttgatttacctagagattttaagaaaaacaaacaaacaaaaaaaacaaaaacgctctggagaagctgaaaacctaatttgggtgtgggggaaggctgtcctcagacacatggacagagattaacagatataactagtaggtctaggaagccaaagctgagggctaggtactaatgggaataggacatcaagttgtccctctccccttcctgcccgcccccacccccacttcaatgagcaggtgtggtcagatgtttgaaacatcaccatttcagtttatgcatgatgcttgattaccgtagggaatgcagttcagacaaagttcctagctctgattggtatcatttaatcctttgttatatcactgaatctggcttttccagagctcctgaaggttttaagccttatttgttggactttgacttagaacatcgatttaaacaacttttgtgaactcccatgacatactttggttactttaaacatatttatgggacagagcatttaaaatgcctgcctgatatttacagggcctgtgaacagtcctccaaagcttgcattctgtggtgtatcaggtcagtcattaatgaggataaagctcatgtgatagccttcttacttaattcaaggcacacttctgtagggctgcactgagtcagtgtctgaggcaacagtataggccagcgttggcactctgaaaacacacccccactggctctcactgttatccgtgaaagcatccttaactaaaaaaagaaaatgtggggctcccttgccagaaagtaatgctatcttcacctggttatttttcccttctatttgccatttctcatcacctgcacagactgctagtaataactttatcatagtggtttttaaaatgtgatatttataacaagaaatcagaattggtatttagatgatttcctttaggtttaatcatgtttgttcctcctcatttatctggtagttgcacatatgttggtggcatcaaccctcagatgggtctttgcaatcagtggaagcccattaatcatgatgcttgccccagattttgaaaatttccagctctacctgccaatttgaaaattaccctgtggagtattggttgaatctacctttcatgttcaccatcttcatttatgtcgttcacatcctgaattgttaaaagaggtatcattgttaaatgttgctaggtgaacaaggaatgtacttcttttcatccgtaattgttgctatttcatgcattattatttaactcattgaatttttaatgtttacgaaataagttttagtgcaactgacttcctgacttaagatttatgtgtagggctggacacagtggctcacgcctgtaatcctagcactttgggaggccaaggcgggtggatcacttgaggtcaggagttcaagaccagcctggccaacatggtaaaacccggtctctactaaaaataccaaaaaaaaaaaaaaattaaccgggcgtgatggcagatgcttgtaatcctagccacttgggaggctgaggcaggagaatcgtatgaacccagaaggcagaggttgcagtgagctgagatcacaccactgcactccatcctgggtgacagaacgagactctgtctcaaaaaaaaaaaaaaaaaaaaaaaaaaagatttatgtgtaggatttactttgtaatttggggctgagaagagaaacctataaatttctttttctcttttttgatgaacatttttttatctgacattattctctttaaaaattgtgggccttcttgtttaatgttttaaattgtttttactacctcctcacatgtatagtagatatattacaatattatattgcaatatttatatatagtgggaaggcaaaataaaattgataattcaaaactgcaaaaatggtcactgctggatggactgcttgttttaggaactgttttgatgaatgtgtcatttagttgggtgatttaaaaaaatttggaggcaatgcaaccttacagtttatgttttactgggaaagaaggagcattctagcaccattgacttgtaaatgcagtttatcaatatttcataatttgcatgactttcttttacaattacctagcaacagttcttctctgcagtgttccttcaaaaaaccccgcagggacagacacagtagagtgaccaccaaaatagcagcaataacagttatgatcaatattctaaaatatgtaaaggtcccaactcagggagacattaaaacctaaatgccttctggtttccagatctgtataattaaattctgactgatgaattttcagcaatgcaatggagctagtctctcttctttaagagattagggaactagaatttggtttcatctgaaatttcattctgaaactaggtgaattttgctttcttaagaattgttagcaggtgtgacccatcattgtttgcaaaggctcctcagaaatgcctccagacaaaggaaattcctgagtctttctctgtgaaagatgaggtgccatcctaggctgggggcttccccaagtgcatgacgcagtggaggctgcagagcttaagccacgggatccagtgtacttaaggcgccttttcaactgaaaaatggggggtgtggggggagatttgtagccattttaaagtagtcttatcctcacacattatgagtattttattgtcttcacacagagaataactagctgaacagactttaggttagttggctagtagccaaaataggaaatgttttagatcctattcccctgattttcaggttctaaaatggactgactgggtggtctgtttcagacatcttcccctccccactccccccacctccaacccttcacacacaaagagttacacaggaaagaagaaaaaaagggatttcttgctggtcctcaaattcgtttgtgcctctgactcttatcccaggagagacccagaagtgcctattgaatgtaacgttccaagtaggaaagcattttaaagtgtgtatttagaatgtatctggaattgcgtaaatatatacatagatctagattctaaaaatatgaaaatatgaagcaatacaatttatgcagtatttgaattgggctcaaaaaggaaatcaaatgaggagccgtcatcaaatcacagtgcggtagaaggtgcacctggtgtttggctacagctccatctgccattgctctgttttccctgtgatctaagcctggaactagtatgacaggaccctttgacagagatatccttagaaggaccacttctaatggccacttttcatacctccccatcaattaaaaaccagcgtggtgaaagatcagaggggcgagctggggtcaggaattgggtatgagctttccttgccacaaataatagggtcacttctgcttttaaatttgaatgtgaatttgttgtttttaagcctgtacattattttttggaaggaattacctatttgtggataatattagtaaactgaatgtaatatacataatgtatttggggatttggagtcactaatccagattgattagttgcctgctagaaaaattcatgtggccacaaggatttttggcaccttttctccctgcagcttcctcattctttttctcttcttcaggttttactcagctccaggcaactcttttccccctggcattagcttgtcgttaaggaaatctagtgggatatctcaaataggggtggagggtagggggcactatttgctgcagattactctgccccatctcagttgtgcatttctatacttggttgattttaacccaaagggaaccagggagtctcatatggcttatccacaggcatcatatggtgaatatccaaaaagagaaatgtaaggatattgtggcaaggctcggcaaaataggaatagcttttcaacaatctttccacgaaggaaagtcagtgttttcttagatctctgtaggtattttacaaccagagagcttctcagcaagtagcacttgtaaactcagagatgaacaagaagaagccaaatcacagcttccgaataggtcaaattagcaaaagagacttgccattaaaagcctgacactgagcgtctgttaagggaaaatcagttgtccaagtcacttaaagacttgtacctcaattttctcataagtaatttaacagatcattcttaagaattgctggataggccgggcaggatggctcacgcctgtaatcccagcactttgggaggccaaggcaggcggatcacgaggtcaggggattgagaccatcctggctaacactgtgaaaccctgtctctacttaaaaaaaaaaaaaattagccgggtgtggttgcaggcgcctgtagtcccagctactcaggaggctgaggcaggagaatggcatgaacctgggaggcagagcttgcagtgagcagagattgcgccactgcactccagcctgggtgaccgagcgagactctgtctcaaaaaaaaaaaaaaaaatagaattgctggatatatttggactaggtattggatgtgttaagggaatacagagatagagcagacatcctgctcttgagaacctgatagtctagtaaaagggaaaagacaccatttgttcgttcattcattcaacaggtatttatcaaatacactctaagaaccaggcatgttctaggcatcacactgagcaaaacagaaaatcctactcttaatttagcttaccttcttggggaaggagacagacaatcagctgattaatacacatgtcacatgccaagtggcatcaaacattataaaagaaaataaggcaatataagggattaaagaagggaggatgtgggtactgtcttataaagggtggtaaaggaaggcctttctgatgtgttgacatttgagttaagtcctaatgaagtcaaagaagtgaattatgcagatattagggacttttattctaagaagagggaacattaaatataacagccctgagacatgctggaagaacactaagggggttggtgtggcttgaagggtacaaacaagggagagaatagttgcagatgagtagcaggaaggcaaatcatattggatcttgtaagccaaggaaaagatatggcacatccttgaaaagccatggtatactctggaagaatgcacatatgagtccattcatttcttggtacagtagatatgtcctgatcccctacactgtgatagtcactgttctagataatgagtgttcagtgggaagcaaagtagacagagtttagtgtggagttgtacacaaagacctcattcatagcattgttaaggaatgagactctgatttgtcatggcagtatcttttagtacctccaaaggttttccctcgtgcatattactaaaagccaagttacttgcatggaataatatttggtttcacatacccaattgtgtaaacaattatttctcaaaatggaggtcgaaatctgtggagtttcagcttacccctgctctcgtgaccccattagattataacccccaggtctcacatacattcaccatgaaggtggattttgttcctaaatagttgccagatgtagcacaatggtggctcacacctgtaatcccagcactttgggaggccaaggcaggtagatcacttgtggccaggagtttgagaccagcctgggcaacatggcaaaacccgtgacagagcaagactgtccccaaccccccccaaaaaaaacaagatgccaagttaaatttgagtttcagataaacagtgaataattttttagtactgcgtgaaatatacttacacaaacaaagtattcattgtttgtctagaccaagttttgtattttatctggcaaccagttgtaattctccacatattcctgtggaggttacataggcaatagtaacagcagtgtatgaaaaggtttgattagtctgtgatgatttcactgatcacaaaaggtcaaaccactggaatttaacccactgaaaatgaaatctgggaagagtactacaaagttctagtgacttggctgcttaaattccattccttccgcatctgctggtacctagcccagtagttttcttggaacaataaaccacttgtgaggcacagtcaataggtacaatataatagttgagagccactcagcccatgcaagtgagtgtataagtttaattagtcgtgtattaattgagtaagccactgcgacactgtgtgagcccatacatccagttactggcagaccatttactcacgaaagatgatgaaaataggaaatcagtcaaataatagagcatttggaattcgcacatccaaaggtgaagtagagaaatggcatttctgataaacttgaaaatagaaggggccatatttttcatgtgcaatatggaatgataaatgtatatgttttcatctgtaattgggacaactttgctaggtatgacaaatcttgtttgaacatgttaaagaaatatagtgtaacctttgaatcctcctgctttaaaaaagaatagtgttcacagattcaaggaaaacaattttggaaatagggttaaactctattaggcttaaagccagataataacaaaaataatgatttttggtgataataatcataatagtagctcacaatcattgtggactttctgtgtgccagtatgttagtttgggtcctccaagaataatatgtcctgataggacaagagatttattggggcaatacctatcaaatataaagggggacagagcaagagtagattgagagaacttttaggctgcagtacagttctgacaggtgggaaaggaggagggaagaatgagagattgggttggaagaatcccagagctctcactcccattgcctaggctggagtgcagtggtatgatcatggctcactgcagcctcaacctcccaggctcaggtgatgctcccacctcagcctaccaaatagctgagactataggcacacgccaccaagcccagctaatttactgtatttttagtagagacgagggtctcactatgttgtccaggctgggttcaaactcctgggctcaagagatccacctgcctcaacctctcaaagtgctggggtcacaggtgtgagccactgcgcctggagtaagcttctaagaaaattttgaccatgccaatggagagtccctgagcttaagtcccctgttggaagaattctgtgttttataggaatgggtctgtgttggtatcctccccctcagttattggctggaaacagcctggaggaagtgtggcctttaagcaaatgtggtggtggattcagaggagcagccctgttaggcaaccatgttccttgcaacaggtggtcagggtggaccatttttattcatggccaccagagccatgcactgtgctgagttctatattcatgatcttatatcatcttaatataatcctatggaggtaggtgctattagtgtgcccattttacagattaggaaactgagacacaaagaatttaagtagcttgtcctacagtcaagaaggcataaagggtattcagactcaactctaagtccagagtcttaactgcttaaccatggcattctattagagaaagaatggaattcaaactctggttctataatgtattgattgtataaatttgaacaagttatttaaactcttaaacttttattttctaatgtataaggtgcgatgtcatcaccttcccaggaaatgtgttttcgttgctgttttgttctgagcacaaacaacgttagttccttttccttcctcttgttttgctctcatctaggattgtcatctcttcctttatttcttatctcatcttcccaggtatctgcctcagccttgttcaggcacccacaggcttaactacatcctcagaactaacaggactgtttctgtgtggattatatgtctggatgtagatatgtggaaagtgctgagcacttgcaacaatccataaatagatactcaataaaatgtagctcgccttctctctcatccacctcattgcctcatagacatgaactaggtgccagggacatcttctttttaagtttcttttttttttttttttgacaaaatatacatctttatagaaaaattacattcttatttttttatgaacactttgttctttttttctacagtctcaagtattatgagtatatggtactttaatagatatttttaaacaatggactgagttttcatttgatttttctgctggaggtggagactataaaatgaggttagttgcaaggtatttataccagatgccattatgtttgttagatggcataaaacaattatgattgccaataaatttaaaagtgtttccgttgcaaaagatttaggagtatagttttactgaaaacataaaatgtttcttttcattccccattttttgtgcagtacaatagaaatttgtgccccattcctttcattttagatttctgaattatttaaaagaattggttaattctccatttcaagtgagcaagacaaagttcattaggatatctgattcctagcaggtcccacattcacagatcatgttaactccatagagaggtttatcttcttttaaaattacaaatgctacccacactgaaagcttttcagtttaatgcattgttacagctttgaactcttcagtaggatcctaaacaatagaaagaaggaaaatgaagcaccttgttgtccgagcttgagccagttctaaaagtagcagtgcagaacgtctatgtcctttcaattctagtggatttgcaacacaatatcatgaaaggcatgcaagtaaaccttagcacgtgctccaccagtagttaccaactggtggtccttgaagggagccagaggaaaaatcttaaattatgcattttttccccttatataaagctgcactggctgaagatttttgcttttgactttatgcttgtgaactcatgggttctcttatacttacagagactctggcagttatagtttggattcatttaatgaaaggtaggggaatgatgaattatctattatttagcaaagatggtaaattaaatactttgagaagctggccttatgagaggaaatgattacaagttgtccttaatggtaagaagatacagaagcctgtgctgtagaccactggttaatagcctttaactttatcttaggaaagacgaagaaagaagagaaaagcaggtgctaggaatagccagtcaagactggttgttgcaggtgctgcccgtcatctccattgtacccctttccggtgttctttcagcagatattgttgaattcagttctatctgagcagaattgatagtgaggccgatgtggaaagcaactcagagtaggagactcaggtggtacttctgtatgtaaattgactaggaaagcataactttgaaacaaaagattctaacaaagtttcatagcccaatcacatgtaagtgtgtagaacatttgagttttggactctgatctctgtggatttttttctgtgcattcataagagaggcacaaaaattgactgtggtcaaataatactatgtactgtaaactttagattgtttgaatatgttaatttgatgtaataattctaagatatagaggacaaggaaactgaggcttggaagttgaggcacatgttcatgatcaatagcaagtgagtgcctgcttcatctttcttgggagagctttgagaataaacagggataacggatagtggtgtgctttgaaatgttttgtactcagcagctataatctcaaataatttgtattgttaggttttcaatgtattgactattctgtccccttaccccagggaaagtatagacttgaggtcagggaataacaatggcatatgacatgtaagtatggtgacataatgtcatatgatatactacataatatatgtattatagtgttacatgcattatgtattacattattgagtaaatatgtattatattacaatgtgtaatctgtagtccttataatctattaggactttgactgaacaccagtcaatgaaaatagtaaatgtcacagtatactgaaagcgaagccagtgagagagagtctgcagaattccacattttcctcaggatacctcgcagaccatgggtgacacatgaccacctgacattggtaccaagtgagggagaatgcattattagaaataaacttatcgtttttcaaagacgacttatttttaaaagctacagtataaatggaagctccagtgatttctttggacaccgcaaatttgtgttttaaggagaccactattctagactatgtgctccctgagggcagaaagtagtgtattatattccaaacaaaatggcactcagtaaatattttagggtgaatgaatgaatgggtaaatgaatgaatcttgtgttcaggagtttaagtcttttcaggggaaaataatacataatcataagttattcccctccttccaattgatctttcttaattgtacatatatttattaatatataatccctgtgccaggcagtgggcatatccacataaaagagaaaccaaccccatactccttgagtacatattctagcaaaggatacagatatttaggcagatagttgcataaaatgtgattgtgatctcctaaagttatttggatggtgtttggggcatatggtggaggcacaagtgataaaggctatgcaagaagcaacaaaagtaaagttagaagtgttcagagaagagcttgttaggtatttgacctaaatgctgaagtgtatacatgttcctagatgttacttagagctttcttgctccttaaaattagctcaaaccccccattccacaacctgaggaaatctaaagcctatcccagtatttctgtgcatttctggggatgcttacagcaaaagttttcttctagctgtcagttcctgcacctgctgagttagtttactttatagatcttcccccaagtcgtgcaatgctcttttccatgtcctgtgcccgtatgttgggttgagcaccttctctgtatttctgtctgatctacctgtagaaattatgtgtacagctggctttggtgaagttgtaggagggcgagtttgggcacttcagtaaagtctcagaacatactaaccgcatcacattgattttaaacaactctgtttttaagagcacttaggtcactctgccatgttaccattgccctctcttcctccctccctctcttctctgagcctctccttgttcttctttagttttccttgagccttgcaaatttatgttcttgggaatctcctttgtaaataagaaatgtgccatcaagatatttcccaatcaatggattctggcactcttgacaaaatgatagatggaatttgcagtttctgtgtgtatgagagggaagatgcaaagtccttgttaaacaaaaggaacattatgggtaaaggcctaggggcagaaaggacccagcatgtaaagctgcagcttggctaagacatagtgtttctgaacagtttcaaatacgccagtcatatcatgttgaattcttggatggccagtcacccagcgtgtttcccttggaatgaagcttgctgactgactggctgacagctagaaagcatccataaatgagagatggagatgaaattaaaatgtgacttctttggcatccacctttcgaacctaggccttccccactttactctaattcaatttagtagatgttggatggaaactaatacagttaaaaagaacttcatgtaatctcactaacattcttagaacatgatgctcaaggttttctggtcaaggatatttgcatttgcatttatagaatagttaagagccagaattctatgcatgtgagaagtccttgctttgagaatgacatttccaagctgtcaaaatctaatgtgctcaaagctcaaaccaaaattgctttttattctgtaaatattgaagagaaggcttagagtggcaccagtgaagttgctagccagggtactagcctactgagttggaatcagaaaaagtccatttgttgagtttaaattataatacaatccaagcctgagggatgcagtgaaaaagtatgaccagtggtcagattcccacattttcctgctgaccacttggtcactttgacacagtttactagagaagtttgatttgcaggtgtgtaagcacagtacatgcatctttgttacttgactcttctcatctccaatttcttaatgcttacattgaactacaaaaatcttcacatgaaatcttcccatattatattcactcattcaaccaatatttatttattaaacatctgctgtatggcagatactgctccaggcattagtcacaagagtgatgaagcacagaaaagtaaagtttcatgcatccaatagcagattcattgtagaactgagagccttgatgttcggttccttgtccagctttctttctcctacatttctactctgcttttcttacacttgctgtttcaccaaaaaaaaagttacttgaaaggcgattgaaatcattcttttcatttgccaataagttgtaaaggttattggaaagtcatttgtgtaggattttgaatcagtttaacacagttttcatattacatttatgtgtgtgattttctgaataatgcctttaaaggcagacattaagtggattgcgaactccatgaaagcaaggattgtttttcttttttactcactgttttctctttagcacagtgcctatcccatagtacatgttcaataaatatttactataaatgcagaactaaatgcatttcttatgcttcgctatatccctgttgtctggtgcagtgtgtgcagtgtgagctctctctgagtctgtcgctggtaagatggtgaacagtgctgtccgtattcagtggacttctgtatagagcatgtcattcccagtctatctcgatattcagtactcgatattcagtacttaagtgtccagtcaagcagcttgtagttttccttgctatgttggggtgggtactctggtacctggaggccccctggctgcagacacagcaagatggtttcgagcagggtgtgaaatgtttgctgccagtgagggagaaaggtttgccttggctaggagtagcaggatttcaggctccacatctgggtcttccgtctacgtcaccaccaccatcctcatatgcgcatagccatcagctgtcctaagtgcagcactctgacagaaaattgtatacgaggcagaggtggctgtaactagtcaaagtgtgagagaaatactcattccatggcaaagctgactgacatgaagagatctttgtgctgagagagattcagcaaagggaggccagagtaaactaggagtgggctccgggttagagttgaagcaagaacctgtatgaaaagaaaggcaatgtccacctcatatttcctagcagacataaaagacatggtgtctctcttgctcagtctttttcatcatcttactgggttcagaacatgggtaaagttcgaagtggtacattggataattctttcgggcagaactttgttgaaaggaagagtgtggtcgtctaattggagcttggcaagtgcaagggtgggagagaaagggagaccctaccttgactccaccgctcacctggctgtgaaacgctttaagaacagaaacacttactaattgtaactggccttaggaaggtacctgacctcccgtgcctcagtttcctcgtctgtaaaatagtcacgaatgcttcttgcccttctttgctcccaaggatttagtaaggatttaatgatatgatgtatctgaaagcactttatgaacaatcaagccatatgtaaaatgagctattgtaataattttgagtcattaggaattccttcatttccatcccaggtcccctggacaatgctgagaaaccagtggctatattgcatattttcttttcagcccagcagtactcattttcaggttgaatatggtaacaaagctgttgcataagaaatgcacactcctctcttagggggaacattctttacattcagcacaccagtgcacccccatgactgcagagtactgcagggtactgaaaggtgtctttctgtgtttaccgtggtatcactttcaccctctattctgaactgatctggcattctaagattttcaaacataatctttaaaagtataagcatccaaaattacctcaaagagccaaaacaaataaatacaacactgaataaatgatgctccagttgatccagaatacacttaagaaatcttttgactctgttaacctatcagtatttgacttcagattgactcgtttatttattcttaaactcccttgaatctccaggcttttttcttatttgcattgagtatgttctccccattgacattcagatcactttgaattggcttttacttaggcttttcttttttggagacaatcagctcagagacaaaataggcttaaaccacaaagatgttttagtaaatagatacatttcattagttgctgagggctgtaggaacacagttgtcccaagtaatttcttctttgtatttggtgatcttaagaggaaatattagtgtcctttttcttaagccactggtctaaaatatctgtcaagcataagatttaaatccctgacaaacaacttctaagattttagaaaaagttttgagtaccttgtgattccaactcttatctctgcttttgagcctcgatttctaccccctcgtcatagtccttacccacctgtaactttaagacatcaaagttcattttaaaaaagaaaaaaataataagtttcatagaaagaaaacctctcatatatattgggagggctaagacaaatatgtttctcttttcatgcatttttctggttgaactgaattctttcacctcctcttagaaaagtcttcgactgtgccagctagaagtacggcagaatgggtaaagtccagccttgctaagacaatttttttggtctgtggtacctacagaggaggttcttacttataatgtgaagtacatggcataaactggtggagaagagcttccttttgttaaatcgttcatttattccactggcctaatgaaagttatatgaaccacaatgagtcacaacaattaccagtttaattcattttttaccctgtatttatttaaaaggtttgctctataaatataggacctgtagataaaaggtttctctaaaaatcactctcttttcaagatgttttcattagttagtattcatttaagtgggttctactctgcataccattaaaggtgtgtgtaaatgtttttattggtttcttccctatcttccacttttgtatttcctctataagaggcagtgccattaaccttagcagggctgagtgtgattgtctttcgatcagccccatcattgcaaaccactgacccatagcttacattacttaaaccactggttcctaaacagaaaaatagccccattaccttccttggaatggtgatgggctgtctgaaaagtcctttcaaaaagaagagtgagcaaaaatactccctacttcctttgagaatagtcctttctttgatataaatgttgcggtagtagtacctgagtttcctattttaactctacatgaaacatttattgagtgtctgctgtgttcagggtgctgttgaagacacatggctatagcaacatgttttggatgcagtcctttaagagccatacttttttatgcaggtgataggcaggtttgcacctaataacaatgcagggtaaatatgctaagtgctctaactgtgaaacaaagtgctctgagaatgtggaaaagagaatgctttaattcagactttagggacaggaagcggaaagttagatttcaaccagcagagaagggtaaggaggatagagaaagaggttccaaaaaaataaaaaagcacccccaaaggcatagtgtggtctgaaagtttatgatgagcttggataatcgccaagtagtgtggtatggcctttgcaaggtaatgaggggatggaggtaaggcattcatgcttttgtataactgatacggtttggctctgtgtccccacccaaatctcatctcgaattgtaatccccacatgtcgagggaggagggagctgtaattcccatgtgtcaagggagggaagtgattggattatgggggcagtttcccccacgttgttcccataatagtgagtgaattctcaagagatctgatggttttataaatggtattttcctgtgctcacacacgctctctcttgcctgccaccgtgtaagatgtgtctgcttccccttcaaccaggattgtaagtttcctgaggcctccccagccatgcagaactgtgactcaagtatacctctttttttaaaaaaataaataaaataagttacccagttcttggtggtattctctatagcagtgtgaaaatggactaacgtactacccttttagataatccttgcagcataagacaaagaaacgatcagttcacctttggccatggactcactgtcaccagagcttgctttaacccaattctgtagttcagccagtcagaatgttggtagaaaatgcattaaatcaggaacccagaaaacaggcttctattcctggctcagctattcattgactatgattttggataaataactgtttctctctgagccttggtttacttccgtaaattggagataataatactacctacctcatggctgttgagagtcttaaatgagaccatgcctacaaggtgtttagcagggtcctcagcatatagccagtactcaaaaagtagaaacaacttaaaaagatttttatacttcattgcccatcttcattgaactggactttattttacttattgataacttacaacacgctgggagaaacgtcccggtgtttcaaagtgactgcgttaacttggaaaataagatcctatttatttccttccgagtaatagtcatcctaacatactgctcacttgtgtttgtagagtagttattttgaaatttttgagacctgaacttatgaaatgtactttcatgcatttctaaaataattgtatactagagctcttttccattgcttgacagttgttcatgagtgttccagtgagtttatagaagctaaaaagaagatgatcttctctagttacattctaagtgctgaatttttccttccttgacagattcccatccggtatcaagaggctctaaagatccctcaaatcactgttggcatttagtgccattccagcaattttgcatcttgatctttttattgattagaattttaccttccttttcaatcttttgaactctcttctgaactttgaagactcaagtgtttgaaatcttgatctgggtctgtcttaggctatacagaagagagctttaacttatgtttccaaaatgaggccactacctctttaatttttctttttaatttaatctcaatgtctgtagaagaaaagctttcacttaaagcacaaactttatgaaaagcatttttgttaaagggaaatcttaatgggaagaactgtagataacaaatttgaggaaaatgtctggcaacacagacttctgcaagtttgaggctcttggtgaaatctcaaacagtccaaatggaaaattacccagtctgtttcctcaagatagacttgtttgtacagcgactcaaagtttaaatggctgaacagtaggtacacacgctgtacttataagctgtttgtattacaatgctctgtttttaacctccttttagtttggaacacaagctggttaatgtcttagttctgtgcttcctggattattagtgaatagctaagttgtatttaataaacagaaagaaagtaacaaacaggccaataccttcactgagaaagcttctcatctctgagatttttacttctgtttgttatgcagaatattttaaaattagataatgttttatactcatgagatgaaagagttttcaaatatctgagggtttgtgagtatatccgtatttttgagagtcccagtaaaagtttctggaacttacaaaaaactcatccatgagctggccaggtcctctcaaggagcaaatcaactgaggatgacattaaaaaaaatttttttaacttgtttcaacagttgttttccgcatttccacagtaattaccatgcttaccagtaagatacaattcatctctggatcatattttatgtgttttaggcaatagcagtgatagctaacaattacactctagagttttacaaaacacttgcttatgcgttatctcatgaggtacctgacagatcttctaagtataattttatgatattccagcagatctataccagtttcactagagtatgagtaataagcatattgaatttttaaaaattgacacctgtctgaaatttttaagaacaaggccatttagaaaattagatttcaagaactctaaatacttacttatattatacaaaaatgttacagaaagtaccattaagcatggctatttctatatattcttcgatagcccacagaaatttatttaaaataattctccacaatgactaatccattacaaccaatattgttttagttctttctcatgaaaatagactactaaaattatagtctttctagttacccagtatacatatacacatatatatatgtatgtatgtatatatacacacacataccatatgtaagctggctatatatgtgtatatatatgtatatacacacacacccatatgtaagctcgatatgtatgtatgtgtttatatatgtacctatacacatagaggtacatacacatgtataaacctccatttttataaagattggtggcttataagaatacatacagtaagatagaaaatataaacaagtaaaaaatgagaattaggaaatacataaattaaagtagaaaggtaaaaatcagagaaaaagaattgaacaaaggttctaccatatggttctacatagttaataacattgagatataagtttgattctgagtttcctggcagccaaaggaaaaagagaaacgtatgattaatcatgtggttctcattacccatgagaaaatacataccagttcctcaagggaaggaagctttccctggcacttaattgtgatgtaaatttctcacgtagaacttcagcaggaggacaccgggtgatatgctaacagtcagtgctattcaagtagatagactaaaggatttggtaagatagcttcttttagggcccactaactagaaactgagaacctaatacaaaagtgtaactcaataaaagtgattctgagtgatccatgaaagtaacttgctgccaatccatcaggacttttataagagctggagaaattcacatcatgaaatttataaatcctgagaagcaggtaggtctcatagtccttggatgattttaaatatttctcacagccaaacttttgattaaagctgagccacagacagttcccattggtgttttttaagaactgatattttcttaaggactcgactttacagagtaaacaaacaggattggccttacaaggtaaaaactgaagctcctgaatataggaaaagcaagcatttacccttgtggttattttttaaagtgctttttaaaaattcctctcattatcttcccttgatagatttcctgaagatttatttaacagtataatgtctattgttatttaaagagaaatgaggtttagaatgcagagccttttttaagagagtatgaacatgctgatttagttcacctccaaacagaaatgattgacatcagattcttcctgaaagcagtttctcctgtggaaagaactttgggttcttcaaggggagtgaaatggtaggttctgtctgagccaggtcacctacaaaagcaaacaacaatgctgtttcctaaggtggttgttggcagcacttagccgctgctgacctggtaacctttcctttgagtctcatccatagctctcctctgagagagaactttcccatttacaatattacttggacacactactgttgcttaggaccaaaagggttatttacacaggggagatagtggtaggtgtgaaggtatgtgttgtgacaactgccatttacccatgcagtgggcagagtttctcttttgaccttgttcattcatagcagtgaagtgtgggctaggacctgtaacatctcctagttttaaatgctccggatgggtactctacaaaagtcttggtcatatagaacctatatggaatgcagtcatgttaagaaattgttaagctgttgatcatgatattatactgttaaacataacagtacaaaaagagggttttgttctccaaatagctaattcatagctacagttatttttttagtgtacaacctcagatttatttcatcagagagcaactgggaggtcccaggacagtgactaagtgggaatatgcagcaatgacgagtaaaagcttagtttctaagaatctcagtttttgtggaaatcccctttagactaatgatacaagagaaaacatgtggtgtgtgttgggtagatcattccccaacaggatgttttattttttgtgtttagtcttcgtccatagtaacaattataatgaatgcatcaaaaataaagcctgcagaccttgtgacctatcttgtaatcagcacaaattagttttagggcaggaaaatccagctgcatattagttttattagatgttcccaaacattttattgcaatattttggaaaaaacatccacaaacaaacctaagttttcaatgtgtttcctattcaatatgtattttgttttgaaggataattagattgtatgtttataattcctttgttcttaattcatcaaattgctgccttttgggaaaataatttcagcataggaaaattactctttttttcaccaacctgttctcagaaagggaaatgtatctttagtacacccccaactcccaaaaatgttctccacattctaaaaatgcttttaaaagttcaaaccattattcctcatttggttctaatgatattgaaatggttttttcctattttgagggtcacaattgctactgttaatctaatggctaaatgatctgtgcactgtgtctgcttttcatcttcattctctttttattggtgaggaaactgaggctcaaagcgattaagtaccttgcacaggtcaaatggcttctaagaggcagaatgtaatcattccttctctcaacattcaggaaatatttaatgagcccatactttattccagataccttggtagttgcacaggatacatcactgaataataaaatccctgcccctcaaggagcttaccttctagttgatggagacagataattaaaatatcaatgagaaaagtatctagtgcatgagatgataataagtgctatggagaaaaattaagaaagaaagaggaatagggagtccagagtagttttggtttgaaaggcaatgatggccacaaacacattgctaagaagttgacatttgaacaagacctagaaaaggtgagggagtgcgacacacagatttccttggggaagactagtgtggatggaatgaagacagcaaggtgagcaggagaaaaggaactcaggtaaaagcctggggcagttcatgcaggacagtggctgtttgacttcagcagcataagaatcacttggaagtcttattaaaacacagatctctgggcactacccttacagtttctgattcagaagtttgcattcctaacaagggtccaagtgatgccagtgccactggtccagggatcacacttgagatccactgaagctattgggaggctttggcttttcctcttaataacatgaatgccatttccaggaactgagaataggagaaacaaaatctctttatgctgttccgagtacactgtaggagacaagggcagaagaagggaaaccaactagggttctactatagtaatcaaaataagagatcagggtgacattggccgggcgcggtggctcacgcctgtaaacccagcactttaggaggccaaggtgggccagatcacttgaggccggaagttcgagaccagcctggccaacatgatgaaaccccgtgtctactgaaaatagaaaaattagctgggcatggtggcacgtgcctgtaatcccagctactcaggaggctgaggtgagagaattgcttaaacctgagaggtggaggttgcagtgagccaagatcacgccactgcactccagcctgggcaacagagcgagactccatctaaaaaagaaaaagagagagagagagagatcagggtgacatcattgagctatgctctctctccattctgagtttatttgaggttgtcctctaaagcaaaagcatactaagcattagttatgtcaacctaaaattcctttggttaaatcttcagtttaattagtgtatgaattccttttcaaagagctgcttgcccacaactttgagaaacgggtggaaaatatggggagtttatagttgggatacgtttcaaatatggctgacaaggatctgcctaggaacatggaactcatagaatatcctcaggaggcagtggggaacaggacactgagatggtccatggaagagaaacaacagttgttcttcaaattcctgccatttgatctaagatctgatttttttttttgtaggattgaagagatgaaagttcccctggtcccccaaaattttgtttatagtacatacaaatgctccctgagatacccagctgtatgaggaataaataaggaaagagaacaataacgtggcaccaccttttcctccttcctgatgtacaaaatgagggaaagtcataaacctccaattaataactgtgcaaccttgctcaagtctcttaatctcatctgaaaacaggaatagtaatagtgcttgtctcatagcaggggttaagggagggtactcatcaaatgttagctgcaactatcatgatcacaatgaaatgtaagtagatttctattctcttttcaagatggagacttactggtccctaaccaaaattcttactgtatacaaaaatagtgtagtataaagtaagtcaggggcaaaggagaaaacggtggaaatgcggtgggcatgggagtgtgaaaagcagtaaccccttaaaaggagagagaaggaaaagaagtcaggtagaaaatggagatatggtagggagcaggaatgattgatattaaggtagccagaggcaaatacaaaggggaaggaggggatgggaaggggtggcagaagagaaaaggaccagagttcctagaacctgttagcagggcagaggttaaccataagcaactcattaccatgccccccaaagcatcaggccagaacctccgttaaacacaagacggccattggctgcacctgcagaagtctctgcattttttatgaacagcagaaaacaagagaagtattagagaggttgcaagttagagactggagacacctggagactctacatagctgtggtggttttgcagtgtagacttatgaaatctgatacccccatgcagtcctgttaggcagataaactgagagcctagacattttataagcccccatgtaagcatttgaggggtaggattccttcaatgctcttccaataggatggaaacagaagggaagaccatcctgtcttcagggcttgccctcttgtttaatcctcagatggacaacattagtcccgtttaacagaagaagactctgaggcttggttagtaaaagaatatggccagaatccagacctggagcctagctccaaaggattgctttcctgttagcaagacactgtcttcttttgattttttttttttttttttttctgagacagagtctcactctgtcgcccaggccgaagtgcagtggtgtgatcttggctcagtacaagctccatctcccgagttcacaccattctcctgcatcagcctcccgagtagctgggactacaggcacacaccaccacgcccggctaatttttgttgtattttttattagagacagagtttcaccgtgttagccaggatggtctcaatctcctgacctcgtgatccgcccgccttggcctcccaaagtgctgggattacaggcgtgagccaccgcacccagccttcttttgattgttttcggagacttgtactcagcctttttgcttctctcacttctctggttctctacctgcctaccttttagccatttcacctatcatcctggagacccagattttgttctttttttttttttttttttttttttaagacagagtctcactctgtcatccaggctggagtgcagtgaagccatctctgctcacgcaacctccccctcctgggttcaagcgattcttgtgcctcagcctcccaagtagctgggactacaggcgcacaccaccatgcctggctaattttggtatttttagtagagacaaagttttgccacgttggccaggctagtctcgaactcctgacctcagatgatccaccaccttggcctcccaaagtgctgctagattttgttctcaaatagcagctgtaggatttggtgtggtattttttcccctcagctgttgtttcttgaatgctttctcttgttcacccacttcttctttaccacttaccatgattaataacaaggtacctgcaaagtaaggttttcccctgaatacttcctagatggtggaggtttttcagaagtaccacccaacctcaaaaacacatagtggtccacatactggccttggagtcctggaggagttattctataggaacagcaaatccatgcacagccaggcattgtctgtcttgacatatcagggtacggaaaactcttatgctgtaagaagagtcacactaagccaaagtttaggaaccagcctgctccagtatgccttttggaggacttttcttttctaattcaccttgccttcctctgtcacatctaacccaatactgtccatataggaaaaattcagaaagtattgggttggtgaatgcagcacagattacctatttaaattaaagctgtgtctttagggaaaaaaacttctgggggatgggagcagtggcatgagcttggaaggatttttgcattctacagcaaaccacagctgctatggccttaatgtttgtgtccccccaaaattcatatgttgaaatcctgactccatggtgatggtattcagaagtggggccttttgggagactaggtcatgaggctagaaccctcttgaatggaactagtgctcttataaagagaacacagagagctagctagcccttctgccacgtgaggatgtggacggtgtgatctatgaggaagagtgctcccactgggtaataaatccgttggtgccttgatcttgcactttctagcccccagaagtgtgagaaatagatttctgttgtttataagctactttgtttatggtgtttcgttacagcagcccaaaaggactaagagaacaccaccacccaacaccagaaaatgggatttgcttaaaccaatctgagaatcagtcacctggataagtgtgtcgagtgatccattgaatcagccagcaatgcataaagaatcatttccagtacccacatatgactgtgcttctgttttgtgttttattaagttgctctggagtaatgccactatcagtgcttccccagcacaaggaggttggcaattgagttacctgtttgtgacagctaaactttcatgaatctttaggagatccatttgctagcatcttttaaagactctggatttttctgagcattttgtgatgataactgatgcatctgaagtagaggtgggagcccttctttgtcaagagttagaaaatacaggctgtcttgtcttcctataaatgtcagttgttgttgttgttattattattgtgtcagcagtaaactgctccccagaggactaagatacagcattacagagagagcatgccttgctgtgaaaatgggtagtagaagtatgatgatattatttcgtggtaatgaatttacctttatgacagatcattatccccttctgtagctgaactggatgaaggacaagtctagcagaataacctggtagtacttggatttattggctttaaatttttaagctggaaaaatgcagtagcagccaggttatctctgtatgaatgttgcagaggaggacagagatgaaggaagtcacattttctttctagtaatggtagaaagcaggtgatgatgacagtcttttaacgaaacatgaatgcagttgctcatatgctttgccattttagtgcacaagtcaaggagtaaatgagtagaaaaaaatccataagatatcatcatcatcaataataaaaaattgcttaaggtctcattgagtgttacaccataggaaagagcaaagatttctttttaaaatgagttagacgagacttccctctcaggtgtgtataatccaggttcatgctttaaaggctatatgtgaaatagaactgttttatattagtgagctgttggggatagtaagttgcagttttgcataaaggcaaaccatggtacagtgaggatggtgcccctgtgggaagaagatgggcttggaaatcatttaggtttacatcctggctttgtccttttctagtagtgtgacctcaagcaaatcatttaaactttctgtcttagttttctcaggaagcaaagaagttagtacctaactttcagatttctttgcagctttagtttcaggtacatagtaagtcttcaataaatgatcactattgctgttcctgctgttgttattgctgttcttgtcttgattcagaagccctggtggtgatactccatgctatattccaaggagtaaccataacctaattattttgaatgactgagaaccagtgctgatgtaaagctccctaaacccagcacttctccagaagccgtaagaaatccatgccatcatttagtaacctacactgtagggctaagatctcaatccgttttccatttgcacactcatcagagtagatagagactagttgttcactatgtctgtgaatactctatagagttttccccagcttcctcctttcctccaattttccttacaaagcctttccttctttcgtctgagctctaacactttgtacgttgtagtaattttatggagcccagtgccaaacatctctatagaggggatgttgtaagggttgaatatgaagagaccctacatgtgacgtgtgtcctacgaatcttggagtcttgactccttctccagtgtcagtactcgttatctttaatttggggccagatatgagcaccccacacactttccaaaaaagcccccgatccacaaatgtatgcatgatttttccttacataagtcttttcatgtttctggacatattttatctcccttcctcctctaatactttttcccttgctttccacagtgagaaaaacaacaacaacaaaaaaaaaaacacaaaattcacacaaaggcttatgtatataaagacatggctccaggttctcatcagttcaaggagtaaaagcaaattccaaaagtatagaaatttaggtggatgtggccgggcgcagtggctaacgcctataatcccagcactctgggaggccagggtgggtggatcacgaggtcagaagtttgagagcagcctgaccaacacagtgaaaccccgtctctactaaaaatacaaaaattagctgggtgtggtggcatgcacctgtagtcccagctacttgggaggctgaggcaggagaattgcttgaacccaggaggcggaggttgcagtgagccgagattgcaccactgcactccagcctgggtgacagagtgaaacgccgtctccagaaataaataaatttaggtgaatgttaccttctccctttaattttctattttatagaatggttgcatgcaataaaagcagttgcttctcttttaactttttaataaaatggaagtctgtttttaaagccatttgctttgaatatgtaagaatacctagagtgttttaccatggtagagataatttacaaagtaagacccagttggagttgctcagttaagatgtatctcaggtgaaatgttaatcaattcaatgtttctttgtgttttgaaaatctctttagtgtgctgggccgatggccacattttctgctgtgtatatgtgatatcaaactttaacaagtctgttgcaacaaggataagacacagcagtaggaaaagaccactggagataaaggggctcaactctcttcccagtgagaactgccatgttatcttccatctgatcacattactggaagcttactactcttcaggaactcttcagcactttacccaagctccagtgaggaggcgatgctggtgcttatggggtacttggacaagtagaggctctccctcgcttgtcaaaatgcctggggaggaagcaccttctgccatttagtgtatggggggaaaaggaagagggcagtgagggatcttaaatgtctcgtaatgctctggatagacctgcctaagaaagaattaactttccccaaatgccagtcacgtcccagttaagaaaggcctgcctggttcttcagcctcatcagtgttcccagaagtcccagctccagccatcacaaaccaaacgtgccacttgccttctttcttttctcttttcctttcttcctccttcccctcccctctcatcccctcctcctgcttctccctcttttccttccttccttccttccttccttccttcctctgaatttcctgtatatcctctctgagaggccttacttagatgccacttgctctgcgcttttgttgcccctggcacacatgtgactccacctgggtggtgagcccactgtgtgctctttccactcttactcacctgtgcaagctcctgatgggcaggtcccagtctttatctctgtatccccagtactgacacagtcctggaacatagtaggcccttggtgtgttttagggaaatgaactaatgaatagtaggtatttagttagtattgcatcgcgttttctgaaagtaattttaaaaaaacacatactgtaggccaggtgcagtggctcacgcctataatcccaacactttgggaggccaaggcaggcagatcagctgaggtcggaagttcgagaccagcctgaccaacatggagaaaccccatctctactaaaaatacaaaattatccgggtttggtggcacatgcctatagtcccagctactcgagaggctgaggcaggagaatcgcttgaacccgggaggtggaggttgcggtgagccgagatcgcgacattgcactccagcctgggcaacaaaagtgaaactccgtctcaaaaaaacaaaaaacaaacaaaaaaaacatactgtagggagttcagtaaaaataaggtcaaggtttctcagcctcagcaccattgacattttgggcaggatactttggtgttctgtcacgtgcattgtcctatgtgtgggtcactgtcctgtgcgttgtaggatgttagcagcacccatggcctctactcaccaaatggcaggagcattccccagtagtaacaaccagaaatgtatccagacattgccaaatgtcacctgggggcaaatcaccccaactgacaatcatcaaattaagataaaagaagaactaacatattgaattccatttaataaacaaaatttctatatgttgtggcaccaataattcactaatccatttagtaaacacattatggaatgatcttcaaattaatgggctgtatagtcttaaccgttaatgtttgagtattctgtaagctcttaagaatttcagtattataaaataatccacccaccctttggaggcttgaagcacctccaccagtggtgaagagccctttggaatcacctttgcagtcataggctcctagaaataacatcaggagtattaggaaatggtgcccattgcattcctctcccgtggcctttactgggaactgtgctggagactgtgttatttcatcggggttggctgccaccaaagtgtggggagccatatgttagctattctgtgcagtaacacctgcactctatatcacaggcaagcttatatgcctgtaatgataagcctgcctatgtagacttgtgagtgcacagttgcagcacagttggcctgctctttgggtgtgggaagtagagttcatggaggtaaaccattgccaagcaagagatttgtactctccctcatgttttgtccatgtgaaacctttgtaagtgcagtgtccacatgcccaaggggccctcaggtaaaaacacagataacaacattgctccagggtttttctttattagaattctgtattgtctaacatgattggtaaaaccaggtgagctcctaaattgtggtttttagtgacattctataattcactgctgaccttctccccaatgttgtgacttggaaaaaaattcaaattaagacttttttttttttttgagacaggattagacaacgtggtcacccaggctggagtgaagtggcacgatcatggctcactgcagcctcaacttcccaggctcaggtgatccttctgagtagctgggactacaggtgcatgccaccatgcctagctaattgtttgtattttttatttttttattttttagagatggggtttgttatattgctcaggctggtctcaaactcctgggctcaagtgatcctcctgcctcagccttccaaagtgctgggattacaggtgtgagccaccatgcccaacttcaaattaggacttctttacaataagggttattctattcagaatctcattagatgttaaaaaaaaatcaaaccaaaacaaaaaaatactttttagtaattctgtcccacaccttttacttttaatttatattacttttaatttgttctttcccaccttttactattaatttggtgtcgctttatccttgcacatatgaacagaaatatagtaaattaagtagtaggcaaagataggccaagtcaaggatagtagtagggcaaggatagagcccagagggaagaagtagaggggaagtgtgttagcggtgacaaattgtattcagagagaatggcttcagtggtattgataaggaagaaacaaccttcccaccaggttgtttgatgaaccacactattagaccattcttgctttgctataaaggaatatctgaggctgggtaatttataaagaaaaaaggtttaattggctcactggtctgtgggctgtgcagggagcatgctgcaggcatctgctgggcttctgggaaggcctcagggagctttcactcatggcagagggtgacgcaggagcagacaggtcacatggcaggagcgggagcaagaaagagaaggggttggggaggtgacacacactttacaaccagatcttgcaagaactcactatcctgaggacaacaccaagaatatggcactgtttcattcatgagaaatctgcccccatgattcaatcacctcccaccaggccacacttccaatattggggattacagttcaacatgagatttagagggagcaacatccacactctatcagacactttccctggactgtaaagctggagttttggtttgggtaaaatctactgagtccatcatttggtgagaaaaaaaaatctatggtacttagatgtgcacatcaggaatttgtatgtacacattgattacaataatggttataatccatcatcatcttccaaacctgttctaagtgcttccgcctctggagtaggtgttcttactcgtgcaattagggaacagtgccttagttaattacattgcttcagttgaaatcccgactctaccagttactgtctgtgtgaccttagactgtgctttatctgtaaaatgaaattataatatgtaatagcacctacctcataacactttgaaaattacaggaaataacacatggcaaagctgaggagaatatctggcatgcagtgagcactcagtaaatattagctcgtatcactttattgttattgttattcttacaaccacaaaaaaactgtgtcactttcctgcacttcacgtcactaatcctgctggtctttgatgacttgtataggccatcactgcttccacaaagccttccctagccctttcactagtttaatgcccccctctgtgccctcagagcctgcttccactaccagagcccttaccacattgtattgtaatgcttcctctgttggcctgcctcccctactggactgcaaggacctgaaggtcaaagaggtacactctaatgcctaccatagtacctgaagcagagaagatattcaacaaaggtttcttgggtaaattattgaaagtttaattaacttgcttaaggtcacaaagctagtaattgagtgaaacccatgtctgacttataaaagtaaataataagctataagaaaaatattcctctaataatgataatgcactaaattatgattccacctgattattacttacagaatactctcaaaattacttgaaaccttccaaattttggctctatcatctcttcaaacctctgtctgacaatggtactcactttatactctgcctccaacatatacacttgacttcctatccatagggttatccttgttgccccccataaatttgacttgcactttcatctcctctcaagcagtcatcagtatttattgaggcctacattgcagcgacctgtgatgctctaaggatacagaaatgatatcagaaggtggtgacatttgaactggatcttcctggtgtgaatcaagccttccccactagctgttctttgaaagaagttttgactaatctgtgagcccttgatgacacgaaatattttgatatatgttctgagttcactgttcgtatttgtttataggttggcatcaatagatatttgttgaatgaataaatcaggctgtagagaaacattttaggtttataattaaagcacctgaaacaaaaaaaaacactacatttagcttctctctaacccttttaatggtagttggaacatcagaaattagccattgagcttactgactctttttctaacgatttactgtataagagagcagaatgctattggcttcaccagctgtggccagaagggctccatgttcaaattagctacaaatcatgtcccttatggcattgttgctaatggtgacactgagggtcagaaatgcctacggtagtgaaaaatatttcaagtgcccctgacagttaacatctgacaagaaagtgcttttctctgtgtgggttttcgagggagtaaatgaaattgaactcgcatacatatatgtttgtgtatacatgcataaacatggtactttgcatctggtctgtgactacgctgcaaccttgggagatttgatcgattttctgatgttagaggtaggaatttaactaagggagtattctttggtaatcgcaaagcagaaggacttccatgcaacctggtactgggtagcagccattggctcttaattttgtaaaaatgacagatattcaataaagtatcagaatgattagagggaaaaatattagagctggaggagctgccctacttctgaacaagcagttgaaacaaaggcactcattggaattcatggttggttgacattatgtagcctgttgttgcttaattttgtttcctgtatattttcagggttgtgttcatttggttttagcaataaggacgggtcattttggtgctgtgtctttttagttcacctgcatccttgagttgagagcagagaacagaatgcatatttattttcaatttttacatgttatttcgtatttccatagagtctgtggacttttaggtacaatgatgctgtcgtgaacaaataagatgctgtctgaatgttcctgagagctttagtgcagtgaacacaccttctcagcaacaacaaaaggagatcagggaggcttggccaatgtactctctcgtccacatacggactgataagccaatcttcaaaatcaagattcttccagaaagtccaaattgtcgagtttatatttatagaccacatgtctgagagtctcctcccaacccccctcaaccaaagatagtagtttagatataacagtttttaaaatcaagttctcactataaaatctgagttagatacttgggtaagggtgaggagtagagggtatggctgaggaagaaggggcatttcaaaagaattgtaataatcagtccctgaccttataagagtttatattctaattacagagaatataagtcagacagctcaacagtggcaagatcacatagtactaaatacctgctgaggtcttaaggcagtgtttatacactggagggtattttcctccagggaccatatggctctccttaagggtattcaaaaatgtgtgagggcatttttggtgctcacaaggaggggatgttgctggcattcagtggtgcaggccagggatgctgagcatcctgaggggacagggcagttctaaacactggaactgattcccctccgaatgctgataaccctgatgagaaacattgtagtggttccgagaagaacaagagcgctcttacttggagccgagtctgagatgtcctcaacacgttctgtgagtcaaaggttatgttccctaaaatcaaggaagtggcctggatcataaagtgcttcaatgatcaaagtcagtcaagtgaaatgtgtcgatcattctcctgcctaaaaggccaaattctttcagcattgatttaaagctataaggaatcaagaccctttctttaatgatgctttctgatgattctccatttgtattgacggaaggagctaaagtgtggaggctctgcactagagggtagtttattttaaaaagttatttctgcatttagtgttaatattaattgcttattttatatgcctttttataccatctgaagtactttcacatctaaaaaaatttaaataactttttttcaaaaaaatactgaaaaataaaatcagatttctaaattaaataaattaaattcagtttcctagagcaggcagcatggcatatttagttatcaacaggaattttcagcaaacgaaagtcttttaaaaaataaagtgaaactggaaaaaggaggccatttttaattctttctctatatacttctgtacattatttatgaaaaagtagataaaacttgatctcctgcaagtaagattgacctaacgtccatttctagagtattagtagtcatcatcccaaaaatataagaccaaaatttgtatccttatgtctagaataatgcttggcctctatagatattcaatatgtatttaaagaagagatggtgatttatatttgaaaatatttgaggaattataaacaattattttcataaacacacaaatatatatactaatatgattatatttaggaattagatttctaacatttaaaatagcttagagactaagtactgttatttctcactttttgtagaaaaatcaaaaaattctagagaatttatttttaataatttgttactagctttagaaaataatttttttactcaaaaattcacttaaataaaattacattatctacattttgatttttatagacaacttttataagaatacttgcattatttaacattccatgtgaaaagaatgtggttatttcttaattttttctgttaaaaattccctgtatgattgaagatctaagatataaagattatgtttgttatttataacagttatcattttttgaacacattctgtgttctaggttctttgctaagcattttaagtgtactatttcattattcctaatgacaaacttatgaagtaagtataatcattagtgtcattttacaggtgtggaaattgaggcttaggattttggaattataatttctgtaatactgcccctcctactttattgtaaataaataatatcttggaaatatgatttttgaaagatgaatgaacattttgccatatagatccctttacaagagaaaagacaagtacattgcaaattcaccccgattcatatttagccctgagtatttgtttttttcagatcacaaacaactaaaaactatgaaacttactatgtttgataattacatattttacattagatatataacttacttaagttcaaaactaagtctggagaaggtggataaataagtcaaaattaacttcattttaagggaagttttacaagcaatggtaataagtcgctgaggagaatggaccccggcatgttggaatccgtggttgcaagctgacactttgagggaatgttcttagcaaaacactcacttcaacggaaattaggtcagccttctggaacatttatcatgtatacctgtcaccagcaagacccagtccttaaagtgaattgagatcacaagcaatggtccctcctgctctgagctgcaaaggacactctaaaccaatagttctacaaatatgtgagcttggcagacgctcccatgaaactaaagccaacacccatatagttgctctgggaattgaattccttaatgctttgtttatagaattttgaaacagcaaatggatttggtctgttctgaaaaaacaatctgtcctgtggcttgtttggaataacatctagagttgctatagaaggatggaggcagatgacccatgtctgatttggaagacagtttcgccagtttcttctccttgtcctttattgttcagccaggttggtttttgcccgactcaaggtatttgcatagaggaaaggccaccttctaccgaagctaatttgatatagaaactagagtagttagcaaaatccagagctaaaagagttagcaaaatccagagtaatagaaggtaagatagagtgtatggtaaaaccaaaacaacgtaaatgagtcataacccagtgccctttcagtaatcatatggcatcattctggtggtttcagagcagtgtcagcaagtatggagtcctgtgtaggaatctgagagtgcatctgtgtcagtgtacatgtacttcagcccagtgaatataattcattgagggttttatgcatggaaattaccacattcaccaggtagcctgtatctactggactaagttaccttgccttggaaaggaagtaattactaatctttctcttgtgtttatgtttggcaaactacacctaaagacttcactaaaaaattggtaaaatatatatgaagctggttgaaaaaaagatgaaattatacatatgtttgtgtagtagcaggaatcttccattacatctcaagaatgaaaggaaaaaactattaagaatagatgtttcatttctgtgttcattcatcacagatatactgagtacccaccatatgtcatacattgtacaaatggtagaatcagaaagatgagagaagtaagatccccactttaactgagtccttattcaagctgtgtgtctgtgtgtgtctgtctgtttgcgagtgacagatccttaaacaaaaaataatgataacctatgtgaaatgccccagtagaggttattttaaaactcaaggagagaactctataacttaaagatattttgtctacaaaaaggagcgaaggttttattcgaagaaagaggagcctgttttatatgaaaatcctgaagatttgaaggggctgaagaagtagaatggatatggaagaaatccaccaatgatttcttcctggaagaattaaacacacacacacacacacacacacacacacacacacacacacacaccaactttcatgatcacactctattaagccaggaccaggaaacaatttctaatcagcactctgatctgggcagagattgtgcagtcttttataccaggcctcagatctgtgttctctattcacacatgctcacttccagctgttgtcattgaaatctcacataatcttccaaggtcaaagggcagtcacccatggctgctgcagttaaaaggttatgctgatttctgttgtcaaatattggcccttttctcttccaaccactcccattctacttcttttttttttttaaacaagaaaaatccagcctagaattgcattacatgactttaaagtcttaaaagtgttcctccattgtgctaacacgacatggcctgaacagtctaattcattctgttacatttcacaaagaattttctggtacttctaaaatactttgtgctaggccagcaaacttcaaagtattgtgacccacatgattgtggcctgccatagtatctgcagaagtgaataatacaggttccacaatttaataaacatggtgaattttggcatcgataactaattactgggtaaatgagcaagaattacacaaaaaatgacttttgaaaagatgaaagctctttgcattttgtggttctaaacattagctagttttattttatatttggagacgtatataatagtacatttaatatttggagtcttagaaaagtaattgtaaggatttttaaaaaatattattgcttcactccatccaggattttctttccatgcttggtgaaccaaaatcagtgttgagtatcttaaaattagcacatggcccctggctatctactttcattatcattgcatgtgtcctcaggtggtttagcaagcaggattctctgtaaatggtctgtctcacagccctgtgtataaaacctaaaaaggaagaaaagggagatgggccattacgattttttgctgtttaacgtccatgaaccagggtagccctcaggtgatccagtttcatgtctgtttcacttaagataatcagtttctgatgtattcagggaatacatttccctgttttttccctagtatatgtaaaagttcataagcagaaactaaagctattacaaatagcttgattcatttgcaaattaccagttgttactgtccaagtttagaggaaactttgatgcagaacataaaaacaataagtttgctttttaaaaaacctctttaattcaaaaccgggttaattaaaaaatgttaatttatagtgcattaaaaccataaaattaattttaaaatattaagcttataaaatactgatactatgctaattacagaagaccttagcttttctaatatgatgcaaaattctctgttttttaaaatggtgctaaagtaagtgtttaaatttttaaaataatccctaaagattatttttgtttctctgttcttgtacaagtctaaattttcagttgagtccgcttgcaaaacaactgtttcagcttttaagactaataaatgcataattctaaatgtttcggggaaatggggaaaataatttgttgacatgacgagagagagaaagggagggaggaaggaaggaaaggaagggaaggaaggaaggaaggaaggacggaaggatatttagcctggaagagagaaaattaggttgatgagatgtcttcagatatttgaaggatagtagaaataaagagagccaacatttgttctgcctataccagaggacaaaatctaggtaaattacaagttataggaaggtagacatattcagggaaatatgatttttttaacccctcatttttttattaaccacaatttttttgttgcaacatgacgattattactccactactagatgaactttaaggtcccttccatatccagttcattgtgtgatgccatggatctgatatttgcaaagatacaaataggtaaaaatcttttttcacttttatttttagatattttgatatctaatagacatagtcctttaattgctcaatcacttggaacttaaaactcatgaactttctttctatgaagtcattgggcaatcacatttagtttaattaaatgctacccttcctttattaactgcaggaattggtgaaaagatgtgacaaggcctttggattagactgggtaattaagtctctgatgctaaaaatcatggattaaaatgggataaaattcattatataaagagtggtaaatatacctgtgttctaatcctaattttgccactatctgtgtgacattaagcaagtcacttaacttctcatgtctagtttaaaagcattcctttgcagattaataatacatactgtactagcaaaatatgtttgtagactggaattggcctgagggctgctaagttgtgacacgttagattcaaaagggataagttagtagttatgtgggttagggtaagtgcttagctactataacaaagcaaccaataaaacgcaaaaacatacagtagttaatgtatattgaaatctatttttctttctgttaatattcccagatgagcagcctaagttggcaggatggttctactccacagtgtcattcagggtcccaggttccttctgtcttactgctctgctattccacgggtgtgtgcctgcatggtagaaagtgttttcgctcataaaaaggggtagagacaatgttcagggcaagaatttcctttcaggtacgtgggggtagaagttgattgtatcacttgcgttcactttctggttgtggccactcctaactgtaaggcagtctggaaagtgtgctttctggctatcaaccacgtatatgtgtgacaaacagcagactcatcacaggaagatattgcagtagtctttattagtttctaatgttctcctagaaaggtattacaaaaacatgaattttatataaatacattactgaaaatcttgctgtaaatatctgccttgactggggacataagtccccaagagtaaggaccttgtgttattttacctgttgcatcccaggtcctaggattgtggttgccatgtaatagacattaagtaaacatttattgaatggaagcagtaaattaaatattgactctgtctctatggctatggcagaaatcattgagtgagcaatgatggcaaaaacaaacaaaaaaacacagattaggtgtctgtattgagtaacagtaaatgagcagcacagggaaatttggagccacaaaagaaggccaacagtgtgtaagtcccatgacacatacttctcaaacctctttttgccccattcttcttttggtctaagagtacattatttccataatggtgacaatttcttaatgtgtcatgataaaccaaaatgacaatcatacccatgttacaaatgcatttaaagcaatccatgtattcatctgagaatctcaaaacacctcatccatattattagctgacaaacatttctgcattttgcaaattctcaggcacaactttctagatatagaagtgtttcagccttactgtcagtccaacaccatatgtcaaccttttaatgtttaccataagcacactaccaagtgaatttttctccactatcataaaggttaatctcacaaacagaatatatatgtacttttattgctcctgtgttcttttttagatatctgaatttttgcatttctttaaactataaggaattattctaaaaataagccgtatctcaaatgtcaccaatgagtggcagaacaatttaaatagtcactatacagtcagaaatcagaccagaaatttaaaatttggcattaatggatcagcagaaacatccctgcacctgactcctcaaaaggaaaaactgttttccaagataatctaaattaagagtacagaagtaatatcactgtaggtgagctaacaaaaatttacatcacgctttagaggactaccaaataacagtatcataagtcactcatctgaatcactaaataaatatttattacacacctagaataaaggcttatgctgggccctgtggacaatgtgagataatgagacccaaccctcccctccccggtttgttgtaggagtgcagagataatacatataaacaaataactgtccagtcaggtagaaagaggcaagtgccgtaagacaagcagagaagttctccttaattgaatagtgtctcctgagcacacctaaaatgttctgtgttggggtgagagggaagattaacgagccacattcccacaggtggctcataagccagtggggaattcacagaaggagaaattaaaattccaaggagggagtctggttgatgaggtaaacttttctttagaaggatgagaatgtaggttccctgagagcagtgtccccagggactagcacagacctgcacagcacaggcagtccaaaatccttctggaatataaacagcgtgagaaggagggagcttttcccgtcaagtggccaaggcacaccagcatggagaagcctggtaatcattggcctgtcttgttattagggatggaaccctatttaccaaaggaagactagaatagagatgagttctttttgatgaaatgactggggtattgcagtttgcctacatcccttaaccagacgagatttgatcatttagagctgacagccccttgatattccagcagagaaaacaaaaataccatcttggatataaactttccttctcagatgcaaaattaactctgtttcttggacctgaaaactttctttagtggtcagcctcctgtgtggtttgttcccaggtgtctctggccttgacctctgaacagctcttcaaggttacctgtctctcttcaaatcttaactttgttcctctcctgcctgctaaaaggcggatagatgttcagttcctccatgaaatgagatttagttcccatgtaatggcattttccataataactgctgatatcatcaaggtaaagagagctgcttctcctaactacccatgaaagaatttagctttttatatttctacctctcccatatagtttaatctctccccactgcgagtatgactgactccaaggtattgaagtctgtgctctaattgggaattcaatgaacaagacttcagtgaatgaacttttttagccatattatataaaatgaaaaaggatctgctcctcatttcaatctcctgtacaattgctcctgaacagtagtacagaattgtagagatagcacattgtgcaacctggctttttatctgagacatacttaatgaaagcacatgttttgcactttttttctgagaggccctattcaaaatgtaaatcttgggaccttttgggagtgtttaatgtgctttccaatggaggatctttcaatattaataatatctgaatttggaatcgcttaaactcacctttttattttcttttccacttttttcttactttgcagtaaagtggaacaatcagattagtgtcatttccctgcaagtcatttttaagatttggtttgtgttcatgagaatgaaatattaattcactcaggtttgcttagtagttgtgttagcaatatcactttttccatcatttcttaggtttcatttctcattgctgtcttcttacaaagttcatcagtgggtttccaagcaattggtaaaggaacaagagcagtttcatcaccatttaaagttacatggagtgtttacacagacctttccatggggacatattataaacataatctagccaaggctgtctgataatactgtgtgaagagatggttacatcaaaacctgccaaagaaggctaggcgtggtggctcacgcctgtaatcccagcactttgggaggccaaggcaggcggatcatgaggtcaggagatcgagaccatcctggctaacacagtgaaaccccatctctactaaaaatacaaaaaattagcagggcgtggtggcaggcgcctgtggttccagctacttgggaggctgaggcaggagaatggcatgaaagataatggcatgaaacccagaggcggagcttgcagtgagccgaaatggcgccgctgcactccagcctgggagacagagctagactctgtctcaaaaaaaaaaaaaaaaaaaaaaatctgccaaagaattatactctttatttttgtgattatagtgcattcacatatgttttaccttctaaattgcacacattccactaaggtaagccttgggaggcaagttgctggtagggaaaagggatgaaattgttatttttgcagtgactttctcaggatcacacaagatcttcttttaagcttgggactagatcctttttgggtggagggagctttatggccatgatggacaatgctactgccctttaactctatttttacttgaactttaaaaatatgaaccataaagggaacaataagacaatccccaggcatttatcatcagaaacgcctgaatcaatctgaccagaagcttcattgcctgtcctgtcctgatcctgtttagtttggagggaatatgtggatggttcattttcatagtttcccagtacagactgactcagttttagttaaactatattgctggaaatgagagaaagagacagaaataagaagttctgccaatgattttaccaagaggaaaaatgacataggtgagcccagtttgagtttcattcactctgaggcatctcaggaacactgaccccatcaggcagtgtgtcaagacctggagggccagaggcacagaagatacttcccctcctcagagggcttacagtctaatgtgagaaaaagacaaagttacaatcacgtacggcaggtcccaggtgagaaatatagagtataactggtcagtattcagaagggagaaaaaaagtgttccccagtggtgggggcagccagggaagacttttgtgagaggtgacaacaaagctgagttctaaaagacactttaggaggtggttaagctaggagtaggaagaacagatgtttcaggaagaaggagctgtatcaggggatggcagtgaagcagtgcaacgaggagcttgcagttcacttaggtcaagggtagggccagaagtgagagagaataaacaagaggctatatctaggtcccatgccatggaaaggagttagtactgtactctgaacgttctgtggggctcttgcaagcattctttctttttaaaagaaaaaaaaatatatatatatgatatgtatatatctactattatgatatgtatatatctacttatatataaatatatatttattatatattttttcattttaatagtttcccagtgcagatcagctcagttttagtttaaactatattgctgcaaatgagacagagagacagaaataagaagttctgtcaaagttttacagtatatataaaaatatatatttacatatatatatttcatttcagtgacctttggggtaaaagtgatttttgggtacatggatgaattgtacagtggtgaagtctgagatttcagtgcatccctcacccaagtagtgtaacttgtacccaatatgtaggcatttttttaatccgtcactccctacacagccgccccctcctgagtctctgcggtccattatatcactctgtatacgtctgcacacccatagcttaacttccacttgtaagtgagaacatgacggtatttagttttccattcctgagttacttcacttagaataatggcctctggctccatccacgttgctgcaaaatacattattttgttcttttttatggctgagtagtattccatggtatatatatataccatattttctttatccgctccttggccaatgggcatttaggttggttccacatctttgcaaatgtgatttgtgtggcagtaaacatacacatacagttgtctttttgatatattgacttcttttcctttgagtaggtaccaagtagtgggattgctggatcaagtggtagatctactttgagttctttaagaaatctccatactgtttcacatagagatggtacttattcttaccagcagtatataagcatacccttttcaccacatccatgccaatatctattattttttttttactttttattaatggccattcttgtagaagtaaggtggcatctcattatagttctaatttgcatttccctgatgattagtgatgttgggcattttttcatgtttgttggccatttgtctatcttcttttgaaaaatgtctgatcatatcatttgcctactttttgctgggatttttttttttcttgttgatttatttgagttccttgtcaattctggatactagttctttgttgtatgcatatttcttgtaaactttctgatagggcagggggctcagaacacattggatttgtctcagtgtctccaacatcttgctctttcctgcctcagggcctttgctcatgttaatcctctgcctgaagagctctttcttcttttcctatttggctccttcgtatctttcagatatcagctcttaaacaagacctgccctggccaccctttctaaagcttttgatatttttctccttcatatcatttattttatatatatatatttttttcgagacggaatttcgctcttattgcccaagctggagtgcaatggcacgatctcggctcaccacaacctacgcttccccgttcaagtgattctcctgcctcagccctcccgagtagctgggattacaggcaagcgccaccatgcccggctaattttgtatttttagtagagacaggatttctctgttagtcaggctggtctctaactcccgacctcaggtgatttgcctgcctcggcctcccaaagtgctgggattacaggcataaaccaccgcacccggcctataattttttttttttttttttgagacggatcttgctctgtcacccaggctggagtgcagtggcgcaatctcagctcactgcaacctttgcctcttgggttcaaatgattctcctgcctcagcttcctgaatagctgggattacaggtacacgtcactacagccggctaatttttgtatttttagtagagacagggtttcaccatgttggccaggctggtcttgaactcctgacctcaaacgatctgcctgctttggccttccaaagtgctgggattacaggcatgagccaccgcacccagcctccatttataatttttttctttttttcttttttttttttttttgagatggagtctcactcggtcgcccaggctggagtgcagtggcgcgatcttggctcgctgcaacctccgcctcccaggttcaagctgttctcctgcctcagcctcctgagtagctgggattacaagcgtgcgccaccatgcctagctaattttttttatttttagtagagatgggttttaccgtattagccaggatggtcttgatttcctgaccttgtgatctgcccacctcagcctcccaaagtgctgggattacaggtgggagccactgcccccggcctgagccaccatacctggcctatcatttttaaagtaatttttttttttttttttttgagacagagtcttgctctgtcacccatgctagaatacagtggcacgatctcggctcactgcaacctctgcctcccgggttcaagtgattctcctgcctcagcctcctgagtagctgggattacaggcgctcgccaccatgcccagctagtttttgtattttcagtagagacgggtttcactatgttggccaagctggtcttgaactcctgaccttgtgatctacccaaagggctgggattacaggtgtgagccacagtgccctgccgtaattttttttacatgtttttagctgtttctgtaaactccctgaaggtgggaactgtatcttgtgcccctagcatgatgcatggcacatagtaggtactccgtagacatttattgaataaatgagtaactcatcagatttgcatatctgtcagacagccctggctaaagggtggagaggggattggagagcaagccaagagagatgatagacagcacagttaggaggctttcccaccatgctggtgaagagggaaggtcctgagccacagtcgcaggagggtgatggagacatacatagagtcaggaatcacagaagcggtggggactggttggatgtgggtgattgtcagaggcaggagtcagggatgatgccaaaaaactagatgagtggccgatggttcattgaaatatggaattcaaaagagtaagaacgggttttgggtgcagtagaaaatggattcggctttgcgcatgttggttctaagaatacctgtgggctatctggatggaatgcccaacaaatacttagatttatgggtttggaacccaggagatagatctcagtaaatgataaagagttgagagtcattggcctgtagattcattcatctactcattcagtaaatattcacttactaacgtgctttgtctcaggcattaagtatacagtggtaaattaaaacattattttagttttcacaaatatcacagtctagactgctagttgatgacatggaggtagataaaataacttaggaaatagatacaccccccccacacacacacacacacgcacacatctgcacacacatacagggagagatgagcacagaccctggagaacaccaacatttaagaggtggacacaagaaaagggggcaaccaggagagggtggtaatttgaatgaatgaacgcaagggtcttcccaattcccaagtccttgcacctaaatcaccctagcctttaaaatatattgcttgcttttttggtggcaggattaaattgccttgtgtttacattcacgctatacagaaattcatgttagttcatccttaaaatgaggaatttcaaagattggaactgaaacaagtatcagcctgtaagtcaagtaaagaaggtagggatgagcaagagctggagatcaacccagattttcctattcatctatgaatttccttgttattgttctatgtgttttaagtcaaccttaatgtacattgtggttagatttcctttgctgtgatctgtgggataaatgtaatgttgatggtctccctataagaaagagatgttgtggtctgttttgccaagacctcattagagaattttatttatttattaattttttaacttctcagttctcttaatctaagagacagcatcttaggtgcttaccaaagccaattgaatacctgggtgtgggtggttttgagaggtgaaatttcttgagcactttgatggtaaaattttgccattttatttcaaaaagccatttacaattattgtctatcctaaaacttggaactgtttcatctcaaataccatagattatgtgtttgatataaaagttaactgaaatttaaaaaaatctcagtagaaatttcttatgcaaaaatccagtgtaacctaaaaaagacaagtaacttgcaggtccatttatactcctccaaaacatggcaactttttgcatgtgtttatgtgtatgacatttagtaaatttattggtggatatgcagtgccacaggtaaatttgctttccctcagtattgtatgaaatctagcttttattaataacaaattttgtttatggattgttatatattcagattggtctattttcttttattgcattttctcaaggtatgtttcttatgtcaaagaacaattatttcaaaaatcccttcggccaacaattttttgacccagattttaaagcagggaaagactaagctgaccttggagtgatctctcaactagactctacctgtgtgagagtcatagaatcagaaaattttagaggtagagtgggaaactacataccatagattatgtgttccttgtcatttataagttctatgtttctgaatgcatcataaaattaaatgagtagttggtgatcgacataataccaggtgtcttaaagggaattaattgcatccagcaaaaatgaagcagaaacaaagttcgaagattaatcactttttgaaccattgatttattatcttttctcaaaaaaatcaacagacacaaaaaaaaatttggggtgtataaataatctgaatttttatttgtgctcaaaagaatttgttttcctgttttgtgagttggggcttgctttttctattttgactttttaaaaattcaccctgtggtgcctctagaaaagaacacctttaaatcttgtttgagttaaatgaatagataactaattccaatcaaatgtttctttagagaataatgtttaaaaaactatgatggaatgcagctctcctagtgattcttagatatgctgtttttatcccaattgttaaggtcttagaggtcacccaaggtaactatttattgtaaattgtcttttgtttcatatttccggttgaattttttttaaccatttcaaaaatcagctagttgttgtaccatagctttgcacaaccttgaaattcaaaccaaaaatctatctgcttagctaaatgactgtgccctcccacataaaccccaaggagagcagagaatgagattaggcaccacatgtgttaatcataatgaaactaatatttaaagctctgttgtcaaatgtcttgtatttatgacactttgttttcttttgtttttgtttccccaggacatttgggcttccaggacagttttgtcacatcaggtgtttttagtgtcactgagctagtaagagtgtcacagagtaagtataattttgctttgatttggtacagatttgccttggtttgtgcttactttctgcctaggactcctagagaccaaaaaaagctttcagaatctccttttcattcacccattggaagaattttgacacacagtttgtttgacaaccaagaatttaaatcaggaaaaattaaatattattttgatgtgaggcataaaagaaagaccaaaatcctgagggtctcatatattctgaggcttccctgatttctaagaaattctgcattttaaaagaatttgtttttgacctttaaaaaatgctaatgccctcagtatgagtgacacagtctgggatgatcattaccagtttgtcaataatcactaacagtgaatgaagagtacctgtcaccatcttgctccattgatcaaaggcccattcaattgattgtagttttgttatgacataatctagcatgcacgcacacacacacacacacacatacacacacacacacacacacacatacacagttgccttcccttaggaatctgttttttcttatttaaaagcacaaatacaatgattatgatgttccaggtcccagtaagaagaaggaaaaataaataccaaatattaaaattttattttgttttactcctccaactacttcaaaataccacttgtaggtaaaatttacatggttaaaattggttttgagcagcatcagccctttgtggaatgagctggagtaaaaagaaacattttcatttcaggttcataccccccattcactgtgttacaggcttgcaagattgactgagtaagccagtccatctcagggcatgacgtcaggtcaaacaagtcaagccatcctggtcccaaaatcctggattttgtctgttcttattttagccactcataggctaggagagtcttgagagcacagaatgtgatacacagtgtgggaacaggggagaatctaatgactactgttcatttactgtctgccaggcactgtcgtaggccttagtgtaaggtacataagttaatccttgcaataagcttttcagacaagaaattaccccatttttaaagatgagttaaattgagggtctatataagttatttatccaaagtcaaacagtgaggccaggcacggtggctcacgcttgtaatcccagcactttgagaggccgaggcaggtggatcacttgaggtcaggagtttgagaccagcctggccaacatggtgaaaccccgtctcgactaaaaatacaaaaagattagctgggcatggtggtgcacgcctatggccccagctactcaggaggctgaggcaggacaattgctcgaacccggagggtggaggttgcagtgagctgagatcacactaccacactccagcctgggcgacagagtgagactccatctcaaaaaacaaaccaacaaaaaattcaaatagcggataaatcgttaagctaagtctctataatgccagtatccgtactcttagactggcccaaaggaacttgaagagatctatagcatgagactagacagggaaacagtgggaaggtaactgtcggggttagaattgtgggagtcaaggactcccaggttgatgctgaggtattccagtgtagaagagttggaaccctaagaaatgagacattaggagcagcaggtcataacttggaagagagaggttgctgccatggtattgaagcgtacttaaagtaccaaccggttaagtagacactacattgccttgttaagctggagaggatatgctcccctagttatagcacagctgattaggcagttatttgccatagacaaataacagtgcatctgtatatatcttttttttttaacttcttaggacttttgaacacaataaatatctcacattttcttgtaattttaataataaccgtaatatggggagtatttgtgtgtgtgtatatatgtgtgtgtgtgtgtgtgtgtatatatatatatatatatatatatatatatatatatatatatatatatatatatatgtatcagaccataccagtcatagtagcattataggaaaatacattcattgagccctcactgggatctaaaacatagccttaaagagtgaaatgaaaatccttttaagcgtaagattggagcactagccattttattctgccctggatgctgcaattcttacatttagtcctcattaccatcagccttcccaggcctgggggttgtatgagaaggcccacacagtacagaatcacccccagcctctcctcctccttccactccctgtctttccttttaaggtcttatatcccaaagcttatcagttccaagtttgagtagaactctggtcagtctaagatagcttggctgccaaatgaattctaaacctgccttcaagactgccagagattatggctgaacagggattgagtttgcagagggacctggacttgtttcctgtccctgcttagggggttgcttagccagtgcctggcatcatgaacatcctttggctctcaaatgctttttgattctgcacactgctgtgtaatcgctctgggactcactcacacatggcctcgtgctgacggaaactgtttggcaagagtgggtctgggctgtgtcagctcgatcatggcttcaggccaaactagtcgactgtagtcaggagacccctttttcttagagataatctaggtttgtcggggtatatttcacaagattaccttggctgcctgggtaaggatccccagctcaggtttcgtcacctacgcaccctcctgaaaggcttaacactcaagccgcatgctggagttgaaatccctcagcattgccttgcaaggctgccctcttccttgttcccccatgtgggaaaagagaagcaaccgtttcagaactatggtggatgctttttgcagatgagtggacctggggtgcattctgtatcctcgaatagaaataagctaactggccaggcgcggtggctcatgcctgtaatcccagcactttgggaggccaaggcgggtggatcacctgaggttgggagttcgagaccagcctggccaacatggagaaaccccatctctactaaaaatacaaaattagccaggtgtggtgtcgggcgcctgtaatcccacctactcgggaggctgaggcaggagaatcgcttgaacccgggagacggaggttgcagtgagctgagatcatgccattgcactccaggctgggtgacaagggcgagactccatctcaaaaaaaaaaagaaataagctaactggcacaaaaggtgattaaacacatgatgttagccctgttaggagtgtgatgtcatataatatgaaaaattagagtagctagcatttatcaagcatataccatgtaccaggcattgtgctgggtactttgtaagcattatctcattcaatcctcccatggttggtgttactgtccctttttatagatggagtctgtgatgctccaagaggttaagcaacttgctctttttcctttattctactcagctagctgactgcctaccttttcatcaaaacctctcctataattgcattatagaactaaatagaatccaaggattctgtgcttttattgaataatcagttcttgttgatttgatacacttttagcttattaatttgtgcattaaaaaaaggttaaaactattttcatgtaaaccaaagcaagtaagatacttaattaattttttttcctggatttgtttttaggtgtgagtttgtttttaattaacagactttattcttttttagggcagttttttaggtttacagttttaggttaacagaaagtacagaagtcccgtatacccctcctccaaaacagtttcccctattgttaacatcgtttgttagtgtggtacatttgttaaaattcatgagccagtattgacgcataattaataattaaagtccacagtttaccttagggttcactcttgtacattctgtgggttttgacaaatgcatagtgatgggtagctactattatggtatcatatggaatagttttactgccctaaatatctcctgttctccacctattcattacctcccactccccaccactgatctttttactctctccatagttatgcctttcacttagatgtttttgatggtctcagtgtcctacaatctctgactgttttgcagatttcttcttaaccttctgttatctatcccagccccatccagtcccctgcaattatacctaattatgactacttacatgggctgaaaatttcacagtcatcattaatgatggcttaggttgagatttttctccctttctggatctttagtattcgatttttaaatttgctaatacaaatatttacttacactaggtttccagttagtttttgtttttcattttcttccttttaaatgtaagagaggagggaggtgctatttcagtatttcctcatgtggattcactgaaataactatgtcctaagtgtgttgtttttaatagcgttactaccaaggtggcaatggcagagaaactcaggagaaagctgctggcttagcctcacaaattcagaggtgagggatgaggcaacaaggatgcttgccattgaattatactgatcagatacatgaacctgttggaatcagggactcctgctggccaactgaagctgcaatcttccgtgaactcccctttcctccttgcctcctgcctaccaccttttaattttttttttcattatcatctaaagtccacgaaaggcaagaatggaaagttctgcttccatggcaaagaaaatactgtagcataaaaatctatatttgttctcttgctagtttttcccccatgtggtaggaccatctgaaagtagctcaattatttattgccttgttccaggggaggaggaaaatacagaccactagatgctgtgccagagagagagagagaagtattctctgctttggggaagggggttttacaagtgttaacaatgtggttcagaatcactaaagttgttttagcataatactatgaggaaagagacaagaaccatctgttgaaatggctcttacatgatgctgcattttcaaacaaagccttctcaaggcatttttagattggtctctttcccttgaagttgctacaaagagagcccactctactagctgctaagtgatgctgcttagatagctctctctgtcagcacccactcttttgtttattttgcgctagtgttttcctcaaagtatgagtgctaaggctgtcaaatatcactcctggtaggaacccagaaagttctcctgaaaaatccactacttctgcccatttccttccaaattgctgactctattttacttgaagttggtggagtgacttcgaaaccctaactacttcactgggaaagaggaaaaccgcaaatacacacaggccattgtgactctggcctggtgggctctaattttctagcggcggtttgtacacccaagccggctgcaagggttaagtaaacttcgtggctaaggatgacttcatggccctggaattttgaaaagccaggattctcagtacactgtggccagccttagagtctttgggtgtgaaaaccactctcagttacccggactgatttttggttcctgttgcagtgctgcagaatctattaaaatccggcagctgaattgtcctggctctgccacaaagctcagctgccgggtccactacaggattcctgagttgtttgtcaatggagagtgggagtgaatggaaccaggcatatgcctcagcctggcatgaggtggcaccctagtggctgttttctgccttagaaatgtgcgctctttctatattttcacacaggaattgtcattaacatccaaattgcagttcatttctaaagttctttttgaagtctctgggtccttgttacgttttcaagtacccatattcagatgcttagattttcaggctagtaatttagtaagaactattggcaatattctaacctgacatggtggaacttctaagacagaatgaactcggctacaaggcacaacaagaaaacgaaactcttgggtaggaacaagcccaaacttgaaaatacaaaatgttcttgcacagaaggactaatgaggaaatgggtgtaggataagaaattccagacatccagtcatttggggtgccatttaaacattcgcagtactttagatcttaattaaagtgggatagatttaaaactttctttctaaactagtggcctgttggttttcctgtgttaagtaacacgatagctgtgatcattgcatggaaattaatttttaaaatagcttatattcttaagcaagatcttctttcaaaagaaaccatttgggctcgagcattaaaggaagaaacaaaaagaatataataaaaaatagattgcagccctagcatgaacagttgccgtgaccttgccttttgtttgccattacacaattcaatggcagtctactcaaactatgtgctcgatcaatatcctattaaagcagcacaaaaagtctccataaacttagtggttagctatgtttataaatggaactcggcataattggatggtcaatagcaggctctactagtaattttaaaatgaacgtcacacattttatatctgtagaagtcaatggcacctcttctagagtgaaggtagagtgtggagcagacaaaagagtgggtggccctttaaaaaaatcataatgtctatttccaaatgtagtttttaaagaaaatctaagttatggaagagaaaattctgattggcccctatatatttttattttgcctatctgaaccaccttcttctgaatatattatgactttgcaaatgttacattttctagttttaatcaacccctcatagagaggtaaaataataaatattgccatactcgtaggaagaaaaataacagtctggctggcttaattcagccagcttcctctactataattcaataaattttcaaaataaatattgaaattgaattagttcaggaggatgttttgttgtatgattttttccttttaattttcttgacatgtttggggtgaatatttgggtagtaaagctggcagcaagtgcaatggactggtagtaatagaaattgtcgtcaaactacgctttcttctgaatcctagctcacagtatgggtggccaagcttgatttttttcctatcctaccctcctcacctaatgaagccatgtaaggtgagagtatccccacccttagactgactctgtcctcagccgactcagccctatgaattaaaaggtgcatataccttgtgttcgatatgtgccctggctgttgtcatggaccactgagctgttgaaattagaactatggcaggaatacgcttatgacattagtgtatccttcagtcactgctctgcatgaaggtctagtcctttctcttacatgcatactcctacaatcttcctggttagagctggcagtgagagttctcatggcagaatttggggccgttttgatctctgttctcagctgaagcttctgataaatttaccagactatgaatactcttattataaagatttgaactggggagaaacacaacataccccttgatgtacatactaatgtgttgtcatggtctctattcgtatgttcatctatttctaggtcattcatcagttatgctttctatgtgtcaagtataaaacctatattcaagatggcagcatgatattgtaaaacagtacaggatatagagttggggaattgagctttgcaacttatcaactctatagctttgggcaatatttaacccctcttggctgtgttttcttctaggttacaatcatttattcattgagcaaatgtttatgaagtcctaactgtgtgctgagtctaagtccaagtactggaaataggaatacctctcaggagtgtaatgagggttaagtgacagatagtctagtgtctgccacatagtagatgctcaacaatgataaccaccacgattattgaacagagcctcagcccctgatcgttcttcactgtgtgctcagagccaatcttggagctgaccactatcagtaaatttattgaaaatgcatgtgtgtgtgcgtgtataaattaagaagggccaattttagaattcatgttctaacaaccaattattagaagagccactctagtgacccttacggagttagtaattccaatagagtaagagcatgccaatagtagacctcattcctctgttttgagcattgtttttcctcaaattttcagaagattctttttcctcaaattttcagccagagcctgtgtttctgcattattctagaaattgttctcctaggatatctcgtggatagcagaatgttttaaaattctcaatctaacactgacacattaacaactttttaagtggcaaaccacacctgggtcatctgtaccggcattctttttttttttttttttttttgagatggagtctcgctctgtcacccaggctggagtgcagtggcgtgatctcggctcactgcaagctccaccttccgggttcacaccattctcctgcctccgcctgccgagtagccgggactacaggtgtccaccaccgcgcccggctaattttttgtatttttagtagagacggggtttcaccgtggtctcgatctcctgacctcgtgatccgcccgcctccacctcccgaagtgctgggattacaggtgtgagccactgcacctggcccatgtaccagcattcttaaaagtagtacttagttttacagtattttaaaattttgctttcactcatattatgagcaaaaattccctatgaatggcagaagcatgctacaggtcattactgacaatgtggtttgtttgggttttcttgagacagagtctcactctgttgtccaggctggagtgtggtgatacaatcatggctccctgtaactccacctcccaggccccagggatcctcccacctcagccttcccagtagccgggaccacaggcacgcgttgccacatccaactaatgtttgcattttttgcagaagtagggttttgtcatgttgcccaggctcgtctcgaactcctgggctcaagagatctgcctgccttggcctcccaaagtgcctggattacaggcgtgagccagtgtgcccagctaataatgtgctttttaataaacctttatttatgcactcataagcctcaactttttaatggtggatattcatatccagtagtaacactgaaaaactagaaggggtttttgtgacctccaaagcttgagagaaatcctatattaccctgcagtagggccacaaatattattgagatttggctggagtacattatcatagctaactcttgccgagtagaagggctgttggtagtgaccatcttagcatgtctagaatggggccggtggagtccacattcagcaaaaccacacataggtcaaatactggaactgaactaatccagtgtgtggttaatatgagtacatgttaatacccaggatttttcactaggtggaggagaaaaaaaatgaaagttattggtggaaatattgaaaactattttttttttttgtaaacagctgaattagtcagttgttgggatgggactctgttgatacggtttggtttcctaatagctaatggtcaagtagtcccagtgcactattggttgtggggcttatgtttagcttagcccttccctggtttatagatcactgtggcaaaaagacctcttaggccatcaaatcccatccctgtcagagaagacttaatcccatgactgaggctgtatcagatactaagcaggtaccacatttgacctcaaccaaaagctaagacatgatgatactctaaaatgcagaaaatcaatttcagcccccaaagcagaaggcactaatgcagatcagtcagcattgctaacccctctgtggactgctctgttagaccaagtggcagggcccttcatccaatggaactcttgctgacgcttataaagtttaagacctgcaaaagcagagaggcgagaaggagaatgatgagatagaagttttgccacataagtgtaggcgataattattcttctatttaaacgtgttgaatatatctccttcataactgatgacaaaggaaagacagcaacactagaaatgtgaatttcactcctgtttctttgaacagatatctaggaaatatctacattcaagcccttcttctgtcacttacttagttgcatgatcttgaccatgttacttaactctcagcgtagtttctcatttctaaatgagaataatataaatacatattccatagggataatgcaaagattaaatgagataattcaggtaaaatacctagcacattgcctggcatgtaataaatgctcaataaatattagctcttagctatttttcattaacaagctcgtgtaattttagttcaactcagtaaacatttggtgcatatgtaatatatgaagcaccctgcactgtgtactgaggagaatacaaaaataagtaggagacagccttttcctctacagggtatatatttaagtttcttgagatctaagactgagcttattttatggcaataaaaagcctgaatacacttaatttacaaattaaactcacagtaattatctgtcaaagataaagtatcttcctgattcggagtggggtgggaaaatgtatcggttaatttttcctattttaatgaaacagaaacattttttgaaaaataaaaattcctctcttcacctcccttttctccttccgccaccatgtatatattccttaacatgtgttcacaagacagggatgtgtgaaaatagggctctgtctgtgttagcggatgcctttcatggggttaaaaaatattctactggcttttgtcacctaatagtacatttcgtaaaaagcattgcttaaatcttttaatagcaggcaagttcattttcacatagagggaaatccttgttttagttcattgcctttttttaatgttcctgtttggaaaaccatactcttagcctgcatttggtcagaccttttagaaaggaaaagtagaaaacaggagatcagcacagggtttacagaccagaaatctgcttggcaaaggagttgctgaagactgtggcgtagaagctgcagagaaagtacctttatgattgatttccattcaagtcagactgactgcagtgtggtcatttttctaacccataactgctcacactgcagcagtctgctatctgcagggtgtctgaattatagcagtctatgttcgtgttacctcttatacaaattacttacactggtttctttttccatgcaaattcatcagttttacagcctctcacagccacagtcaggaaactctggcagagagcacaaattgataaaatgagttaatttttactatacttattttttttctttctaaaagccctttctcataggcagtgttcaggaagcatattacggtaaaagggagataacaaaggagttgaattttcttgccataaattactttccaagttaattccctttaacgatgattccagatttgcttgagttttcatagcattgtgcgttttacaactgtgcctttgatagaaagaagaacaagtattttcccatgttcagtccctttgtgccagtgacatgaactttcttacaagatctttgccactggaatgcaaaacaacactaaattgtgctgggtccatagaactctgtgctgctattggacttttcccctcccccggtcttcaaatacaagttcccaaagtctcactgagtgttttagatcatgtaatcagaagaaaaatatctctccattttttcatatttgtaagttggaaattgagttgggttacttattgccattctttcatattcctcggtggccatacagatttgaagaagggacaataatggtcagtctctgaaatgtaagccccacaagggcaggggttttctatatcttgtccactgatgtttctcaagcatctggaatgatgcctggctcactaaaagtgctccataaatattgttgaattccattgaatacagcctctctgaggatatgtactattaaccataggctggacaaactagtcatttcgttaatgctccctgctgacttccgttgaacaagttggaaacttagcacactgtaatctctcaggcagagtagctcaaaaatttgtatggaaattttttccatcatcctctctttccaacaatgcaagcctgagcagcttgtctctggtggatggcagaagttcaataaccacaaccttatccaactactaatgtgtacagaagagcaggtcattaagagggttggctactaaaataacccctttcttccagtagcctacattactataatgattccttaatagcaaaccatttattaagaaatgacacaaagactacattctacttatgacaggaaagaggcaggggtagaggatgaatgacttggaagtaatatttgaagagaccatttccaaaagttaaccttttgagaaaaactcctcgatagagcaaaatacttcagattcgttaattacaatactacttaagaaaattgaggagccttcaacacaatttatatgtatttatagaattctgagtttcatttggtattgtttaaagtttagagggggcaaatagggagggtaattattcactcttcttaattcaaagcatatttattgatgatcaactgtgtacacaaaactggtcaaagggagctctaggacctgtaggattaaagtcatgtgtatcacctctgacttcatgacctgggagagttatttaacctctttgtgcctcagttccttcctggtggtatggtgaggatcaggattccccagtgctcaggctgcagactagtaccagtcagtggcctgttaggaaccggactgcacagcaggaggggagtggcgggtgagtgagcattgctccctgaactctgcctcctgtcagatcagtggtagcattagattctcctaggaacgcaaaccctattgtgaactgcacgtgcgaaggacctgggttgcagcctccttatgagagtctaatgcctgatgatctgagggggaacagtttcactccgaaatcacccccctactctgattcatggcaaaattgttttctatgaaactggtctctggtgccaaaaaggttggggacttctggtgaggagtaagtgggatgatgtgcttaaaacccttagcccaacttctggttcataaatgatgcctaataaatcgtgatggtgatggtggcagcagtggttagtggtggcagttcatttttgccataattattattagaattatgaggcccaaagagttccagtgacttaatcaagtaaacaggtggtgattggcaggattgggaatctagacaatctctccccgtcctatactagcattttttatgccccatgacatctctttataaccttcaaaatgcatctcaacctagatagggagaaaatgttacatatgagacaaagcatgataaagcccagagtcaattacaaatggagcaaaactggatttcacaataaatggaacagaaaggcagtgctgtgcttggtccagtcctacctaacatctccacatttgattggcagcgactgcatcgtttttatagcacaccagaaggcagttagtctttaacctcaaaaacccaatgtgataacctgggcaggccagaatttatgtgacattggacaaatcatttaaccttccacaacttttattagtttcttaattttcaaaagaaggacttaatgccattattagttaaaaagtatactgtgttacatacatcttattgatattttatatttgttagaagaatatgatcatttatttatgccctttcaagtgcacaattgggaacaggtctttgagacctgtttgctctcctggaggaggtgtcaaatttccattgtaaaaattctattttctttcccagcagcagagtcttggcctccattcccttctgctgggacacttgcatcaatcttctgatttccccacctccagaatcttagcccccttccatgcattctgaatatggttgctgtgttagtccgttctcatgctgctatgaagaaatacccgagactgggtgatttgtaaagaaaagaggtttaattgactcacagttctacatggctgggaaagtctcgggaaacttataatcatggcagaaggcacctcttcacagggcagcaggagagagaatcggtccccagcaaagggggaagccccttataacaccatcagatctcgtgggaacttactcactatcacgagaacagcatgggggaaactgcccccaagattcagttatctccacctggtcccacccttgacatgtggaaattacaattcaaggtgagatttgggtggggacacagagccaaaccatatcagttgccttgtgattgttcccaggtccacagtgatcttatcacttccctattcagaaactgtcctggatcccacttttttttttttttttttttttttttgagatggagtcttgctctgtcgcccaggctagagtgcagtggcacgatctgggctcactgtaagctccgcctcctgggttcacaccattctcctgcctcagcctcccgagtagctgggactacaggcgcccaccaccacgcccggctaattttctgtatttttagcagagatggagtttcaccgtgttagccaggatggtctcgatctcctgacctcatgatccgcctgcctcagcctcccaaagtgctgggattacagtcgtgagccaccgtgcccggcccactttgcttcttatctccaaacttatgcacatactttgtctattgccaagaaagcctctcctgtgtcctgtgcctctttaaatctgaactatcctcgaaggctcagcttaagtgcccactcttcctggaatcaaacctttttctgatctcacaagccaatgggatccatgactcctttgaactttcctagcacattctttgcattttttcctatgaaatttagcatgttcggcattgcattagatattcaggtattattttagtattccacttaggttgtaaaccttttggggacagagacactgtgtatctttttatcatttcaagtttaagacaaatactatatgtgggagtcagtgtggcgcagtaagaaaagcccaggttttgaggtcagtatccttacattttaaccctgactctctctttttgtctttttgtaatcgaggacaagttatttaatctcacttcaaggcttcgttctcctcatctagcaaatgcactttgaggtttgagaatgaaattaagtacagtaagtacagtgcttatcaaaacatggcatcatgggtgctccaaaaagcctgcctaaagcccacctcttcagttcttcatgacctgccaaaagctctttctgttctccagattagaggtactgagaatacccaacccaatgcaaggatactttgatagggactgctcccctcaagtgtgaagctttctctttggctgtgacagtgtcactgagtcagaatccaacccaataagccaactgtccatgtgattcatacctacaggcagttgcagggggatgttcctttataagactcttgaagaaggcagagtttgggtctgtgaattactaggattatttaactcagggtgtgaaacccattctcatttcagaaacttagtgatgttttaaaattcaagacacacataaccagtttgccaagctctcaagttactcatcagaagtctgatagacactttcgggacgtgccaggccacctggtgccatttgccacattacaattccagtgtacttaagtggttcacaggaagtatatatatgaccaagctaagcccgtttatgtgggcttaattattttttaacatctggaaggtgggcacaccatgtttacacaggcttttctttttcttcccctattctggctctcttgacatttaaaaaagataaggcaaaagacatttttctaggatagataaagtattaaatttaagtgcagctggatgttcaccacgagctaggaggcctcttcttctctccgtctgatcaagtccctcacattcacactttgctctgtgttcctctccttccaagagcgagggagtgagggccagacagtgtccgccatgctcaggaatgaaacggcttctccacccagttgagacctcatctcccttctgacatttgtgaaaaacatctaaatccagagctatgacactgatcagccttataacccttctttggttaatgagaggtgtgaatctctaatctccaggaaggcacaaagcattaagtacctactgtatgtcagcttgctgggagtgaggatgagtgatctaggctcatatttgactaatctcccccacccttcctccatagcctatttcatacataaagattacctaataaaagaggaaattatgcaaataaatttaatataaaaagcaaattagggaatgactatcagaattattaattagaaccctgtttacacttattgtcaagcctcaccgtttttttttaaacgaaaggcccttagagcctgttactgagagatgtgtttgaatttcagaaagtagatgtgaatttcagtcttccattttttttagcagtgactgtttttgtatattgacagttgtgattaaggtttattcattggtattaatcaaataactaagtatttattcttagaaattgttttatttcctcataccgtccctcgattccatagttccattatggcacctcaattcacctggtttcccaagtgctaatcgtgggagttatcccatactcccctgttcccattattacgatagtcaagaagtcagcatgtcttctttttatttatttattttccaagatttttattcgagatgggttctcactccattgcccaggctggagttgtagtgacatgatcatagttaactgcagcctcaaactcctgggctcaagtgatcctcccgtctcagcctcctaagtagctgggactacaggcacgtgtcactacacctagctaatttaatttttaaaaaaaatattttttttttctgtggagacatagtctcactatgttgctcaggctggtcttgaacttttggtctcaagcaatcctcccacctcagcttcccaaagtgctgtgattataggcgtgagccaccacacgtgtgcccagccagtcagtacatcttgattctaactcctgaataacttacatcaggctcctcctttccatcctttgagtttagtccccatccccactataccttgcataaatgccccagtggactctctggtttgcctattatattcttcaggcgccccccaccctttcacctccatgcctaccctcatgacagactgatctttctaggtgataaatgcaaatttgatgatagcattcccatactttgctggtccttctttgactattgaatacaactcaatgcagcaacccattccattgaccagtgtttactgactgcctcctggtgtcagggactatattagatgctgacagtataatccccagttatagtggggtgaggtagatgctttaatagcttataaacttgggaatctgctgaattcaaatttatgttccttaaataaacctgccagatcccaccgggcacatgttggctcatgcttgtaatcccagtgctttgggaggcaaaggcaggaggatcgctttagactggaagttcaataccagcctgggcattatggtaaggacccatctctacaaaagaaatttttaaaaaattagccgggtgtggcgtagcatacctgtggtcccagctattccggaggctgaggcgggaagattgcttgagcgcaggagctggaggctacagtaagctatgatcacacctctgcatctgcacttagcctgtgtggcaaagtgagctcttgtctctaaaacaaagaaagaaaaacctgccagatccttcataacctcaccttaaccatccttcctctttcccgtgtattctacactatgtcatcataccaagctatcagaaatccagtaaacattttctgctctcttgatgctgtttcctctacctagaagtcctccatccctttcagttgcataattcctcctttccttttaacattgtttccaggcttcacgttttctgaggccattcccttgaacttcttatccccaggttgggttagataacccacttctttgcagccacttcaatttaggaatgcagatggtccccaatttacaatgattccacttaaaattttcagctttacgatggtgggaaagtgacatgtgttcagtagaagtcatacttcaagtagccatacacttattctgtttttcactttcagtacaatattcaatcagttacatgagatattcaacactttattataaaataggcatattaagtgcattttaagctgatgatatttttaacttatgatgagtttatcaggacatagcctcattgtaagttgagcacctgtagctctatcagatgacttcgcagacttttaaaaaattaatctgtcagactttcttttccgtttaagggtagggaccatgtctttcatctaagtgccttcctcactcatcatagttcttggcagtagcaggctctcagtaagcattcattggatgtacaaatgtccctggttcatgataacccttattgttatttcttctgatggatactaacctgtaatttatttattccagtatcaaatcatgtgggcttagctctcaaaccagtgcctcagtacagtatctattgttcctgctttgacataacctttcaaaaagattatttgcactaataatttacaccactaattttacggagttgttttatagaattggtacttgttatttgtccattggaaaacatgtattaaactactgtcaaaaaggtatctaaagattcaaagacagaaaatgcaaggaatcagtctcacacaagggtcatttctgaaaatcacaaataatcaaaattaaatcaaaggtcagaaaatcattttataagaggccagctaataaatatgttaggctttgtgggccatatggtctctgttgcagctactcgtctctgatggtgtaatgtggcagcagtcatagacaatatagaaatgaaaggccatggctatgctcccgtaaaactttattcataaaaactatgggcctgccttaaattacaaggttggacaaatattcagttaaggtgtatgcaagatggagaggtgattcagagtaaagagaaaccacacatttcatgttataagaaactgggaatggacagcttagaaagatgactttgttctcaccaaagttcaaaacagaattccaaaatacagatgagtagaagctgtcaggatcagataaagttagaaaagtctaaagagtgttttggctggtcattccagaaaagtgtaagaccaaaatgtggggaagtatttttgttaaaagcatccaagaatgttgcaaccttggtgacaatttactattacataaagagaaaagatgaaaaatatattagaaaaaatatgcctttcctgtatagactatttttagtcaatattcctttggagtcatagtttattactgattattttcgattcgcttacatataaatgcaaaaagaaaatgtgctaaatgcaacactgaggatgctgtcattgatttttttatccacagaatttaactgatttttgtttgttttcttaattctagcaccaatagctgcaggaactggcccaaatttttctctctcagatttggaaagttcttcatactacagcatgagtccaggagcaatgaggaggtctttacccagcacatcctctacgaggtaattttattggcagctcttgaagaaattatgctacatggttgcacaccttgattttaactctgggcccactatggatttagcaatgcgcctttagtaatagaagataacaaagtagtgggttcagccccaaaagactgtcggtctcgttggggagataaagcaaatatgcatgtggcaagattaaatacacacacacacacacacacacacacacgcacacacactaaaaaactgtgaactaaattgtgtgacacaggctaaaaatagttaaagagagctttatgcaaaaagaataccttgtttccagctctaaatgttggttagggttggtgagatagaaaggaaaaggaatggaattctgggtggggtgaaaaatgagcaaaggcttggaggaaggatggatgatgaacataacatgttctcaggaaatgaaggacaaggctggactgcagcaaagggcatatgttttggcttgtttggcaggaagtgaacactggtgacagtctcagtgtcatgcccacagcagacattacagctcagtgccagctcttttcccaccgagcccccaaagctctcaatatccagtttactggagttgccctaaaaggtgaaacccatttgatatcctggtgtgaggttatacaaatggaagtagtcacttgcataacctcaagtgagggtggggccagaccacagaccccattgtattgagagaccttaaaaacagtaaagctagagtagtgtaacctgataatgattctggggttcttgctccctttaacgtcacaaagccaaaatcaaaatgaagcatttttgcaagatcgtgttgtctctagataacctgtaccagagggaaagggattaggcattaaacccacagtattcttttacaaattggctttagcactggactgtgacaacaaagaatagaatggtacagaacgatctttaatgtttgtgtactttgcagaaaaatgtctgacaaaggtatattcctcctaaagcaagtacctgagtcttatgatttaaaacaatgcccaaattatagaacttttccttggtgcacactcgttcttaccttgcctttatatattttaaacatcactactttaaaaaaaagatcaacttagtcatccctaataccttgaagacagttaaagaaacaggtattcccttaatataactatcaaatcctaccatcatctttcatgttgtttaaatgttccctttagttccctgtagtatcagctcctcagggggacaaaaaagtcacacatccaaagtatatttataatagaagaaagagattgtgaatatatttgggtgttcatacattttgaggattttgaatgtttgctgatgggagagaccttgtgtgtaactgtactcagtcaacatgaaaaagctttgcaaatacctgtgggcagtgattaatttaaaagtttatgggctgtttgtttttcatgtgtgtgctgtatgtgtaccatgtacctcccaaacagtgtttccccctttttatgttttcacacaattctccagctatgttttattatcttttgtgactctctgagaggaaagctcattatgaatgtcatttaaaaggccagtgtcgttctcatattctgcaaataactaaccctgataaggagctaattataacctgcatcagtagttaataacccggtaatatgtttgttttactctcattaggctcttcctaggatgatttttaaaattctttaaatacatagattcagcagaattaacgatgtacaggttagaaagtgtgcccagaagaatatctcagatttatatatagaaatgttcaccgatcaatatgtcttcctgctgtgccaatattaatgggtcattttctctgtggcaggcaccatattaggtgagttgtatacctgttctgatttattcttcacaataatttgacaacacacacagtgttttcatttaaacagtggagcaacacaaagctcagagaagttaagtaacttgcccaaagtcacagtcctagtgaatagaggagtctccattcacactcaggtctgttggaactttaaaaatatgctcttttcacacagaatcctcttgagaataggactgactcttttagtaaggaacaacagaatatgaggtcctaaaaaaggagtttctagcatctctattcctccctggcatttagtgtttgccgtcttgagttattcttaaccatctttgaggccaacacgtgtgcagcctccccatctagacagtgagtcccttgaacgacagcgtctagctcttcccattcagcagcgaacgttattagtaagaaacaaggacaccgtccttggcaccatgggtgtaaagtcaaataagaggggctttacaatctagtggtagagactgagaagtgggaattttcagttcagggtcctatgaacactcaggaaagttaaggcattttgcagtcttaggaatgctaagtaagacttctaggccgtaattacacagagtaggaattaagatatttggaattagggtaatacttttaccttattttttagatataattgctagaaatacaagaaaaaattccacatacaagaagaaatagtgcatcactccttaggagaatattcatccttttcgtgtagatcttacagatactttcctgcttccctcaagtgtttctgggaaaatgagtgtgttagaaagagcaagaaaccaaaatcaatgactgattcatttcaatagatagataggtaggtagataatgtgatgcaatggtactgactgtaagttctgtaccccttcagggtaaacatcttcaaaatcatagaaagagcagtgtaaaaattgggatacgatacattttttattccaaaaaactttatcaagataaaccagctgtcaaaagtttgtgaagtcagagtaaagttgtctcggaagcctccacctgtgcttcctaacttgcttcattcctgatctttttatcttttccatgctccctccagatgttaatttttttttttctccaatagagacagagtctctttctattacccaaggtgagtgcagtgatcataattcactgcaacctcgaagtcccgagctcaagcaattctcctgcctcagcctttgaagtagctaggactgtaggcatctgccaccacacgcggctgatttaaaaaatatttttttttgtaaagacaaggtctcgctatgttgcccacggtggtctctcaactcctggcttcaagtgatcctcctgccttggcctcccaaagtgttggaattataggtgtgagccaccatgcccagccctcttttgtcaacttctgaaaatccttgctttcaaactaaggcatcaaccgatagctatagaatctttcaactctaggatttaatactggcttggggtatttgcattttattagaggatgccaaggaaatcaaaacctttaaaaactcagaaaagtatcaataatgggagaatgatggacaatggagttggcctttggggctagatctaactgaattatacttggatgaatccatgtcacatgtatttgtatggctgtttctaagtcagtagcccaattcagcagttttttagtatcttctgttagccagacactgtggtaggcactagagattaaaaagtatatagtcattttccctgaagatcttacagccccatcagaacatataggcttctcattttatttgccagagtacttcagggaaatgtttatttttttctaacatgtattctttctgtttccaagatgatttccagtggctttccattttaaaacaacaggtaatattaaatgtagaaagaggccagaaaccatgtggaaaaaaattgttatagcaggagcctgaaccaagagttatgccttaagtttagccctgagcttcctggttgccaaggcaaaaagggttatatagtttgcatttctaataaaaggatacaagataaatttgttcaaagagaccatatttttctgattatgttttgtaaggaattcgctgtgtatatcgtcttataaaggactcccattagatgtagttttacataaaatatagaaaagttcttcagtggctatttttcattgaactttcaaggaaagcccagcaaagaacattaaataagcattaaaggcatttcctttgagtactaagctagcatggcacagttatgttgctttcctgtggtctggctttaatgagaatagaacttaatggctaagaatactggaatgccaacattaataattagaatttcttgccataaattggccctccacattttttcattcagattgctgcaatagcttaactgtctccctgccctaggctccattttcctgttttcccctttgcctttctaaatctatcatctgcacaattaccaaagtaacttttctaaaatataactcccctgtcattccctgtttagattatttcggggagtctacattgcttataggagaaagtccagacgtgcaatatcttctataacctccacccttctcactcgctgtgccccttcttccccacctcagccatcctaaacagctggcagttctctgaacatatcacacttcactcacaatgtggcttcttcctgataggctcctcccttctgggggttatgttcgaaatatctgataacctgtgtgacatgagcataccaattagaacagacactgccctgcttgcagggctttctttggctaggtcctggaatgctcctgatctgcaagacattaaccctttagatttcggactgtgagggtgtctgggacaaagaaggggaggcaaggttggaagaaatgtatggagtttaagacaatgacagtttgcccattgataatatttttaataccaaatggctgcctgagtggtacatcagctgtagagcagccctgcctctgccctttccttcattcttccctgtctccttgaccctcttgaagatagctcaggagccatttcctccaggaagcctttcccgaacccctggctcatcactgtctccattgtgtgacccactgtaccctgtgtgtggttccatcataactcctatatttctcttttgcacagttttgtttgcctctctgtctccatgtctgactcatctctatatcccagcactttgcacagcacctggcatgtaggatgcgcacagtaggtatttcatgaatgaaacatacgaaaacttctgtcccctgaaacgtgaagaagagatttcccaacacgcactcccagtagatatgaaatctactcatcctaataatatgggtagatttgacagttttatcacccctgcaaacttcctgattctgtggcattcaattaaaacaactacagcaagcatagcagcaggcggcatttcactacgttttcactcctgaagcctcaaactggggagaatattcagtccttcaactggaaaaaatgagatatattctgaaagtttcttgaccgtacctctccaaaaaatgaaaatccctaccctgatggaataaaactttgttttgataatctttgcatagagaaagcacataaaagtcattgggccactctttttttatgtctcttgttctcaggggacagagcactccttcttccttcctttttatttgttttgttcactgatttatttctagtatttagagcaggacctggactagctgtgcagtaaatgtttttttgaatgaacaactccaagtggaagatgggaaaatgtggcaaaagaaaaaaaaagcaatccaaacttttcattttcttttcttttctttctttctttttttttttttttttttttttttgagacagaatcttgctctgtcgcccagggttgagtgcagtggcacgatctcggctcactgcaacctccacctctcaattcaagcaattgtcctgcctcagcctcccgagtagctgggattacaggtgcctgccaccacacccagctaatttttgcacttttagtagagataggattttaccatgttggccaggatggtctcaaactcctgacctcaagtgtgatcagcctgccttggcctcccaaagtcctgggattacaggcttgagccaccatgcccagcccaatccaagcttttcctgaaggatcacgagccctgctttttatcctttctgaggttccagcagggattaaattgatgcccaggttcattgctgatggccaggccccagccaccacctgtggagataggaaatatgtggccttactcccaacacttccaggtggaggcaggagctagagccagccgcttattcctcaaaggaaacaggaacaggatgtggcagcagcagcaacttgattgacaataaaaatcaaactcagacacttggaacaacacagacccaagactttgttctacatccagtgactcaccagactgaacagaagtttaaaaggagtcctagaactacattaagttgcccaattgcttcctcccttggctttctttcaaccagaggtgcagtgtccaagagaaaggtggttgcgattgcttttaaacatgcacccatttgttatttcagctccacaaagcgcctcaagtctgtggaggatgaaatggacagtcctggtgaggagccattttatacaggccaagggcgctccccaggaagtggcagtcagtcaagtggatggcatgaagtggagccaggtaagcagagtggcggcacgggcatgtggctaacactgtgaaactgaaaatacgtgtggggtcccatgccacgcataaaagtgaagaaagaaagctcaaggtagttcactttttcaggatgagcacttgtttgtattgtaatctgattgccacattcataaaaggatggctgtgcaaagcagtagtaattcaactgaaatgcaagactggtgagatggtgtatgattttctgctcttacatattttcccctacaccacaatccagcatttgatttgcttttggtttttttgtttgttttgttttgtttgtttgtttgcttttttgagacagagtcttgccctgtcgcccgggctggagtacagtggcatgatcttggctcactgcaacctccttctccctggttcctccttcttctgcctcagcctcccgagtagctgggattacaggcacctgccaccacgcctggctaattttttgtatttttagtagagacggggtttcaccatgttggccaagctggtcaatttttgtatttttaaaagagacggggtttcaccatgttggccaggctggtctcaaactcctgaccttgtgattcacccacctcggcctcccaattgtttttgtttttatactatcttttggtttagtttttgaaattatcttttaatcctaataaaaatctatcaactttttcagcaggatcgataacattcgaaagaagaatgggttccttgcgatagtttagactcagatttttatataataaggacactttgcaatatttttcctattactggatatcatcatgattatttttctatttaaatggaacaactctctttattctgatctgtactaaactgaacaaatgatgactgctggtctaatctcctggggtagtctaatcttggctctggagtcttgggagtaatatggataagtctgattgcaaaaactatttgaaaccctttccaatgtctaacacgtggtttagagggaatcttctccaaagcttcctgaatatggcaagtccaatgggtataaaggatagagtatgtgccttgaaatcagacagttggagtgccaacctggcttcaactcctgctggctgtgtgattgtgggcaagttacctagcctctctgagcctgtgtctccctttttataatctgacagtactaatagctatttcctagcatagctactacctagcatagagtaagtatgaaaatactgttctatggccatccttccccagcttttgcttcagagttaattccctgcaagtacagacgagcaccaagaaaatttctgaaccaacctcttcatctataaatcctagctcccttgtctcctcccttaattttttttcaaaagacaatgctcaggggatgtgactataaaggtgtagcacggggaaaatgttggggtgatagaaccattctgtatcctgattgtggtggtcacagtaatctatacaatcgttaacattcacagaagtacatacctccctgctcaagttaattttactgtatcataattaaacacaaaacaaaaacacctcaggcccattggcggtgtcttttatcttgcccctgctattaaaatgcaaaaatgtctctttgctttgcttctgcctagtctttcattcattcactcattggatagtcttcactggggactttctctgtatgaagcactatgccaggttctgggaactcaaggatagatgggaaggttatggcccctgctctcaaggaattcacagtcagaggtgggaaacaaacacataagcagatcattatacggtgatatgggaagcgcagagatggtggtgttagtcttccgtgacttctgtttctaattagtaccaaccacagcactcaaggtgtggtggttcttctatgaaggtcacacatcatcttttctccgaattcgtgttcacatcagtttgcctaaagtgcctaagaaatagtcccagccctaaatgagaaggaaaatgctgactctcactgccactacccgcatcatcagcatgacctctatatagtgccaatgaaaagtttatgtgctattaaaaaattaaaagatggaaaacttctttgaaccctttttcaaaggctaattagagccctagtcaatttacctgcttcagtgaaaatcagaattaaacatataggtttggtacatttgtgcttgattattgtgtagatgcatttttgtgcatattgaagctgctttattaggttgaggtactcagagctcccccatcatgaggctgagctctaggtccttgcatttaattcctctgggtatattgggggctgtggaggttgattgataattacagaatattttgacctagtgactcttttattcagggcaattcctattcctatctgtacattatgattcaaacgatcataaattttaacatttgaatacctgaatcctttgtagtcattaaataactgaagtttaatggctgaatcctttttggtaagaggtgtgtgtgtgtgtgtgtgtgtgtgtgtgtgtgtgtgtgtgtgtacgtacacatatatattcttagagaatccctcacagttgtattcctggactgactctccattctctatccccatttcattacagaaaaatgcagtttcatggtatatgtttatagggagtgatagaggacagtggataaacgtacatttggccatactcagcaagcgcagaaagtcataattgcaacaaggcctgaggggacattaaaactcaactgaaggatgttgcacatgttcttggtgactttggtgtcattaactcacaccagccattttaaatggataatttatgctgccagatggtcctttttggggattttccataaagcccaatcccctttttggcacagagagcacctttatgttgttcccacacttatgcaggcctgcatagcttttccccaggggtacagttaaattgagtaggaggcttttagtagttcacatgtaaattaccttcagaaatatgttgggagttatgtatatctgaatgcaccagcagcctcttggttgcctacatttgggataattctctcaaacaagtactaaggatactgtgtttaggcctcagatgtgacacaggaagcaaggcctgtacctgctcctcactcagaatgctttggtttccgtttacctgccttaaaatgcttttccaggactccctggccaaaagagggccaaaggttgccagaagagacaaatttcctagagcaacaggaagattgtggaaagtaaaacaaaccagacatgcagtaaattacatgggctatttcaaatgtcttttgtagtatcctgttccccattagtttatctcagcacttttagtgcacagctcttattatctgggaagaagggcataggagattaaagatgatgttagtttaaaaacatcagacaacttcagaatgactttcgcttctcttacaatgctgcatttgtctctcgtacttagttttgtttcccagttatctcaaaactgggttagatacgaagctttgaagcaaatcatgaattgacaaaacgagtcctatgaaattctatcaagcacaaatgcacatatcatcaactcttgtttatctgtacaaatgaagaattacagagaaattgataatgcagataaacaggaaagaaaccaatacacagcgcccacattgggtcagacactcatgttgctttcaaatatatggaaaaattctagttacaattgagtacctactgtgtaccaggtttttaaaaaattaacctcctttaaaatatgcaaaatataatgatcctgcctctaaagagataaaaactgagactcataaaaggtcaagtgacttgcccaagcccacacagatagtaaatctgtggatccaaaatccatatttgaaaccaaatctgacttcatagtctaagtttatcttctacactcagtaacctcttttaccataaacatttggagcagcattttagggtctcatgtcctggactggtactttagttaaaacgttataaagccgggtgtgatggctcacgcctgtaatcccagcactttgggaggccgaggtggacggatcacctgaggttgggagttcgagaccagcctgaccaacatggagaaaccccatctctactaaaaatacaaaattagctgcgcatggtgctgcatgcctataatcccagctactcgggaggctgaggcaggagaattggttgaacctgggaggtggaggttgcagtgaaccgagatcgtgccattgcactccagcctgggcaacaagagcaaaactccgtcaaaaaaaaaaaaaattataataagaaacaataaataactcatgagagagacctgaaaaatattcgattttccttatcccaaagccttgtaatacaacttaatctagagaagaaatatagattattaaatatacataggacacaatatataagcaaagagtattaactgttaacaaagtaaactatcgttttcatttataaaatcaaataaccctcagcagttaggtctttgttcaaatagtagctcatcacacaggccctcagtgatctaaaatagctgctgaccctcactccatcatcctataactcacaacactgttttgctttctttacatctgcatctactattttttttttttttctgagacagagtcttgctctatcgcccaggctggagtgcagtggcgcgatctcagctcactgcaacctccacctccgggttcaggtgattctcctgcctcagcctcccgagcaggtaggactacaggtgcatgccaccatgcctggctaatttttgtatttttagtagagacagggtttcatcatattggccaggctagtctcaaactcctggcctcaagtgatcctcctgcctcagcctcccaaagtgctgggattaccagtgtgagcccaccacgccaggccatctctctgctattattgtctgttttctctctctagaatatatacttcatgaacagtgggacttagtctgtcttttccattgctgtatctctaacatccataacagtgtctagcacataataggtattcaataaatattgattgaatgaatgaagcgataaagcagagaatttggggtgctttcaataaacttgaaagcagaatttgctatcaagaatactctcagaattggtgtttactacactttcaatttgtaggctttcagtcaaatccaattactagcaagtcgtaagcagaacaattgcttaggctcagccaaggacctcttgacgagcagcagtgcattgactttattacaagtatccctcacctgaaagtgtgttcctttaagtgaatcaaaccttttttaaaaaaacaaataataattctgtattatttctaagtttgttgtttagtattagctccgtattaagaatcccaacagtgaatcctttgtagaacattttatgtagtatagacaacctccctgacttacctgtgaaaaattcagatttccataccaaatgttctcttctacaagtgtaaggagcacccatatgagacacttcagacccttgctgctccaagtgtggtctgaggacctgcaacatggcatcacctgggggcttactaaaaatagagaaccctggccgggcatggggcccaaggtgggaggattgcttgaggccaggagcttgagatcagcctaagtaacatagcaggaccctgtctctacaaaaaaaaatttttaattagccatgcataatggtgtgtgcccgtagtcccagctacttgggaggctgaggcaggaggcttgcttgagccgaggaactcaaggttacagtgagctatgattgtgccattgcactccagcctgagcaacagagtgagaccctgtctcaaaagaaaagagaaacaaacagaaaaacagaatctcacgccccacctagaccaacagaattttaacaagatctcccggtgatgcttgtgcatgttacactttgcaaagcactgatttaggctgcttttttgttcctttaggtgggttctccctactcagtacttgtctggaagccaccttaactttaaatgtcacgctctccaaccgttctctctatgttaaagtaggttctctttaaaacaattctagataggtagaaatctagcctattttcaaatagattagaaaagattggattctgggtgactctagatacctcactataagaaaaacaattctcttgtctccctctctgtcccatattcctccagtttagggcctgctgcatgaaaaggaatggctggtcttctaatcattatcattaaagtcaagccaagttgttgaatccttattaagtgctgattgtatgcagtatactagagtagatacagagaggactccagcaagtccctgtctccaagggcaaacctctgaatttcctcaagtgtcagtcactacctgtaaggtgggaactgttccttctgctccatctctgtcacaaagttatgacagatgaggtaatgaagtccaaagtcctttgtgaaaattaatattctctaatcacgtgaaatatcatcattaggattactgaggcagccaggcttacccagctgagggtagttgaaagcagacagggttaagtgtcacaggagtaaaagaaaagagctgttaaatctggagaataagggatagtttccttaaaaggtggcaattaaactggatttagatggaatcagactgagaaatgttcaagtctcacttgaaagtgagacttgtctcttagtcttttgattgttagtatatataaatttaagtcttcttcctaagttgaaaggcagctctgtggctgttctgtgagcctttctcaggttatatttgtccccgaagttaacgatttataccaggggtccagtgggcttcatggatgactgcgttgcaccactttcagatttgagaccgcatctgcattaagtacagacatatcagtaagttttggcagacctaaaaagtaaagcaaatttttttattgtaaaaaaaaatgaaattacagtacttttcagtgaagttcagtactgtgtttcaaatatatgcataagaagctacttaaattttctcctgtagaaaaacattcaaaattccaaatgccttcaattatactgggattgtaaaacaattaacagacacagttacatccaccaacatgttgaaagtttcaaaacagtttagtgaaagttttgaagtcaaatttgataaggaataaatttagttttatttttataaataacttttggagatacatttctctgcaaagagtaagttgttctcatttttgaaggtcaaaattaagtactttaggccgagcacaatggctcacacctgtaatcccagcactttgggaggccgaggtgggcagatcacttgaggtcaggagtttgagacctgcctggccaacatggtgagaccccatctctgctaaaaacacaaaatttagctgggcgtggcggcgccctcctgtaatcccagctactagggaggctgaggcaggagaatcgcttgaacccaggaggcagaggttgcagtgagtcaagattgtgccattgcactccagtctgggcgacaagaacaaaactcctgtctgaaaaacaaaaatgaagtattttaataacatgttctctgttcctatcacaatgattaagaaacacagttttaaaaaattgtttaaaggcatctgtcaaagaatatttcggtaaacatctggtcagtcagcgacccagggcattcagaactaggggtcagtgtcacaactactggcagcatagttgaattttgcagacttatgttagtcattgtaattttaaatatcacatattaggttcacctggattcccaactctgctggtcctaatttgactgccaacagtcatttatcaattgtaagagtggaggaagtctaccaacttagatttctagctgagacacaggggaaacccattatcagtgccagtaaaaaggcagcgactggtaacaatagtgctttgatcatggacactccactgcactagcatatattagagaaaatgattaaatctcccatcatctcttgctggagtaggaatagtcactgctacagaacattgccatgggatcgatgtcttggcttttcttctgcatttatggagcagtaggaaagcatcatctgggaccacatcctcttctatgatctcatattggcacctgcccattagagactggtacaccaggggacattggtacagtaacaaggggcctcttctttacgaacccttctttatcagagaaatttcacccaaataaggggttatgacaggaaagctgtattaccaaatgagcactgtaaccacccttcaaaaatcccttgccttctttatcaaggctgttttttcttaatgtcagaaaagggcctaaaacagctccttgtaattggagtctaaaaggttacctcttagaggaaaagaaatattcttctcatacacacacacatatactctgtgtatgtgttatatacatatataataaagcatgatccagaaaactgtttggattcctgaagcctctagtacctggcgacttagtagccattcaatcaatatttgtttaataaataagtaaataataagatggagatcacacacgtctcactttgtccttcgagtaggatcaagcgctcagaagcagagcgatgtatacgtttgtcgaacgaatgagcgttgctccgcttgcatcggagaacccagatgtacaattttgtgaatgcagaagctctcaggaaaacagatgctgcatttcagctggtcttgtctgaataaataaattacccaaatctccaaatttttaatttcatgtttgaaaatgaagctgtgtaaatattctagaaggggaggaagaaggagatgcagtgtatacattaggtttatatgtgaaatcctcctccctgtgcctgtcaccatcctcagtacagcccccgtggctcaggtggccaactcatggtgtggcttgggtggagcatactgtaaagaggaacattaaagcaaatttcattccaaccacagcaatcttcataggcttgctggggaggaagataagtgagaaatagaatgtattttaaagaggaaaaagtacaaattaagaattttaaaagttagtcattctcatattctgccatgagcaagcctgagaattttagcaaactacttctctgaattttcatttcctcatatgtaaacattgaggacaataaaacagccttgccttcctaactcatagctttgaaaagatcaaatgagatgataagaacaagagctgccatttattaagcatcagctctgtgtaaaagtatcgtgcagggcactatacatatttttaatatacgcaaagtatatttaataaatcaaaatgctgtaaagaaatactgtatatcctttttagggggtaaatactttgaaaaccctaaacttactgtatgaatttaagatactgtgaaatttatttgataacatatattacacctctgcatctattatatgcaaagcactgtgcaaaaatgatagaagaagtatgaaaataagcaaaacagaacttgccttcaaagagcttacagcccagtgaaggaaggaagggtaactggttaaataagtacccaatggctgtaatagataagatgtagagcacagcaagcttcatatgggtgaggagtttattcagcggcttagaccacagtcctctgctgtgcctgcttaaaatagctggtgcatcagccatttcatcgttaaaggagcagcagtgaatactggcccgtttccttcgtttcgtaatatcagagtcgaatcttactccatctctaagaagcttctagagagctgacatactaggaagtcctcaagaagtgcatatacaaaaatacagtttatcatactatactcatggacccaaatctcccctgcctgaaacagacagttttctgatttgtagataatagattgggtagaatacaagcaaataatttacttggagggaacaaaattaatctgaatggagattaaattcaccagagggtagaataaccagaaagtgtagttggaagaggaggaaggaaagaaaaaagacagagcgatcattgatagaaagataatagatcagacttacctaagagtataccatgttttcctatatctaatattatttaaatatttatagaacttaaattgaaggtagttttaaccatagatataaagatgaaaatactttagtgatcttacttcctgcgttctatcatataaacacagtgtagctattttatagactcaagacaagttgattaacaataaatatatattggcttgtattttgtcactgctgctgaaattttaaatatataagcgttttataagtaatagcaataactgatgtttattgagcacttactatgggccacacattgttctaagctatatgcacacatatataaatatatatgtgtgcatacatatacattcatttaatttgtaaaaaagtgataccactaatactattgtttgcagacttatttccctctctcatagggtcttatatttttcctacatactgatgattctctttaaacgttaaataacctaatatagcaccatcagtttatatggaaataaagttctgtggtttttggccatcaatgtttttaacaaagtagtttgttaacactccagaataagtggcttttacatggggaattggggagagagggaagaaataagtccttggtctgtgcagatcccagaagtcaatcaatagtgtgtgcagcacgctgctgtgcagcagtttctcatgaggctgtgcacatcccaattgctttctgctcagcagaggattacaataatgcctatttatccagctctgtccatccaaggattttagatacatcataaactcatcaattaatcagagacatggcacccatttcaaaatgctgggagaattacatcctggaagattacgagaaatgctcacgtcgacagagtaaatcaagaactatttcctgatggattcctgaatggcacaccaagtactgaaatgaagagggctgtctccagcactgattcacaaagtatatctcaagtggaagaaaacttccggaataaaacgtcactttactttgaagcatctgttaaacttgaaaaattaaactgaggtagaatggcaaagctcattaaatattaatacaattaattggcttccctcttcagagtaaagtatcactgacctccctttcttaacaattaaaacccctctgaaacctttgggttttttaaatacagtgtaactttggttcttgattctctggtctttgtcaagtgaggaattcttcctgtggtccagcacgctcagcccactgtggggaactggctttccagacagctgtgaatgttcggtatttattcagacaatactcccacactttgatgatttactgtggtccaagcatcttgttcctcattttgaagaaacattccagtctgtaggtatcgtctactttgtatgtaatgagaggtagtttaaagttttcatttgcgtagctggaagtgcactcacgtcattagaaattcaaggaatggcaactcaatatccatttctaatctgaagggtcttccctgcccctgccatgttagccccacccagaaatcacttaactatgattagcttccaagattagtgaattctaggatagcaggattacttatgacttaatgccagtcagaatttgccatctgcctttcagccatttcatgaacccagcagaagagagcatttatcaaaatggctgtgcaacacccctcatgtcttaacactctttagggacttatataagcaacacttcatgttcgaatgtcaaaatccacgtgtaaggcttaaaagtagtatgggatgcttaagaatgcttttcagggccagttattctttgatatttatcacttcatggtgctgacacctgcttctaattttaagagttcgttcttccagtggatttttttttccttcagaaatcttatcctcaaaagacttaactagcaatttttctttttttgatgtgcttgatgttttgatgagtttgtctatcagcattgaaaccttaacatacctttcatttagaataaaaaaaaatctttgtgacacacatttattatattggatcacataaatttttgccctggcagtacattcgaagacttttgcagagatataatttattagaaatgtcattatctgccacttggcctacttgatagttgtcttaagttgacaaaagctatagacatagataaagtcttccttgagggagcaattcagtaaataactttcacccaatacccttatttggttgtctttcacacccaagggtcaggttggtggcaattgtcatttgagagttagtaagtggaaagacaaagacagagaggaacctagttttgtctattgagacacatatggaaatagtcctttggtttgggtgtagccagcctagttgtagtgcccaatgtggtttgctttcttgtttttatcttgtctaaagacctttccctcacaagtttcctcacaagtgctggataaagttcattgcatgagtagaagaagccgcaaaagatgatatatagctagcaacccgttctgattggtctatgaagagttgcctgtataaaattggatccttgtgttcggttccaaaaaaaggtgtgaatgtgaagaagaagtgttaaatcatgactccagagaaaatgtcggccatgagcagtttttagtttaagtgaaaaccaaactttaggatttggacaaataagatgaggagaaaaaagggtgaatcattaactccaatatgaaaggattatggtgatcaagtttcacccaacttgaataagaaacccaacaaagactatgactgatggaactaactcatttacttaattgatatgccaaactctgccaagcatttacccttagtgtcaaataagtaatttttaataaaatatttctaagatatgaagacagttaagaaaatagcatgctttttaataattgtactcataagtaaatggatcattacattgtcacaaagaatgacagtgagcagaaacagcctgctaatccctcttagataagtatttaacataattagacagacaccatctcttctgttgaatgtagcattaatcattagaagtgcaactttacacagcatacttgtttctgatatgtcattgttgttaaaaaaaaaaaagcaaactattttgtcagatacagtgcttcagaaaatgactcatgtagttgtgtgatttacataaatacagttatttccctttttattgttttttgtttgctttaatagtgtttaatagtagtgtggtccttttacatccatgaagctgcatttgaggtaagtggttcatacattttgttttgcaaaatatcagtatagtgaacatacttgaatttgaagtatttttaagctttgaagggatcttttggctcatctacctaaactgaaggcacaactctttcagagaaaggttttcttataaggaatgggctagaagttttctgcattaaataagagctgaagagagaacctctttctattaaaaatttgaggttaaaatgatggaatgtattgccctcttccagtattcataagcactacctttaaaaaaattcattttcttttgctgtgtagcttctagcttgaactatgaactacggaatacttataaagtgatagcagctcaattcattgcacaacgctagcttcccactttctctgtgattcaaaggccttcgaaggcaaagaatggggttattgaaggatggcaggcagatttcactaagtaacaggtggaggtcaaagcagtttatttgtgggatgaacagagtgcagagatgaaaaagcaaatgctttgccataataagatttagcaagaaaatgctgacaacacgaagccttagattctagctgacagaaccttttctcgtgttcattacttgatttcacagttcaagcaatttgaagagggctaaaattttctttctttttcccttatgaaatgtttcaatcagtttcaaatttttactttagctgggttctctgcttgtatccaaggaacactggaattaatagagctccagcacaggcgtatcccaaacatggaccctcacagactatgcatctctttcaaattaaattttatccataggacccttaagctctagctctctatcatgttttaactgacagaagagagtatatttaagtaaatactaaagttcacatcatcaaggctaatgttatatgccaacgaaagtattcataagggtgttaaccaagcttgaacactgagttacttccagcttgttggagatggagaggaaaagctttcatttttttcccattatacagttctatatttgtacagtgaatatgtttcgcttttggaagttaaaaaaaaaaagactaaacatgctgaacaatacaaaataaggtttatctactgttgtacagcatgaccaaaaaagtaaaaagttatttggtatcatatcatagagaccagagctgtccaatagaattttctgcagtgatagagatgttctgtgtctatactatccagtattctaaccatgagccacatatggctactaagcccttgcaatgtggctatgctgagcaacttaatttttaaattcatttaattttaattaatttagatttaagtagccacatgtggctagtagctaccatattgggcagggcagatataagccaaacatatgtatgattgagttttttactattcagctggatatctaaggagaatgaataaaacattatgctattttatactatatgtattgtttatgcaaagaaataatttggttttctcagaaatgtcttctttatcctcagtccttctgtgaatgcgtataattgctatgttgagctaaaatcagtcctttcctgaacacatggggggatgggatggctagggggcagatggaatgggtagggaatctccaacctcttgtaagtatatggagcatgtaacacaattttttttatttcagtcctgtcactggggtgtctgtgtttaccttgaaaggagaggaaatcccccaactagtcaagagattttatttttggcccagaaaccagatttttatatgacattttccttgtgtctattctttactctctctggttgtaaattttcactcacaaatgaacatttggaatatattacagaactcatcgtttctttccccctgaataatccatgtaatttttactccatactcccattttttaaaaactgaagaaatcactgatgtccccaagccatttaaattacctgaacttctttatgatgtgataattctttgggagtccttttagctcattttcaatggctacatatagagtaagaaggataaacctcagaagctatattaactttcatttatgctctctatcataaaaatgattttaaaacatttttattgactgaaaaaggctaaaagtcaaaatagtctattttacctttttatcgttgagtgtgctaatcataaaaaattatattagaatgaactctaatggattttatcattaggacacacatctaacaaacgtgtggtgtcttcaacgacctccttgtatcacgcagcctgtgtttatgctcacaagaacagaatggtcccttaaccgtgggattcttctgttcagtcacagcctttatttggcatcatggttagagataatctaattacaaggtatactttaaatggttctagaaaggtcttgttcctgcctgtgggggaattactagagtgcagtatagctctgcatctggaagagatgtgtctgagtgtaaatctgatggtggatgacttgcaaaagatggtactggtactcagcattcatgctgggcttgagaaatgtcactgaaatttatgtggacaccattagtctgatggacatgactgagctgtctgttccccacacttagatctagtggagtaggggaatctgaatgcctgagtgtaaaaaagagtcacaaagcagttagcatcattaagacttggaatgtttgcaagaagaaacatgttcaagtgtcattaatagttcagatttaaatcagctcatgataggtttgtattgataagatacataagtagtactcccccgcgccctcacccagaagtagggatcttggtagcatggtacactgaaaggagcaagagctttggtttcctgggttcaaatcctggctcctccactcactgattgtgtagcctctcaccttcttaaggactgcactgcctcaggcaccctctcttctctgagtcatggctttctgcctgtctgctggaccattcccatcagtagacaagcatgctggactctctcccaccttcagaaagctatcccttgcttccctccctcttcctgtagccactaccctatttttctgctctcctgtgcagattcctccttcgtttcatggaagttgactacaccatttcccctgtttcttcacttcccattgattttataaaccatgctatcctgtcttctatgtgcctcactctcctggaactcacttttcaagactgtcagaaacattcatgttgccaaatccagtggacccttttctgtcctcattatacgtgatctctcagtggcattcaactcagttgattgcagccttctccttgaaacacttcttagtttctataaagatatactctccaatgagttaaatgcctcaacttagttgcctgtttagatgctgactttagacactcgggggccttccttgatttttacacattactgaattctaaataattgtgtgtgtgttatagcctctggttaagtgagctatttattactgcattgtaatatatagtctaggcttggacactatcaacaagtcttaagagaagaatttttgtcctttcttgttatagatagataacatggtttgcaggaggctttatagaaaaagcaacttgttgaataggcaagaggcctatagtaaatataaaacatttatatactcttttgcaactcaacatctggggtcattatcttcttctaaatctatgtgatatttattttgtggaggttctgtgttagaatcgctgataattcattcagtgtgtgtttgataaaatcttaactgatccttactaaggccaagagaaaactttgatatataagacaaatgattcctagtatacttcagagtgggtttttttgcatacacttttgtatctgatatacccttcctttttttccccctttggataaccaaatttaaaacttcagctataaatatactttattgacttaaataggacactgtttttatagtatactagggaaactacatgagggttttataaaatgtatgcacttgagaaccagagagacctggatctgcagtaccatctaatagctgtatgatcctagacaaattgtttaacatcacttgatatctaatttctgtaatattaagttattggtagaaaagataataatacctacctatctcagatgaaaatgtaaggatttggggatggacacggtggcttatgcctgtaatcccagcactttgggaggccaaggtgggtggatcacctgaggtctggagttcgagaccagcttggccaacatggtgaaaccctgtatctactaaaaaaaaaaatacaaaaattagccgggtatggtggcatgtgcctgtagacccagctactcaggaggctgaggcaggagaattgcttgaaccagggaggcagaggttgcagtgagccaagattgcaccactgcactccagcctgggtaacagaccgagactccatctcaaaaaaaagaaagaaagagaagaaaatgtaaggatttgagatatttataagtacatggcacatagtgggcacttcataatttgtagcttttattattttcagcctggtttttggacgtgatcgacatgcagagatttaatctctgtagctgcctcctgcctctcttgaggccacttgatggatgaaggcttccagttgcctttaagcctttaagtttggtgtaatcgttgttctggtaataacagttataaaaataggttgttgggaattagatgatgacaatgaacaggacactatccaagtcatgaacaattaaacttgtaacattttggggtcctctctaacctgcttattgtattggatttaaaaactaaagtgctgaggttgcttgctttcagagtttctctccgtttgtgactataaatgaacattattgaaactaaactttctattcttgactttgtcactttgaagaaaagaacatacaccagttatatcttctctgacaacttgaattacatctcccaaactcctgcgacagacaagataaggtcctgctgtcccgagcagcacttaccagggatacttttaacaggagaatgaatttttggataggtgctctaacaaagtaagcactaacactgagaagttacagttccttttgaaaaatccagcatgttgttcggttgtcactggaataattatagtttatggtgatccttcccttctcttccattcccattaatgttgtagctcctttgactcctaaaaatctcccctttaagaagatacctaaggaagaaaaaacagctttgtacttcctaatgattcctgcagtgtttcctttactattgtcactatggagttcttggtcaaagtgtctgaaaaatatcataacttgggagtaggggagaggtgaaattaattatgattggttttcttctttttattttatgtgatatcaaattgcagtgaaaaattccctaaaacaaattttaacttcttaggggagaccccaagaatttgagtttttttcccacgtcactcaatctaattttgttattgatgtttctcgaaagaatcaggagaagtagaaattttcaaaagtatttatgtccctcgaaaattaccactttttagttccctttctaagaatacgtcttaccgttttctctaggtgactaggctagtgaaagactatacaacctagggtggattaggtaaaaataagggaaactttcagaattatagagagtaattattgtacagtaaacatctttaatacacacatgtctagcattgcagtcgtcttatatttgaatatcatgtttgttttctgtactgcagaacaaattttcacagagttagcaacttgaagcaacacacagttattaatattatctcacagtttccatgggtctggagcctggccacggctgaactagatcttctgcttaggtcatacaaggctgcaatgagaattttgttcagactccatttctttctggagctcaagggcctgttgctgactctcgtgattgttggcagaattcagttgcttgtggatgtgggactaaggtccctgctttctgaaagctgtcagcaaggggccccactcagctcccagaggcccctgcagttccttaccatgtggctgtcacaggccctttcacaatatggcagctgacttcttcaaagcctgaagaagaatctctctgacttctaattccttttatacaaggctcccctgattaggtcaggccctccagggataatatatttttccttaactcaaactcacctgattggggaccttaattatatctgtagaagtcttttgcaatataacataacctaatcaatataatcacctttgcggtataatataacctattcacaagaatgacatttatcatattcacaagtatctcacacatgcaagaggagaggattatataaggcatcattatacaaggctggaaactaggaagccatcttagaattctgagtaccacaatttttttttcaagataaggtctctctctgttgcccaggctggagtgcagtggtatgatgatagcttataaactcctgggttcatgtgatcctcctgcctcagccttctgagtagctgggactgtaggcatataccaccacactcagctaactttttctttttcttttttttttttttttttttttttgagatggaatcttgctctgtcagtaggctggagtgcagtagcatgatctgggctgactgcaacctccgcctcccaggttcaagcaatcctcctgcctccacgtcctgagtagctgggactacaggcacatgtcaccatgcccagctaagttttgtatttttagtagagatgcggtttcaccatgttggccaggatggtctcgatctcttgaccttgtgatctgcccacctcagcctcccaaagtgctgggattacaggcatgagccaccgtgcctggcctcagctaacttttaaaaattaattttttgtagagataaggtctcactatattgtccaggctgctctcgaactcctggcctgaagcaatcctcctgtctcagcctcccacagtgctgagattatagacatgagccaccagcccagcctgactaccacaaataccaatgatgaatttgaaggaatctttgtgaatagtgcatttgacctgtattttcaaggttttcttgttgaactttgcacttataagtgcctccagagatgaaagccactacatgactagaatcccatatatgtttgcccttgtctactgaacacaatttggaatgactcatatagcttagaaaaaaatggcagactagagggaaattgaaaattcaaaaattctggatgtttagaaaaccagtgacaagccacaggccttcttgacatgtttctccaattctatttactctcattgggtttttttataccaatcaaaaggatgaaatgccccattgaaacaaaacattatgctagatttctgcttctcattctacaaaagtctttatttttctgcattgaactttgaagtaacatttcatttcctccagaaaaagagtaggattacttcatccgtagtctttttttaaaaatctggtacttctagaaaatacattgaaattaaagttttaatgcattgaaagaaagccaatcagtcattaatccatacagtaattttgtaacagttgtgcataaataattggcaaaagagattttaaaaaggagtttatttttaaagtaatgtacagaaccaaatttgatttcaaaaataaaagccaacattaatgttttctagcttttaacagaaagcagtttactagcattttggaatttcatctggtcaattaaatatacaaaacaaattaaccaaaacatacattatgtatgtagagaaaatattaaagtatataataaggaaatgtgctcaatacgaactctttaaaaattgaaaacacaaagtaattttgagattcatgacagccttagggttcatattacttgactgtgataaatttagaagattatacatagtttggctggttgttcctgcatgctgacggtatttcttccgtctttaacccttgcaaagaagatttaaattttgctatttttgaacttgtttaccaacttggtcattcttgatacttgttattgcccaaattttacttgtaattccttttagaagcataaatagtggatttcaatcatgtcaatatttctgcagtatttagaatggcatgaattagaaaacatgaatttttcaaagaaatcataactttttcttgagtccagccatttgctatcatcaataagattagttaggatactggatttcatcagtgattccattatctgaaaaaaaaaaaaaaatctgccacctttaaagttttgatttttgttttaattatctgttctgcttctgttttatgacatgtagttcaggcattggactaaatttaaatcagtggaatggttggcagcctataaattggtctacacaaaaaggtttaaatgagttgggagatttgtttacattttgctagctttttatttctttcattttttttatttgaaatctcctccttagtggaattacatgatgataaccttaggttaggttatcttacagtgaatgttcacccaaaatctcagtgcatcctacattagaactttggtatggtgtgactggttactgattcagcaagcaacaaatataactaaagtcacttaattacttcatttttaattcaaatcacatggatgttgatctagaaaggatctgattcaaattgtcaaattagtatgaaatcacataccactctatgttgtacttatatctgactatgcaaatgtgtttaccaattttcaatttttctttcttggggtgaaaattctaagctttgctatgtttaagcatctattcatgaagctacagataaagctgagacctgcacaagtagtttaaatatcttttcagaccatttgggtgtttcagacccttggaggtcttggacatagaggggaacaaagcagacaaggactctgtccttatacagtctgagtcacactcaaaggtcatgttgtagaattgcattaaggaaatctgtgatcagaaataacagggacatatttagatacacgcaaaactagctaaatttctggaaagatctatacctataaagtgcttggcacagtacatggtactccataacagttacatgttaatatcattatgatttttattacttttccagttcatccaaataattctctggtcatgggcagaacacagcacatgtaaacatgtataagtaaaatggaatttggttcttttaacatcagtgcagaccagttttgtgctacaaccttaagagagcccaaatttgtcccctgatgcggagactaggagtcatttcttttatttttatatccaaattttcattgttttaattggcaccctatcaaactgatagatgcctccagttgggtatgtcagcgtggttgccgagaacattacaaatccagtaattacaaggaactgtttctccattattttcttcccaaagcattttctatgctggaaatgctgtgaaaactttagacacaataataaaagtactatttttaaaaacaagcttttattgtattaacatgaaagcaatatatgttcatcatagaaaagacaggtaagcaaaacaaaggcaatgaaaatcacccaaattcaatacagagagagaactaccattatagtttatgcatattgccttccagttctttctctgtgcatagaaatagccttttcaatggtgtcatagtataacatcctattttgtaattgcctttttcaattaacattatattataaatgttttgccacatcattactcttttacagtattgcttacattggttataccatacttatttaaccagtccccaattgtagggcatttaagatttttttacttttcttttttctttttttctattctaaagaattcattgaatgaacaactaagttgccattgttgagggtattcttatgttaaaacagccaaattatttaaaatatggagaaagtgatttggtgtcaaagcaaggtaaccaacaagatgaaacgattgcatgtgaagtcttcataagcatacatggtttcctttttgggagtcacagaggtcacagacacaagcagcaacttttaggaaacactggaaaagttgaaccctgtattattattgaagaccaataacccaaaaatggactgtgattaattagaataaattgaaatcaaatacagaccgacttatcaggggactattctgtcacctctttgtttctgtgacaaatgcaaagcaattcacaacatctttttcattcacaggtggatttctctttttgtttgtttttaattctttaaatgttatcttttaggttgcacaaatcattgttccatgaattaaagtgtacttaccagttgatccttcttgccaggaatgccatctccaaccacactgaagaagtcggagaagtctggtttcagcagcccctccccttcacagacctcctccctgggaacggcgttcacacagcatcaccgacctgtcattacaggacccagaggtgagctgctccacaggcacccttggttgtgcttatatcatggcctttggacccaagtagcaaaatgagaaacaatgaggactccccctgaacactcgtgaggcagtgagtgttccaatttcttacccttgggggcagccttggaattttagagaccaaagagatttggcatcacattttttgtcctttcctaaggcaaaaagagaccaaatctgttttttgttggccagtgagatttttgcagaaagatgggaagtaacttgaattgaaccaaaatcaaatctgttctacaagttgtgtgtgtgtgtgtgtgagagagagagacagaatgtgtgtgtgtgtgcgcacatgcgcgtgcacacatgcatgcattgggtgagtatatttccatgtggtcaattacctgttttcaagtagtagctttttctcatccctgctgactctctttccataaaacctgatttcaatatgtggcattttgtgttgaggttgtttgcatcagggtgttgacgagcagtcttcattcactccttttgaagtggtagatagtttgtctggttttcattgcaatgttttcattatttttgtctcatatgcttttaagtttattattaaaatgtgtccacgagaaatatgatttgtatttcgcattaaagacaagccttaagcctcaagagaatgtcagcaaatcacttaacttgatcttattgcaagataaaaatatttattattttgtttatgaaactcccacagtagaagtatgaataattgtagccatgtttgctttcctttatcagattttcttttaggtaggtctgtgacctaccagctggtttcataaaacatcctagaaaattatgatctcttgtctgctttgacatatacctggggaaactgatgtttcttgcattaatctcaatgttagccccaccaatctgaatccctttatgaatgtgctctgtgtgcatctcagggaaatgtggcaggtaagagggctgtccggtgcacacatgggagtcatattgaagaaagtaagcattttgaccactgtgggaatgaaacttacttgtttcatctttaaacatcttgtgatcattggtagaactttctcaagatcccttctttcatttgtgtattatgtgtggtataatcagagaggcttactatcgatatataatttgaaaacctgcatcagaattagattataaggtcccagaatgaggcttattaaatagtattaagatattatcctcatagttaacactcattgagcatataaactgtagtgggggatcagagatatgaagcccttttagtcagaatatttatggcctgaaggagatgaggcatgtgttgtttttcatctgtttggggtcaagttaacatattctaaatgctaactgaatggtaaaagttcctgcaggagctcagtattggggggaccgtggaggttcattcactctttaaacaaggatttactgagtgcctctatagacactgggaccagtggttcctgtcctcatagagcatgttatctactgcagaagagaggcacacaaggaaataagcaagtaaaagatgatgggccgggcacagtggctcacgcctgtaatcctagcactttctgaggccaaggcgggcagatcacttgagctcaggaattcaagatcagcctggccaacatggtgaaaccccatctctactaaaaatacaaaaaaaaattagccaggtgtggtggcacatgcctgtaaatcccagctacctgtgaggctgaggcaggagaatcacttgaacccaggaggcagaggctgcagtgagccaagatggtgccactgcactccagcctgggcaacagagcaagactccatctcaaaaaaaaaagagacttcaaagtataaataacattgaagtcaaatcttaaaagatgcttagataaatggagggccatcctaagcaaaggaaagatttgtggtgtagtaagttagtaagaactgagaagaacagtatgccagcaatcaggagagctgggtaggctccctcttttccttcccactcaccttctgggttttttaatgtcctcatcaatatagtgggtacaatactaataatgaccatttcctcccaatcttgtattcttatacagaaacaacaataaaacagtatttgtggagattccatgaagagcataatgcaatctgtatatattatcattagtcagtaaatattaagagtgtctaatgtgtgtcttgccttaaaactgtagttctagaaattactgtcatgggcacttccctatgggtacaggttgagagcttgttcatgctagatgactaagcacattttctaaaatgacccacgctgggttgaaccagagtggacctccttagctcacagcataacaagttgcagtctattcatattcattcataaaactgtgtttgaggaaaagagaaagatgcctagtgtaagaattatggaataccaaagattctttgttttcaccagaattcaagatggctcccagcatcctcggctctcctttctggaaagtctactcaggtacccgttcttaccgtgtcccaccccgcttagtggtctggtgaagggaattggagtagttgagatgaaacttcagttgcctctttgtggtaagaatcataagaattgagataggctaacgtaagacatttttctggctaagacatttttaaaaggttggaattcagcctcattatttatttgctgtgggtactgtaatttccttcatttctctctgaactagttggaaagctaatgcttggaatgataccacatttgggagtaagacgtggtgttttaggaagatgaggccaaaattgaggaggaagagtatagctgcaagagtcagtgtggaatcgatgtcacatgtgcgcataaaggagatttcaacctctgacactccttgtattgggcaaagttgccacaacccaaaatagtaaattattagataatccagagaatcaaactttaaaaggatcttgaagaaaagaaaagaatgtcctttatcaggtccccagggcatggggcagggatcacggaggccattgactgctctctggttagcactaggttgtgaggcttctgctgccttccctagcatttatcacgggaatgcttcaactagactagcaccagttagtaagcaataactgtccaacacacatccacgctcagaatggagatgagattttacagagctacagcaaatcaaggtcacctcactaaaaacacaagggccttacttttggctgcaaacataagctacatttggaaatttcacagccaccttttacaaagaaaatctctctcttaagattgcaaagcaaagggagaaacacagggcgttgaagggaggtagcgtagcacagcggttgtccttgtctgttttgactgccagaacagaacaccatagactgggtggtctataaacaacagaaatgtattgctcacagttctagaggctggaagtccaagattaaggctctggcagcttctgtgtctggtgagggcccacttcctggttcatagatggcatcttcttgctgtgtcctcacatggcagaaggggtggggtcgctctctagtgtctctttcttaaaagcactaatcctattcatgagggccccaccctgtgacctaatcacctcccaaaggccctgctacctattaccatcacattgggggttaggatttcaagatatggatcctagagggccacagacattcagcctatagcagtggttaagcacaaaatctcagggggtcagataggctggtgtctgaatctctgtccactacttggcacattgcttttctctctgaaccaaaggtttctcatctctaagttagagattatcatctctaactcaaaagaattgtattatgttaggagcaaaggaaataatgtatttgtagtcatttgcacagtgcctggaagtacagtatgcacgtgggtcatacaattaaataatcctttttcacccaggctttgaaagtatcatgctgtccctattgccttcgcccagcaacattctgcccatcccccagatcagctcaagcactttctttttttttttttttttttttttgagacggagtctcgtcaagcagtactttcaaagtgaaacctcctctcctccacccagcttgccatcatctcacactgcttaagctcctgctgcctttcatgtctgcacattgactccaccaacctcatctggccttgttagttaatctacatgtctcctggaggagaacctccaaagggaaggatctctaacttagacatttcactatctttgttgtgcctcacacagtgggttttatgctcaaatattggttgaatgaataaaagtagtcaaattgcatataaatgcacacaggagacatttatcccctctctgaccctgatgagttttcatttcttcagataaatgtgtgatagttcatgcagtacttccttgtaagaaatgtccaagacatggaagaaccatggcgttgcatccaaagaaaacctatgcaagattctctaagtagagctttgctattaagagctatgggctttctttatgttgttctaaccacttccctatttatagtgtaaaggtagagacatgtggtttcttaaaatgaatcccctctctgatagtggctttctttatggctttgataaatcacttaaccttgtcgcctcagtttggccatctgtaccatggggacaatactttaccacctgtttctctgtgtggttagaattaggtaaagaggttatttgggaatatcctatcgatagggggaagatattaaatttcagtagaggcatttgtacatcgttatacgttagtataattactgtgcactttaagctgaaagattgagctttcaaagactttcttttaccactacttaaaattgtaaccatagtaaagtatttactcatgactatttgtcttattcatgataattgaaaaaagaaatctttcttcatccctttgccttttcaagaattgtaagtttgcctggttgatgatctgaagggtctaacttgttagagaattatttagagtaatcatcagttacatcttaaagtttcttgaaggtttagatcttcttgaaacttatctttttgcttaaaatctttgctgttttgaagattaagaagatagtgaatgatactttatttaaatactctgcactaagtaaaacaattctgtgccttagagatttaggaacagagagcagcctacacgatccacattgggcagcacaattgaaagtaattgaaagagttatggtctgggaatcttttggtataatgtgttcccagtatcagtgaagattgtttttggctgaaagtaacagaatatctgactgaacaatggcttaagaaaataaggagtcacatttttctcatacaaaaacaagtatgtggctaggtatggtgactcacacttgtaatcccagcacttcaggaggctgaggcaggaagcacttgaggccaggggtttgagaccagcctgagcaacacagcaagaccctatctctacaaaaactttttaaaattaggagagcatagtggtagagacctgtggtcctagatactcgggaggctgaggtgggaggattgcttgagcccaggaatttgaggctgcagtgagctatgacggcactccagcctgagcaacagagaaagaccctgtctcaaaacaacaacaacaaaaaaaagcaagtatgtgattcaaggctgatagggtggcacttgcagtgccatcagggattgagatttcttctcctagacatgtttcagtgggttgtttttatgaggtcacagcatgggcgctgccccctgccttatgtctgcatgccaagcagaaagaagggaaaaggtgaaggcaaaaaggacctgtcagcttatcctgccactttttcataggatcttctgcagcacaatcagactgtgtcccatgatcacctgtagctgcaagggaggctggaaactccaaatttttagctgagcatatggccactctctataaaattaagcttttatcagtgggtaaataagggataaatatgctggttgacagttagcaacatattccccattatttttacagatgagaaatctgagctagccagaaccaagaccagaaatcaagtctctagttcagtgccttttttgccatatcagtagtttctacctttttctcccccgactgggagaaattaactgcatttatttaaacaattactttgttttcacattttttatgagtcaaagtcataacatatccatctagatcttttgataatcataatataacctgtgccatcacactgagttttttttttttaatagcagccataaacaaatcacttagccttttttattagtccataagtccttgctactggtaaatttgtggtttctcttaggtgcacgccactttagagacagtttttgaggtcagtttggcttttttcaatattgtattagtttgcagatacctattactatctggggacccattaatttttttccacaaatatttatcaggctcttacagtgtacaagatgctctagtagtagagtgaacaagagaagcatggattctgtcctttgagtgcttgcctcctggaggacgagaggacaaggaaaccagcagttgcactgctgtgctagaagcacagggtgcggtagaaaatgaggggaaggacatccttgtggacaactacagtggcatctggcactacgcaagtccagacacacaggagacccaaccgctattgtcaaacagtttgccttcgcattatgggcatggaaaacagaacaacagcaaataaatcatgctcttagataactaagtaccaaagaattcagacatacgaaatgcaaacatgaggttaaacccccacctctttatgagtcaaaaaaaaaaatacacgatgggagtttagaagtaaaattgcctggattctgaaaatacgcctaagatacactaaagcaatcaccatataaaccaaagatttattgtgcagctttcaaagaatcattccagtttctgtttggagaggtagtcagaagtttatatgctctataaacctctctaagtccatgatcctcctggcccaaatagggatcttgctctcagtgatgaaacatctgaaggtctgaagttaacaatatctcccagtttggccaagaaaaatatactgcagagaattatgagaattaagatcacctttcaggaagttggggtcaccaagaaaggttagaggagtgtggattcataataggcatagacaataatagaggagcggggaaggagaggtaaaataggagggtgacagtcatcactagatggcagggcctattagggcaaggaccacacctttatcatttatctctgaatccctccgccttgtgcccggcataaggaaagcactcaataaataattgtcaaataaatgaatgaatgaatgcatggatttgattgaagaaacagaaagtttgagaataataggaagttctttccttctccactgtgtagtagtataatattcaaatgcatatattcagcagcacgtagaaagaggcatggcatgtttaagtgctcagtatatatttgatttgtttgtttatttgtttgtttgtttgtttgtttgtttgttttgagacagggtctctctctctgacacccaggctggagtgcagtgacttgatcacagctcactgcagcctcgacctcctaggctcaagggattctcctgcctcagcattccaagtggctgggactacaggcgcatgccactatgcctagctaatttttaaaatttttttgtagagacagggtctcactgtgttacctaggctggtctcgaactcctggctcaagcaatcctcctgcttcaaccttccaaagtgctgggattacaacagcaaataagttatgcccttagataactaagtactgaggatttaagacatacaaaatgcgaacacaaggttaaaccccacttctttatgaatcaaacacacacacacacacacacacacacacacacacacacacacacacacacacaggcagtttagaagtaaaattgccttgattctggcaggcgtgtgccaccatgcccagcctaatatatgtttggttttaattaagatctaccttgatagaccttaagagaaatgagctcaaaattatttggtcccctatttgtagaatatttcctgtggcattttaagtttttctctccaaactaaggtccctccagaaagaacgtcccctggcgtttcactactactgtaattgtggcaccccctcccctggcctaggcccccaagtgctaggtttgttcatctttctcctatcacatccacaaacttctttgcctcttaggaaagcttttaacttagttggagaacatgctggtgatccactgaatctaatttgtctctcctggtttagtgcaattgaatcatctcaggaaaatgagaagcaattaggtacctgttgctaacaaggcactgaaataatctgccaacagacgcacggtgtttatttattattggagtatgtcacttgagcaaacattacgttgcctttctccaagaagaattgccagaattgattttcaaatgcaggcctcatagacctaacaagtaccacctttaaggagcatggaacagagaagcaagagggcttgtgagcctcgttcagggttagttcaagtgccagtgcctagcctaatgggcagcgttgtggatgggatttgaagttgcaggacactaaagaaaaagcagcttttttcttttttttttgcagaggtcctttaagtcccagttcaggaaattattaaattcattagccagatacttagaaccagctattactgcccagccaaaggaaaaaaagagtgccagcaaatgttttaaaactacaactaaacaaaagtcaggaagcgtgtaattaaaactgtacctttattgtattgtaaagagtttcactgtgacatggaaaatatttaaaggagaaggctgtttagctaatttgtctgcaagtgaactgcctagtggaactatcctaaattaactgtaaggccacccaccgagccaccctcataaagagccatggctgctcagcttgggtttgtgtaacgttcaataattactagataaatgcacaactaaaagctctattacactaataatttgtactgtgatagatgtgtgggacaccctgctgggttaatttgtcatccctgcagcaaacttctaaagagagctcttccgtagtggaatcatgttaatatgttgtccctgggaggacaggttagagcagtgagaccacttggctccttaatctcttaaagaggcaaagggcctccagggtgagtgctgaagagaatagggtgatgaacccaggggacctggatttaaactcatcttcacaaaagaagctgctttcccttggaattcctttgcccctttctctctgtccctctcagtcacacgcaggcctatgtgtcccagtggtgcatgtgtgcgcacaggcacacacaggcatagacccacgtatccatacatagtgaaggcagtggttctgagcaaggtttcttagaaaccccctcattttaagacttcctggtatcgtacgcttggactgtaccttgcgtagtcagataagccccgttctttctggtttagcttaacctaagttgattccatgtatagactcattatttattttccttttttcagcatagaataaaaaattcaagattgaacttgtatctcctctttatgtggaatggtttcttctgcctcgccctctccctctctctctctctctctctctctctctctctctctctctctctctccctctttctctccctctctccccgtctctccccctccccaaccccacccgcacccaggtctgctattctctgtgtgagctttgtgcttaggctaaatatcctcagactgtggcccagatagccacagtgagcagctccagccttaatttccaccaatttaataatcccaagagaaaaaagagcagcttttcaacaacagatttagggaagggcctactcctgcatgcttatgattctgattatctgggtttgggtcatttgctcacttttaaaataacccttatgtttaaaagacaatggagtgcctcattggtgtgacccggcttccctgtccacccatggagtcagcgggttaagtccatcctaaccacataggctgaggctgagggacagagagttccccaaagaaacattagagctctgtttccagaagaaggggtgaagaactgctgggcaggcaaaaataatagctacccccaggagataacagcaaagctggcctgagcactggccaatgggctcagcttactcactagctgtggcttgttcctgcagttagtgtttgcagagcacaagaaaaacccaggcctatttgttcatgccacagacccccagggtcacttgaaaacagttcggctcttgattctcaattagctggtgttacctcattgcattgtataatccagattacttttcatgtatctctatttattctaaaaacaatcctaagaatattaaataacccagagtctagcatgctgtttggcacacagtagattctcaacacatttgttgaatgagtgatcctactatgaatgaggcacctgtgtacattaatgctaatcctcagaaaagcctttcaaattgcgctattctttcttacccccctctgccccacccaagacagagtcttgctctgttgcccaggctggagtgcagtggcacgatcttggctcactgcaacctctgccttccatgttcaagcaattctcctacctcagcctcctgagtgtctgggactacaggtacacgccaccatgcctggctaattttttgtatttttagtagagatggggtttcaccatgttgaccaggctggtctcaaactcctgaccttgtgatctgcctgccttagcctcccaaagtgctgggattacaggcgtgagccaccatgcctgaccaattgctgctactatttaaagataagaaatttaaagataagaaactgtaggtttggaaatgttaaataattttgcccagattaacacagggagtgaatgattttacaaccagaagagtcaagctcattttgtagtagaggacactaaggaatataggaggctggcgtcttgctagtcaatacccaagctgacatgaaaacttggtaccctgactttaatcactagactgattattctgttgcttattccattccttgtgtgaaatttacccacagtaggattactcctcaaatcctatggggtgaattcaggaagatacttcaagttcaggaggatgccttgaaagtagtctttggctgggagcggtggctcacacctgtaatcccaacatgttgggagaccaaggcaggcggatcatttgagttcaggagtttgcaaccagcctgggtgacaatgaaaccccatctctactaaaaatataaaaattagccgagcgtggtggcacatgcttgcagtctcagccacttgggaggctgaggtgggaggatcgcttgagcctgggaagcagaggttgcagtgaacctagattgcatcactgccctccagcctgggcgacagagcaaaaccctgtctcagagagagagagagagagaaaagtagcctatgctttagtaatcatgttgcacagaaatagaggcttccatttcagtataaatctgacaatttggtggagagaaatgctgcaaaataacccatggctttatgtttgttatgagatttgcttttctgtctgcttattttctgtgtgtgtgtgtgtttttttttttttttaatgcaggaaaagacttgcaacagcctagatccagcacttggtcgttacgcaagaagcatctgcatggatcttgttttttgaagtcctctttcacaggactgcagtttgtaattccatttcacttccaacaggtcattggatgattccctccctttttctgttaatctctggaatcatccaatctatggtggttagttttcttctcaagtaattgttttgatttgtttttcattcttcatttagtctcacagtagtatcgcttacatgttacgtaaaagttcaagttcccttcatgtaactggattcttgtcaactttgcctattaaaccatcactctaaatatttccaataatcacagctgttgcgtggcgtttgaacacatttcacatcagccatcatggaagcttaggcaattagtgtgagaatatggtcaattttgattcaaagaggccctgtcaggacaaaggctggggctgtatttcacagagcttaaagtagcacactcaggtttttttaaactctaaatattacagtctccccaaagccaaagtatcttaaagactgagtctagatatactgtacaacttaatatcccataaacatttttaaaatcatttgttttaaaagccttccttatttcaatttttagattttaattttatttttatggatcagttgtactatttgtaaatgtaatcccagagactgaattctatacatccactagagcttaaactagatgagcttcagagagtatttagtccaagctgcttactgtgagaagagagacctagggagagagaagccacccacatttataatatgccaggtagtggcagaaactaagttaaaacccaagtctctttatctagtctgaaaatattcctaaaaaatgccctagatcttctgaaaagcatttgtttttgttactgtttttttgtttgttggttggttttttagatatagggtcttgctctgtcacccaggctagagtgcagtggtgtgatcatggctcactgcagcctcaaactcctgggattaagcaatcctcccacctcagcctccaagtagctggaattacaggcacctgccaccacacctggctacatttttaaaattttttgtagagatgaaatctcactgtgttgcccagggtggtctcaaactcctgggctcgagtgattctcctgcctcagccttctgagtagctggggttacaggtgtgagccatcacacccagccgaaaagtatttctagtagtcaatatgtattagatttctgataagcaaactcccaataactaacacgatgggactttcaagggaaatgatagagatttccactgtttccatgttttgggaggccgtggggaggccatgctcagattgtggtgtggtcagaaacgtgcctgggggccaggcacagtggctcatgcctgtaatcctagcacttggggaggccgaggcaggtagattgcctgagctcaggagttcaagaccacgctgggcaacgtggtgaaaccccatctctactaaaaaaattcaaaaattagccaagtgtgatggtaggcacctgtagtcccagctactcgggaggctaaggcaggagaattgcttgaacccagaaggtggaggttgcagtgagccgagattgcgccactgcactccatcctaggtgacagagtgagactctgtctccaaaaaaaaaaataataataataatgcccggttggcaggggcctacgtggtgaagagggaggtcagtatggacactcaaggattgtaggtctaagtgaaaaatagcatctaaagggagatggccccatagttctaagcttctgggttaaatctcacagtctgaaatttaagtaaaggcaggaattcacagtatgtttggtcagcaaagactatttgtctaggtctttaaagaacttttatctttacttagatatctatggtatctatgattattaggtcaagattgttgctactgctgttgttgcttttacttttcattttgttgtttgtggaattattttcaaggccctcatgtcatatccatgctgatagtatatactattttatcaatatttatgtacttttttgtccaagagacaggcgagcaacaagtacctcttgttccatcactcctttctttcatgtattctacaatcagaacaggtcctagcacacaggagcaaatttcaatgtattcattgcctatcccattcttgtctatgatagtactatcatactacaaaagaagctattgatcacttaattgtgtgatcagaaactgtgccgtgtgccttatatacattgtctcatttagtcttcacaacagcgctatgaggtattattagccccattatacagatgccaaaactgagttgtagagaagctcagcaacctgaagcatagctcgtgatagagcttagaatttaaactcatgtctatctgactccaaagccctggtccttatattatactgcactgcttttctgagtcgtatgtttaacttagaattatatacgcacacacacggatgtggtcagccagcacagaccaaggcatattaagtaatggtgaagacagacaatcaaaagtctaccgtggagagttaatgagatatcaaaggtgaccagattgctttggaaagcttcagaaagctgaggtggaattggtattgactgtcaggggtctgactcacagagcacagcaggtgcttggagagtgaacaagaattttgtgggtctacaccagggactggaaaactattgggcccacagatccaatagccctttgcctgtatttgaaaataaacttttattggaacacagccgcgctcatttgtttatgtaatgtctgtgactgcttctgcactgtagcagcggagttcagcagttgcaacagagaccatatagcctgcaaagtctaaactatttagtatctggtctttacagaaaatgtttgccaactcctggtctagtcagggccttgagcaacaaaggtcttgaagtagctaaaattgatctagataaaaattttaaaagactttggccttctgttttcttgtgtgggtctttctttttctttctgtttttccaaaagacattagaatttgatctcttagaaaatcccctgaattcaaatggaatagactctatcaaccatcttggaaactaaccgtggcataaagttactttgtctggtagcagtaatacaaaaacactggtgttttgcaagctgtcaagccatgtcatatatttctctcaattgacatatctgggtcctttcacgtgcatcttcgtgatgttaaaagatatgtaccatatgttttgaaaaaccttggctcacctcgagtcaaaagctttgttatttagaaaaggcatcacctcttaaaggtttgaaaagcattgccaattcttctttcctgtatctctgttaaaataaatcccttaactccaaacttctcagctttcatcaatggcaggcctgattcatgcatgatttataaattagggctatggaccattaagatagatttctcagctttaggtggggtataatggtgttatatagtgtggttttgaatttctgaagaagcaagatacatagtagttgacaacccaagccatttttatgttctatttacccttatggaaagcttcttttgttttttaagtgggatttttttcttcgattttcttttccttttgaagctttgccgtattacaaatttttacttctaattatgagtagtcaagagttcttaatgccacccttacgctatggaagtggtaactttcatctaaagaacatcttatttctgaagacagataagaaggtttttcttataatggcgctaacagagaaaaactgtttggaatctcacctgttgccactgcctttgtattcattaacactaagactgtgaagttttgcagatgccagggctcaggagtgattattcgctcttgtgagggaagaagcctgtatataacactgccttaagagcacactgtgcctgaaggaggattatattttattgtttgtgttgctctcttgacagcttttctttggagcctcccatagaagagagactgggatttaaaggctgatgccagaaagcaaaagctaacgtgaaaagaatccaagtctctgtccagtgtgtgagaatctgcaacggttcatggacaaggaataaaacaattaaggcaatgtcagggttataatacagaagaacatatttcaacccataaaattttggtttgagggaaaatgtgtgagagttattagagttcttggaggatgagcttgagaaaaactactggaaatactaagagattactttcttcttctatctctttttcttccctaagacttataaaagcagaaaaatgcaagattccaagcttgtctggacacagctccctgataccatcctatttcatatggcccacgcttagattttctaactagttctgactcctcttaagagcactcttatgtgtctacaagacctcctccccatagtggactctcagaccaagaatcactggttgtattatagaagtcttgcaacatatccaataatacaataatgatcctgaccttctcctttctcagtcttaataaattctgcttttaacggaagaagcatttttgagttaaacatgtatatgtattttttcaattgtttgaatttttaactttttctcctttaaactaaaaccaagagaggatttttaagaactggtgggctgctggactggtggggagggaatgaacaagtaaaccaacctgactgacctgctttcgtttttcaaagtatccagtaatatgatcattttgtaataaatagctgagtattacaccctttgggaaattgtggctctctgtttcttttcgttgtggctactttgttcaggatgtgtaggcagtgccattgcagccaaagaaacctgatcaaatttccttccttcccatcttatttatattctttgtgaaaagcccaaacagttgttttaaacaagtctggccactcgttaaagtttaaactagtagtgagatccatcaggagtgaagtgtttctgacactctctgctgctcctggcctagggtactaagagtattagatgccggaagcagccaattttgtagtgtcttttaatacacaaaattgtattaacatcaatgtggatacagatggatgcactgcaataaactgtaaccacttgagaaaagcctttattgactctcaagtaaataatgcacattttaaaggatctaaatatgcatttacataatgtgctataattttttatggtgtcaactactcacacacacacatccataagacatgtttttcttcgtcaaaaatctggactcataccattcttcgtgcattccattagcatcatgccaaattcataatggtagtttttttctataaagcctgatctggccacctcaaaatatagttgatgaattttactctttaattgatttaaccccagtggctctttctaaaatgatttgagacaaataaaaacttaggtacagtaaaaacatccaagatgaagagagaaaacaagaaataggagagaagagaaacaaagttaggcaggcattgatgacatcttaattctgagtttcagtgggtttcattgtctggtagaagaggaatagcaggttatctagagaaatagcatctatttaataataactagagctttgtgatgtcagtaacgtaactattttctgtttgaagaaatgaaggttcaggatctcgaatgatttctctccagttgcacagtgaactgatgactgaaccagaaagtccaaagcatgagaaagtaagggttgcaaaggatgaccctttaaaatgcagactcagcaattgcccaatttgaaactacaggctaaatgatttcctggtattaattaagaattaattgattcttataaatcagtcattgtagaattaattccatatagtaccatatgttcttgtgtttgtgttaaactctgttccacaaggaaatggtgaataaattgtttttagtaaaataaaaaacgaaggtctaaatttaagttgctaatgattgtcttttacgtatttaacaacaacaaaatgagggaaaggatgtttataacagttaatgaggagatgacagggtgcttttgagttatttcttctatctcatttctttaaagatcagctctgcttgatctttgctcaagtgaatttcttttttgggcagcattttctgtaggccaccgtgatttcataatctaacaattacccatcactttccattgagcacctgaggcagcggcactttatcttcaaggtcagcctaccaggggctcttgtcagcagaattggcacctttgtgtttggcattctgcaaaagttgagtgtttcgttttgttaggctcagtatattctcagcctagtttgggaaatatcacattctgtccttaactagtgactattccatcagacgcagggtaccgagtacaagttttttgccaccagcaaggaggactgtaccatgttggatgaaaaaattcctttgattcttgaaagccaatggcataatttgcagagtaagagatgaccagagccatttaactttttagcttgtgggttttaacaagcaacaacaatagatcccaagatttatcattcattgcaggaagtcctaagttttactcatttttcttttttttttttttttttttttgagacggagtctccctctgtcgcccaggctagagtgcagtggcgcgatctcggctcattgcaagatccgcctcccaggttcatgccattctcctgcctcagcctttggagtagctggaactacaggcacccaccaccacacctggctaatttttttgtatttttagtagagatggggtttcaccgtgttacccagggtggtctcaatcccctaacctcatgatccgcctgcctcagcctcccaaattgctgggattacaggcatgagccaccgtaccaggccagttttaccgatttttctaaaagctccctggctcttgaccaggtggagaaaccaagttttggttttagcaaattttattctatgtttaacggtatgattatcttattaacctctgtttattcagtcattcactgcacattcaacaaatatttattgagtgccagactcagttctggggatattgcagtgggttgaaaaggtatttacgaagatggagaaggctgggagaagtgtaagcttgagaggagaaggtaatgaaaattctgattcaaataggttatgtttgagacatcctcaattgtatgaccgatggcaaaatttcatctgttttggctcagatttgtttcttgagcccatagtaggagcctatgaatatttattgggcagattaaagattgcataaattaaagggttgcaccagaccacctgcaagacatggattggaaagttgcttcccctccaatcgcccatttccagtctttttgaaaactacagatgtcactctgaaccccatagcatgagccatttcagtcattagtcagaaagtgccccaatcatgaggagatcccggtagggaacaaagaacctatgcccagcaactaatacagatgcattctttttcacagcctttagccatgcaagtgggatagtggtagaagtgatggcctgtcttactgagtttctcttcagtattatgagtcattcttggtattggaaaggtcttattttccaaaatgtggacattcctgtgattttcagtttaaagatttaaaccgaagaaaggaaagataaatactttcatctcctctaatttgggagaggtttctctggctctcattgagaagcaagagctgctgctatcttggcttgacttggtttgaatatctgcaaccttcccatgcactgctcttatcctccagccagttttatcaatcatccttctaattcaagggcaaaagttctcttagagaagttattaggcacctcacataagtttttttaatctaatgtaatcttcttgttcacatgaaatttaccagggttcaaatgtaagggagcagtagttgtctgagtcttttatcagtttttatgggcacagggccaacattttagcaggggtcactgcctgcttaccctgtgggttcccctgctgtaacatatgtgcatttctgagtttgtctttgaaatggcatctgaaggcgacataaaccatccgtgtaaagtgaggcacccaaattgcatgggctcattaagtgatcatttactacatacttcaaaaaattttcatcctgaattagtccctagaaatttccttgaaaggggtataagaggtttaacaatgaattattgtctatggatagctcagcgtgaaaggggatccatatgtgcaaactagaatttgtcatatgtaatgtcagttaagtcaggtctaatctaccaaatacattttttattgcttgcttcattaaaaaggctcttaaggtaatgaataatcttcagcctcaccaaggattattaatgcctttataactcatgtccactgaaaatagaaagacagcttgaaactctaccctaatctaacctccgtgtttgtcttagagccttaaggaagaaaatctgtcagacctatccagtgttaaattcagtcacatgagcaatattgtgaatcgggccaggaagagaaataaaggaggaagttgaatcgggttcagctatgacaaagcaggtctttcttttcataaccctgatgttttcttttcctgcagcaagtccgcatgcaacaccatcgactcttcatttcccgacatcacccattatccagcagcctgggccttacttctcacacccagccatccgctatcaccctcaggagacgctgaaagaatttgtccaacttgtctgccctgatgctggtcagcaggctggacaggtggggttcctcaatgtaaggaaacctctttttttccatttctttagaaatgttagccgaatataaaaataacaaggggagaccttatgatcatgtgacgttgtgctctaatgttgtgctgactgactgcaggcaaatgtcatatttattctagattgtgggaaagttaacttggtctaagagtgattagtcagggtttaaaaacagtgtttgtgttaagtttgcaactgtcaagtttatggatataaatcagctcaagggtgaactatataaccttctaagttctgtgggctgatcattccacctcgtgcattctaaccccagggctcatacagttaacaaaatagaaagaccaagtagttttaaataatgatttggggtggtagagaaaggtagggagatgaaggggacagatgtttcagatcaactaagttgatatttttgaaaaatacagtcttgtaacactttagatcaagttgaccagtacttgaactcaagatgctgaaagtacagtttattatggtttgttatttctgcaagtcattatctttcccacttatcttggtataaagctaaacagtgttcaatagcttcacatgaatgtttttatttttcctcaaataaaccaaataatcacaatttgaaatggcattccaaatgtaaaagtgatttttaaaaatcagaaattttatttcaaatataggattagatgtttacagtggaaagctgtatctcaaggccaataataataaacaacgaccagcataaagccaaatttgattttccttttctactaataactgtgcatgaagtcacagactagccataattattactggccaatttaggatagtatgtcacaccatcctgtcaccgatttttttcacttgcagaaatacctgattctgcatatctgcgccagaacaggcagctttgactaatgtctggtgatgtgttagcagatacatttctgtctagacaacaaatcaatatggtgcctcttttctttttgcttgtacattcatttgcttggcttattctaaagcattcacttatggactctcagcccactcagaaataacgcaaaggcaaggttgctggcaagaaagcacagcattctgatcgtcagacgaggtagtctttgaggagcaatactaaatatataagtactaaatatataagtaaatgttgatgggggagtgagactgcctctgtagaattattaagcttaaatgtaaaagcctgggacagcagaatctccttcaaccgaattttgattggggactaaatgtgaactgttgtcgttggttgaatagaggcctcttgggaaacaatgaaaaaactgagctgatcaccagcatcaagcatctgacttctaaattattaaccatttttgtaatagtcctgacaccctatataactgtcaaatgcccagttttgcattttgatcagaattttataggacttaaggcaggtctcttcatgaaactattttgaaaaaattgaaaataaaatgggttttattgctctctttggaggggaattttttgttaaagagctgttatttggttgttttaacatcaggcagcaaaataaatatgactcttatggcatatgcttatataatttaaatcaaaattagaagtgatatttttccctagcagacttctgacagctgaattctaaagtttctgtgcctgatgttatacaatatgtgaacaaaattttctatgttcacttaacacatttattaaatgttatataatatcaactttgaagagtgaaaataaaatattacttttttatctcaagtgcatatttaggaaaatttattctatctatgtaaagaaacatagtggaataatgccacagtccataaaacacttagatattaaatatttaataatcatgagaaagataatgaaggtagcagttaatacagaaaaatacaaaagattccaagcaaaagttggttactcaggggacaaatccaaagtgataattggcaggtgattttatgaaaccagatgcaaagaaggacaatgtagttcaagagataagtttaggatgcatggagcacatgtggctaagagtacttttgtgaaatgccttaagaacagaacccaacaatggacatttccgtatgggcttatggaagaattgaagcagctagatacttagtaatttacattaaaggtgcctgatgaatattttgttttcagaagcagctaatggttgctgtctctttcttctttttcttgtacgtgtgttttctgccccccccccccccacagcccaatgggagcagccaaggcaaggtgcacaacccattccttcccaccccaatgttgccaccgccaccgccaccaccgatggccaggcctgtgcctctgccggtgccagacacaaagcctccaaccacgtcaacagaaggaggtgcagcctcccccacgtcaccaagtaagtatggctgcgacaaggcgccggtcacttctaaagctgtatgcactggaatccacacttaggctttgtccctcactgtataggctctagaaagaggcacagatccccagtgatgttgtagcatgagtttgccagaccgagaatcaaagtgaacatgactcttgggtactccaccagatgaggaaaacactgggtgttgggtggatgagatggtgtagctacatacctaggactgaagtcaagttatgagctattacattttgtatattatttgagggatttcaaatgctattcccatcatcaagcagcagctacttacatggattctgcttagaaaaagttcctcattcttacagacagccctgccttccaggaacttgcagtctaagagaaatgcacttgaaagttatatacctcatacatcaaataggagaaaatgtctagatcaaagcaccaactcaaaggtgtgtacactgaccattcgctgagagtaagagcctggcagaagatcaatgctagtagccctggcagtcgcatggtgaggtttggcagaggttggggtaggggctggggtacggagatagaggggagagtaggatggaaggaggagagaagtcttggctcttctctgaacagtctgagaacatttaatcaaagaatataagatttcacaacccttttagatgatgggaatgattacttgaactagagagagagtaattctccagatattccctgatgttttagatatggcaaggggatagaaatagtttgaatgcacaaatgtgccttttattagtgcctggaataatgacaaaaagagtgatggctggagttcctaggtgatggatgccctagccttgatagatggtgtgatgagcaccttccctaaagctgtaaagaggcagcaaagtataagagaaggataggagctgtggcagtgtgaccctaaggaaagccttcaagggggttgtcaaaagaagtgagactgaggcaaggaatctacagaggaaaggatgtaagagcagcataggaaaggagtgttaaggccaagaacttgaaccacagtaataggtgtagaatggaacgggacatggtggggagtgttttgtagacataagcatcgggattggacagtcctctggatgaatgcggtgaatgaagattctaggcctctcagcttccttaccttcagtattggaataataatgatagtgaatacaggagggaaagagacaaagaagaaaactgagcccctgtttatgccatgttcatagaatttgattctgggggcacggaatccagatggctagaggccctcatggacacatcagagagtgagctttgggttatccagtatttatgcattttgataatatatgcagaaatgagcagcactgtgcatagattctgtatcaatagccaaaagattgaaggttcaggggcaatctagggaagacctacttctcttggtaagaggtgattcaacacttgtcaacaaaggagaaaaccctcagtgtccaatgacagagaagcaagctgggcttggcccatggatcttagaagctcagcttagaaggaaagcctctgcttctcagaggtttgaggcttgttcaaagatgtcacataaatacacaataagtgccctgctcgttgtgtatttatgtaacatctttaaacaagtcagagaaataactgccccagactctacttacatctgttccttgaggatgttggcttacagattatgcctactgtgccctgtccatgcctctgcataccattttctgctcgtcttctctctgtctgtgcaggacattgccacagtcttttaaaagctgcatagtaatatgcaatcaattccgtggaaacagatcctcacctccactctcaatggctcgtgtgtcctaatgagtttttcagtaacgggaatgaggctctgctgaggcacagcagaagagtggaaatagtaatgtgtggctgttcaagtctaaaggatgggggctcaaatgcccacctttcaaattactaactgtgtttctctttgaatcaatttcctcttctataaaatgtagatgataatatctacctggcatgtttgttgtgagatcagttctgatcattggagtattttattatctgcccaaactcttacatagtggaagactccaggcttgggtaatggtaaaatatatctgtaggacttggagaagctactcaacccctaaattgagttgatgcctttgggtccacagttctagactccactccgtggattgaaccaagtgctatgtataagatgatacctatcatcctcttgtgcccagcctcaagcatcttgtcagcactaaggggcaaagggcagaaggagtcttggcagatccaactcatatggttgcatgttagagcagcacttaagatttggggtggggtgggggtgagagaatatcaggagaaagagtcccagagcttgatacagataatttgatacttactttttgaatcatgggattctagaaatatagacaaaacaaaatgttctaccgatgacacagaaaggtttttatcatcattcattttagcccttgttcagctaaaggcttttctagggtatgatgaattcatagtaatatgtagtttcacagcatactattgcttaccattttctgctttcttaacaagatggtgttaggctgggagagctgtaatttatagcgtaggagaagcctttcaaattaaaaatcttgaagcccactcatccttatttggaggggatttaagggccctcattttaaaatatcgtctcccatgccctgatttctaaaccaattgataaataaaatatttttttaaatcagaagacaaaatatcacctttattatgagagaatttagtttataactgtgggcagggcacttcctaacactgaacccccaattacatcgtcatagctaccaggtcgctggcaggactagaccacagcagcccttcctacatatggtccgccctagcctgtaaagctgatggcatgaaggtgcgggtggcagtgtgcttcccaccagcacctgtccccgaagaggaagagacagggtggggtggtagggactagtcatgtccagtttttcctttgaagcccttacaacctagagagtaacaggtgagagggtggagagaagccaagagtagatggaagggaataaatatcaggagtgaagtagcttctccctcccttaacattcatctttgatgactgcctttttcattcatttattcagcctgcacctatcaggcatctgtgacacggcatggctgtgttagtgtgtgggattcagagatgatggatccctgctctcaagaaatggggatctattgagggaaaggtaaacaggcagtttacacaggatgacaccgggataaaggtgtgtataggtgccatgtgaagacatgggagggagtttggtccagtgtgggcctccaggtaaaggtattttagaggagttgacttctaagctattcagtagggatgacatcctggtgtcttaagagaagatagaacttttcttctgaaaccagctgggggcctaaaattggattaccactagataaaaatgtagggcaaaactatagtttcagaaatcaggtgctttcttagaaattaaacacacaggttgagtggattctgtttatcttgtcagcttatgagagctcaactttagcaagaaggagcatcatgacagggtattcagtacatgtgctcagcatcccaacagtttgatgtctgaaatggaggctgttctcaaaaatgtaaactgtatgatgtaaaacagccttttctatttaggagtttgagatgacttgcaataaaatacaattctaaaaataaatatagggactgggcttcgtggctcacacctgtagacccagcactttgggaggcctaggaggcggggcagattgcttgagctcaggagttcgagaccagcctgggcaatgtggtgaaaccccatctctacaaaaaatacaaaaattagctgggtgtggtggcgtgcacccgtagtttcagctacttgggaggctgaggcaggaaaaatgcttgagcctaggagcttgaggctgcagtgaaccaagatcacgccactgcattccagcctgggtgacagagcgagaccctgtttcaaaaaatatatataaaaataaataaaaataaaagtaggaaaatatgccaagtgtcttctgtattatcagcttttctagacctcaactcccttatgtattgatggaataacactaactgctctactcactctcgtagtcagattatcagaacaaacaggagtaacagatgtgctgtgctgtagacggttaaaagtccaaggcatcatttttaatatcttcttataatgaaatacaaatggatgccagcctggagcagagtatgtattttttaactaatcagttgcctctggcactaatactaaactttgcagctgtggccagaaaagcagggggaaggcagatgtgggggaaaaaaaatcctgtgaaataaatacattttaatgggaaaaatccttaccagcgccctaagaagtagggaagtgggggtggggcaagaataatttttataatcttgatttgtttggagaaagattgatagactgtgccaggtctctttaggatactatgacaaatggaagcataacctgtaagagcatttcacaaccaatgtgctccattcccacagattaactacctgtgtgggttttgatacctactgaaaaaggaccacttctttcatttattcaataaatgtttattgagcatcagctgtgtgccaagcactcttcttggtgctaggattcagcagggaatccctggccttatggaactttgattctagagagggaagaaagacagtgaacaaaatagtgagtacgaaaggtacgtaggatataagatggtgatatgtaagtgctacatagggaaatcaagccgagaggggagggatgcagctctaagcagggtgatcagaggagggctacttgcgaagggcaaatttgaacaaagtctggacaaagacgagagggtgagcaaggatgcagtaggaggagaggtttccaagcagaagaaccagccagtagaaaggcagaccaatgtggtgagatcagggaatgaaagcaagggggtgaggtcagagtggagtgaggatgcatttgggaccttggggatgtaaattacaccggttcttataggctcttataaggacttcagcatttaccctgagtgagatggggcagagaggtaatgccacctagattttaatagatacatcctgaaggttttgttgaaaatagattgtcaggagcaagaattaaagaattaaagcagggagttaaaaagctggatttttccaataaataaaatgagcgtcttctacatgccagccagcattctaggtataagggatataaaagtgaacaaaacagacaaaaatcccttgccctggtggagattacattttagtggaaggggataaacaataattaaaatataagtaaattagcgagttaaggaccagtaagtacaatggagaaaactaaaacaagcagggttgatagggaggggcacttattgcaatcttccaggcaagagttgctaatgacctgcaccaacgtgggagcaataggggtgatgagaagtaagcgggttccaggtatatttgaaaggtagagctggcaagatttgctgacacattagatgtgggttgagaagaattggtgatgatgcctgtgtttatgacctgagcaactaggatagagttgccagcagctgagatgggaagaccacaggaggggcatctctgggtgaggggtggagatcagaagttcggtttgaccaaattatgtttgagatgcctattagacatcttactgctggacttatcataataagctgcctttcacagctctttgcaggtgactgggtttttctgtgtgtatcatctcattaaattgagaagggactcctttttgaacatgtagtacaatgaatgaatagacctaagagtcctgagaacagctctggcatgggacaaagctttcattatgtttgggtctgtttgtgctgtggtaattcaaaatacacaattctttctggtaactgtactttaagttccaatttttatattgtagattggaatcaatatactataaaaatggacttttccagaaaaaaatgaagattggcatcataatctagagatataatagaaagagaaaaaacacttttgaattatgatggaagataaaacatgcatatttttttaattaagtaggaacacaaaaactcaatttaaaaatgcatgaaagacctatcaatatgtttctccatgccttcttcactatgaactttgaattttttcaactagaattctattaaaatagaagcatataataagttacctttattatttatttttatatctttgatgaatcttgtatatattcattatacaaatgaatatgaattcgttagccaagaacctaacaataatctatgactgggatttaaaatttctcgtataataattaacatgtgttcaatgctttttggttaacaaagctctttttacatatgtattatcttatcccatcttctcaacactcctatgaggtcaggatttcataggcaaggaaactgagattggaagatggaggttacattcccaggttagtttggtagggagtcaaatacaggcctttccatgctctttctactacctcatactgtaactgaacaaattacaaacaatgtcactagatttctgattctggggggaaccacagctgtctgctactgtcagaaattaacaacaacaaagtattttgctttttttttttttttttttttttttttttgagatggtgtctcgcttggtcacccaggctggagtgcagtggcattatctcagctcactgcaacctccacctcctgggttcaagcgattctcctgcctcagcctcctgagtagctgggactgcaggcacccaccaccacacctggctaatttttgtattttttagtggagacagggtttcgccatattggccaggctggtctcgaactcctgaccttgtgatccacccgcctcaacctcccaaagtgctgggattacaggcatgagccactgtgcctggcccaagtattttacttttacagatgtgtcaggcacttcacaaattgtttttttgtttttttgtttgtttgtctttctgcaacagagtcttgttctgtcacccaggctggagtgcagtggcgcaatctcagctcactgcaatctccatctttctggttcaagtgattctcatgcctcagcctcctgagtagctgggatgacaggtgcgcaccaccacttccagctaatttttgtatttttagttaagacagggtttcgtcatgttggccaggctagtctcaaactcctggcctcaagcggtccacctgcctcggcctcccaaagtgttgggattataggcattagccactgtgcccagcccacttcacaaaatgtttttatatatgtattatcttacttcatcctcagaataatcctatgaaataaattctcttgttagccagattgagaaagacaaggtatggaaagataaagtaactttctcaaggtcattcagccaggatgctagagtcataatttccatccaattcaccttcaacctagagctcataggcttggctgtagcatgaggatctttgctttagcccaaagcttcttggttttttggttttttgttttgtttttttttttcagtgaaaacccaatgggagaaatacagaggaagatgttagtagttgtttatacttaagtatgaattggtttctgttccagagagtgcatcttattagcaggtaaaggaagagagcagaaagtttgaggggaaatataaggactgtgtttcctctgtcagagaagaagcagtagattttaagaaagaatgaaaaaaaaggagttagtggcttccattcgcggaactgttttttttcattagtgacgcctggactatgttactgttctttttcttaattttaaaattttacattcaataaaattcactctttagtgtacagctctgtgaatgttaataacattcttgtaaccaataccacagacaagatacggaacaatccccaaactctttcattgttctcacctactcttagtttaaagtctgatgtcacttagtgccagggaacttattttactttgcttgatttccatgttgattttaattcctctaccagtgctgctgctatcccattatgtttcaaaaattgagagattatgaaagagacttaaatacgtacagtattttaatctatgataagagtggcattttatattagagaagcaaaaggggttagtgagtaaagtatattgggacagtctggaaaaaataatgtttcttacatcaaaacaaatttcagccggaatcaaaaatataatattaagccataaaatagcacaagaaaatacagggcaaatttttatactattggagtaaagaagggctttctaaataatgccaaaaaaccagcatccatgaaaggaaagtatccaaaatttatgcatggaaaaaacaccatgaacaaagtcaaaacacaaaagatagaaaaaaaattgtaacagacgtgacagggctaaattatctaacatataaattatttttaaaagttagtaagagaaagaccaacaatccaatagaaagacaagaaagggatataaacagaaaaggaaaacatttgaaagacatctcattcatgtatcatgagagcaatactgattaaaacttgagtgatatttttacctattagattagcaaagatcaaaaggtgtcttaacacaatattggtaagcatgtggaaaacagacattctcttgtgctactaaaggactgtaaattggttcaacctctacagaggacattttagttttttatatatataaaatgtaaatgtgtgtgataaagtttataacacaaaaacatgtttacattttgtacctatattagtacatatataaattttacatgtaagccgtgcatacatggctagggcatatgaacaaaaatgtacataaagtattgattgcaacattgattacaataagagactggtaataactgaaatacctaccaactgagtattgtacattaggagctctttaaaaataaaaagataggtctgtctccatgaattcatggactaatccttgagttatattgttacattaattcagcaaaggagagtgctaagaaatatgtatggaatgctgcatgggagaggggatgcatgtacgtatcagactgtatgtggaaggatagaaactaatagtggtttactccagggaaaggggcaaggttgttggcagacaactttttggtgccttatccagtgagaaagatattgctaagttttcagtcctccttttatatcaaatattatgatttctttattcttaaaaatatttgtctagtgatctaataatcttgtttatactaaaatgatgacagtgatcaaaaccacatactcacacatgggggagttcataaaatccttggcaatttttatacatctagcttttagctgtactaacctgaacttttggagtgattccaaaaatgtgtgatttttctagtaaaaaataatactcttttccccctcacagagagcatggggttcagtgtaaggtgagcattttcattcacagtagctattagttggttgcaggttctgccttacgaacccattaaatataaatgtacttgtactatcttataacataattggttataaatactttttagagtattttaattttgtgtagtctaatattttggtgtttaaattttttaaatgaaaagaaaaagaattattaaaaatcaagcattttgataggtattttcatatgcattaccttagttgcatttgttattataaatctgcacaattggaattattagccccttttaaagaagatgaaacggagcaaaggttcagatcccagtctgctggactccaaagcccagtgttttctactctaccaggacacatactatgtttagaggtgtaatatcatgcagctttcctttgaaaatcttaaaacaccccattaaaaatcttttacattacgtcaagaataacaccatcctgggtacattgaaatagatgaaaaacatggaaaccaaagcaggaaaaagattaagagataagcattacaaagaaggaataggaaaaagaacagaacattggatgattccattcatttgggtcgtcataacccagtcaactcttgtgttcaccttagttttttattatttcagatgacagatgagtttaagtctttctttataaagataatatatggcattttaggaaatttgcaaaatatagaaaagcataaaaaagaaaattatattctcccattatcaactattaacattttggttttgtttcctcatctttgtgtgtgtgtgtgtgtgtgtgtgtatacacatataagatgattgtgaccatactgaatataatatctagtatgccattaattcacattttatgccttttcgtactcaaaaaaaagttaagaaataggattttaaataatttttacctatattcttactataggacataaacttttcttctaacctatggagtatgctccagcatatccttagacatgtatttttgtccccaactctaataatttttttaggatatgtttctagaattggaattgctaatacaaacagtatgaacattcctcttgatacacattacttcattgctttcagaaaggttgtgccaatttacaccttttcaaattgtgtacgagtatgatcataacattaacccttgagaagtttgggtgttatcttttttaattgttggaaggcaaatgtgttggggatataatgtcccttatcagatattggaatcagtagtccctgatgaaatgattttagtgtttttctttacttgtatcaattatattaaaattggaattttagggatttcccatcctatttgcaaagcctctccatagggatcaccctttggactgttcctgtgaagagagtgacctgttggatatcacagaggggtaaagccttagttaaagggctgggagattggagtaatgtccattatactggactctatatagagaagttcagagaggttaactggcttgccaagatcacatttctaataagagatctaatgaattcaatccaggatttgctggtttttaaaatttattttctatttactatgttgcactgtctccaaaaaaagtattatttgagatttttaggttccatttgtgttttatttaagattaaaaattactggaagttatttaaaaatcatccataatccggctgggtgtcatggcacacacctgtaatcccagcacattgggaggctgagacaggaagatggcttgagcccaggagttcaagaccagcctgggcaacataatgagacagtgtctctacaaaaaataaaaatttccaggcatgtggcacacacctgtggtcccagctactcggtaggctgaggcaggaggatcacttgagcccagcaggtcaaggctgcagtgagccatgttaaagccactgcactctagcctgggcaacagagcaagacccatctcaaaaaagaaaaaaaaaatcatccataatcccagtcttcaaagacaatcactctctgtgcatatttcccagtcattttctgtgcatattttaatcataattgatcatgatatatgtgtgtattatacagttttgtaaatgattcttattttgtcttataagcacattacattattattttaagatattattaatggctgcaaaatattccaatgtatggatgaagcattaacttataagttggttccaatttgttgctcttataagtaatgatgtaatgaacatcttgtagcataaacctttatctgtattattagtatttgtggaggataaattcctgaagtagattccagagttgcactgccttttgagaggctgcagaagtctttcaagagggagcaatccaatatattgatctaagtttctttttttagcaaactccagctgaatccagggtttattccctgtggctatttaatataactttcacctgtccctacccatatacatggttgcttctgatcaataaacattttctgtcaattgagcaacacacagcatacacataaaaataaatgacagtcataaaatttggatcagccatcagaagtaaatttaaatgaactgaaacaaagttgtattcttagcctttaaaaactattatgagaaagaatgttacaggcagttcagacagacagactgtgggccaggtgtagtggtttgcccctgtaatcccagcactttgggaggccatcgcaggaagattgcttgaaaccaggagttccaaaccagcctgagcaacatagtgagacccctacttctacaaaaaataaaagtaaaaaaattagctgggcaccttggcacgtgcttgtagtcctaactaccggaaaagctgaggtgggaagatcacttgctgcaatgagctatgatgacatcactgcactccactccagcctgggtgacagaataagaccctgtctctaaaacaaaagattggctacaggaaacactcactgcactcattgtaaagtgccttcttcttgcacagattttggtaacataaggtcaaagcgtctccagttgaagggttactctggtctcctctctgtgtgcacattataacatgaattctcttgcacctccctttctatactttttaccccaaattctgatatagcttgacctcctactgcccttaggatccttaatacaaacagaaatactaacagagcaaagccatctggccagactatttcttttcatggtttttgtgacttcttggcaccttagacatgccatgcaaatagttagcatacacgttaagcattgctaatatatttaagttagaattcattagcttttcaggaaggaagcttgtgggtatgttgttctgtaattactagcgataaggaggcttttattctgtgccctgagggttgtgagtttttgttgttgctgttggtaacttgtttgtagagacaaaagatttgcagaaataataggacgaggtagctgtacagatgtgatcagaataatagaaattcggcgtagttatcctctagatgctaaacatctggataaaaactacaacatccattccatcatgtgggggtttctaaatctctgaatattggatcatgtgtaagtaaggcctgtagatttttaaaaggctgtttctctagctatctaataatattactaatactaacccaggccctgtaaacttgtcgataccaattgatttctttgaaggagaaacactccaatactttctagcatttcttttgtgaccttgtaagaaatagtgctgttcaaatttttaagtgagttcagttgtaatggtttcatatagaaattagccgatatattttctaacagtttctgcattatttttagaaatgaaagttttctcacaggaccttttttttttttaaatagcatgacagtgcagttaaaagattcgggacattatttcaatgaggtatttagccacctccttgtttcagtttgcaactgaatgcttcttaggcacgtttcctttactgccaggagtcactgataaacatttaataaaattgcaatttgaatacccagggttctgtttaagtctatattcctgaacttgttttgattacttttgtctaataactggcaaattttgagcaggtagtagaatcatatagtaagcctattttgaataaaattgaattttcgactagctttagagggagactcccacacatgaatatgtctgagtttctgaaaacgagggaacacatgaaggtgcatcttgatatttgagatgagaagggaaaggtttagagtggaagaatgtctagttgccttaacagtgtttagaattgaaatttggtgtctgtttattttgtaaattatttcctcctcttaaaataaattcaacaggcttcttgcccgtcattttcaaacatttagatccctgatccttaaaatactacctttccttgctgtatggcaaaacgtaatttgcaatttctctatcttctcctttccctccacaattgccagctccgttccctgcctctgttcctccaattgtgctgtgcccttggtggcctcagtccactggaacctgtcaaccaacacatctttcacagcccatcccagaggcccgctccatctcccctgtaaggcttgtcctgttcctcctgccagtgtcacttttctgtcctttacaccctgcagagttttatttatattactttttaggcactcatgtttccatcctctgtacttatctctccccattaggctgtaacatgttggggatagcagcgtgtctcactcgcctttgcatcctccatagtgctcagtacagagcctggcacgtagcaagtgttgaaatatctcttggagagagagaaaaaaaatgaatctattaaaatgtctctatgatgcactgcggaagctagacttggtagatcgagtttaagggaatgaagagggggtgaatgtttgctacttccgtatatttggagtatttgataaaacagaagaccagtttctcttcaaacttcatgtcggtttgtaggccaggctgccagggtttagggtacctcatcgcttcctgcatctggaagtaaattcagaacctcaaagctcaccctgccgtatcttttctgccaaggtgcctcacattttcctcctagctgcggccagaggagctggctgtcactcaagtaggtcagcctcaggtgaaaccagccacttagcctccttctgggcaccctgtgggtatatggaggggtgtttgttcaaagagcagctcccctttcaggtttaccctttacacggaagaaatctggctaaattttctcccttttctgcctttctgtgattacatgtattttagtgattgctaaatttgaactaaaccttgaaactaactgcctgctttcaaaacaaaccaatgtgaactcacattttctagtttgtcagatttggggaattttattaatattatttttatcttaaagaaacatcaactggctgagtgtggtggctcacgcctgtaatcccagcactttgggaggccaaagtgggaggatcacttgagcctaggagtttgagaccagcctgggcaacatagggagacctcatctccacaaataattttaaaaattagaagggcatgatggcacgtgtctgtagtcccagctactcaggaagttgaaatacaagaatcatttgagctcaagaggtcaaggcttcagtaagctgtgttcctgccactgcactccagcctgggcgacagagccagactccatctcaaaaaaataaagaaacctcaactgacgttggcatgaatattttaatatcttaatatcttcttcttcagtcatattttttccaaagacaagctgaaagcatctccactcaaatcagtttgaccacgttttcaacaccatgttcaggtataatggttgagtgaaggctattacaaactcaaaactaattcatctggaaatgccatggttcgtttttgcagatatatcccttataccttcccatttggaaaaagaaaaaaggaaacctaccacaggaacaacaaaaactggaatttgtttggctagcagtcagtaagccacattcatttctgaggacgtagaggccgttcagtcctctcagggacatccgccatgataaacagcagtgcttggtcccagcaccttgggaggccgaggcgagaggattgcctgagcccaagagtttgagaccagcctgagcaacatggcgagacccccgtctctatttaaaaaaaaaaaaaaaaagagcagtactgatggatgattcccctactaaccctctccaccccactccctcatgtccatgtaccccacagtgcccctagagataattcctagcatcctcagaggccctgtcaaactattgttcataaagagagaactgttcttgagccattccccgactgatcttagggaggcaggaccggtattgtctaagtgaaggattatataattagcaatgcctaccataagggggtaacacagaaagaatgcaaattttctggatatgggatcaaattctggtttgggattttgaaacttactgctgtagtgcaggccaaactaagactcttggataatgtgaagaaatacattagagagagagagaaaatatggtcagattagtgcaaatgagatctggccagaagcttcttataggaacattcttcaatgttaggaaaatggttcatagcgctattgctaatataggtaaaatggctgctaaaaaaaaaaaaagcaaacactttctgtttcagaagcagccaaataatcaatgatttgatttctaatagtcatgtttgccataaggattcttataataagattaggtagccaagttggtttccctgttgactttatcagtaagtcatcaagtacttctgaacctcccctccagaatgcccaaaaatgtcctacaataatctccccagaaaactattttctggattttattatttttcatagttctacctacagctttgattattgctgttgtaaataaggcaagaattgtaattaagaaagatatgaatatgatataatatcatagtatacacagttgtatgtaattaattaccttattgcccctttgcttgattttatattcacattgtaagctcttaactgtgcatgtataattgattcactatggtaaatgtggttgttttaacaaaaagtttcaattaaggttttattcaacagtgtaattcccttatccaattgtttctgtaggaaaatcaaattcaacttatgttatatcatttttgggactatatcctgttataggtaactgccctgctagaataatggaagatgagtcagaatttctttcttccttcctttattttccctgtgtccttttcccagaagctagctttctatggaataaacttgcctgggcaccatttgtcccattctttcacttgagtactcaaagactagtagacttttgtagctgttatatatgaatatatatgaatatatatatatataaatgcaaaccccctagcacctctcttaccattgttctttttcttaaagaactagaatcaaatttctagaagctctggtaggctttgatagcatgaaaggccttctgggatgttctgaaactaagactgcaagttttgtcccatgattgaagaagagaaaatatctgattgttggcctcatagaaattttgtgtagctaaagtatttgcatgctaaatctttcaaatggagaaattgaggttaagcaaaaataggtgatgggatataatataaatacctttccagatttagcaagcttgctatagtgaagctatcttcacaaaaaatgacacccccccctcaacccccagaatggcttctgtgttgggatcagttagcatgcttgttttggatgtccccagtatggtaagaatgtcataggaaatcctgctatgtgtctatgatgagcagcaggcgagtgcacactgttctatcagggccatcaaacatggactcacgtttcagcgtctgtcatcaatcactcatagacttcataccttaatatacccttcattcctttttgttccttctcaacctacctacctattcatgtgtgaaagaacacttttttccctaaccactaacaggttcaacaggttatttcacctcctagcttcctctttatccctcccacatcctctttgtgctctaagagcaggggaacacactatcagataattatagtctctccttttcaatataaaaactttatgttgctgtttctcaaagcatatcaaagtaaagccatggggtgaatggtacacttaatatagattattttactgagcttttaaaaaaattaaattacccccataccagtaagtgagaggtacaggcagaatggctaaaggcagaggtatttctcaaatctgttcaaattagtctggcatagcatgggctagagacaaaatcagtagatttacattgctagacagtatgacatatcatacatttagatcattttaaataaagtcattactgaatagatcctcctaaaacaaatactattaccacaaaaagtttcttatttaagagacatcagggaccctcatgctcagcctctgttcagtgccgttttaacacagccatgtccacatccatgtgaccattgcagatctgtttgggtggcttagctcttaccaaagacaaccaacagggtctgggccagatggtggaaattttatccctagatttgtttaatgagagaaacaagaagtatgagcaattttctgtaaaacagaaagccagagtaagaggagcagatgatgtcaataaggaaaaaaaaaatctggcaggaatttgatatcatgccctcaattatctgtgttttaaaaagttgcatatcctgattgtttcttagatggtgtttgtctagagttagcttaaaaacctagattgtttcttagatgatgtgtgtctggagttagtttaaaaaccttaggcctttttaattattgttaagacatttgaaatttttaagtaacagtctaaagattctagtacagaggaagaatgtgaacaaatccttggaggtgatgataaagaagtgaattgaaggacaccaaaaaacaaaatgtacctttggatttatgagccagtgaaacaacaaagccactgaattttttcccattaaagtagaaagaagctcttaagtacagatacaaaaaccaacaacaaaacttccatgaaccaagaaaggatagtaaactgaagtgtggtacctgaggttccagtgtgatatcttagttgataaagggtcttgatagtttatgcctgaacagaaaggttctaggatgggaagactacaaatgttaatatgaaaagcatattttgtgcatcataaagattctagacactacagggcctctaaagacagcttattctgaatggttttctatctccttcctggagaacccattagttccttctataaagattcctcttcgatctctagctgtagaggcacaggaccatttcatgattttttaagagtgtaacggtgtgaaaagcaagcttgtaaaatgaactgctttcctccccttcctacctaatttctttctccctctgctctaaagaataggatatctctttctgactccagagctcatgtttaactcagaaagtatactttgcaaatgtcctgcatgttctaatttgtatggtagaaggagaaaatagctcgtctgagcattagtttgacatcattttatcccaacagtctttggaagccaatccctcttcccccttttttgactgtctgaaatgcccttgctagccagacccctttgctagctacagtgtttgcacatttccttgttaatcagctgcgtcggctcggagactgtgtgttttggtgttgtttgtgtgtgcaatctcgtgccgcttcctgaacgcatgtgtcccttcccttcacagcctactcgacacccagcacctcccccgcaaaccgattcgtcagtgttggaccacgggatccaagctttgtaaatatccctcaacagacacaggtgggccgctctcatcttttctgtatgtggtgcagcttgtattattcatcaggtgcattttaacttgtcttttgcacaaaaggccacattttccagaccctgtccagtcttccctttcctcctgatcccaccagccacatttccatgtgttctcagaaatcacagaaaattttgcctgcaatttttgcttcttgtattgagtgggtagaagaagaactgttttagctatggcacaaaaaggtttcccagtgttagctagtgtgtgttccctcttataggaattcatggtcctctaaatgcaagcagacagaagcaggcccctacagaacctgaaagtaatatctggttgccagtgacatcagagtgcatgctgggcatggagggaccagccactcctctgtattcattagagggtccccaggcacctggcaagctttctaaaagaaagagggagaaaagggtatatgagccctattaagttgctggtgttggtccagaaataagacgtgtttattagtggttactgctgaccactggggagcaaggtgcggtgggtggcaaggggtgtgtatgagtcatatctgaagcaggtgattgagagaagaggactgctcagacatccagagcttgtctgcccatagacagttgtgttttgtgctagtctaggtcaaggagaagaaatatttttgaaaagttttggaatggctgctgtatattgagaaacagtaaaaggctttttaagttcaaagttagtataggtagaggcatttagaggtttgtgaaatagaattagattcacgttttgaaataaactctctgatttcctaattagaacatggcgatattttatcataattaacataaggaaagtattttctctgtaaggttcttagcgcggtgtttgaaaacattcttggagcaattttgtgcacatgcctgtgtgtggaatctccagatgcctaatttataactatttgcctctgtttgtaaaactatggccaggtgctatatgaatgggatagatttgccttcctgggtccatttgccccctctgtaaagggctttggtttattgctatgtcgacagcacaggttaaactgcattgtatctgaagccttcctcacactgaagcagggtcacagaaagtacagcatcagcagagaaggcagctgggaggacagggggagctaaaaggggagggagaaggttaactcttgaatttcccacctctgctgtttcttcttaaactggcctgcatatggcgtctgatattaaaatctcctattcagtacctctcacaaaattctttcagttatttgcttattctcccataccttcaaatattcaaacacttttctggtgaatttgaagttgcataattacctgtaaagcattaaaacagaagaacataatttaattttgtacatttggcgtaagtgtccaagttcaatgagagggggaaaactggagatggtggctctatattggatgattgcttttcccaaagcacgaatgtcctcaagttgcttcattaagagcctttaaaatgcagctttgaaatgtcctgtttgtattttacatagtattttttatataagctgtgattcacagccctgaaattgtatgctgtgttcttttcaatttatttctttataatcaaaatgtattatatgccactgtggctttccttcacaaatgccttacttaacccagaatctgagttttcataatgctgaccacaaaaattcaattcttaaaaatccagattttccacgcatctggatgaatgatgtcatgtaggcccagtattggcatctggaactgaattttttttttttttttttggtttctgttaaatatttggcgtcatggggacaacagcttaaatgtttcttaccatagtgacacctgccacatttggcttgaagaaagtcattcccaattgtctaatgagaaactatgttaatggagttgtcatttttcccccaaaaaaagatatcttgaggtaaaaattatgtgttctaaatattttaattttaaggtatatatattaactcttcccttaaatgaggaactattttctgggaccacttaaagtgttagatatacgtagatatagataataaaaataataatataccttaaaaaataagttccctttcaagaggacatcagttcagaagaggaatttttgacaagaatttttaaaaacataattagaacatggtcggcagatttcctaggcaaacttgtgtttttctatattgatacccttgttacaaagcatgacatttatattaattgaattacaggaaaagttatctgggaaaacaaaattttgctttctacctatggagaaataagaattgaagagtcacccaagcagatacttaagctttctaaatgtagaagcagtatcttgtacataaatctataaacagatgcaaaataaaatgggctttctgctcccaaaggccagtgtccagtggaaatctcttaaaatgcctgaagcatcatcctgtagaagatggaactgatggggtctctgttttttcaagtgggtagaaattgaaccaatgcagacattataagtaggcagcttcagactatcataagatcttttttaagaaaaagagttatttgattgtatatagcttctactgggcattttctatgtactaaatccatcaagtatgtgatgcacctaatctttatagtcacctaataggatagagctctactttatagatgtggaagctgagactaaggagattgttgattttcccaaggccatacaatatagtcaggagtggagcaagaatttgcacccagttctgtctgacagcaaggcctgtgctctctaaccactgtattatgttactgccttatgagctggtgagctcttttccctggggatattccaacagcaactgatgctcacttctcagggatactactggtggagtccctgcttttgtccctaagactgcattaaaatataatctttagcgtatacccccaaaaatggcaagcaaagtttcaaagagatatttgttcacttgtggttgtagcagcattctccacaatagccaaaaggtggaagcaacccaagtgtccattgacagatgaattggttaaacaaaatgtggtctatacatagaatggaatattactcagcctttaaaaggaaggaaattctgacatatgccacaacgtggatgaatcttgaagacattctgctcagtgaaataagccagtcacaacaaaataaatactgtatgattctacggatgtgaggtacctagagtagtcaaattcatagaaatgcaaagtagagtagtggctgccaggggttaggggcagggcagaatggtgagttagtgttaaaggggtacagagtttcagctttgcgagatgaaaagagttctggagatggatgttggtgatgtttgcacaacaatgtgaacataccaaatcccactgaactgtacactcaaaaatggttaagatggtaaatgttacattgtgtgtatttcaccacaatttttaaaacgtgatcattaaaaaagttctaaagtccttttcacctcttaggagtaaaaaattctgtaaaacagtcagagcaagtggactgttgatcagagtaattgtgtgctgactgctcagaaaagcactaattatcatgcccagcacatagtgggtactctgcatacattggctgagtctaaatggttcagaaagaactttaaaaatatgactttttcttattatattcataatacatgttaattgtggaaaatacagttgagaaaaataataaaaatcacttgtagtcctactgttaacatttctgtataaatccatccagagtgtttctgtgcatacaaatatattgcaaaaagtgagatcatattatatacgctgtttggtagcctgctgtttcttccccttaacaatatattatggccttctttccatgtaaattggaaaaattgaatattggcttttattgcatctattcatcatctgtaatgattggtggggaaagataacgtggataattgaaagccatttttcctcctctttcccttgtagtctgtttttttctccagagaattcctcccttgactgaagcagaattgccttctctttagccttgccttgagctagttttctttcaaactgccttccaattgcattgtatatctggccctggctttcggctttgttcgaacattcctgccgagttatctgtcccattcttccacctcacttgtctgctacctctgctaccatcatttgcccctcatttttttcctccttctccatattgtaactgatcactgagatgagaggtggccacctccctacagcctttagaacacccatcaatactgagaaactgtggccacttgtcccaccttgaatctcttatttttcaacgttgtcccgtgacagctgatattaacatatagaaaggtctctggggcatacagtatttacttcactttagacactattaacgtgccctgcatgcccaccgaatggtataatgtaatgatagggaacctgccattgtttcaaatagcagaaagccaatggccatttcaattgcatcccataacttaatctgatccctgaaaatgagaaccattaagaggaggcgtttacttaaagaaaaaaaagttaatatttcatcatcaggtagtaaatagaaataccagtttccacacaaggggactgagcaaagaactcattttgatacaggttctagtttaatcaaaaggtttaaataaaatgcttaatctacagaactccaatgaggactaattctttaaaatgaaaaatgggtgcaaacaatattaaaaacaggcatttcctccttaccacccaaatctatcactgttttgcatcaacagtatcatggtacccaaaatgctatttaaaaccaaattaccatttggactattagaagaatcacttggcatggcatgggcctgatttgttgacaaaaaggcacaggtgctataacctttgcttaataaatcatttagctgcctgacttgcaagcagtgtgattgcctttgcctcatgaaatttacaaatgtatgcacaagccacacacttcactgtgctggaagctggctgatctggagaggtccctgcatagccaaattatgggcatgacacccgttgtctgcctctggtgggggtgcacccagaatgggagaggtggagatcatggagagcattttgagctgttgccattccgtgtgtcatattcctgaagctctacctgagaaaccaaagcttagaccatctgtggaactcttcataagttcctttcttcagtcatttagtgtttacttaattgcttaatagagcctcaacacctacaaagtacagggaataaaaactctcctcgagttgttcaaagtctagcagaggaaacaaatgtgaagaaataatggtaatgacaacaccaacatcaaaacagtgtaatcgcagtactataaagatttgtctaagaggctttaagacaacagagttgggtataggaactttccaaagagtggaagcagcagaagaggctggatagtttttctgtccttgtccttgtctagcttgggcctaatgatatggttcttgtacacttttccctatttttttttttttttttgccaatcagatggtagatcgtgttctaacccatcccaataagagacatgttcagttctgtcttccctggaccagataaaattagactcctttactgctgcacaaggctcagccagaaaccccttcacccctcatttccaagaaacacctcctcctggtggtacatcctcacttgcccacccaagctcacttgagattgcatttcagttagctgacgccattcccgggctcctgcccaccctgacaggagctgcctgagtgtagaaggttagttaccacacagaagttcaaggagcagctggagagttacaaagacaagaaactcagatttccttagagggaaaaatatatatgtgtgtatatatatatatatatacacacacacacacgtacacacatatatatacacatatatatacatatatatacagagatatatatacacatgtatatatcccaccctgcaaccctacctcatcttctaattagaagtggatttgagcatttcagtttcaagccctcacagctgcaaactcccaagattagagaggaatggcagataaaattccactttctcctgactttgagccaagttaaaagtcttattggccaaatgaatattctacagcacccgtgcatgctaggttctgtgcctacactcgctgcagtactcgagagccctctaaggtgctacatctccattttacagatgaggaaaccgaagtttcagaagagtacatttgtcccatggtaattgaagtagctgagatttgaaccagtctccagaacttctgtttttcacaaatacttatctgcatccccagttgtttgtagtgataggttactgaccattttctctttaaaagagtctaagattgactcacactcttatatcaaggaatcagaagccttgaagttagtcccagtgctccctggctccagtgggactgtgctgaacttcgttcttctgaagatctgccccggtctcctgttagttcatgtctctgtaaaaccaagactgaattcattctctcatcctgcctgggaagaagacctttactaatgatattagtctgcatctgtgggaacagctagcctttgtccagagaccagatagcagagcagctaagataactcctttattttcagattttagttgaagctttattccatcacttagaagcattctgtgtgttttatttttgttgttgttggtttcttttttttttcacagtaattcaatttatctagcctagttttttaactgtaaaatagtgaaaatagtgagaaataaatatgtgtgtgtatatatactcacacacacacacacacccttatggttttgggtcttaaattctgttagtgtaaaaaaagtgtttaacacctaatgaatacctaacaaatgatagctttcattgtttggttaataactaaactcttattttctggattacaaagtattttctcatttgattataagagttacactttgaagtaggcagagctattgttattattgttatccccactgtataggttaaaaaaaactgaggtttaaagaggggaagtgactttcccagaaccacatatccagaggtcagtagagtcaggacacaaacccacttctgattccacgtgtcctatgaaggaaggacttgtgtataagccattcagcacctgctgctctatggtcagaacctacttaccaaaagcaaccgtctagcaaattaggaagcctcctactacccactgcaaaatcctaaccctgtaggttgttccactgagcatcaaccttacaggtgcccaaaagcctgtttaaattgggcacagctattcttcccttgtacaggcagcagtctaagtgtaccattgcttctcttacgctaaattgtgcctgagaagggccttcccaaggggagacaatgtctctgagagtggtaaggactggcaggaagtgaatgcacccctcagaatctaaagggaaaggaggtacctaaatcgaggtggtgcctggtcattttttctcgtatgttctcagctccagtagcaggtgttgaatagtaagcaacacctcgcagagatgagttactcatgcaatctgcttcccctccctccatactactgtgggcaggagtgaatcgtcccagcttccccagctcccacaccaacctgtaagttcttgacacattctcttcacatacacttggcggctgactcactgacaggctatgagacactcttaaaataaatttttcaataaacagagtctttgtctttcaagttttaatttggcagcatgtcgtagacatccttggccacaaacttcacttctggacaaagttcgagccattaattctagatactggtcaccttttctctcagttcctgttcttcctgtcacctttgctccacaaagatttgggggatcttcttagttgaaacaaattgatgattattgtaataattaaggtctctgccatagtatctggcacacaataggtgctcagtaaatattgcttctcttcttgcttccttttttttaatattaaagtgagaacagtggcaatagagaaggggaaggtaaaaaagagatttcacaggaaattttacattgtatgggagaggaagggaatagaccaaaaatctgctatccattaaattagcacttggaactgtgggaaaagggggacagaaaatgatgtcaggaaaagggttggaaaaaggagttgtgagttggtggacagaactgacaggaactagatcaaaagttgatgatagccatgcatggaacttagaaaaccatagtgccaagtgcagaaatgccatcaacatttctagcttttaggtgggtctccataacaatgcttctgatcagtgacattccagggtactaagggaaatgtactgggtactcaccaggtttctctgggggaacaggaggaaaagtcatgattcaaggagtaggacagacctgttctgacatcctggctgtgccatttatctcagtgatcttgtgtatcttaccctttaaaattcagcttcctcatctgtgaaatgaaggcaataatagtatctacctcatagaagaaaccccaattaagtgtggtttaagccagtcaggattattttcctcccgtaacaagaaatctgtgagtgagtggttgttggcattgtttcagcgctgcacgaggccaacaggaacccatgccgttcctaacattctgctctgtcttcctcagtatgctgcctcttcagcctcatgcttagagcctctgacggcaagatggctgctgcagctccaaatagcatagtcatatcataccttatttttcctctaatatcagggaaaaggccctgctattcctcctgtgcaccctgctagcaaatttctttgtaggtctcattggctaaatctgggtcacattttaatctctagctgcaaaggatgctgagaaaaccagcagaagattatcttgattggctcaaatcatgaccgtcacctaggaccagtcacatttgcctctctaagcaaaattgtcccaaggaagaaggcgcaataggtagtggatagactgttaataggatctgccatattcttttttcctattccctgataggtttcatgcacttttcaactccagtagttgcacttgaccctcttgtctctgaatgcttggcttattattctgcctttcctccacacactccctatgtgtttaggagatgtagatgctatgtgcgtgactgtgcagaggtcatttcttttcagcctctgtttgaggtccaggatttgggcagaagtcctggcgttttgtgcagacctgctcccatggggctgggtcaccgtgtgctggttaaacatggactctgaaaaggctgagttggaggatatgtgcctttgtggttgcaggggagctctgtgaaacagtgccccctgggtgccctccagagtgcttaccaaacaggcagcaataggttctgggtttctcttttatgacttggaaccagatgcttcctttgcaaaggaaaagagcctggttttgcagagcttgagtcaacacaagttcagagaacaggaaaatgagttgactggccctgctgcatgaactttgaggagagaactcaatacaggtggtgttctcgctgtccacaaagtccttgcttgtgaaaatcctatgcccaagaaattggccttaccgaatatttctacactctaaataatgactgttcacatgaggaaaggattcagcattaggaatccttttggacctaggctttcccagggcttctaatgagtctaaggccttgaaagttccactgacacacacagtttcaagcccagagcttgctgtctaatgtgagatccatcgaagatctcacgtgaggtctcagtgattcttcctgccacttttctcacacccacctgcttaccttcctgtttgtttattgaggacttaggcacattctttgatctgtgccctgtctttttgggatatagcctttctattgagtctgttcattgagttacattccacagcacacacctcccccaaaatatttgcatgagaatttttcttaaggtctcacattgcttcctttacagcagagatgaaataacttagcacttctaattggcttttcactttccaaacgctttacacatttaactaatgagtcacatgagcttgtgataagccggatcccttgtcttggagcagggacactgggttaggacaggctgttctggccctgtgtttctcaccctcaacaccctccttcctcagagtctgaatgtgttgagataatggggatgccaccaggcacagttgttctcagcacagggcaacctcggaccctcacagtgctgccttaataatgtgggaagcaccctttgctgccctccagggctggactatgctgcatatctcctgttgccttgactagtgaagggaagcataaggccagccctcatgacatacagcttctgcccctctcaagcgcagtcttccttccattggtccctggcagtgtgtctgtgcatatatggggaaggagtggtactagggggatagaagaataacatagtaggtctaataagggaactgaccataggagggacctatggtcttggtacacagagaaaccctggactaggagtttttctacatcttggtacacagagaaaccctggactaggagtcaaaatacctggattcctagctcatctctcccacccgccagctgcatgattgatcttagagaggagaaagaagccagaatttattgagcacctactatgttcctggcaccatactaagctggaagggaggctaaagatgtacattattcaatccctgccgtacatagctcacagaaagaaaagtaaataaactaagatgtgatcgatgaagtaattgaaataggtataatccatacagaagagtcagtaactaactctggggagaagcatggagctcatggaagatatgccagaggagaagacacatgagtggttttgaaggagacagatatacttggtggggagaacattccagaccaggcaggaggaacagtgcatgcaaaggaacagcagtgtgtgtctgaagaaccctattctgtttggtgtatctgtcagtttacagtagacggcagaaacattagatcagagtctagtcgtgaataaatacatacctttttccaagggtagtaaagcacttggactttattctgtgggagatgggaagcaggtgatgggcacagtgggatctctatatgtgaagaaacctctgccttgcttggttcaatcctcctgagatacaggattttataggcaatagtagcattgagacctgtggtcatgaggtaccttcctcttctgggcagcataatgtagtggaaaaaatagaagctttggagggagacagacctgagtttgatctcagtatgtgaccttggaataatttttagcctttctgaccctcagatgtcacatctataaaattataaatgaatgcctgcattccacttagagttatgtaaagactcagtctagttaggatgaaaagccctcagcaccctgcccagccagtgtgtggtgctgccttttcagccctcaggagggaacctctgtgagcactggaggcagggtgctgctcatttatctttaggacaaggggcctgtgaccacaaagaagaaacagaaatggtaatatgatgagcaccccggaggtaatctggtaatgttctccctgagctaaatctcttctcaccgcatcctcccgtgtccattttccttaagttgtgccattaattctctcattacccagtggaatgatatttatgtattaagatcatacttagcatactcccaaggagcaagttaaagttcaactaacgtcgccagtttctcgttgtaaggataaatacactgaggaatccatacggagagcttctgtgtgtcttataatttcatattaaaaaaagattaaattttatactggataagagagggaaggaaaaaaaaatcccagtgcaaaaacaagttgtgaacctaggagcacagtttctgaatgtttattttgtcagatacacagctgacatgattagttctaatggggtggtgatcctcattgaattgcagattggtatgagtgactgaaataccgcagggacttaaataagtggtgcatatggtattacttaggctgcatcctttagccaaggtgaaggcttcgttttctgtccattcctaacatgcatgcagacacacacacacacacacacacacacacacacacacacacacctgctacatatgcgtccatctagtccagaagctccacactgaacatcaattacctatctagagtaaggctggctggcctttacttccttccctttgccctgtgttacctgagtgcacccccaagcccccacactctccagtgtagataatggtgtatcagattagtctgccttgctgctgcatcaagacccagatcaatttattgactctgccagagtggctggtacagtaattgttacaagagaagaatagaaagtgagaacgtgtacacatgaaaaataaaaatgacgttttgttctctcctgccccctcccccgccttttttttcctcatagatctttatgtgtttacacagcagagagcactttacttaagttaatcagctccttctacattattaattgtgacagggtgccacatgacaggacgagtattatgggaaacattgatctcactccgatggtgtggacctgagcaggtttggtattcctctccctatctcgctgctttggggtcccatcaaatcacatttccctgattgacaacacggaatgcctcccatcaatacgattgattttgtgaaaaggacaaggaacatttttcaactggagagagatgaattgtggttatgggaaagagagcatctcagaaatctttcaggttagaagcctaaattgggaactaaggtattcttgtcatcccaaacacaagcataatttgtaccccctgaaaaatggtattaggagaaacttattacaagtgaaaaatagacttagtggaggccagcaatgaacctgaggacataatggctgtttttaaaaggccacctgctaatttttttgtgaggaatttttggttaagtgcacatctttgaaagacatttcattaaagttcagctttcatggcttatacctgtagaccctaacataaatcctgtgtgaacggacaaaactgagtgggtgtcatttgtgacctggaaataaaaggtcaaccattgaatttatagcttttttagtgaaaagaacataaagattcctgccaactggagtcaatccatattttaatgtttcctagttaagattataaaatcaagggattaggatcgtgctgctcaatgaaggtcaaaaattaaatgtgatgggctaagtgtcattcccatggggcagaagttaatatttcaaaaaccatttctaccactggcagtcaagaaatgaattgtccatgatcattaaccaagttaaggggaatcccactatcattactaaatttaatgatgattattatactaatcaactatattattaaattactctgctgttctgtaatgtccccaaacagtaatagtgaattgattgctaccaagtaattctcatatacagttgagaacaagttgagatgcaggatcatggatgaaggcctccttttgaagaaagaagttgtggctattttatggataacagtgataacgtagaacgttcttttaagatgaagagtgagtggcactacagacctgttattaactataattcattagtacatgttttttaagtacaaaaaaagaacacgtatttctctttattgtgtttttttttctctttcagatttttgtatcctcctcccgatgcttttttttttcttttcttttctttgggaaaaagaacatctattttgccagattcctttttccacaaatttttagagctctggatactgtctactttggatttttatgaagagggaagaaaggatatttaaatgtctttatatgatgactcagacacatgtgccctgtaccattttcaaatccattttaagatgccagtatttttcaaaagttttagaaatttccttaaagctggtaatttccttaaagattatctactccagactcccatcatttttcagatacaactttaagaatattttggaataaagttcatatcattttaataaagtagcacctccaaataagaggggccaaagcctggggaactgaaacaacttgcaaggccccaaagctaatcagagacagagcaggactgaaatgcagggacctgttatgagtgaaggaagggactaatggtttaatatgtggcttagaaaatgggtgcatggtttccattttacaaaggtgttttataaaagcccaatatcattagactgactcaaacgcattgcaattccaaggaacaaatgcatgtaattcagaagttcactttgcaggatttactttcatagactgccgtgcaggggtgtgtgtgtgtgtgtgtgtgtgtgtgtgtgtgtgtgtgtgtctgtctgtctgtctgtctgtgtaacctgtgcttccgtctatgctcctggacagcttttttttgcatattttcctatcttctgatcttcacagtgcagacaaaggtcaaaattcccatctaccttcacaggcaaacactttaaagtgcttctacatgaggcaggttgtagggaggacctttgatttaaagttcagcatttacatttgtaattttgactaatttctgtgctagcattaattaaattgaaattatttaattagaataaaactgaaattgatcattaggattaatttaacctgatagactttgtgtgcctttctagacaaatattatgaaatatagtgataatgaagtagtgagaggtataatttcacatcttataatgattttagtatccagttgttctctctgatatctagatagtgctgaatattgctctttgttacatcattaccatttagctagggccatgctgtatctcttatttggcctcttcccaaacatttttttcctgtcttgaagtctgaagatgtaccaaactcccttcacaccacccccctgttaacgtcattgttccctttcccccacccccaccgtcttccaggaaggcggtttgcttggctcatcccttgggtcttgcattgcagtgacctttgtaagccaagaactgccggatgaaactcattatggaattcgctaatgctcctcagccctggggtcaatactgtcaaatctggactatcccctcgcaccccttcctggctgcttgctttgagtcagaagcaggcacggaatgaagccctgacgagggatgccaggcactgagtaggtaactccaagggagtacaggagagaagcgttactcctcccggtgccagattcgcttccaggaaatagtttcccctcttcatcccacaccttccacatagtttgatcaagcaaacacgcttccaaagttggtgccctctgtttcttaaagaaaattataggtgaatgaaactactattttaccagaagaatcagtataaatgaaatgagattagatctgaatctacctacccacacatgaacaagtataaaacactttgaactatcaactattaaatcaactatcaaattattttgtcttcaaaaccattaggatccacatgaataaattaaatcctcaggaaaatgtgcaaaccattttaagtttcaaatttctcccattcaccattttgtcagagttgcttaaaaaaaaaaaaaagtaacattagcagttatgtttaataggcttcctgtagcagcccttattggcaggggtccaaaggacagtggaaaatgaaccaaagtttgatagatatttatgaaaaagaaagaagaaaaaatacacaaaagaaagaacacatgattttcagtcatttggaattgactgaccaatgagaaattatctcttatgcaaattatcttctttctggaaatcaaccaatcagtcctggctaaaggctgagaaacttaagattgtaagcccaaattccacccaatcactgtaactaaactgctgctcccaaagaaaccagttttatcatccatttctgcagaacgtcatctaaatggattccgctttcattcatgtccttatccagtaagaggaagcttctgatttttccagcagagggttttatttagaagcatattcacatttaatttggttttagaaaacccttaatgttttttaatattgagctaggttgagttcaggggattgagaaaaaagactaaaagctttgcatatagctagcatgctcgtgctattattgaacatgcaagaaaagtgacggctcaatattgcactaggttaagaaaaggccatgatctagcacatgaagatgaggtttctgtcttccgccagacagagaggaatccccttcccccaccccaacaactccaaagataaaaaagcatcagttacagtcctgttaggagacaaaacacaaatattagttcatttcatcctcacaagcaccatgctagctagcaaggtggtcttcatcctttcttagcagaggtgcaaactgagatccagattcaccacacactcctagtccatccacccccagccatgcaattgcttctctgaaccccaccacccccacagcagtgcttactcttgaactatttatctgacgcatcacatgtcactctgcagggatgcagctgctgaatctgggtactgggaatgccacaacctgcagttttgccaggtatgctcacctatcaggaaaggactgctccagtatgaaaagatgctataaagtaactcttgagcattgccctgaggttacagttactattagtatcattgatttattactgctgtacccacttgcttgctgttatagataaactccaattcagagagaagttgagaaggagagtccttggtgctctttctcctgtgccctttccatttctgcccatgaagatgatggctgctttctctgaactccttgacccttgcttagcaacaagattgagtcttaatttcaataagccaggaaatcagctctctccagattggttccctgtgggcatctgagaaccccttcaactcttcctgcttctaaatgaaaaatagccatttcttcctctctgatgcacctttattggctggaaaatccctgagatctttttgacctcaaaaacctcttaggtttaggatctcttttgggctgggtacatttctcttcataacttaatcttcaaggcagaaaaaccatttaagcaaacccttgttttaatatttgaagagaatcaacgtgcattgaccatttccacagaaagctgaaactcattgcacagaaattttaagtcatggccatgagattctagaatctacatctagaagccattttcaactataatgttaactagaatgccttttagggaaaattaagaagcaaagttctcctggcccctgccctgcctttctctctgtccttctttgcctctggagtagacctgaggaaatttttaatactaacgagaacttggtgctgcgtagcctctgagtctgaaatgcctgagaaagcagtccagattccaactgtaaaacattccttcaccaagccttggaaactaacatacagaggccggcagagttcagagggagcacatgtaaatgaggctccgttataaactcctgaggagtgttttatttagtttaaacctgaacttgaacttgtaaacggtgttccttgagaacaatacagaaaggttgatgcagtagaacaggaagtcacattttagctcagacattttactcctttaaaagaaggaaactatcttaaagtatttcttaattgaactgtcttctagaatagcacaaattggcatgtctgcaagatttttgggattgcagaatcagaatggaagtgtatatgtatatatatcatttgaacttaccaccattcttgcaaaataaacaatagaatttcctatccatatggcgatttaacaagaggatatttaaagagcctgtccacatataacagtcatgccatctgtaattgattttattaattgataataaagtgacagtagaggtgtgggaccgtttcaaactagcactgtgtgtgtgtattgagagtttgttcccaaatctcagttgctggtagagcactaccaagtggaatttatccgaaaacaaagtgagaatgattttgtacgcatgctcaattttataaaacacattcttgaatcagtcttcaataatctttgcttgcgagatctccatctcagaagtcactactaaaaaggtaaaaaataaattaaattgtctgtgttagaatgatattacctctctccaagaagcatagatccctgacagggaagccaagcagctctgccaatcacgtatgctatgtacatgtccaggttgttggtaaggcccttcacggagactgtcaatgctataggatcttcaccttgcacaaatcccaaccgcagccccatcaagaagcctccccctcatatcccctggaaatatttgggaggaatctaattgtttgtagcaacgaatattgcttagttgtaaatttaatctacaaatttagaaggaaataaatctgaacataaaaagcatttgctgtttcagcattaaaaaaaaaatgctatcatttgaaactgcaaactctcccatgtgggtttgttttgcaagtcacgtcttaacaaagacaagttttgttgccataaaaccctaaatcctaccacatcctcagaaggaggagaaaagtattgttcactggttccgggtttgggctttcaggataacacagagctatgaccgcgcacagggaaattgtttggtatttatccagagttgttggttcaggtgaaaccctgacacacacatacctcccatctagattatatcagtgcctcatgtaattatgctccttacattttaggcctgtgtctgaaagtcgttttgtatttttaactttattttttccctcaaatgatgtgataactagtatcctgaggcctgttttgcagaaaagttaaagttggacccctgactccctacaaactaggatttagatctctgactccatgatctgactttttccatagccaagctcattctgacctcaatgaaagataggaacagttttacctctcccaatatcccatctaccctgtgaacgattagaaaaaaaaaatgattcctggcaccagtgatatctaaaagcaggtgttcctagaaggtaaagaaaggcatagcaacaggatcttgtagtatccttagagagatctggtgaagttcaggcccctcagcaagccagtgactgaactgggacttgaaccaggccaccagacccgcagtccagtgcttaactatcttttctcatgaatctgaaaacgcagatgccacagtttcctttgcattctctccaaatgctgcctgtatgtcttgtttctttggctcacaacagaagccttccaggggttgtggtttgcagctcaaggccttcttcacttcatcttaatccttagggactgttggtctgcatggcctgggagagagtaggggtctgtcatgattcctgcacagggattaaacacaggtggagagggagggagacactaacttgaggggtgggaggagatagagaatggaactagaaagaccaggaacagtggacaggggagaattaaagaggtaacgagcagacctgtgccagggcttgagcgtggaagtgcctgctggggtggagaagtccaaaggtggcagatgctatccagtgtctgaagggcttcttggctggaaaggttggtttgggaattcatttctggcaaaaggccagatcttctggcatactgttgcaggatgtatctgggagaatttttgaaataactggactttttacttcaatgttattttctctcttactggactttatcttcctgcacaatccacactaaggtctccttgattgattggctctcaacctgagtcatgtttgggaagagcaagagcgaggaggcacggagtagaatgattattacaatgtggccacgctctgctgagctccggcctccactcccacgcctctctttttaaacaagaaaggttacctccctgggccaccattgggccaaccccaagtgtttctgtctgcacttgttagacaacaggcatttaattaaaattggaatccgatgtgtagaaaacatacattttttcatttcatagctccccaggaagtcatattcccttccttccccactctcctcaactctccccctgccaaaaaaatttaaaaaaaaattgtgaaggaaaagattattttaatgtgaaaatcaaaaattacaaagggctaggctgcttcttcattttttgcctttgggggagacattagccaatcataaagcctgtattgtgtcttcagaccaggagccagcttttttatggctaacttcccatatggaaaagggtttgtcccatttcagggcattaaaatacagcctttaatgaatttgtaacttaaatcttttatcttgctcttatgcgatagaaagtgtggcctgtcttctgatatttgttggactttgtggaatcaacaaatacaaagaaacagataataaacatgaggcccaagttgaaaaataaagccgcgaaaccccgtcgccactgcattttccgcagcagagccatccactgcactgtctgggctccacccagaaaatccggcagtgccatcatgaccaaatagataggaactctggacaatttcatcgggtcattgtccccttaatctccacgctgcacctcagatctcaagcagcttccgtggcgcaggctcaatttaatggatagaatctatttttcatgaaaaagcaggaaataagctgtctctttcataaaaagatttacaaaatgtaatcattgttgaaatattccctttgaactgccgtgtccacgggggtctccggctcccagagtcgtgcttcattagaaccccgtcataagcggctccagaagggcaggtacgctggtggtgcccggctttgatgtcttgaatgaatgaaagaaaagcacaataaaaaagagctgttgatcaagcataaaatactctttaagctgacagaatagcagcgttaacacaccctaagctgcttttagtttttcccttttttcctcacattttcctgtgctttgtgtacagtgggggtttgtattttataagaagtctctgatctatgtagtatgccattcgctaacaaaaaccaaaataggattgtttctgtcccacttggttgcctgactaccccctcccttcctccccttttctcctcacccccaacctccaaggcgtgcagtttagccttgcaaggcaagggcccaaatgcctttcataaacttgagccaattccttttgtgttgtgggtttcaccgctctgattttaatatcgcaattaaagacagatttttattttctcaagaactttctcttgcaactggggaaatggaattgacgcagctgctacttttaactaagaaattatatcattaaataagagaaagccgccttgtagagtgatttgctttcctggggacgttgggtctcacgtggaccctaaggccccagaaaccgttcacagtgagagaacccagctacccctggctttctggctttctgtagtagcccctagccaggcatttaatccccacaaaaactgatacagttgttacctccatttcatggagtctaaaactgagacctagtgatgctaacttgcctaagattatctaactagttcataatggtgccaggatttttgtcattcggaccccagagtcctggctcttacggctatgcacacagctctctagtaggatcttggagcaaatgcggtgggccggagtgcagtttttaatccagcagtctttgatttcatgaggtaaaaggttacgtgatgaaaaatggaaaggaagggagaccaaaagaaaaatgtacttggtggtaagagagacactagggcaagctggaatctcgtgaaagattcagactttggatgaacagtcagaataattggattgtgtatgcactctcaaggtttggaggtactggatggcttattgggtaaaaagattagtgttttcccgtcttgaggtctgaaccaaacggaggtcttggctgggagcagcacagtcattctccagggattggtggtttggacaacttctctgagcttgtagtaagtaggcagcagtccatgttacaaaactattgcacatgctactgacgcagttggccgcaactggccccgctgcaacaactctcccgtcggaactgcctggagtggcttgtggagacttgtgtccctcgagggagagtgtctgtcatttggggagacatggtcatgtggcacgagcatgctagaagtcatccatccagatgccttgctttgccctcattggggtgactgacaccaggctttggtaacctcggatacagcttgttcttccttccctcctttatttatttaacagtatttattacatgcccaccctggcatcccttagatagccagcttgcctgggatgaaaacaggtaattaaagtttagcaactgtgacagaggagaatcctgagggtaaaggccccaagaaagacccctctgaagaagggacatctaatcttagaacccaaggactagtaagcattagcaaagccaaggagtgggacagcctgtgcccaggcctggcagggagaaagcatttggctttgggggatccggaagaagtttaaggcaacaaaagtgttgaggacaagtggtgaaaagataaggccacaaaggtgccggggccaatcccggcccattacggttttaatagttttctgtacaataaacaagtcttggttcggagttactgaaaacagactttctttaattaagaaaataaaatcaggcaagaaaaatgattacagagatcaaagcccaaggctggcagtaccagtaactaacacctgtgtacagcatgacacccttttcagaagaaaccagtgtaaatcactgctgcctctcatgaatacagactggtcctcacaagactctgagggtcccaggacagggactggcttgcttgaagtcacactgctggtcagtggaaaaagtgacaccaatcctgagtcctttggacactggatactgggcatcgttcattgccagaagtttataaaatcctattgggagaaaagcaggctatctggtatcatgaagggtctagaatctagccactgcttcctgatagacaagaaagtcctacagggcagggactatattttactcattatatccccagagccagcatacatagcacctagcacatagaaggcccttagtgcttgttggatgagtgaataaatgctcccaaatggtttatgcgaatgtgagaaactcagagtccactgagagacctcatccatttctatcatattgagatgggcagaagagactactgggcttttggctgatttgccaaggacaactcatttgggctaaacagtaggctttagtccatccacagaagtgcgggaagccaaaaatgacccactggagtagtgtgaagtagtagtgcaaagctaacacctccccaagagagaatgcacaacagcgacagcagctcctggagtcttggcttattggttggctgagtcctctttgggggctgatgaggagctgggcctgcagggtgcggggaggccagcctgtgtttgcacatttccgttttatgtgtgtgaatgtcctcaaataacccaccttgcctgcagaagaaagccaagtgtcacacccagttctggattccacattaacaacctccttccgcagtgttaaactttgcccttgttgaggccttttgtttaagtttttaatctgaaaaacagattctgctgcatcacagtccactctgccctctgcccctgccaccccagcactctctgctccttttaggggttaaagtaaaatacaaaatacaaaaaatgtttctcagacatttttctttttcctctagaatgtgcatcctgccctcttagtaaaaagaggatgtaaaaagccttttaaaaagttgttgcacacattagagcatttgttgctaacgcaggggttgaggccatggcccgcatcagctgtgtcttcagcagccccatgaccacattttggaagacggcccctgtgttctgattgctctctgtgaggcgtacgaaatggaagagattggcaccgtcagaggtaccttctgccatttcaggcttcctgtttaggatgcagtcggatagatattgtttatggttcataaaacctgactactgtgagtattccagaatcccagcggaatgggattcgaactttcatggagctgtaaattaacgggcggcaagtgtgataaaactccttagagaactgtgaggggaaaaagtcgtgctgcaatggttaaatgaaattttataagcacattcagtgtggagctgttttgcattacatgagttgaataccttagagacgccacatctgcaggcactttattaaatccttagtcagcacttttccaacctgatgagattacttcttcatttgactggagaaaaggaaagctgagctcttgtcctggactgcagatttcttttgatgtttcaccttgaacattgaaagaggacagtcaccccacttccctccccactcccgctcagcacatcccaaactctagacattgtgaatgttaccgactaattttacgtaactggagccttggtgggagtgtggatttgtggacctccacaacaactatagctgaaagtttctgaggaaaaaatagatcaaagctctgtgtttacttaatgtaaatgtatcaagataacatcatcctatattgcattgtaataatgccactcactgcacatagggagggagattcctttgtagtccatttggatacagtagggtagattaaggggctataaagtacgaaggcagaaagcatatgaaacctaagcttatgtcactaaatgtctgaggatagtttttgtttaatgtgttaccattttcccagtgatttgctgctcaaccccaacgatcgaataagctcagatttcttttatgtttttcctatatgacccaagaagaaaatatgcagaatcattcttcaattaatgttctaaaacttgtactgcttgcataatagaaattataagaaaatatcacaagagaaaagtaggcttttacaaacattatattgtccatctggtgttactagcagctcatggaagtttctaggaattgactggcttacacatgtgtgactgtcacactcatcccaatgggattatgagtgtctttacaaactgattaggagaaaattcagggagatgtatgaattattattattattattattattattagaactatctgccatctctgcaaataaatgatttaatcagagacttcaaaaaagaaaaattccctgtgtggttcccctaaccaacttcctgttctggaaaaccttggtcaagtagctgggttaattgtcatgaagattagtgtgatgttgaaataagtactaatggtcaaattataggagtgaacaagtttaagaataggttttggtttgggcctgaaagggttaattaaggttttttcacgggttattaaagacccccaacctctgccttcaggagtcatattgacaccccaccacagggcagctcagcccctctgttgacatgttgctggtcagagcacaatagccttctgtgtctgcaaatcattgctaaaatcatctcaaggaaaaaaaagtttgaaagctttaacgttagacaaaagcccaagagttgcagcgtgcagcccaaaaacctggagtcagcaacttctattgattaaaaactaacctttaaagtaactctgagagtgtgtggttagcatttaaatttaaacatgtcatgagttgatttgtgttactgaataccaactcagaaggagtaacattcacatcgcattttttttttctaattcccttaagcagctaaagtatttcatgaaatgtcaatagggcaaaaagaaaaagaggtggggggctgatgctgggccttgtagttttctttcccatgcaaatatccaccccccaaaagaaaagtgtgcagagtgaaacacaataattagtcctttgtctaactttcccaagtgccagagaaagacagattaattaaatatacaacaatgttggtttttggagtgggggtcttgcttgctgtgtaggtcataaattaggcagaataaatacttcaatgtgtttgcagtgggcctgctacgtcagaaccactggaaggttggtgggaggagagcagagggtttcttgctaatgatagtcacgtctgggtctgtctggttgctcttagcaaccagacatgatgtaacaccaggatgaacttgaacttgggggacttgaaaagagaacaatagaccagagcaatcaataaagcctatttcagtgaaggattacagagctgctctggggtaaccttgtcggcaaggcacatactgaatagtaagatgtgtgaagaaacttttttttttttttttttttttttgctttgctttttaagagaagtgcagaggcactgcagatttttgtagtgccctgaggtctcgtccagaaactgtggtgtggagaactgctccccctgctgactcactgggtgccaggcctttgcttcaagaactaccttagtgtcagattgaagaagtctggaatttcacaaccgacttagaaagtgtgaaaacagaaatagtaagcattattccccgcacccaaagtttgaacctgttttgtagaagggaggaagcggctctaacgtggatgagagtcagctgttaggtagaggcctactagaaacacagtttggggtttgctttctctctcctttctctccccctcttctttcttttgtccagctagatttaggccatgtgtatttgccaggctgatttcctttcaggacacaagaggctttattgtgttcctcaaagcatgtggtcaaagaataacatctgaaagtctacaggatgcgtagtttttcggtctgggcttaagttttttaaactcctctggaaatcaaaggtggcttgtgtgactaggaaatcttataccaaactccatgtagctatcacttagccattcatccctggggaccaaatgagtccttacattacctaatggaatctcttccacagggatgatccttcacctgcctgaagcaacccaattagaaccctttctgataccgtcaacttaaagaattcagaagcattggtttttgttaggccttggtaatttttctgtaaataatgataaatgtagtgaatttgtcaaggtatctctagagaaaagtcggcaaaagccacatacttttttatttcactggagaaactaactctgatgttagtccataattgctcattctgtctagctaacagaaaaagaaatgccagcagataaagtgatatatgaccagacaattgctcaaagctaaccacctaaggatttacgaaaggaaaaggtaaccagtaactgggcctggcaggcacacagaaggctctaaataaatgctgcatggacgcaagcatgaatgaagggtacgcagtggcctcatttttcctttggacaatgtggtacttaatagagtaaaatcttgatcctacttagttattatgtttcatgtttgaaaataccattttagatatattgggctgaaaggagcatcttccctcataaaatcctacatatgtaaggaaggaaaaatactgtgacttgctcaaaatcacccaggaagactgggtccagcactttttccaccttacctccacttattcttgtgtcgctattgaccatctgggcctgttaggagagtgtcacaatcatggcttcagtgcctgcacctcatttgaaaggagatgttgaaaatcatcagagtagccattcattgccacatgaaacccctccctttacccattctccattcattcaactcttcttcattaagaacgttctgtattccaggcactgggctaggcactgaggattgaatgataaacaagatggtcaagtttcctgccctcctataactgcccccatcagttaacaaaacccttatttgtatttcaagtgaacagaaatacctcattctgtaagatatactcagaatgttggaaaaccccaatgaagacaatgaattataatttcagaagaataagatcagtttcagtgtcacaggattttttattgtctgtcgtgcctttacttttcccagcgaatccctcccgcatccctaacgtagatcctgatttcgtggttgaaaaggcaacttctaaaacacacgtttttacaaattgtgattttaattgtatttttccttttgtcttccagtcctggtacctgggataaaagttgcagcgtcccaccatccaccagacagaccacctgaccccttctcaactctgtaacatggacgcaacctcaacccagcgcagttacaacttcactatcagcggaaggggagaaaaaccgattcaaatcaacttgtacatggaaacagcaagcattatggtcaaacagcaaaggccataaccttttgggatttttttttttttaaaatactttagggactgttgtaatttctcatatggtgctggaaatggttgggctttgtaacatttgaagtgtttccatggtagcgtgagcattaggtgacgtggctagcggaggactacccttgctcactgacttcctgttgtaacacactttccttacggagcctggctgtttcacagtatttcatgaatttacccacacaggtgtgatcctccttgagcattgaggaggcacatggagaactaaatcttttgtagtagctgagatctgcaatatataacgggacagtcaaagggcaatgtttttctgtaacatattggaaaaagaaaatgcagttatattccttttttatttgttcctttagtttgttttggttcagcagtcagcagttaagtatataacatggcccgcaaggacaatgaatccactcacattgcagaacaattccgaaaatggcaaactactactactactgttcagttttttaaaagttttgaaatgctgcacttacatttaaaaaaacaacaacaacattttttcaacaatttcaacaatgacacaaaaattcacatggaaatggggaagatggtctgttttgacagaaactgacaggaatcaatcaaaacaatcgaattttgaattgagtaaagtgcaatttcattggatagctaaatatctttgtaagatagagattgttgaaaattctatttttgtttttctagtcctttcaccccaggactctaaattattggggtaaaaaacagccttgcaagaaaaaggggagctatttttgctttttatgttttttattgttaaacttgtatccctttaaaaactgaaggaaattaaaaaaaaaaaacaaaaaaacaaatctaatggtgcttttaccacaatatgttaactacattaaatgctaattaattattttctgttatcaaagcacatgactaaaatgaaatcatggtatctgttaattttataagctagaagtcactataatggattacgccaattctaaaaaattttacacctatctggcatcataggatttatcagttatcagacacctcattgtaccagagattgtccagaagttttaaagacctttgcatccctgaactgggctatgggaaataataatagtaataataataataataataatgatgaaaccaatactgacacaaatgctggtgcccattcagatcaagggtacttgttagggaaaaaaaaaaaagtttgcacccccaaacgtcctgtatcttatgaaaaaaaaaacaaaaaacaaaaacaaaaaaaaaacacaaaaaaccacagaaacaaaaacaaaaaaaagtgcaagtgatttttctaccagacagcgaagcacccctttgcttcccatgcgacttcaagaaggtttcctatactatacatatatatacgttctggttggcaagccctgctgatcagagaaagtctctgcatgttctagtgttagtaactaatttttatatagttaatgtaggataaagtagagtgcattaagacacaatattgtaatccctactctaggcacttgcctttaaactatgtttttcagcccttcagaagggttctactactgtcctatacaatcaagtaactgaaattcttgggaagacactttgctcctcatctttctccccgaaacaatgttgttttgttttgttttttttccttaatttgcacgaaaacaaaaattccatatcaatgtgccttgccctggatagcgattatttgtggaattgttgcacatgctcctctattgaaaggggtttttccctagtcaagcatttggagacactttttgtaaatgtgacttttatgtcagccatcgtcagtttcaacatctagaactaaatagaaagctagttgttccgcagataggagtagtctttattgtcctgtacggtcggtggcagtgctattctgagatctgtagatgcttagaatatcagtattttggatgttgctgcattttacaatttatttggagtcttcctttattttcccccagatatatgaaaatatgcaatacctgcttatatcatgtagaaaagcttagcaattattaatttttcttttatttttttttatttgaccaaagtcggtgctgcacttgacgcagtgtgttttaggtgtttgtctttgtacttttttgtgatttttgaatgcacgtgcgcaggaagggctcctcttagagaagcagtcaaactgtgaagcactaagctgaccctgcttcaagcaattttgtttttacaactgttcctttcacaagcaagccttaaaaaaaaaaaagacaacttcctttttcttcagctcccacaccccatttttcttagcagactgcagtcaatccacattcaataaaaagtatataatgcccatttttatatgcacgtttttaaacttccaagttctgaaaattgtttactggttatctctatttaaggaaaaaaaaataaaataaaacattttggattttcatatgtgtctgataagtggttgaatagtcgtttggcgctgttgtatggtgtgattgtcagtgtatggtgtcacttcctatagccagccagcatactttgccttcccctatagcacttagctgggcattactttattatgacatatgtgcactaaaaaatgaaaaaaaggaaaaaaagaaaaaaaaaaagaaaaaatagcagctttcagtgcttcacagtgaagggaaaaaagcctagacaaacattttgtcagaaccttgcaataagccaaggtattaccagtaaattggttgtatatacaataaaattgcacccttttttaaacaaaacaaactaagcaatagtttgggcagttttagttgtttttagtgagcatgttgtagtcatgactgcaaagagagagaataaactgcccgctcagaagatatgtaatttgtattgttgtatagttttattgattacactgatttattctaccctattttataatgcaggacttttgtaatgttgtttaaatgaggaaaaatttctgtcaaattagcctagtaaaatttctgatcgttcattataaaggcagcgttcatagaattgcttttctttctttttaccccccctttgggaactggatttaagtttaaaactttcctgtttcctttttttttttttttttgtaagtatttaaatacaattatttttttctctcaatggtatagcatattcctatgcttgagaagtataggtctactgaaaaaccattgtaaatggacgttacaggtatgctgtatttttgaaggtattttgttgtattaagtttgatgaagctaaaattagggaactctgaacagatttgcaggaaaaaatgttttaaaggctttaaaacattagggaggcagtctagggtgataacgaacaggggttaagtattaaatacacgaagttacatttttgttcatgtttcattgtccagaaagcagcaggaaactattcagttgtgatcaagcaggaaaaaagaaacaccaacagttgccagtgtttttgctttttagcttaaaagcatagtgaagatgcttgaggaagactttgctacctggggtgtgtagacagacagactgagagctatcagcatttgaaggcccagcccttgactctgagacacatttgaattttttctttcccatcaaatggcattaacaagattgggcaaagatgagtccctcaaatttctgtgttttttgtttgtttgtttgtttgttttttctttgggaactgaagtcagaggcacgaacactaactcttagcatttttctgtagactttttcttctggcccttgtccctgccagcaaaacgccccttttctgatcattcgtgcgcagagggcctcccagtaatgccacgctctccatgctagagagccttctctttcctctgaggtttgaactgatgttctgtgtcttcacaccctggcatgacagttacgtgtggtcagcccgctccccaggcccgtccctgccgccgccaggtgtgggctctaggcaggccgacaaggttacacctcccagagcttgtgatcttcattttctgacagtcaaagtgtgaaggaacccagacttccccgagccacggtgttcagtcagcccacaggaatatgcaagacccatctccaaaagtttgtctttgattttttccaagcccttagccccataagctttgaatcctgtagttacagtggcataaaggactgacaaaacctggataaggaaaaaccttttttttctatgaattttttttgttttttaggggaaagggattctaagaatgtcatttaatgtactttgcatcatgtctctagaaatatctttgtccatagtggtggtggagtctctctctctctctctctttttgtttgcttctgttttctttcttgtcttcattctttcttttcttttttatttctggtagcaggcctccatagaacaaatctaaaacacaaccaccatagtaatgtaaggagagcttcagtggcacctcaaaacccacccttcgagatctgtccaaagacagtctcagaaagctgcactgcccaccggctcagctttcattcaaaaaggcttccaaggccaattctgtcttgaagtcaatgcatgtatttactgtttgacagtaaacccgctctgccttctccacgtccaaggctgtgcattcgtctaattagcgtcgtgtatgttttccttttattttttccaataaaaaagcagtgggatgaaaattgctttgatatatagcaggtaacattgaagctattccatagcacttaactgtagtgaatactgtgtcaccaattttgaaatcaatttaatgtttaatgcaaatccattacatggtgctattataggctgacaaaatgatttacacaaatgtgacaacttgggctcaattcactctgctttccaacagtgtaaatgcatagcagtgtttatctgcatgagaactatgcactaatctatctgaagaaaaaaactatatcaactttggtatctactttccgtttacttcaatccttgcctttttggtcattgttataatgccagctttaggacagaaagaattataagaaaaccagcataatacctgatatattaaaatgtagtgcctgtgaaatctgtattatattgctcttctgaagtaagatttttctacaccggtagccttcgctgtctgtcagtcaggaccttctggtataggtgatgtaaaataaccgtacaatattaatgcatgcgattccataatgcttagtgaactgtatgaatattactcaaagttatgttagtctttttttccgacttggttcttgtcagctaggtttaaaggtatttcactgagaacgcaaattctgtcttttcttgatttcggctgttttcagtattttggaggtatacatttacttaaattcagtattactcgtgttttgtttttgtttttgttttttgttttctttttcctaggggacaagcatgggtgtttgatttcagaaatcagtacctggcgagatttttgtctcaaaacgactatttgaatttcaagaactgtgctgcgaagacactctgagaacatttgcaagtcaggggcattttccttgacccttgactgatgctatgcggagactgatacattttcttaatggacaatgttcaagccaggtacccatgcttgatctgtcttcacaccagacctcctcatattaaaaggaaaaataagaaaaaaaatgtaagaaatcacatggctatttagtttcatgcacagttgcaatattttcttcaaaaataaaactctgtacaaactttgggcccgattcataagaaaaagaagtttgctattaacacgggatttttttaatatactttttttggtctaaatttgaaattacttgcttcccaaattaaataaatttcatctcatttttttccctaaaccagcacccatctgccttttattccccaaagagttacctttcccagattagggggatggtatgtggggagcagatagcggaaatgcttagaaagataagggggaccacccacagctggtcgtgagaacagggagacagtgtgtgggggtgggacctcatctgtgtgcctggtatcctgagttttacatgtagatgcattcgcctatttgattcagaaaaataaactttcccaaaatgtgtctgaaccacaagagcatacagtggaagtgctacctctaatctaaccagagcaccttcatggtggaagacacccaccaggtcatacaatgtgaacttttgtatctctgcagtggtttcaaggacaaatagtgtccaatgtattgggccatttttcctgctgtttttatactcaacttctcaaaatgaaaaaagcttttatttttcctttgacttatttgtgttgttcttattttttaaatttttattttttgataatagtctgtaagttagcctttttgggttttttttttttttttttggcttttttttttgtttgtttttttttcttttgacattgcaaccgaaggtcataaggccgctagctccgctgggacagaggcttgagagaactaacggctcggtgccttctccctggtctcagaccatcgtctctgcactgcgaaggcatttggtagcctcgccactgagatactaactagacctagactaggagctttatcaggttctaggaggtcctttaggaagactctcaaaggcaaatccctgatcccccgccccacccttagccctgccctctcaccagagcaaaattcactggggacttttcccaccacacatggaaatctgtccactcggaatacctctgttttccatttcaaattgtagggggaggggatggaacacttccagtgatggtaagagatctgttatgaaacgaaacaccccccgtgttaataacttggtctgaaatctgtttttatgagccgggccccctgtgcctctagtatacttgtattgactctcatagttacccttttagttttactgtgttctgtgaaaatttgtaattggttgagaatcactgtgggcgtccattcttattcaactaaatctccacaggttttttgagctggtgtggattagtttaactcttgtattcaaccattagtgctaccaccttctcacattacaatacaattactggaagcaagtactgcatttcctatgcaacaaaaaaggaaaaataaaaaattgctaatgcta

SEQ ID NO: 2056 - DNA, 380482 bp, Homo sapiens; identical to SEQ ID NO: 2055

SEQ ID NO: 2057 - DNA, 16093 bp, Homo sapiens
acgcgcaaatcctcgtccgcgagaactgcaaggcccgcaatgccctgcgcctgcgtggaccggtgcgggggcgggggggaggtgaaaggggcggggcaacaaagcagtagggaggcggcaacgacgcctgcgcagtgtgaccgggatggcgcattttcttgcaccaactaatgcggtgtcgctggcggctgaggagggcggagagttctgtggtgaaatagtgggaaggattcatgtaggcatcgggaagagcctaagtccacattataaaataggaagttgatgcggggtacagttactcccggaccggcggcgtgaaagtcgtgatatcatcgttgaactgtgagcggcagtggcggcggctggggggaacccggatgggaagaagggcgggggaggctgggaggcggggcagaggaaagaaagaaaggagagtgaggacccggatgctgaaccggattgtgtatgaattttccatcccctagctttaagcgaggagggagaggaagggttggccaagtggggcggaagggagcatctgagcgaggaggaagcagaaacctcaccgtttcttcccctccggactctgtgctagcactgtatacgtttgcagttctctgcccagccgctgtggaaaatcggcctcgaagtgattgaaattccctgtttatatcaggcggcttctttcagatccatcgtctttctcccggagtatgaatggaaggattcagtatgcgcttcacatttgtatgtctctggccattctcaaaccaggcccttccctttgaaaagtcttttgcatgggatgttcacttcttagacgcaaggttgtgtgccctggtttcatcgtctaacgcgttagaaggcgctttcatttcttcatgggtgttgagcgccgaccactggggtggcctctgccttcgtagacctgcgcctggtgagacggacagatgctgaacaaaacgatgtgaaattaccgcagtggcagtgccccagaggagagttccacggtgataggagaatgagggaatttggcttctttagggagggaaaggaagggtttctgagcaagtgaggatcgagctgagagctgaagggctagcaggagttaactaaggaaagagaaaaggaaaagacattccagacaaaaagactaacttgtcagaaagccctgtggcggaagggagcttttccaatatgaagaactgagcctggagagatgggatgagggggagtgtcgaaccttttaggctttgtaaaggagttttggttttctcctaatagcaatgggatatcttccaaggaatctcaatcaaaagggagagatggctccgattggaatgtcatccctggctgaagagtagaggaagcgaaaaaaagaagagttaaagaggcaaatgcagggaacccgacgaggaggctattgccgtagtagttcacatggtgaaaagaatggagcgtttgtattaatgattatggattcactctttgaacaaatttctggcagctttttagttttgaaagtgagaagtttcagactctcactgaggtattctgtagttttttcactctaaaaggaaactagtagagttcatgtaacacacactaatgcctctttacatttaactttagtatgtgatagctgaaatttccagctgtgataaattgggaaatcctttgatttaaaagaaaaacaaaggcgggtgagggtgagagtatatgccacggtgtgtagaatcctttagactcttaagaagacacaaggcggctgggcgtggtggctcacgcttgtaatcccagcactttgggaggccgaggcgggcggatcacgaggtcaggagatcgagaccatcctggctaacacggtgaaagcccgtctctactaaaaatacaaaaaaattagccgggcaaggtggcgggcgcctgtagtcccagctactcgggaggctgaggcaggagaatggcgtgaacccgggaggcggagtttgcagtgagacgagatcacgccactgcactccagcctgggcgacagagtgagacgctgtttcagaagaaagacacaaggcaagttggttgtcgatacctggaaaaattgaagttcttatgttttcataccactgaaaatgcttgtatgtaaatatcctctgggacaggaaattgacttaagtgagtattcttaaacatctctaagtgaggaaaggaaatattttttaaagcataattagtgttttaagttgaaaaataacatcaaccacaaagctctacgaattgaaacaaagattagctctgatttctgtgcaacagggtacacctgttacaggtcctgacacaaaagggaattctgaaagtgcatctcattgatttttaagttcggtcaaatgtgttttggaggctgtgagaaaatatacaaacgtgattcttgctcccaacttgtagttgagaaaagatagatactaacatttaaatagagaagtatatgagatccttttttaattctacttttaatgatgttcgataataatcttttagctaagccattattcttcctgttttgcatcttcttttcttacttcaatccctgataataaggtcacgtgtcagagatcaaatagtataggtaataggttacctaaataggtatttgcataataggttacctaactaaataggtttttgcctaataggtatgttgattatttcgcttacttgattctttatgagcctttttttccttgcgacgtctttggtattaattgttagtcaagatggatgtagaaattttccatatgggatgtttctctttgaattcatgttgttaaaatgatttcttttggtggagtgctgatcttttttatgattgtttcatatagataagaacagactacaaaaaaatatgcctttcaatcctgaagagtaacctgaactatacactagttttgtgctttaattttcatttgtaatctgccttcaataaagagttaagctagtggaatttatgtcttagcttgttataacacaaacacgaatatttgtctgcttggcattaaagggtaaagatattccatagctgggaatcttaatctgaggtacgtgtaaacattcagggactatatgatctctgagaatttgtatgttgtaagtctttgtggcagtgtatacatttgtgttgcaacttattaacacatacaccgggcttttttttttttttttagaagattcatagctttcatcatattctcaaaaggtttctgtgacccatgagatggtttacagtatggggaagcatcaaagcacttgcacagttgatggttatatgtgtgtgttattatttcagccacccattatcatgtgcttaccaactgcctaacagtgcatacatatgtagaagttttattcttttctcctgttgccatattatacgtctcatttcacagcagaaaaacaactgcatgacagagacaatgtggttcaaaccattttacccttgtattcattgactgctacaaaacaggaacattaaatacctgattgtcaccaaattgggtagtctcagcacttctacactcgtaattgtgctggaaaagtggaatgctagcactaataattagattttggtttggagggttttttatttgtttattcttacttgtataaatttatggggtgcaagtgtagttttatcacatgcatagattgcattgtagtgaagtcaggacttttagggggtccatcacccatgtaatcacgttgtacccattaagtaatctttcatcatccacctccttcccaccttctcaccctttggaatctccattgtctatcattccacactccatgtccatgtatacacattatctagctcccatttataattgagaagatgtactatttgtcttttatgtctgacttgttacacttaaggtaagggctatccatccattttgctgcaaatgacatgatttcattttgttttaatggctgagtaatcattcgttgtatatataccacattttctttattcagtcatctgctgatggacacttaggttgattccatatctttactattgtgaatagtgctgtaataaacacatagtgcaagattttggaaattttacttttgtggcacgttgttggtatttactcaggatctttggatttgcttggctgcatgtatatgaatcagtgtgtttatttactgaaatatgtgcaaaagtcttgtctttggtggattaatttataatataaatccacaaaagtcagattctgctcctaagtatattttacatttttaaatttaatgccagcaagaagttacagtactagaattgccttacccctgagagtatcaatgatcagatcatagtatcaggtgactgggctatagaagatgacttttattacttaacattatgaagttactagggctgatttagaaatcgaggaacactggtgaaaccccgtctctactaaaatacaaaaattagctgggcgtggtggtgggcacctgtagtcccagctactcagaaggctgagtcaggagaattgcttgagcccaggaggcagaggttgcagtgagccgagatcgtgccactgcactccagcctgggcgacagagtgagactccgtctcaaaaaaaaaaaaaaaaaaaaaaaaggaacacatcctcactgttacaataaataacagtagcccacacccccttagttgtgatgtggtgtgataccatgtaagcaacctatttccagttcccctaacattctcaagcagctgtatcagaatcatacaagatgcatatttaaattgaagatttctaagtctctggcccagacttagaaaaaaaggatcaggccgggcacagtagctaacacctgcaattccaacactttgggaggctgaggcgggtggatcgcctgaggtcaggagttttgagaccagcctggccaacatagtgaaaccccatctctactaaaaattcaaaaaattagctgggcgtggtggcaagaacctgtaatccctgctattcgggaggctgaggcaggggaatcacttgaacccgggaggtggaggttgcagtgagccaagattgcgccactgcactccagcctgggcaacgagcaaaactccgtctcaaaaaaaaaaaacaaaaggacctttgagcaatcagaataacacaaagtacatgaactgaacttcattttcttcattcaaaagaaagtggccctcactcaagcaaatatattcttgtgctttatcttctggcatactgagataactttctaaagtggtttccaattccaaaatccaatgatgtgcaactcattgaacagccctaaccacaaactgccattagatgccatattacatttagcctttttgttgtagaaaagttggttagaagtgggctcaggattctaaagactaaatcatagtcccaagaagcaaaagaaagaggataaaagtaataaacttcccaaaatgtgccaaagatgctagagcagttagattcctaatatgaggacaagtaataatagaaacagatacaaagaaataaagtagagattcaacagtacagggagaccctaggaagaccatgagtgttattctaggaaatactgaaataagacagatttcagtataaaggggaatatgtttaataaatatatgcatttgagttaatgcgtattttaaatcagaaatctctgaaatggattgattgtagagaaactactagggggacgaggagaatccctttaaattttaaatacataaaacatactcatcttagtgctcatttaaaaaaggatatgtttactaattagtgtaatcagttaaatacagaggtatctttccaattctttggatgtgttttgacatttgccgtcaacaaattaagccttttgtggttgattaaaataggaaaagcttaatataagttatgtgactaagaaaacaacttaaaaaccaagacaacactttgaccaatataatcacttgaatgaagaattttctaattgagatataatttacataccacccatttaaagtgtacatttcagcagtttttagtgtattcacagggctgtgcaaccatcacaatttaattttataacattttgatccctgcgaaaagaaaccctgtactcattagcaattagtccctgttcctaaccactaatctactttctttctctgtagattggcttattctgaacatttcgtataaatggaatcatacaatatgtagtctcttgagattggcttctttcacttaacatgttttcaaggcttcatagctgtagaatcttgctttgtttttttgagactggagtcactctttcgcccaggctggagtgcagtggtgtgatctcagctcactgcaacctctgcctcccgggttcaagcagttctcctgcctcagcctcccaagtagccagaactacaggcacacaccaccatgctcggctaatctttgtagttttagtagagatggtgtgaaggctggtctcgaactcctgacctcatgatctacccacctcagctaatttttcatatttttagtagagacaaggttttgccatgttgcccaggctggtctcgaactcctgggcttaagctatccgcccgcctcagcctcccaaagtgctgggattacaggcgtgaactaccgtgcccagcaacagaatcttctttttaaaccagactaggtgtcttttcacaaacaccctgcaatacaaattcctttgcagtttgacactgaaagatgattagtttcatgtgatctttatgtttctcctttttgacagattagctttgaagtttaaatccaatggagaagactcaagaaacagtccaaagaattcttctagaaccctataaatacttacttcagttaccaggtaatacttcacttacagtccatatagggtcattttcatgcagtagtggtcgttcaaatgttagcaaatagaaaaggttagacttgctagccgttgagattttctatttaaggtgatgcgtatgagaaaaatgataaatagaacattataattttttctttattaaaaggtaatttttgccaggtgcagtgatacatacctgttgtcccacctacttgggaggctgaggcaggaggatggcttgagcccaggagtttaaggctatagtgcacaatgatcacacctgtgaatagccactacactccagcttgggcaacatagtgagaccccgtctcttaaaaagaaacgtaatttttgaaggcaccctttaaaacatatccaattatttaacatatcttgaaaaataaaaatacttaaaacattttggtatctcattggaggttgtactctttacggatattacgcattcagattccccactgtttagatattaggggaagttacgcagatttgtttaacagtagaacactttatttaccatacatgttcaagtttaccttctatgtctgtattttccagtatctcacacatacactgcatttcatatactactggttcctttgagagccaaataataatgtatctaaaatcacagtatttggaaatatagcccactttattcctgtataagggtatgccaccttggacatggcttcctacctcacgtgtacgtgtgtgtttttgttttattttgcttctttaaaaacttgtctggaggctgggcgtggtggctcacgcctgtaatcccagcactttttgaggccaaggcgggcggatcatgaggtcaagaggttgagaccagcctggccaacatggtaaaaccccgtctctactaaaaacacaaaagttagctgggcatggtggcgcatgcctgtagtcccagctactcgggaggctgaggcaggagaatcacctgaacctggaaggcagaggttgcagtgagctgagattgcatcactgcactccagcctggcaacagaatgagactccgactcaaaaaaaaagaagaacttgtctggaaatgataataagcaaaaactcatgaatataataaacaggggttattgtaataaaaaatcatttgtattagaatattctttctcatagacataatataggccaggtgtggtggcccacacctgtattcccagcactttgggaagccaaggcaggattgcttgagaccaaaagtttgagaccaccttgggcaacataacaagtccccctctctgttttaaacattttttaaaaaagaagaaataatataaaagttggtaaattatttgacaagcataaaaacctatttagccatactgtgactaaactctaatgatgctctcaattcagtctcaatagacacttttaaatttccgtgctaaagtacacacctttctttatgagcacttctctgtggtaatatgtgcatttctgttcttcatgagcctgggaaggataaaagccaaaagaatgcttgctcctgtgctacaccttggaaaccataattagtgtcatttttattttggccgaccctaatagagactcgcctgctaatgtcaatgcatgagaagaatgagggaatgacagaaatggagaattcaaagggaaggttgcccactgtttaagaaaaagccaagagactgcttttgagtgacatttatccagcagttagtaacttatttcagtatctcccagtgagaaacatggcacagtttcactttcactctacccagctcttactgccagacatcctttagaacacgctcacaaacactagctggaactgggctggcattaatagcaagccagttatcagtgctgacaaaagtctaacaagcatcgcttgaatgtctcttactctgctacttacaaagcaaggactgcctacagttacattttaaccataatgcttacttatgctgtgaccaccttctgtgacttccttttttttaattctcattacttggaaataatgttttaagacattagataacatatttaaaattatcactaggtacctcacctttttattcaagtacgttcttgatccatgatggaatacaacctcaaaagatactactaaagaaatatgacattgcactatgcacataacacacttatttttttacagagagcttcagagttactaaagtaacttagaggtgtgccaggtcatttatactgttgtaatattactcttgctaataaataataataatgctatcagtattttctgaagtcaacctggccaacatggtgaaaccctgtatctactaaaaatacaaatattagccaagtatggtagcgcatgcctgtagtcccagctgaggcacgggagtcacaggagcctaggaggcagaggttgcagtgagccgagatcacgccactgcactccagcctgggcaacagagtgagacactgtctcaaaaaaaaaaaaggattttctgaaattagtaaagaaaattatttttatttttaaatttctcatacttgctgtcatcttatgtttatgtttgtttatttgccttagtgtggggccctagatgaggtgaagggtgggattagggagagatgaagctggcagtggaggaagaagggctccaaaaagagagacaataatgtttagatcttaaagaggaagcagtaatcttttaattttgagagatctctgtgattagcctcagtactagaaattattttggaactcagccaggcgcggtggctcacatctgtactcccagcactttgggagaccgaagtgggcagatggcttaagcccaggagttcaagaccagcctgggcaacatggcaaaaccctgtctctactaaaaatacaaaaaattagccaggcatgtgatacgcccttgtagtcccagcttacctgggggactgaggtgggatgattaccggagcctgggaggttgaggctgcagtaagccaagatcacaccactgcaccccagcctgggtgattaagggagaccccgtctcagaaaaaaaaaagggggggaaacttaaaagcatcaggctaaacactagcatgtcatcagaggggaaaaaaatattaaaactgtagtacctcaaaaataagccatatattgtactgttttctatataacattcaaaagtaaaatgaaaaatgaaatttcacattgagactctgtttttcatcttcaaaaaaatgtgtttaagtgatacaggccaagtgcagtggctgacttattatcccagcactttgggaggccaagtgggacagattgcttttgagcccaggggtttgagaccagcctgggcaacagggcgaaaccctgcctctacaaaaaataaataaataaaaataaaattagccaggcatggtggcttgttcttgtagtcccagctactcaggggacttgagcctaggaggtcaaggctgcagtaggccgtgattgtgccactgcactccagcctgggtgacagagcgagaccctgtctcaaaaataataataataggccgggcgtggtgggtcacacctgtaatcccagcacttcgagaggccaaagcatgtggacgacttgaggtcaggagttcgagaccagcctggccaacatggggaaaccctgtctctattaaaagtacaaaaaattggccgggcgcggtagctcacgcatgtaatccctacactttgggaggctgaggtgggtggatcacctgaggtcaggaattcaagaccagcctggccaacatgatgaaaccgtctctactaaaaatacaaaaaattagctggatttagtggcgcacgactgtaatcccagctactcaggaggctgaggcaggagaatcgcttgaacctaggaggtggaggttgcagtgagccaagatcgtgacactgtaccccagcctgggcaacaagagcaaaactcgatctcagaaaaaaaatacaaaaaattagctaggcgtagtgacgcacacctgtaatcccagctactcgggaggctgagacaggagaatcccttgaacccaggaggcgaaggttgtggtgagccgagccaagatcgtgccattgctttccagcctaggtgacagagcaaaacttcatctccacaaacaaacaaacaaacaaaaaaacccataatcccagcattttgggaggccaacacaggtgaattacctgaggtcaggagtttgacaccagcctggccaacatagtgaaaccctgtctctactaaaattacaaaaattagccaggtgtggtggcaggtgcctgtaatcccagctacttgggaggctgaggcaggagaatcgcttgaacccagggggcggaggttgcagtgagccgagatcacaccattgcactctagcctgggtgacaagagcgaaattccatctccaaaaaaaaaaaaagaaaacagtattttagttttaactttttatgtaaccattttcctgaaaccttatctaaaattaggatgttattaccatgcattcatttagcagaaaacttatagaacatttttactaagtgaactggccatggtttttatctatcattcctttgtatgtgactacaatgacttctagtggtaacttctatccaaagacctatcttaaattagccacgcatggtggcacatgcgtgtaatcccagctactcaggaggctgaggcaggagaatagcttgatcttgggaggcggaggttgcaagtgagccgagatcacgccgctgcaatccagcctgggcaacagaatgagactccgtctcaaaaacaaaaaacaaaaagacctatcttgagctttccgtgtaagaaaaagatgatactgttgggtgaagtgactcaacgtctgtaatttcagcaatttgggaggctgtagcggccggattgcttgagcccaggagtttgagaccagcttgggcaacatgggaacacactgtctctacaaaaacaaaaattaaccgggcgtggtcgcttgcacctatagtgccagctactcgggaggctgaggtggaggctgcagtgagctgtgaacacaccactgcactccagcctgggtgacagagtgagaccctgtctcaaaaaaaaaagcaagaagcgcagtggctcacgcctgtaatcccagcactttgggaggccgaggcgggcggatcacgaggtcaggagatcgagaccatcctggctaacacggtgaaaccccgtctctactaaaaatacaaaaaatgagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaacaagaaagaaaaaaagaagatactgaaaaatagatgtccctagtcaaaataatgagattagcttttgactaaactcaggatattaaaagggaatacttcagtgcatgatgatctcatttttgaaaggaaagaagcagagcttccccatctctaaaaccttaattcaaaggagaaatagataatttcaagaggtatttttatgaggtaatagtaaaatatattttattaacagtacctatagttatgtaaaataggtagtgccaattaactgacactaaactagcttcttggcctggcgcagtggctcacgcctgtaatccaaacactttgggaggccgatgcgggtgtatcgcttgggctcaggaattcaaggccagcctgggcaacatattaaaaccccctttctataaaatatacaaaaattagccaggcatggtgtgtgcctgtagtcccagatactcaggaggctgaggcacgagaatcatgtgaacccaggaggtggagtttgcagtgagccgagatcacgccactgcactccagcctgggcaacagagcaaaactctgtctcaaataattaataaataaactagcttccttttcaaaaaaagaaataaattaggtcctaagtcctaaaagcccatcctactttaaaattgtttattcaagttcagatgaaaagagtggactagtaggcaactgaagtgctttagagtctcccgtgcctgccctaattctagaaggttgtgcactttatgatccagatttctgagtggttgagaatgagttattgagcagtgcaaggcaagctctgcagtaggtaatggattgatgaggctggatttagcaagtctgatcaatctaaaggaagtttctgaatgtgttttttgtagttaaaatactcataattaaaacacttatcacattgtcacattttatttttaaattgcaggtaaacaagtgagaaccaaactttcacaggcatttaatcattggctgaaagttccagaggacaagctacaggtattaggcaactctaacctcattaatccccaagaaattaatagctgtcgcataaaaatattcctagttcttgattgaatttagtcctcatgcaagatattattttatattgaggttgctaaatatttattagttgtgaaaattaacacacctgagactttcataatctgttaattaaactgagtaagttttgaatagttcaaataagtgaaattttcaatttttttattagattattattgaagtgacagaaatgttgcataatgccagtttactcatcgatgatattgaagacaactcaaaactccgacgtggctttccagtggcccacagcatctatggaatcccatctgtcatcaattctgccaattacgtgtatttccttggcttggagaaagtcttaacccttgatcacccagatgcagtgaagctttttacccgccagcttttggaactccatcagggacaaggcctagatatttactggagggataattacacttgtcccactgaagaagaatataaagctatggtgctgcagaaaacaggtggactgtttggattagcagtaggtctcatgcagttgttctctgattacaaagaagatttaaaaccgctacttaatacacttgggctctttttccaaattagggatgattatgctaatctacactccaaagaatatagtgaaaacaaaagtttttgtgaagatctgacagagggaaagttctcatttcctactattcatgctatttggtcaaggcctgaaagcacccaggtgcagaatatcttgcgccagagaacagaaaacatagatataaaaaaatactgtgtacattatcttgaggatgtaggttcttttgaatacactcgtaatacccttaaagagcttgaagctaaagcctataaacagattgatgcacgtggtgggaaccctgagctagtagccttagtaaaacacttaagtaagatgttcaaagaagaaaatgaataatgttaagccattcttgattggacctcatagcttattttagttaatcttttttttgtcttttagccttaccaccttttaaaaaatttgttattctccagaaacagtaaataggtgagtaggggtggtgcaagtgaattcgttttcatttagaagcccctctgtacagataatcaaaattcaaagttgaaagaatcaaaagcagccacagttatgtaggtctgatttgaatgtcataattgcagtgacaggacattgccaccaactctatcctactaccatcaatgttgtgtttattccgtcaataaaaaagacttgcttccaggaatttttatccatacactttctaactgtactatctgggcagttccaagccagtttctattagctagctggaccaaagaccacaaatctctttttttcctaaacgctgctgtaaggaatatctcacttttccccccggaaacaccctcactgaagtcttctatgaaaaggctgataatgggctgggcgcggtggctcacgcctgtaatcccagcactttgggaggccgaggcgggcagatcacgaggtcaggagatcgagaccatcctgacacggtgaaaccctgtctctactaaaaatacaaaaaattagctgggcgtggtggtgggcgcctgtagtcccagctactcgggaggctgaggcaggagaatggtgtgaacccaggaggcggagcttgcagtgagccgagatagtgcctctgcactccagcctgggtgacagagcgagactccgtctcaaaaaaaagggctgataatgataaacagtgagcactccggtcctttttcttaggttttccttttttccttcctctccaccccacaagttttgctttttaaccaaggtgtctctgcttgatgaaattcacatgctagtctaaatctttttttctcccttgtaacatttatgtgccccaaactggttagtatatgggtacagcattccctttccaattgggaagcggaaaaagagagtatgggatattttagaagggagcctttgaaccttattatatttccccatcattgatagtgacaatcttaaaagggttgttttcttaccttaagtacaaaagcatggaaaaatgcgcttttccttcccgcccacatcaccaccccgacttgaagacagtaggtgcttgaatggaaagtgagtaggcatctttaatcgccctgattaaaggaaagtgttagcctgagagggcctgactgaaaagtaaccaaaggcttaatatcaaacactaattagctttttagtgccttaaccctgacctggttaccagttttctgtagtttctacacccaagccactgaagtcatctgtggcccaagaggtaggacaaaaaaaaaaaaaaaaaaagctgatttcaatatttgatttgttgacatcccaaaatgaaagttttatgtttcccttagaaacatgttttgcttggttctatagtatgttacttaggatctatttaccatatatttgtatgagaaatcctcacccaagcattcaacctaaatctttgaaaagttgggtgctgtctttagtaacttttaaaatagtttaaatctcccattttaatagtgataaggaaacctgttaaaatcatggctattgatgttatagtatggaaagttgaactttatgaacccatacttttaaaaagcatttttaaaaatctaacactgactatagaaacaaattaaaatgtctacctttaagtataa

SEQ ID NO: 2058 - DNA, 161324 bp, Homo sapiens
atcaaggattcacaaactatggcattttatttcagagcctttgcttacatttgtacaatatattacataattcttcattgtttgcagatcctaatatatactttatagcttttattctataagcttttttcttcaacattttgctgtcaacaaatctttacagtcctgtacaaatttgaataacttgaaaccattttcaacaaaattagttactgtaagcacacactacaagactgaaaatgcttttcttagaaaagttgaatgtaaaggattctgacacgttagcatctacaacaaaacgcattgaaattcccacgtcgtattgccaggaaacaaagaaaacatgccagccccatccaaaaaaagtacacagaactacaattaaaacagtaaaacagtctgtacaataaagtactgtgtattaacagtgccagatattaaatagcttgaatgaacacatccacaatatacaaatgtcttacaaaggtgaagaattaaatacaagtgccaaacagaacagagattggaatcatacaacataaagtcaatacaagtgaaaacaattttgcattcattttggattttatacaaggcatttaattttataggcctaccacccccattagctatttatatttaaaataaccaccatccttttgagacagttcctatcaacaatcttgaaccatactaatacattacttgttcctgaagtccttttgttgtagctcataataaaataagcaatacaaatgaattatctgtatttaagggaaaagaaacatttacaagaaaacacaaaaatataactgttataattcattatgaataaatatacactttgaactggctaagtacaatctttatacattgtttaagatttaatacagtttattagccattttcttttttcacacaatgtatatcaaaattaaaaaaaaatactgatttatagaaaaatggcaaagtacagtagttccattccaatttgaagggccatgaaaagccactgcaagaccttttagcctaattcaaacctgtaaacatgttcagtcttttttaaagagaatctttaatatttggttaccaggattgatgtctaatatcctgttaactgcaggttttgaatttattacatgtgcttgacttatacaattaaagccaccctaaggtgacttgctttaaaaaacaattaccttgtacaaatgaaaataggttcatattttttcataaataaatggaaaaatatcaaatgttccagctttaacaaaatacaagggaatacatatacagtaagttatcttaacatgttctgacccaccccttaactatgcttactgtattgtctctacaggcagtgaaaagcctccatttgccacagtggaaggccttccagttaccagacacacaattcccagacaagttggaaacaattattgcttgaggaaaagcagttcattgtactttttcttcataaaaaagtgcacttaagtgccaagtcagcttgtcaagaaacaatttttaaatataaaatagtgcttgtctgatatttttttgtgccactgtgcagtataaaaaaaaagtggccctcaacagccattaagtgcaaagtgctttagcaagtcctgctgtcacctgcactcaactgacattccattttgtgatgcgctggacattgacggttcagctaaagttaacataacagcagctgttatggaactggatgaaggtgaagaggaggatgaggatgtagcagcacctaaggaaaagggagaccaaaccaagagcttaataaaaatttatgtctaacaatagacagaaaatactagtcctctgaactaaaattccgctatattgtccaaaatcatttagcttacaacaacagtggtcaattctcacagttctacgatgtgaagaaaggaaaagctagtgtagctcaagaagctagacagtgcccaactacagaagtaatgaaaaggacagaccagggaaggctcctgcgtgggtcaaagagggaaagaactgtgcctagtctacaagacacagaaataaaatacagaatacactttttgtaacagtgaaacaagtatcaaaacaggaaaaatctgcaatccatccaaaaatcatttgtcccctcctaatccctccatctttctgtacttaggagttttcttgtacatgtaaatggtgacaagagtgggaggcttaattgcttcttcaagttggatcaaaacagtgcatagctcaactgttgcattctccgccactaggtttacaaagcaaataacacattagttattttcatcagaggaagtctctcactgtttccttttttcgtttttttttgtttgtttgttttttgagacaaagtctcgctctgtctgtcgcccaggctggagtgcagtggctcgatcttggctcactaaaagttctgcctcctgagttcacgccattctcctgcctcagcccccccagtagctgggactataagcgcccgccaccacgcccggctaatttttttgtatttttagtagagatggggtttcaccatgttagccaggatggtctcgatctcctgacctcatgatccgcccatctcagcctcccaaaatgccgggattacaggtgtgagccaccgcgcccagcctgtttgtttttttgagacggagtctcactctgtcgcccaggctggagtgcagtggtgcgatctcggctcactgcaagctccgccttccaggttcacgccattctcctgcctcagcctccttttttttttttttcctttgagatgggggtcttgctctgttgcccaggctggactgcagcagtgcaatctcagctcactgcaacctttgcctcctgggttcaagcaattttcctgtctcagcctcctgagtatctgggattacaggcatgcgccaccatgtccggctaatgtttctatttttagtagagatggggtttcgtcatgttggccagtctggtctcgaactcctgacctcaggtgatctgcctgccttggcttccctaagtgctggaattacaggcgtgagcaattgcgcccggcctctctgttataaattagtgttcataaattaatatttttaaatacatgcacagatttaaaaaattcattcagtacaggggtaataggatagaaaagcaaatctcactctcatccaggaacctcctaatcacccaaattcccttccccattgctaccagttgattcatattcattacaactctagaaaaaaggctggcaaaaaaactaccccaggggcaaatctggcttacttgtctttggaaagaaaaattgtactggaacacagccatgcctatttgtttacatattgcctatgggagttttcacacttaccatggcagagataagtagtttctacagagaccacatggcccacaaagcctaacatatttattgtctctttacagaaaatgtttgcaacccctgttctacaggaattttatctctagaatctagagatatgatatgcaaatttaaaatatatagatatagcaacacctttaaaaacataagtggaggccgggcacggtggctcacacctgtaatcccagcactttgggaggactaggtgggcggatcacaaggtcaggagatcgagaccatcctggctaacacaatgaaactcagtctctactaaaaatacaaaaaattagccagatgtggtggtgggcgcctgtagtcccagctactagagaggctgaggcaggagaatggcgtgaacccgggaggcggagcttgcagtgagccaagattgcaccactacactccagcctggatgacagagagatactctgtctcaaaaattaataataatattacaaaaattagctgggcatggcggcacgcacctgtagtcctagctacccgggaggctgaggcaggagaatcgcttgaaccggaaggcagaggttgcagtgagccaagatcgcgccactgcactccagcctggtgactgaccgagactccgtctcaaaaaaaaaaaaaaaaaaaaaaaaccacacacacacaagtggaagcatagttcagtgtctgacttttttttaaacaatatattttaagagattgttccatatcagtacatacagatccttttcttttcaaagttgagtaatattctactatattacaactcataacttatatatttcactacactgttcctgcattggttttagttttaatttttttggtaagaatgataccttatttgggccagtcgcagtggctcatgcctgtaatcccagcactttgggagactgaagcaggcggatcacgaagtcaagagatcgagccatcctgcatcctggccaacatggtgaaaccccatctctactaaaaataaaaaattagctgggcgtggcagcacgcttgtaatcccagccactcgggagactgaggcaggataatcgcttgaactcaggaggcggaggttgtagtgagctgagatcgcgccactgcactccagcctgggcgacagagcaaaactccatctccaaaaaaaaagaatgataccttatttgatttgcatttctttggtaaccaggataagcattttcctatggatttttcttaaaatagtatttaggaaccgacttttaatgctaacccagtagagaggctctatttagcaaaatcattcattataaagaatttgtggtgactatatttacaaaacattgtttagaaggagtttctggatagatgtctttttttttttgagacagagtttagctcttgttgcccaggctggagtgcaatggcatgatctccgttcactgcaacatctgcctcctgggtttaagcaattctcctgcgtcggcctcccaagtagctgggattacaggcacccgccaccgcgcacagctaattttttgtattttttagtagagacggggtttcactatgttggccaagctggtctcgacctcctgacctcaggcaatccacccaccgcagcctcccaaagtgctgggattacaggcatgagccactgtgcccggcctcctcccagattttaatttatctcacttcctcatgtcattcaggtatcaacaaaaatatactgaccatttgtaatctaaagtaacccatccaatcactaccttaacatcattttcttcatagtgctttcaatatctgaaattatcttattaggatgtttttggtagagtataaactctatgaaagtgaatattatgatctgaaataatttttttatttgagataatttcactttagagatgaggaaaataagataaagaaattaaagaatttgcctgaaaatagacaaagtcatggcagtctaactgcagagtgagaaattctggtttatgtttaaataaagtaaaaatactggcagggcactcttggctcacgcctgtaatcttagcactttgggaggccaagacaggtagatcacctgaggtcaggagttagagaccagcctgattgacatggcgaaaccctgtctctacctaaaaaatacaaaattagccgggcttggtggtgcatgcctgtaattccagctacttaggaagctgaggtaggagaactgtttgaacccaggaggtggaggttgcagtgagccgagattgcgccattgcactccagcctggcgacaagagtgaaactctgtctcaaaataaataaataaataaaaataaagtaaaaatacttactttctctctctttcttctttaaacgctttctcctccgatcaatggaagctacttcagattttaatgacagataatgttttctgatttcttgaagtttttcttgaagaattgtgatgcgttcggcacttgtcatattttccaggtccgctataaatttaaagctttcattaacagacatttttaaagaaaattttaacatacaaaaaggagagaacatcgagcatggctgctgaataaggttgaggcagatgaactaaaaaactaaggcttctgaaatatttgttttccaaattttttatctagcctagaacaatgcctggcacataataaatgcacagtatttgttgaatgaatatgtacagcattaaacaccttaagatctacatatatccacatccatatacagtattaccacagtaaaaaatcacacttaaaaataaaactggggctgggcacggtggctcacacctgtaatcctagcactttgggaggccgaggtgggcggatcacgaggtcaggagttcgataccagcctggccaagatggtgaaaccctgtctctactaaaactacaaaaattagctgggcatggtggcgggtgcctgcaatcccagctactcgggaggctggggcaggataatcgcttgaatctggaaggtggaggttggagtgagccgagattgtgccactgcacgctagcctgggcaacagagtgagactctgtctaaaaataacaaaaacacaaaaacaaaacaaaacaaaaaacctggaaagacaccaaaatgctaaattgtacacattttgtgagtaacaagactgtggataaatttttctcttctgttctctgttattttttaggtttttttaaagagtgtgtaaaaatttaaattagaaggcaattttaaaaagctctaaagcaatcttcaatctcctaagaatacttaaggtatttccttgtgtgaaaaactctagagtagtattaaaaaaatatacatattggctgggtgtggtggctcacacctgtaatcctagcactttgggaagtagaggtggaaggatcagctcagtcttgagctcaggagttcaagattagcctgggcaacataatgagacctcgtctctatttaaaaaaaaaaaaaaaaaaaaaaaaaaaaaatatatatatatatatatatatatatatatatatatatatatgtatacctaaaacatatatatatatacctttttttaaatgaagatttatgaagatttctcacatatacaaaagtatagagagaaggatagtgaaccccatgtactcattatccagcttcagtaatcatcaatttatggcaaaacctgtatcatctgcacccctatccattcctcacccctaacaccagatacttttaaatcaaattaccgacatcatatcagaagtatctttttttttttttctgggatggggtctcactctgtcgcccaggctggagtgcagtggcgcaacctcggctcactgcaacctccacctgccaggtgcaagcaattctcctgcctcagcctcctgagtagctgggactacaagcgcgtgccaccacgcgcagctaattttttgttttattagtagagacagggtttcaccatgctggtcaggctggtctcgaactcctgacctcgtgatccacccacctcagcctcccaaagtgctgggattacaggcatgagccactgcgcccagccatatcagaaatatctagtcagtgttggcatttgcctcaactgccttaaaatttttctttaaccaatttatttattcaaaccgggatccaaataaggtctatacattgtacattagtacatctattaagtttggtaaagcctctttttcagagtattggcatgaagagttactaggattggggctgggcatggtggctcatgcccaaaatcccagcactttgcgaggcagaggcggatggatcacctgaggtcaggagttcaaggccagcctggccaacatggtgaaaccccatgtctactaaaaatacaacaacaacaaaaaaattagccaggtgtggtggtgggcgtctgtaatcccaactactcgggaggttgaggcaggagaatcatttgaaccagggagatggaggttgcagtgagcagagactatgccactgcactgcactctagcctgggcgacagagagactctgtctcaaaaaaaaaggccaggcgcagtggctcatgcctgtaatcccagcactttgggaggccgaggcgggcggatcatgaggtcaggagatggagaccatcctggccaacatggtgaaaccctgtctctactaaacacacaaaaaaattagctgggtgtggtggcgcgtgcctgtaatcccagctacttgggaggctgaggcaggaggatggcttgaacccaggaggctgaagattacagtgagccaagatcgcaccaccgcactccagcctggtgacagagcgagactctgtctctaaaaacaaaaacaaaataaaacaaaaagagttactaggatgaagtttgtatgcttgtcaatttaacatgtcacttacacatctgaaaactccatttgtaaactttgggtaatcgattactgggttccttgagatcaggatccttatcaccattctttccacattttcctggagactgcgtccttgcgggagatttggtactatgagacttcattccagtggaaactgatttgactggctgactcttagttatactttcaccagctgaaagttcttcactatcactactatttgctgaaagagaaagaaaagatttaataaacaaaaatgtaacaataaatttgtcacagattttagtaggtaatttaaaattagccatttgaatttagtcctacagaaaacaacctgcctagaaacctggaaaatcatatacaaatgcagcagcatcttaggaaaagcaaaaacaaaaaattcttcttacctgaactgccaataatatgtatacttttaaaatcactcacactaatctatcattatgcttggtagactgtcaaatatacagtaatcatctgaatggctttttactctattatgttaatacataaaatatatcatcttttaaaatgattaattgtagaaacctctacaatgaatatgtaacattgggtatatgcaacattttcctgctcctttggccacaaacaaataatgatgcacaatcatcatattcaataaagaactcctcgggaataaactctgaagtttgatatgtataatgaaattactcttaaataactcctatgctgtgggttgactaaaataatcagtttcaccctaataaaatattcagtattttatgaacaattcagaagtctgtgtaacaattatgttacaactgctattgctaattaaacttcagcactaaaatggaaatacttgaccttgacagcttaccatgtgaacaggtaggtgatgggattagtatttccatagataacctctttctggatacaaagtattagtttagattccatcagaattaattcatgttactaaattattctcttgaatggttaactcattctgatttaccatggcagaatcccaataagtaaaatgggagaacactatatctctgtattatatgaatatactaaataactcattgaagatgcgctctcttaggaaatgtcatttaaatagtaaactcttgaagacaaaaacatcacagtgaaagaaaaaacactttaaatatcctaccagttacaccaaacaattgatgactgactgatttggcatatatttactgatttttcacttaacaacatcaccaaaaaaaaaaaaaaaaaaaaaaaaaaaaaaaggagttaaactctcaaagccagaaattattccaaatagtaaaggtagatagcagcaactcctcccactgtgaaattttgggaataaagaaactccaccactggttgacacatatacacaaattccctcccagctcccccactgctgctctggaacccctggcaactcctagctaagccacccaaggcttggccccactctatgcagtggactgtctcagcctggctttcatggccttgctgagcacagccgcccggggccccagggacgccatattcaccgcctggaagtcatatgggctcagcagaacctcggggagctggccgaataacccttttctgcactgaagtgcagccaagccggctgctagcaaaggtcaggcagtggaggtggcaggagtctcctggaagagcagcaggaggtcagtgtggggcacctgaaaaaaaattctttacatattttctgcttcttactttgtctacaaaagagagataaaatgtgcagccctcagaagaaatacagtatatatattttctgtggattgatgcacggagtcgttgctaaagttggagcatacttagcaaaaagtattgtttgtagttactctcaggtcacataatatagagtaccaaagacaaatgttgtagactggagttgttggaattatagttctaaagttatcttgattgttatacttctatgctgattttgccttgaagaattactaagcaatcaatttcactgtaataaaaataacatgtagttgaaatatttcacaatgtgtgatacattttatagcaagtgaaaagaactgtggaatacaaaggtaacaaatatgttgatgtttataatatattggctattatttcaaaaacagattacttgatttttcatcagcaatcaataccaccgctgaataacaccaacttgcttaaaactagaatttacctaagattagaaaacctgtgttttttttgttttgttttgtttgtttttgcagaaattcttttttctttttattattatactttaagttctagggtacgtgtgcacaatgtgcaggtttgttacataggtatacatgtgccatgttggtttgctgcacccatcaactcatcatttacattaggtatttgtcctagtgcatgttttttttttgtctattttgttttttaaagcaagtagccttacagaatttgtgtgactttttttgagtgtacagacaaaatcaaaatagtgtactatcccataccctgaataccattttcttactgggggtaaaattatcagctattatttttatattttaaaaattagagatttcacacttactgccttttcccttctttttgttgtttaccactgttgctttatggcttcttttctgcttttttgatgaacttcctcctccctgagcatctttcactcttttctgacctgtacaggctatgaagggaaaggaattaagtaacacaaaataaaatccaacattccctaagtataaattaattccacattttagaaacatagaacaatccaaaactacatgttctttatgacatttataagttgtcacagaacttactacaatttttaaataaactgtcattaatggaagctcaattcttatacataataaaagtcagggtttttaaaaaggcaaacaaagtatgcacatccttctttaaaaaaatcagatataaactgaaaatagtccttaatatagtactgggagtttataagcctagtaattaaaagtatatgctgaaaataaaaactgaaatttgttaagattcaataaaaccaaaatattaagacttaatcacaggttaaaatgttaatgacattatgtcttataatcatattaatataatttttaaatgatataaatgaggtaaattttagcagtaattcatacttggttcttttttaccaatttatgtcaagaataactaagctcccagggcactgtttggttaacatgcataccatttacaaatccaacatagtagttctaaaaaacgtctcatcttcttggtgggaaattattgcaaaacattacaaataaatgtctcccttttcttcaaggactagcccaagtcctacatcttcactaagatgttccaggcttcactgatcaatcactactctgaactgtagcatttttctatactactcatttggtccttaacatctgctatatttctgtctaattcatatatgttatctctcagactatataaagtaagattttttctccagagactaataaagtactatctccattcagttccaatgtcagacaccaaatcaaccttctgtgtataaaacctaacttccttgatcaaaaacaggacaagtaattaactgtctgcaacttcctagcttttttttaatgggtcatataatcttacttacaacttttcctaatacctttttaaatttttaatatttcttttttattttttacaccaagtatgtgacccacctaatgtcattttaatatcacaatttaagtgaaacataaaggagacgtagatattgaccatactgaagcacagaaccataattgtcaggtttctctccaagagagtttaattctaaagtgttcagatactaagaaataaaaaccttcaatgtagagtaaattaagaggaaaaaactacatctaaatagtaaaacttaaattttaacttgtgatatagtggggagtctccaatattcatagtaagtaaatttattaaaatgtggccatgtgaaacaggtgcttaagaacctatttctggctgggcgcggtggctcatgcctgtaattccagcactttgggaggccaaggtaggtggattacctgaggtcaggagttcgtagaccagcctggccaacatggcgaaaccccatctctactaaacaaaatacaaaaattagccgggcgttaatcccagatactcagcaggctgaggcaggagaatctcttgaacctgagaggtggaggttgcagtgaaccaagattgcaccactgcactccagcctgggcaacaagagcaaaactctatgtctcaaaaaaaaaaaaaaaaaaaaaaaaaaaacccaacaaaaagaaaaacaccaattatttctaaagagatataaattaccctaaatttaggagtagctttcaaattccacaattattaacctagtcaagattaagattcaaaagggcagtgttgacttagtctattagcagagaagatatcctctttttttttgttgttaattttaatcttttgtaagatattacgaacataataaggatacaacctcttaaaaactacaacaataggctaggcacggtggctcatgcctgtaatcctagcactttgggaggccaaggcaggcagatcatgaggtcaagagatagagaccatcctggctaacatggcgaaatgccatctctactaaaaatacaaaaaattagctgggcatggtggcacacgcctgtagtcccagctactcagcaggctgaggcaggggaatcacttgaacccaggagacggaggttgcagtgagcccagatcacaccactgcactccagcctgggcaacagagcgagactccatctcaaaaaaaaaacccccaagaaaacctataacaataaaacctgtttttttctttcttttcttgttttttcttttttttttttttttttttttgagacagggtcttgttttatcacccaggctggagtgcagtggcgtgatcttggctcactgcagcctttccgggatcaagtgattctccctcatcagcccccaaggtagctgggactacaggcatgcgccaccacagctggctgacgtttgtatttttggtagagatggggttttgccatgttgtccaggctggtcttgaactcctggactcaagcgatccaccgccttgacctcccagacctcccaaattgctgggattacaggtgtgagtgaccacacctggccagtaaaatcttactgttgaaagcctaatattctgaaataaaggattctttcattttgaagattagtcatgcctggatagttcagttgcatgagatagtatggcacagataaaatcatagtagttatacttgtaaatgtgaaaaaaagcaaagaacatttcaatttaattgcaagtatttttttaatttattttaaaacagaaatgttttaagtcaagattcctgagaaaacatagaattaactaatttgatctagaccatatctctttaagctttgctgaaaacctaaagctagcattctaaaatcttttacggtatataaaaaacatactccagtgctctgtctttacgatggaaaagtgtgttccaaagccaggtgtcagcctagagtatactgatttaaagatacctgaatgaagtggtttataagaaaaatgatgacagaagtatggctatggcaccatcgaaaggcactaatactttgggaaggtaccgatttgaatttccacttttaacaatttcacggaaaatcaaaaaagtattactgtaggttattaacgtacacattggtccttcaatttggaagctatgcatctaagaaagcatcaaattcctttacaaactcacacaagttagtcaggcttgaaaatcagtttgacacggttgtctgaggaaagcagtgcctggacagttggttgctccaaacccctacatacagtatttggttaagggtggaggggtctgtcaataaatcaaaatgttcgtgagaaactgcacattacaattgcaaaaacaatgttacagaaatagatttaagctgctcatgccatatagtcaaccactgcatataatgaattctcaaacaggtttggatttgggcctgggtgcaatttctagcatgtgttctggtccacaataaaatgccatggatggctcaagcaaagcacattaaagccttctcaagcttttaaatgcattccactattcattttcaaattacctttaaaatttccatttttaccatgttcacacaaatatgacacttaatcgcctcaggttataacaagagatactgtgaaatcattgaaactttaagaggggaaaccctaaaataagtcaacatacacattttccttctcacctttttcaggatgttctggttctggctgattactactgcttgagctcacactggcatcaaaacctgctggcgagctattcccttcagactggaggtcttggagctccccagcaacactatccacctcaattgtgctatcagtttcactcttgatacttcgaacctcttcttggtttggagccagtggttctgatactgttacagaagactgctgccggctgccttctgttacagtgactgatgaaggcgattcaggtgtagtaggaggggtatttagcactgaattactgccactacttggaaattctgcttttctgtcattgacctctactgttttttcttcaatgggtttactatcgacattgactggaggtggtttttctagttctacactgggtgaacaactctcctcttcagccacagtctgcagtgactcctctgccaccccctcctctggggcaggatgcggtggggaagctgcagcctcagtatcagagtctgaaaaaagctctttcagcgtttttttaggccactgtccctgaatacttgaccagacatcttttcgatctttggccctgctgttttgaagtctttcatcagagttatttaaaagtttaatccttttttctgccacttctgaaaatcctgaatagaaaccagttgtccgtagagattttcttttttcctccaaaccattgtatttcttagttggtgtcatctttgcttttgtttcttcttcatcttcatctgaagagctgttgctactgttttccatgcaaagtgattctttgttcttggccttctcttcctttttgccaggtgatccagtttttagacactcttctgtattgcaataccttcttttaccacgttttatttgtggttttgaagatttatctgttgtgtccttcttgacatcctttctcttttttgtgacttcatcttcttcataatcagtatcttcggataatacttctatatctttccttaatctttctggagattttgacactggtttggatattaccaaatctgcatgaactttgttttcttctagcaaagatgaactgttctgttcctcctttgaaataagatcatttctgttgttggtcaaatgatcaatcttagattcctctttgccattattatccatgtcttgagcacctctctcatcttcctgctcactgtcttcagcagaactttcagaagctagaaaataacagaaaaaaaaatgatgagtatgataagaacactagcaatgtcttctatgtgccagggactgtatatattaggtcctgtgtatacagccacccgaggttgctggcttttatctctatgtaacatgcaaagaaactgggtttcaaagaggctaagaggctcttccaatgatggaaatgttctattacgatcacggtgatggttgtaacactgtatacttttgtcaaaacccatcacattttaaacataaaagtcatcacttttatgtaaactgtaccttaataaagctgaaataaaaaagaaaaaagcttctccaagtttatataagtataatatttttatcataatatatctgagaaaatagtggagtcaggatataatcccagattgtgctacctccaagttaatattcttctttttttttttttgagtctcactttgtcatccaagctaaaagtgtaagtggcgtgatgtcggctcacagcaagctctgcctcctgggttcacgccattctcctgcctcagcctcctgagcagctgggactacaggcgcccaccaccacgcccggctaattttttgtatttttagtagacacggggtttcactgtgttagccaggatggtcttgatctcctgacctcgtgacccgccctcctcggcctcccaaagtgctgggattacaggcgtgagccaccacgcctggccccaagtttatactcttatgaaactatagccttcatttttcttttcatcagagacggtctcactctctcatccaagctggagtgcagtggcacaatcacagtgcacttcagcctcaaactcctaggctcaagagatcctcccacctcagattcctgagtagctgggatcacaggagcaagctactgcacctggcctctcatttttctttcctttgttttgttttgttttattttctttccctccctgcctcccttcctttctctttcctttctctttctttatttctctctctctctctatttttttctgagacagggtcttactctgttccccaggcactatcatggctcactgcagcctcaacctcctgggctcaaatgatcctcccacctcagccacccaagtagctgggactacaggtgtgccacatccagtgaatttttgtattttttgtagagacagggtctcgtcatgttgccaaggctggtcttgaactcctgagctctagcaacctgcctacctcagccttccaaagtgctgagattaaaggcatgagccaccacacctggccagcttcatttttcaatgtaataatgaatatccaataattttgtaatcaatgatttccatgatgttttaaagaatagatataattaattttagttactgataacttatgtaaaattaattatggaacttactgcttcagtgtgttcattctggtaaatcattttattgttattttaagataacatttcctgagaacttactacatgctggttacttttgatacactttgaacagaccatctcattcaatcctcagaacaatgctacgagatacatgttatcagccccactttatagttcaagagactagggtcttaaataaataagaaaaacaaacaaacaaaaagcaacacaacaaaacaaagcaaaaaaaaagggactggggtttagaggttaatctaccccccaaggtagttaaatctaagtcatttaactccagaacttacaaccttaactatagctctctactgagaaatccatgcatgttctttagctaaattcattaaatgtaaaacataactgacataactaagattgtgaaaccatttcacctttacaatgtgtgtctgcatggccacattttttaaattatcaaaacaatacatatacatcattaaaaacaaatctagactcataatgaaaaaccaaaaagaggataaaaatctgtttttccacctccaaagtgttaacatctgatagttatagtcatctcttactattcataatatactatttgttttatttatttttttgtgtgtgtgacggaatctcactctgtcacccaggctggagtacagtggtgtgatctcagttcactgcaacctcctcttcctggattcaagcaattctcctgcctcggcctcccaagcagctgggactacaggcacatgccaccatgcccagctaatttttgtatttttagtagagatgaagtttcatcattttagacaggctgatctcgaactcttgaccccaagtgatctgctcatctcagcctcccaaagcactgggattataggcatgagccaacgtccctggcctgctgacttatttataaagtttatcctctatgagcaatggggattcttacttatcaacacccatatctcccctctaccatcctttctatatatagttatctttcatttttacaatatagtatttataacatatgtaaatgtggttccctgcagaaataagtagtacatttgataaacttcctttcttatacagcattttatttttccaagagtttccaactacttttctgcatgttacatcttcctttgtatctcttttacattattttatttcattaaattaagcgttgtatccaatttccccttattcatcctatctctgcaccctagagagctattttctgcagtagcatctgggtggtatctctctgggtctgctctaacagctgtcatccggggaatcctcctcactgctttcttttgagctaggtccactgttaactgaatctcacatcttcttcttccttggttatctcatctgtactagagctcatcgagtagtttccttaaaaaggtacatgggatataaatattcatcgtccttacttatctgaatacatccttaccctcaaacttcattgattgagagtttcacgaggtacagaattctaggttaaaaattgtttccttcagagttctgaatccttccgaatgtattgcttctttgcttaaggggttataagccataaccttcctttggtttctcattcctttgtggtgattttttcattcttgatattttataatttcataatgatgtactacggtatgactctattaatttattcggtacctagtgagcaatttcaatgtaaagatttgtgtctgtcagttctggaatttttctttagttatttgctttttttttttttgagactgagtcttgctctgtcatcaggttggagtgcagtggtgcaatctcagttcactgcaacctccacctcccaggttcaagtgattcccctgcctcagcctcctgagtagctgggactacaggtgcatgccaccacacccagctaatttttgtactttagtagagacagggtttcaccgtgttagccaggatggtcttgatttcctgacctcgtgatccgcccacctcagcctcccaaagtgcagggattataggcgtgagccaccgcgcctggcctctctcctctgttttcatagttcccccttcctagattaatacattatgtaacctatcttttctctaaaatttccatcactgctcttttaaactttctgaagatttcctccatttaaaattcttaatgctctactgaatttgcttatttttttttttttttaagagacagagtctcgctctgttgcccaggctggagtgcgctggcaagatctcagttcactacaacctccacctcccgggttcaggcaattctcctgtctcggcctccccaatagctgggactacaggcacacgccaagctaatttttgtatttttagcagagatggggtttcaccctattggtcaggctggtctcaaactcctgacctcagatgatccacctgcctcggcctcccaaagtgctgggattacaggtgtgagccactgtgcccagctctactgaattttaatttagattttttgtttttgttttttttgagacagggtctctctctgttgcccagactggagtgcagtggtgcaggttcaagcaattctcatgcttctgcctcctgagcagctgggattataggcaccaaccaccacattcggctaattttaatatttttattagagacacggttttaccatgttggttaggctggtctcgaactcctgacctcaagtgatctgcccaccttggcctcccaaagtgctgggattacaggcatgagccactgtgcctggcctttagatttttatctccaagtctttcttgttcttttctttttcactgcatcttattcttttctttttcactgcatcttattcttttttttttttttttttttgtagacggagtttcactcctgttacccaggctggagcgcaatggcgtgatctcagctcaccgcaacctccgcctcgtgggttcaagtgattctcctgcctcagcctcccaagcagctggaactacaggcatgtgccaccacacccggctaactgttttctattttcagtagagacgaggtttctccctgttggtcaggctggtcttgaactcccgacctcaggtgatccgcctaccttggcctcccaaaatgctggaattacaggtgtgagccaccgtgcccagcttattcttgttttatagatactgtaggttctctgagattaacaagagatgattaagaatgccctattaaaacttgattgacactactgttagtaggatttattaactgataggctttacgtgattcatcccggatctagtttactctaggggatttccactgccagaatgtagaagattattctccagagacattcaatttctccacagaactccaactaccactgtacctctagttttattcccaacccatctcaggacaagaggatagaatcttagctgtctgtgttctctactcacaaggggcatcaaatttttatgtatacatatacatacacatatgcattcatatgatgatcattaattaactggaaatatttgaaatgtcttcaatttgatctgtggccaaagataaaaaataaaattcactgaaaaaagaaaatatgaagagaatacttaaaatgttaaaagtatgcaaatatgatactcattgttgaactaacaggaaaaatatgggaaaggatcaaaatgtctttttttagcaactaattaaataaattatgatatatctattcagtagatgtggatgtgccgatttggaaagatttataagttataccactaagtaggggaaaaaaagagtttgtaatatgttaatgatcccatctgtaaaaagactgcacacatgtgagtgtctattacacatataggataaatatgtgtgtgggggggtttggggtcattgtatatgtgttatatgtatgtgtgtgtgtatatatactcatatgtcatatatatggtatataaatgcaatttctgaaataatataaacctataaaaatgggggaaaatacgaaagaaaagcaacacaatttgcaagtcagaaagcagataaatgaatgacgggcaccaaagaaggctaaacctcataccagcagtgaggaaagccaaaaaccaacccagtttaccatagaaacctcaataattactgactgccctagtgcctatgaaaattaaaaagggcagtggggagcctcatacaaggagcactgggtgaagactaaaaattacttagatgcctagatccccacctcacttcaggttggaaggtgactgcccttctagagctttattctctgaagacagtaggagagggctcctagcctgggagatgctaacaactgttgaaggcacaggtacagatgcgatgctgaaattagggggattcatgaacatatctaaccactaagaatcctccaccccactctctgttcttcaactagatcctagaacactggaaaccattctcttaccaccctccagtcaagagattggaactcttttctctggaagccaactagtctaagagaaaaagacctaaagacttcatattatgaattccctaggacatggccaaccagatcacccgatagtgaaactcaaggtcaacaagtgccaaccatatgcttgcaatttccaaatcagtttagtctttccttcataatcataagacagccaggaaaaaaaattcttaatagggaagagctcaaaacaacaacacagaaaaaagcaaattagaggtaactgaaaaaaccaaaaattataaaatcctttgaaagatcaaaatccgaaaggtaaggtattgcatccatctataagaacagagtggtacaaaacacacagaaaacagagctcttgaaaaattaaactagtttaatttaaaaatattcattgaaaggctgggcgcagtggctcacgcctataatcccagcactgtgggaggctgaggcaggtggatcacaaggtcaggagttcaagaccagcctggccaagatggtgaaaccccatctctactaaaaatacaaaaaattagctgggtgcggtggcaggcgcctgtaataccagctactcgggaggctgaggcaggagaatcgcttgaacttggagggcagagattgcagtgagccgagatcatgccactgcactccagcctaggcaacagagtgagactcagtctcaaaaaaaaaaaaaaaaaaaaaaaaatcattgaaaacttaaacattacagcaaaaagtcaacaaaaggattaaaagacaaagcagataaaatttcaaagaaataaaaagacaaaaaaattaataaaaagcaagaaattaaaaggtgagcatattagagtatattacagaaggtataatatcaaataatggctggccaaagaaagataacagccaagtgcagtgtcatgcacctataccccagctacccaactacttgggaggctgaggcaggaggactgcttgagcccagaagtgtgagaacagcctgggctgaacatagtgaaacacagtctcaattaaagaaaaaaaaaaatttggcagggctgggacagtagctcatgcctgtaatcctagcactttgggaggctgagacaggaaaatcgcttgagctcagaagtttgagaccagcctgggcaatatagtaacacctcatctcaaaaatagtaacaatgaacaaaaattaaaaaggagagaacagtaaaatgcaggagaggaaatcatcaagaaaatcattcaaaaaaactgcctagaacagaaagacagaagttgctagaatgaaagagtctagcaagtaggcatcacaggggatgaaaatatatctacacaaggctaaagaaagagaacagccaagtgtactgtggatatatctgttctcttcctttggccttgtgtagatatatttcagagttaaatttctggatacgaaaaacaaagattcaagattcctagcagggcatggtggctcatgccagtaatcccagcactttgggaggctgaggtgagtggatcacttgaggtcagcagttcgagaccagcctggccaaaatggcaaaaccccatctctactaaaaatagaaaaactagccaggcgtggtggcaggcccctgcaatcccacctactcgggaggctgaggcaggagaaacacttgaacccaggaggcagaggctgcagtaagccaaaattgtgccactgcactccagcttggccaacagagtgagattccatctcaaaaaaagaaaagaaaaaaaaaagattccagagacagaaaagcaaaaaataaagaataaaacaagtcacatacaaagaatcaggaattggaagagctctggacttcacaaaagcaatactggaagcaaaaaaacaattcaacactgccaataaaatactgaaggaaaaacttccaatccagccaaactatgaatagaataaagatatttgcaaaaataaatacagatatttaaatgcagccaatctctaaaaattccatctcatgcacttgttctttagaagctactagagaatgtgctccaccaaaatgaaagtatgggggtggggaggaacctgagatgccaaaaacaaagaaatccaagaactacattaaaggagatccctagaatgggatctccctaggaaaatagctgtgcaacagatatagagggaaaccagtccagactacagcagtgttatttccaaagaaagtcatactgcaggctattatcattaagctacctgctaccgcctctctgtagtctttgaatgcctgagtgacccagactggattttaaaatctgtatttatcttgtttcaactatgtgtcaatgaaattccagctctcccttccatgtcttatgtgccactacctagatcagctaatgacatcattttatccagcagaaacattctgacctacttgtgaaaaataggggtaaatcaccataagcctagaatgagaatatatatagagtagtctgctactacgactgagcacactcccacataacatccactgcgaatgtgtcacatattctttttattttattttttttaagatggagtttcgctgttgctacccaggctagagtgcaatggtgtgatcttgactcactgcaacctctgcctcctgggttcaagcgattctcctgcctcagcctcccaagtagctgggattacaggcacccaccaccacacccggcaaagtttttgtatttttttttttagtagagacagggtttcaccatgttggccaggctggtctcaaactcctgacctcaggtaatctgcccgccttggcctccaaaagtgctgggattacaggagtgagctactatgcccagccaaatgtgtcagatattctaactgtagtggacccctaggtttatcagaactggcttatgacctgtccaactgaattctctagaggggcttttgtaaactctcagagaagctaaatctgaaatcagagtatgacttagaatctctattcaggtaacattctcagaaagccttcatctgagccttcttataaaactaggcttatgcttgttactcaatttttaaaaaactaaaaaacaggctgggtgcagtggctcatgcctataatcctaacactttggaaggctgaggcagatggattggattgcttgagtccaggagtttgagacaagcctgggcaacagggtgaaaccccatctctacaaaaactacaaaaaatagcctggcatggtggcacacacctgtagttccagctacttaggaggctgagatggaaaggtcgcttgagcccaggaggtcacttgagtcgtgatagcaccactgcactccagcctgggtgacagagcgagactctgcctcaaaaacaaaaacaaaacaaaaaaacaccctaaaaaaatgaagtaaaataaaaattacttaggaatataaatatagataattcaattctgaagaaaagtaaagcaaggattacacaaaagtccagactataattacttctgggaggagacatactacgaagtaaaataaaaattacttaggaatataaatatagataattcaattctgaagaaaagtaaagcaaggattacacaaaagtccagactataattacttctgggaggagacatactacatgttttaagtaaatagtatttgattgctactgtggagacatactagtatccatattattactgttctttaaactatacatgtattttccatgcactatttgcatgtaggatacatgggaaaattttttaaaaatcaatttaaaaatattgccctaattagtacagtggtgagtaaataaaaatatagtacagcatttggtttataaaataatgagttaatataaacacacatctacaataagaaacaaaaactagcttctattaacattcaaaataagtaaaaatgaaacctcttttaagttatgagaaatgataagatatttttatggagatccattcttttatctcatagatatgtccccttccctgccagtcagatttaataaatctctgctccaatcctcattgcttttattacctatacttcattttgccttaaatactaagcaataatcccatcataaaagaggtcatgtcaggccaggcgcggtggctcacgcctgtaatcccagcactttgggaggccaaggtgggcggatcataaggtcaggagatccagaccatggtgaaaccccatctgtactaaaaatacagaaaattagccaggcgcagtggcgggcgcctgtagtcccagctactcaggaagctgagacaggagaacagtgtgaacccgggaggtggagcttgcaagtgagctgagattgcgccactgcactccagcctgggtgacagagcgagactccgtctcaaaaaaaaaaaaaaagcagtcagtccaggtgcagtggctcctgcctgtaatcctagcactcgggaggctaagacaggccaattgcttgagcctaggagctcgagacgagcctggtcaacagggcaaaaccccgtctctagaaacaatataaatattagccgggcatggtggcatgcgcctgcagctccagctccttgggaggctgaggtgtgaggatctttagagtctgggaggttgaggctgaagtgagctgagattgcaccactgtactccaacctaggctacagagtgagaccctgtctcaaagaaacagagatcataatagtcataatcaggacaaacaaagtttggtgttctttacaacaacttgtcagtatacttttatggtctgatgttgtataacacaaactatgcattacattgcaacagaaaggatggcacagaaaagattaaaaaactaaagtaacaatgctaaaagttgaatattaaatgttaaccaaaattttatggtgcccttggatctactagtaataaaaaatttgaggcctcaatcaatggctgattttatttcaagtacaggttgaacatcccaaatccaaaatctgaagactccaaaatcatacactttttgagtgctgacgtgattctgaaaggtaacgctcactggagcatttcagatttagaattttcggatttggcttgtggaatgcaaatattccaaaatcaaaaaaaaatctgaaatccaaaacatttctggttccaagaatttcagttaagagatattcaacctgtaataagagagcaaacaaaactctggtagaaaaaacagtagttggtaatgtcactgaattacctttatagaacttgactcataaattaaaatcaaatacttgcacaacagaacgattgttatgtttaccttgaagtccattaaggatcgaagtaatttctatggacttaatatgagcagtatcagagtttttggcatcagtgagatccagtttggataccatttcaggagatggatttgtctgaaatggtggtttggacaagcgccgaagtttacagttttttggagagtatttttcatctttgtctttttctttgtctaatttattctaggttaagaaaaaaagtatgtcgtaatttatcataaggcatttatcagaaacaatgttaatgtccacttttaactcactattacagaatatgttgttaaatatttaacataaaaagaaagaacataagaagcccctcaaaacagccagatttttaaagctacttaacaaaatactacacaggatgatcaaaaggttttgtatttatactttaataacgggaatcaaattagcaatcagataggtgattaggactagcaaacctacaacttgctcttcagaattaaaatcacaatacgtttaaattaaatactaactaaaaaaagaggccaggtgaggtggctcacacctgtaatcccagcactttgggaggccgcggcaggtggatcacctgaggtcaggaggtcaagaccagcctgaccaacatggagaaaccccgtctctactaaaaatacaaaagtagccggggtggtggcgcatgcctgtaatcccagctactcgggaggctgaggcaggagaatcgcttgaacctgggagatggaggttgcggtgagccaagatcgcgccattgcactccagcctgggcaacaagagtgaaactccgtctcaaaaaaacaagaaaaaaaagaaacgattgcaacgtggtcattttaaaatctcactatatgtgggttgggaatgacaaaattccaggtacttttgtaaagtcaagtcaggggcaaccttcctacctcagtgatatattaatgttttgagaaaagatgagaaattttctcaaattatttgtttacaaatagataagcaaaggccgatatatttcctggaaactactcttaaaaattttgttgatttataggaaaaataagctctctgaagcatgagttagcagtaagcactataaattttgagtgagagtaattctcctaaggatggtacatatctagtatcattccagatgcatagaagatgctaatcaaacatttaggaaaatttagtcttagaatgaataattctatcatacataaaagtaacattaattttccatatgagctcctaagtaaatcctcatggcattttcgtggttaataggatcctgtggggctgggcgtggtggctcacacctataatcccggcattttgggaggccaaggcgggcggatcacctgaggtcagaagttcgagaccagcctggccaacatggtgaaaccccatctctactaaaaatacaaaaattagccaggtgtggtggtgtgtgcctgtaatcccagctactcgggaggctgaggcatgagaatcgcttgaactgggaggtggaggttgcagtgagccgaggttgcaccactgtactccagcctgggcaacagagcgagactctgtctccaaaaaaaaaaaaaaatcttgtgaatatattctaagccactgactataatcagataaagaagaagagaaaaaggagttgccagatagccttttcttccttggaatggtttacagctacaataataacctatgtctctccaagtcacactgccttatggctcctggttgggaactagaggggaaggaaatggcagaaatagataaataaaatctggttgaatggctttatataatgttgggactgaaaaagtctcaaagatcatccagtactgtttctaaaatgctttccctaacctgacaaaattaattatatacaaatctagcatttgaaaaatgtgctatttcaataaagtgtaacactaacacatatttaattgcatcatttggaggaaaacttctttttaagagctaatagtgtgtagtaaaaacaagcacttacctttattttcttccgatgttttatctttggcacatttttatcagcaggtcttactattttatctgctttaatccattcatcgtatctaaaattaaaggaaattaatataaatatgtacaatatataccacggaaataacctatgccatattaaagagaaactcatatagaatcttgacattttagaagggaaaggaccttggaaatcatctcagcttcctggtttgaagagcaagctaccaaggcacaaagagagggaggtaataacttgcccatggacttaaagttagctactggccgagccaagactagagagcatgatctcatgattcctcaactagcactgcttactcggctacaacaaagagaaactgaatctgtacagtaagtattaagataaatcacagtattttctacattttgttttactttgtttcattcttaagcagcaggtaggcaatttttctctagacacatcagagagctaaggtaatagcttcagttttaaatggcattgtgtaatagaaaagcaccgtattacagccaggcacagtggctcacaccagtaatcctagcacttttgggagaccaaggcgggcagatcacgaagtcaggagatcaagaccatcaacgctaacacggtgaaaccccatctctactaaaaatacaaaaaattagccagacgtggtggtgggggcctgtagccccagctactcaggaggctgaggcagaagaatcgtgtgaacccaggagcggagcttgcagtgagctgagatcgcgccactgcactccagcctgggcgacagagcgagactctgtttcacaaaaaaaaaaaaaaaaaagaaataagaaaagaaaagcaccatattgtaacgtatggataatgcaaaatcaactagaaaaaaaaaatgcttgctcataaaataccagaaaaacattactctgcaaagtttttcagtattctgaaatgctccctacatgtacagacagctgagtcaacagctgtgatggcctcttgattcaatgctgatggtcttcacaatttcatagggtgcaaattactattaactgcaataaaactatttgtttaaagcaaaaaaaaaagaatgacagtttattcgttcttcattcattcaagaattataacagctagaagaagtaaacattaaaaactaattgacattctctttttgtgttcaaagttatatacattactcatagaaaacacaaaactctagaacatggacacctgaaaacgagcttttaaattaaaatgtcctcattgttagaggtattaaaaggaagtaacaaagtccccaaatcaagaagtaaatgacttgagtcattacttgactaataaattatattcttactctagcataggcctggaaagtatctgtagcaaactcctgggcagttactctgctggtacaaactactggcttgtagccagtaaaagccagaaaagctgaggattcatccccatgcaaggggttctgtttatatgctggaagatgctgagggccgtaataagaataagagggaatggaatgagctttaggacagacttaacataatccctgcttcctagttatgtggtcctgatcaactcattctcaatctaaggcttagtttatttctgtataaaataagactacaatttaaaaacaaaataaaaaataatggtacataccatatatgggtttttttgtagaaatatatggtaagtactggtgtaagtacaaatatatggtaagtactttgaaaagctttaaagtaagtattcttctactaaatacactccttttggtacttctacctggcactgtagcatctatccatatatttgcagcagtacttttacctttcctattaatatcgaaaattgtataatgcttaggaaagcaatttacttccttccaaaatcgggggcatggtgggaaacgaaaagaaaacacctccatcctctgtagatttcagtatgaactcctagaagttgctctattagaagagttatggaaagaagaagtcaagatatcaactttgtttttaaaagaaaacaaaacaagctttctaattttttatgagagaaactgaagtcagttcatgatggctgcacataacattaatgtgagctaaacaaagttataatcatgttctacctttcttaaccaaaggctatctgttctgtagctagttttataccagacatgttttactatcaataaaaaactgactcaattcaacctgggttttattatcaattatattttgaagtagggtaaaatagtagttttcaatttaagaatacatgcatgatattgcacatttgtatattttacatgcaacaccaaacacatcaaacaaggaaaaacagttactgcctcatgggtaaggccactgtgataaaggaagattcctttattactcagatataatgtatgttgtttaaattctcttaagaacaaggtggcaagaacatacacataaataataaaatgatggatgcttggtatggtacaggctggggcccactgcctaagctctgtaaatcctatatggtaatcatgttctcttctactcaattataaaagaaggatggtacaagaggactggatgtcagaaaaatgttaagtagttgagtttagatgtcaaaagtgtgttggagcaggcaggacacacacacaaaaataaattcttaaattagatgaaacaaactacatacatagttgtaattaacagtatggccttactattctggaaaatttttgttttaaaattctcatggggccgggcgcagtggctaacgcctgtaatcccagcactttggaaggctgaggtggacagatcacctgaggtcaggagttcgagaccagcctggccaatatggtgaaaccctgtctctacaaaaacacaaaaattagccaggcatgatggcgcatgcctgtaatcctagctactcgggaggctgaggctggagaatcgcttcaacccgggaggcggaggttgcagtgagccgagatcgcgccattgcactccagcctgggtgacagaacaagactccgtctcaaaaaacaaaacaaaaaaaattctcatggaatactctgtatggttttaagaaattccctgaaaacttactatagagtaataatgtaatctaacagcaaacataatgtataataatattacattatatttatagatctaacttaacagatctataaatattagctaatattatgactcttctgttatttggcttctttctattctactttctcagtgcttttatttgtttaattcaggcccttgttttgacactaagtttttgcatttttttttaccttgccaattatgctctttgtataaaacacagttacacaatattgttactgttatcaaaactaataacttttagaactagagcatatcttaaaaatttatcagggcctttatttcacaagttaagaaattccaacaatgaaagtgaaagacagtgcttgccaaaaagcactcctgtggagaattagagaagagaaggaaatggactgcccgggaaaagattctaacacgaaaataacggtagggggcattccaggccctattcagagtaagtttagtgaagagtgagagaccagtggcgtgaagaggaagaaaaggagaaaataacatgtgagaattttggttggggaagctttttcgaattacaaatgtccttaccaaatacaagctgagatcactgacacaaacatattggcagacaagtatttcaaaacctaatgagacgttaaatagcactttagttgtctgatagatcttacaagaaaaataaagatggtcagaagattaaataactataactgatcattgcttttaaaaataagaaatgttccttccgtatatgtaattacccattacaatactacccaagtgttccttctattttctctacaggatattttcaaagaatagggaaaaaaaaaaaaaaaagcaaattcatgtggggaggccgggcacggtggctcacacctgtaatcccagaactatgggaggcccagacaggcagatcacccgaggccaggagttcgagaccagcctggccaacgtggtgaaactccgtctctaacaaaaagataaaaattaggccgggcgcagtggctcatgcctgtaatcccagcactttgggaggccgaggcagaggtgggcagatcatgaggtcaggagttcgagaccagcctggccaacatggtgaaaccgtgtctctactgaaaatacaaaaatcagccaggcgtggtagcgggcgcctgtagtcctagctacttgggatgctgaggcaggagaagagcttgaacccgagaggcggaggttgcagtgagccgagatcgcatgccacggtaccctagcctgggtgacagagcaagactcatctcaaaaaaataaaattcatgcggggaaaaactctacatgaaaaccccatatttcctacagacattaaaattatataagaaagaacgtcttagactggcataattactggtgccaattaatttaagaaagcaatattagtgggtcaagatttctcattccttaccaaagaagcacaggcttcaaagaagaatttacttcagaactacaacaaaaagctacagttaatcctacttcttctttataaatttagacttttaaaaatacagtacatttagtatatattaaaaagagacaacaccaaatttaccttagacataatagataagaaaatagtcaatgcagatagaaaatgggaaattttagctcaagttcacatatcttgaatttcataaaaaattaaaataggccaggcccggtggcttatgcctgtaatcctagcactttgggaggccgaggagggcggatcacaagatcaggtgttcaacaccagcctggccaacatagtgaaaccccgtctctaataaaaatacaaaaaaaattagctggctgtggcggcgggcacctgtagtcccagatacttgggaggctggggtaggagaatcacttgaacccaggaggcagaggtggcagtgagccaagatcgcaccactgtgctccagcctgggtgacacagcgagactctgtctccaaaaaaaataaaataaataaaaataaagtaaaacaaaataactggaaaggaagtggcaaagagtgaaactgcagctaagaaatagaaggccataaaatatttctcaatttctccttggggtaccacgtcaagtaagatatctattcatccccgaaagtacattcttaaggaatacgagaatcttctttttttttttttcttcttcatacagagtctctgttgctcagactggagtgcggtagcgccatcctggctcactgcagccttgacctcccagtatcaattgtcccacctcagactcctgaacagttgggactccaggcattcaccaccacacctggataatttttttatattttgtagagagagggtgtcactatgtttctcaggctggtctcaaactcctgggctctagtgattcgcccaccttggcctcccgaagtgctgggattataggtgtgagccaccgcatctggcggaatacaataatcttagtaagtaagttaaatacaaaccttttggttttaaaatgcttccagaccagcctggctaacatggcgaaaccccatctctactaaaaatacaaaaatcagctgggcacggtggcgcatgtctataatcccagctactcaggaggctgaggcaggagaatcacttgatcccagaaggcagaggttgcagtgagccaagactgcactactgcactccaacctgggaaacagagcaagactctgtctcaaaaaaatatgtaaaataaaataaaataaaataaattgtcttgcaattttagattcaagcaatacagttttctgaaaatgtgaaaattcaggtagactgggttgttattttatatatatgtgtatataatatatacatatatatacacaatatatacatatatatacaatccaggatagtttatctatcctggctttaactggtcttaacctttaggaattatgattacaaatcataattggccttttcataataacaggaaataaattaattttgcagggcacaagggaaacagcattactaaatgcttccatttaaaaagaaatactgaaataaacaaaaagtattgaaacaaatattaaaaacaaatattgagttagaaaattaagacagtgattagcctatactttttcaattcagttatcaatacagtcaatgtaattaattctacagatggaatctaaacaagtatcttattgaatatttatctaaagtactaaggaaaatatttccaaggtatatatatgacttgtctgataatatttctattgagatcacttaacattcaactaacaaaacataaaataacatatgcatgataaactcatttaacttctgaagatctagtatgttccctgacctacataaaatgaagtacaatgaaaaaaaaatttttttttttttgagacggagtcttgctctgttgccctggctggagtgcaatggtgcgatctcagctcactgcaacctccgcctctcaggttcaagtgattctcctgcctcagccccctgagtagctgggattacaggtgtgtgccaccacgtccagctaatttttgtatttttagtagagactgggttttgccatgttggccagacttgtcttgaactcctgaccttaggtgatttgcctgcctcagcctcctgaagtgctgggattacaggcgtgagccaccacacctggccgtagaatgaaaaattatatgagactccaagaccataagtacacatgtggacgtattcatttgacaaacacctctaaggtatctattatgtaataacagagtctgctaggcactgggtactcagcaatgaatcaacaaacacagcccttgcctgcgaggagcttacaattcaacaaaagaagacaatactaaacagtaatgacaaattgtgaatacaaacgtgaaactttctgaaagaagccaccacacaaatatttgatttttcaaatgtttaaaaatattcatacaaggctaaaagataccattcagagaccacagcatacttgctctcaccacagaaaaattggatttctaaaaagaaaactttatggcttttgtacagatgcattggcaaattatgtaagaaatcattttgtaataataaaaatggaaaagaacattagtcgaccagatatactaccaaaatggttaatatgcccacatcaattcagcttttggttcttcttaaacccaattttaaaagaaatattatcagcatatagttaatatatacctaaaaagcacagtcttaagagatttaaaaataaacagcatgcagaataaaggtattttaaaaataacttcgtaagtaaaatcaaattaatataaacttgaaacctcactctttgaaatatgtatagataagataaaaatctaataaccaaccattaagtaaatgttaaaatcatctatattttgctttctataatgaatagattcatttaataattgttgcacaatatgtattttatatcttgcctctctataatcaaaaaagttaatgtatgtcatataattaacttacttagtttttaagaacctcacatctaaagtggaaatttgtactgtcttagtatggaaagggatttccccacctgaattaaataaataaaagtatgacaaaataatagaaaaaaacaccaagtcaagataaaaagcagtgttaatcattattaattataaacttcataagcaattttatcaatatttacctactttatgaattttatataatctcaatttatatgtattttaatctgactatctaaaacaagatatatgaaaataacaactgatcacaattaatacttttaatcatgtatctacaataaaatgaaacaaaaaagtagtatattattcaaaaataaaattcctgccgggtgcagtggctcacatctgtaagactaacattttgggaggccaaggcaggcggatcatgacgtcaggatttcaagaccagcctggccagcatggtgaaacctcatctctcctaaaaatacaaaaattagccgggcatggtggcacacgcctgtagtcccagctactcgggaggctgaggcaggagaattgcttgaacccagaaggcggaggttgcagtgagccaagatcatgccactgcactctagcctgggtgacggagcgaaactccgcttcaaaataaaataaaataaaatgaaattcctaagtatgatataaacatttcatatttctacttcatataacacttaaatctacatcagagagacagcgatggtattcctcacacttaagaatataacagcagaatgacagaaccataaatattatagcatagtcatatttaagagttgacataaacagctcaacggaatggtatagtaattatatcaataggttttcctaagcaatgtaacgctataaaatgaaacggaagtataggtctttaggcagaggtaatatgtaataataagaacactaatacagcattttaccaaagcgtacaaagacaactgcaaatggttaactgtgccattaattgcatattgtaatgcagatgctaagttttttaaattccccaaaagtgtactttgttaatatttgataaatgtatggaattagttatttgtgcgtacttagacaaaaatatcaatgtacctgccaatctacgaaactactgaatgaaacaggtccaagtttagtaaacattctaagatgaatacacaaagaaaaattaaagcccatttgagtacaacacataactgaattatcatctttttttcatgaaggaaatgtttatgttcatttgtactcaaaatctatggttaactcaaaagccactctcttttaatacaaacttacagataatggaaaccactgtcaaatggtcattttataggcctctgacttctgtactatagaaacaacgcagacaacttcccagggtaccttgctttctatcattaccaggacaattatttcaaagaaaatgagtagaacaactttgtactctatttcaatattcctaaatccaatggcatacacaactcaagtacagcagggatcagattacatggaaataagaaagaaaaaaaatgaaggacacaaaacattttagagcaggaaagaacaaagaaattaagctgaaaagtgacttaaaaattttttaaggacaaaaggagactaagaatagctaaaaagtaacagaaaattaatatttccaatcaaattcattccagtctctcagtctcgactccattttgtttgctaagagatgagctctttatgtaacccaaagaggtcacatatatcatatacaaatatgaactcagattagaacaacaatgtaaacattacagctaaaactataaagttcttagaagaaaacataaaggaaaattttcagaacactggatttggcaatgtttctttggaaataacatcaaaagcagaggcaacaaaagaaacatttgcaatcatgtatctgataagggaataacatctagaatatatgaagaactataattcaacaacaacaaaacaactgaccaattcaaaaatggcaaaaacttgaagggacgttcctctaaagaagatatacaaatggctaataagtacatgaaaaaatgttcaactctacatttcaagtacatgaaaaaatgttgcattaggaaaatgcaaatcaaaaaagcacaatgagataaacagagaataacaagtgttgacaaggctgcagagaacctggaaccctaacacattgctggtgagaatgtaaaacggtgtcgtctctgtggaaaagtttgacagttccttagaatgtgaaacacagagttatatataaatgaggtgagaagcagctccagtgagagggtcaagccatatctgtcccaatcccctattataggtatcactttaaaaaaccagtggcttttatttggattttaccttctgctctacttccattttgttgtcaggaggtccaatttagttcaacattcatttagtacttatcatatgccaaatgaatacttttctagatgtggtaagggatattaggagaatagatatgaaacagaaatttttttcatattttaaaattaagttcacttttgtaataatacataacgtagtcctaatgtagaaagcttgaacgatgaagaaaaaaagaaaaggagggggaggagagttgaagggaaagaatttacccagagtcctaggtgaaagttatattccagatcaaattcctttggctcggaaaaataatttagaaaaattcaatatcagaattgtgactcaagttaggattggaaaaataggaacagaaaccaaaaaaatgttaaatggatatcagaaagaaataggggaaaaattagaagggagaaaacacataaagatgaggaagacagaaaagataattgaggagtggtttcttaattttgagaaaggaagaaaaggaaaataaacaagaaaaatggttgtagctggagcagctggagcccaagcaaagcatatcacggaaggagtgatcaactgactgtaaagccactgataaggtacgtaagagggcaagaaaagcaggaggaatttatctacaaagggtcactagtgttcctggtaagcacagttgtggagacacagtgaacaaaaggctgatgagagtggatttacacagaaaaaggagagaaactgagtaacaagtgtaggtaactttcaaacagttctgctgaatgaaaatggagcgaagaaatgtcacagtagaagtcaggctccagaaaagattttccttgagatgtgacaaataaccacagatctgtaagtagtgggaatgactcagaacagagcaagaaaatgggccatgtctttgatcagtcaagaagggatgcttatgaagactggcttcagacagtagcatgactgtatatctatggctaaagatgaaaacacagagaatgtggcagcaaacgcagttaggtaggcagatcttatgaagtgtgtagaaatgtttttcttgtttctatctctcagtaggtacaaagcaaggtcaccagctgaaaatgaggatagggaagagatgttggggatgtgaagacataagcagcagtatgaaatagtcttctaagaaagtaggaaagtgaatggaagaaggacatagagaattaaggacccacttgaggttcacagtaatgaatttaaaataagaacagtcattgtggttgcttgctttactccaaccacgatcggctgcacaggtgcaggcaaggagctggagggttagatttaatcaaggttcttgtggttttgtcagatgagtactataaagcaaaaggagagaaaaagaacagcttgagtcaaaagaagtgattataataataatgccagggaatgtaagcaatatcaagggaagactgagtgcattaactggggtgaagaggtaaggggtggtaggatcaataccttaataaagaatttattattattatgaattccttaataaggaccacttcttggtatctttggtgacaagcacagtatttggcacatagtgggtattcaacttatgtttggaaaataaaggaataaagtgtgataaaaagcaactgaatgatggcaaaaaataggattgagcctactcatttgtgaaagccttttaccaggttttttcatcccctaactcattccctcctaagaggatttaatttgtttggcgaaaatattttttaaatgtaacacatttttaatttcaaataatatatttagcataatttagcttattttcagttctctgtaactgttaacatgcactagaactgttgtggcttatttaagagttttacaactgaagttttacagtgtctcttttacttttgggttcccattaatgcagctggtgatcttcaacatacaaaaaattattctctaactaaatttgcaactctttgattacagaaagccaagttggaaatgagcgagaaaattcaatcagtattgatacactattacaaaatattgatgtattttaaattccatgccaattagtctagatagtttcactcagttgttactaaacaaagaaatccaacacactcaactagtttacggcatgttaatttcaatgtgtacccttactttcaaaaatcaatcccatatttacgacacgacttagaaacttgagagtgaaagggatcaattagataattatgctaagattctctataaaatattaacatcactaagaaaagttaaatagagagcctactattaaaaactacttaagcagaactaaattttttttaaatgtagggagacattttaaaagactaaaagagaacacactataatattagtaattttattattattttttttctatttttttgagatggagtttcgctcttgttgcccaggctggagtgcaatggcgcaatctcggctcaccgcaacctccgtctcccaggttcgagcgattctcctgcctcaccctacctagtagctgggattataggcatgtgcctccatgcctggctaattttgtgtttttttttagtagagatggggtttcttcatgttggtcaggctggtctcgaactggtctcgaactcccaacctcaggtgatccgcccacctcggcctcccaaagtgctgggattacaggcgtgagccaccgtgcccggccggccagcaataattttatctttctacttttatgtatttttctaaattgttatttttagaagagtttaaaaaataatttatgagcatactccaaacatgcctagtgcttggtgacatagtaagtaatatagtgctagacaatagttttagatactgtcactgcatcagaaaaattctgtaagagtattataatatttgtggttaaagagttcaagccctttccagtaaatgtggtgtgaacatgttaaaatatgactttttttcatcacaacagtagaaaacaaacttgcccaaatgttaacctttgtataacaaaaatcaacattttcagctgtgaaatagggacatacatgaaaattatattaaagatttatacaggtcgggcgcagtggctcacgcctataatcccaccacttacgggggcagaggtggatcacctgaggtcaggcgtttgagaccagtctggtcaacatggtgaaaccccatctctactaaaaatacaaaaatttgctgggcatggtggcatgtgcctacaatcccagctacttgggaggctgagacaggggaatcttttgaacctgggaggcggaggtgacagtgagatgatatcacggcgctgcactccagcctagacaacaagagcaaaacctcatctcaaaaacaaacaacaaacaaacaaacagcattttagttagaaaaaaaagaaaaatgtaaaaattaacaagaaaattgatttttttgttttttgttttgtttttttttttttgagatggagtcttgctctgtcacccaggctggagtgcaatggtgtgatcttggttcactgcaacctctgtgcccctggatcaagtcattctcatgcctcagcctcccaagtagatcggattacaggcacctgccaccatgtctggctaatttttgtatttttagtagagatgaggtttcgccatgttggccaggctggtttcgaactcctgacctcaggtgatctgcccgcctcggcctcccaaagtgctgggattatgggcatgagctacccgtgcctggcctaaaaacagtatttttaaacaaaaagacagacactcttacattatttgagaaaatctctttaccggaaaaacatgtttcatggccaggagcattggttcatgtctataatcccagcacttttggaagccaaggcaggaggactgcttgagcccaggagtttgaaaccagcttgggcaacatagtgagaccccatctctacaaaagataaaaaattagccaggtgtggtgatgcacacctagagtcccacctattccagaggctgaggtgggaggatcactcgagcccaagaagtcgaggctggagagccatgattgcaccactgcactccagcctgggtgacagaacaaggtcctgtctgtctctctctttttttttaatctgaaatacttgtttcagattaaaaaaaccatggaaataggtccacacaaatctcccaaactgcttgtcatgaatgactaccactgaagataaaactattttcatgaacctccacgcataaatcttcatttccaatttcacatctgttaagtataaatttagagatcaagctgaagaccctaaaaataaaagaaaaattgtcatacagctgatgaggatttgttgcagtccttattaaattagcttcagaactggaggagccgcaaaaataaaaattattgcttatttatcaataagacagactgattattgcagaaagaaataaaatagttatgttaactctaagaagattaactgcttaatctactgaagtacatttgttttctccatgatgttggagtgtatagagatccatcctacaggtcttcatcaagatgttaagttttcttcttttgaaagttcatagcatacaagcacttgagttctcagaaatagatggcaacgttcacagtaacacaagcatgtcttgttgaactaggtcgcattttcctccctatattattaaaaacttgaatgcctcaatttaaattctttcctttcccttcctgctatttaaaaactaaattactagagattctttctaccatctaaaatcaaaatactcctggaattctctttcttttagtcaatcttttcttaacaaaacaaagctatatcttaattgtaaaacagtttcatgaatgactcagttcttatatctactaagccttttttgtttaaagagccaattaatagaaaataagccttggccgggcacggtggctcatgcctgtagtcccagcactttgggaggctgaggcaggtggatcacctgaggtcaggagtttgagaccagcctaacaaacatggagaaaccccatctctactaaaaatacaaaaattagctgggcgtggtggtgcgtgcctatctcagctactcaggagactgaggcaggagaagcgcttgaacccgggaggcggaggctgcggtgagccaagatccagccactgcactccaggctgggcattaagagtgaaactccgtggaaggaaggagggaaggagggaaggaagaagggaaggaaatgagccctgattatatacagtgaaagttggagaacacctaaattctatccctttttcatagaatttcaaatacttcataaaggccaagaggaaaaactgcctctacatgtaaactagcaaaataatcagaaaaactaaaaagagaggcaaaaggtgttgtgactctatctcatgggcattatgcagtaattattcgtttttgctaatccaagtatttcttaatttaagagatgaggtctcattctggcactcaggctggagtacagtggcatgatcatagttcactgcagcctcgaattcctgggttcaagtgatcctcccacctcagtagctgggactacaggcatgcaacaccacacccagcttttttcttcctaattttaaactaacatattctacatttacatttatatcctaggcagaagtagaactccctctacatttatattcggtaagataatttagtaagatcaaaatgactagaagtaaaaaattgggcaaaatattcttttggtagctatatctgagatctcaagtaccttctttggaatatattcattaatagccagaccttcaggtgaggaaaatcacataccagaaaggcagcataagaaccaacagctgacacccgtaatcccagcactttgggaggccaaggcagatcacctgaggtcaggagttcaagacaaacatggcaaaaccccatctctactaaaaatacgaaaattagccaggcacaatggtgggcgcctataatcctagctactcaggaggctgcagcacaagaatcgcttgagcctgggaggtggaagttgcagtgagtagagatcgtgccactacactccagcctgggcaacagagctagactctatctccaaaaaaagacaaaaacaaaaacaaaaaacagaaaaaaagaaccaacaggtgaaaggataaattgtgcagtgtgttaaagtggtatctggaaaaacttatgtttctggatgactatcacatctaagctctgacgataggtattcttaaaatctaaaactgtatcctgattagacataataaagaatgagaccaaaacaaaacttctgaacatctcctcatgacttaagttgctatttgctatttgctattttcttccaagcatcagaatggatcggactggtacttttctcaaaataagaaaggtaatcagattagatcatgagcttcctattacacaacaggacaacaaaaaatttaagaaacagaattttgtatagtataatttatttaaaacacatgcatgtaagaatactatatattttctatgagtacatttatatgtatgtgaaagtagaatgaaaagttagtaaggacagcctcaaaactctcagaagtgattttctttagagaaagggcattgtgggaagtgattaaagagaatcaaaatttcatttgcaacactcaaacacagaatttgagatgatgccttcctattaacttcccaaaccacagaatataatttaagtataaagcatgagaactgtattcctccttgaagacactaggtacaccatgaaaccacaacttaaacttctatggttaatctttccaggtatctgtcttataggctacatttcaaatatactatcaaatattctaaaataaatgattcttaaaagataactgaatgaatagatcccaaaactggcttgccaattttggataaaatcaaaatacaaaatttctttggaaagccaaagaaaatttatctaagaaaaatgcttaagtcattgaacatgacttaaaaccaaatttcactcttgcctttcagttccctaggttaggagcagtcaaaaagtgcattctattttagtgaagcaggtctgcttacatgttcaaccagattttttcaaagatactaataaatttctgagacttctgaataaggctgtaatgcaatagctgttaataaggagataaggctttcttaaaatagctaatgtttcctaggattttaaatccctgactacagaaggaaagaaatgacttcagaatacaaaaaagaggttactgtggcaatgtagtttaaaatgcaagacagcaagcagcctgataattggtttgtagatgtccagaagttctgatcatttcaacaatgttttgtctgctgatctacatgtagtacataaaaatcaagtgtgtagacctcggttttctagacattagggatatcttctaagtagtgaaaacattaattgtaagtcactaagtgaggtatttacatgctaaaaactattttttataaggtactatgacctcaattagaatactaataaatctgtaatccattacttaagtttttaaatagaaaagtattttataattgtttttaggtaataatcactagctaaaactcaagttacctcacattccatccgcagtaatgcaccaagtaaaggacctctccaccttcgacatcagaatctttaatactagcttcatacattttttgatttttccctcgtccataccgcacttggactttcatgcctggtggatagcactcaaactcctcttcctcattgttgtcatcatcatcttcatcctcttcttcttcttcctcctcctcctcctcttctgcttcttcatcatcttcatcttcttctttattcgtttcatctcttgaaaggtttaaaaaattgcagagttaataaaagacacttcataagtttttcagttccaaaccacatatattgataaaagttgtggctgtgattgttccaggaaaagcaggttccacgtgtatgaaattctcagagtttcattttactattaaaaactaaaactgtaagacaaccaaggttacagaaagacacatttagagaaaatgaagattcaaaaataagtgcagtaaaagaaaatttccaaaagtcagaagaacagaatttgtgccgaacagcaagaagcaagtatggtcaactctaacaattttttcatgttttattaataaaagtgttttaacatctcaattgacaaaaaaattcattatacttcattgccattttacaactaaaaattatttttcattcaaatatttccagcctcaagatgtttgtttcatttttttagagacagagtcttgctctgtcacccaagctggaggcctcaggaagtttgaaacaataatttttactagcagatggcagtcttaataactttaaaacattctccaaccgaattttcaaatgttataataactgaaatactattttaatttaaacagaaatattctaataatgtactaccaatatcttatcatgtttgttctttcctttaaacttcaacacaatttctactctcattaccacagatttattaacatcttctacaaatcttctcaactttgatgttccaaagaaatagacagatgagaggccaattacaagtatatgaaactaaaagtcaaactattctagaaagagtattacatccttttttttttttttttttttgatagattttcactcctgtcgcccaggctggagtggtgcaatggcgcaatctcggctcactgcaacctccgcctcccaggttcaagcgattctcctgcctcagcctcccaagtagctgggattacaggcacccaccaccacacccagctaattttttttgtatttttagtagtgacagggtttcaccatgttggtcaggctggtctcaaactcctgacctcaggtgatccacccaccgtggcctcccaaagtgctgggattacagccgtgagccaccacacctggccttacacccatttttatcttcttagtaccatgtactttctaaaactgagcattcatatcctttttatattgaccaccaatctgtattcaacaagttggagaaaatcttcaatcataaatctttccaaacactagatttattttttaaaaaatttcaatatgaaatccaaggctacatttagtctggttttatttgctgtcctgtatgtctgtacttaaagactccatcactttagggctcacaaatgactaaacatcataaggcagaacaaccagatagtttagtatttaagctttaaaaattaataatatgtaaaatacatgatatattaaaatatatgctatattatatattaagagtaatgattatatatatacatatattacaccatgcacacatatatatgtgtgtgtgtgtgtgtgtgtgtgtgtgtgtgtatatatttttcccccccttggagacatggtctcactgtgtcatccaggttggagtgaagtggcctgatcactgctcactgtggtcttgacttcctgtgctcaaatgatcctcccacctcagcatcccaagtagctgggactacaggcacacaccaccacacccagatagttttttattttttatttttgtagagacaggggtctcactatgttgtttaggctggtcttgaactcccgggctcaagcaatcttcatactttggccttccaaagtgctgggattataggtgtgagccactgtgcccacctgatgaatataatatttatattaaaaaaaaaacttcctccactgaaaatttcagctttatatctctatatgcaacctttttagggataatatactttatcattcctaattaattatacaggcaacaaaaataatatataaatagtgatataagcagcactataatgcttttttattctccttgtccttttgtatagtggggcaggagtgttggcaggatgtttaatggaccggtggaagtaagtccgtgttcacgaaagtatcaaatatatcaattttgtctgaactataacacaaattcctcaaaaattctcaagatttattcctattttaaagactcagttacagtcaaatatataagtatttaaaaaatctaaaaccttcatgaaaccagctataatctgagatatacatatatatgtatacacacacacacacacacacacatatatacgtgtatatatatatactttttttttgagacagagtctcgctctgttgcccaggctggagtacagtggcgtgatctcagctcactgcaacctccgtctcccaggttcaaccaattctcctgcttcagcttcccaataagctgggactacatgccactacgctctgctgattttttgtatttttagtagagatggggtttcaccatgttggccaggctggtctcgaactcctgacctcaggtgatccgcctgcctgggcctcccgaagtgcagggattacaggcatgagccaccgcacccagcctgagattaaaatattaacaatgttattgaaaataatatttctattataaaaaagtaattttattaaggctaaaatatcaaaaaaattaacagaaatgggattatcaatgataaattattatgaggaattttattttatatagtaaattaaaacaatttttttttgaaagaatacttgcctaagtcataagactctatctttgcatagtggggaaaagaagcatattttattgtggccacaataaaagagatttatcatgcacctcagaatcatcatataaaaatgagatatagaatcaaaattctaaattttttgaaatgacgacaaactccaagctgtatcttacatcatagaatacactgagttgatgaatacaaacaattctaaatgccaacagcaagcacaatcatactttaagtagtagcccaggcaaattttcattcaatctacaacaaaaacccaacactcttttattaatgaaatcaagcaatcaaaaattaaaaatatacatttaatatcaccctcagacacaaaccaaatgaaattcactttaataatacactgaagtataaagaaaaaaacaacataattactggcaatcaaccaaagaaaactattctactctctaagacttcagtggcaaattcaagactaatgtgctaaaccagatggaacacagaatgccaagaaagagagcctctgaaagtataaaatgcaaccaacatacatacaggttaaaaaaaattaagttgatgcatacactacatacatgcactcatatacatacatacactcacatacatacatacatacatacacacacatatgcatttaagctagtcatattttagagaagaatatcttgggaaacgaaatgtatcagcaaggattttcatctgaattcacaaagaaatatcaaatcttccctacttgatattacactctttacaatgaaacaaaaattttaaaaaagatagtgtattaagtacgtgctatggccaaggcactgaactagacattttacatatatcaacttcttcaatctcccacatctggacaatggaagaaggacactgaacattcttggtagtagcctattacttagagaaagtttatatgccagaaaaatacctatatattaattatcactgtaaaattttccactgcaattatctaataaaactcaaaaatcaattacagtaagcccctcttatctgcaagggatacagtccaagatccccagtggatgcctgaaaccgtggatagtaccaaaccttatatatactgtgttttttcctatacatacatacctctgataaagtttaatttattaataaggcacagcatgagataagcaatgactaataacaaagcaattataatatgctataataacagttatgtgaatatggtcttgtctcactctctcaaaatattttattgcactgtactcacctgttttcagaccacagttgaccacaggtaactgaaactgtggaaaagcagggagtactatataaacagtcccaactgcaatgcttctaaaaaatatctaccaaactagggcagtcacatcaggaaaattttagtttgaggtacgcatatactaataaatatctgtagtacataaaaatccatataattatacagttaaaggggttgttaaaaacctacaaaatacagtttattctataaaataagcagaagcaccaacttaaaaaattagcaaagaaaaaaatacagatttatcacagtgccttgcaaacagcagatgttccagaaacatctgcagatttaaaaatcagattttttggtaaaaagctgaatctttattaagattcttatcaaaatgatctcctttagcagtactttaaacatacacttctacacatagaaatataacaaagtataatcaacaaacacttttactacattcttctaaacccaggatgtttttcttccatgtttgtatggtgccaccaaaatttcagaactctgatcaatcaaaagattttaggcaaaaagctgaaatctttactgtttcttaatacttgaaatagtctccaacagcagtaaggcatacttcaaatatatatttttatacacaaaaatacaacaaagtataataaacattttttactatattcatataagccccattttttattttccccttccctgttcgtctgcatactgtggccaaatgtcagtacgctaaatgatttttttttttttttttttgagacagagtctcactcgatcccccaagctggcctacagtggtacgatctcagctcactgcaacctctgcctccagggttcaagagattctcctgcctcaccctcctgagtagctgggattatgggcacatgtcaccacgcctgacttctttgtatttttagaagagacagggtttcggtatgttggccaggctggtcttgaaatcccgacatcaagtgatctgcccgccccggtctcccaaaagtgctgggattacaggcgtgaaccaccgcacctggcctgctaaatgattttttttttaattcattgtacttatttaaatgagacactaacagatatgtttatgttttttaagcctcagaaaaaagattcaatgccaaagattatctataaaatccaggggtccactagcagtgcataaattacattgtcaaataattcatcattccaagtgactaaaacaaacaaatgctactatcacataaaatagaacatacaatttttggccttttaaaactttagtatttttccactcttgcttttgcttaagaaataaatacaactctcagaatctatagccaacatacaatatataaaacatggacatagccccaagtttatattatcaagtaattcagcagacctaaaaagtactttgctctagctaaaaattttatcaatttccatgatgagagcaagaagggtggatcaaagtatgatctttctctacaaatttctatcagtagggtctctgaaagaagtgaatgctatttaattaataaatgccaatcactctattatttaatattttgtcaattaatttagattcatacataaacacatacaaagagcaaatgataagaatccatcaagctgaaatgcatcgtaaccaaaaacaattttcttacccagattttgctttttcttcctcagcttctacctttatgttgagggattcatctaccctagttgtgtcatcatctttgtcatccagattttcattgtcttctggttttttaatgttaacttctttttcctgatcagaatgtgtaggtatagattctaataaattctttttacttccctagaaaaagatcagaggaaagaaaccaacaaaagtaaaaattttcaacctatatccatggtttatctcttagcaacaggaggtatcaaccaattctaatattaaaagttataaattacttttaagaaactcctgctactttaaagctctagacaaaaatagctaacagctattttgaagttatgataaaaattatacaaaagtagcacttaatgaagaaaataaacaaataataaagaataatattatacaatatattgattttggaactttatagaggatatggaaaatataccaaagaaagcaaaagacaattaacaatatctgatttaccagagagggcttaatattttcttttctttcaatttcatcctcaataggcttttcttctcttggtattatattcctctcctcctccatctttatttctttgatctctgtttcattttcctccttaacttttatttcttttacattttcacactccttacattgcttgttaacaactttctctggcaatgccatctgaaattcaatgttggctgatctacagtactcctcaaaaccatataagtatctggaaacatgaagagaaattacatttggtgaaaacatttcaaaatataactatagagttatttttaatgtgtattcatttcttttgtctaaactctcagatattgagccatattaacattctaatttattctagttctttctaatcttttcaatgcaaaaaaaaaattttgtcaaaaaattcatttaaaacactgtgctcagagtcataacaataacagctattaaaagtattagtaatagcatctattttttgcacatttcttatgtgtgaggctggactccttagtaaatctcatttagtcactacagtaaccctggggcacacagcagcatcctttttttgtttttttttgtttttttttgtttttttgagacagccttactctgttgcccaggctgaagtgcagtggcgcaatctcagctcactataacctccgcctcctgggttcaagcaattctcctgcctcagcctcctgagtagctgggactacaggcgttagccactatgctcaggtaatttttgtatttttagtggagacaaggtttcgccatgctggccaggctggtcttgaactcctgacctcaagtgatctgcccgcctcggcctcccaaagtgctgaagttacaggcatgagccaccgtgcctggccaagcattccattttacaaatgaagaaactgaggcttaggagaataaataactggccctagggcataaacagttaataattggcagaactaggattcaaatgtggatttacttgacttcagaatattagctttttaacctctatgaagtacttgacaaatgtacttagccacaaaaactttcttcacagaatttctcatagatctagtatcatagaatacactttagaaaatactatcatagaatgactactctagtaaaatgttctgatttctttaaagaaataattaacctcagttataaggtaaatttcatcctgctttctaggtaaaaatactgaagataatcatatcaattatactaacttactttttataagcacatttaacattgtatcctgcagctgaatttaagacagggattccaagatcttggtagacttgtttccaaacagctccactttcaatctaatggacaaagtgaaacaaaaactctcaaattaaaaggtgttaatataataacattttgatagacacagtatatatgagtatatttttatatttattggtcctagactcaaaagaatttttaaaaacttgataaattctaaatttggtttaaaaataaaggttttagtactctaacaaatatcagaaaattataaatgttgaaatattaagtcatttgactattttttttttttttttttttttttttttttttttggagacaggatcttattctattgcctaggctaaagtgcagcaacagtggcacaaacacagctcactgcagccctgaacttccgggctcaagggatcttcctgactcaacaacccaagtagctgggactatagatgcacaccaccacacctggctaattaaaaaattttttttgtggagatggagtctcaccatgttgcccaggcgggtctcaaagtcctgggctccagcaatcccctggccttagcctcccaaagtgctgagattacaggcatgagtcaccataactggccccatttgacttttaaataaacccagttatggaaaatggaaaaatattcaggctcttaaatcaaaatttttaacaaagaaatggagacaaacatttttaaaggatttattatttcgcataaaatatacaggctaataaatgcagttctgcagaaatttgtaaagtattttattccatagaatattctcaattggataagtatcgtacatcacgtcaaccttaaaataatttcttcagatcagttcaacaaacatttcctgctttaatccctttatattctgaaagggattaagaatatacagaatattaagacagatccctgctcttaaggagcatactgtctaatgaaaaagagacacaggaaggatttccaccaatatggctgtgctgtgactcagataaaaaaagaaggtttatgaaagattgaccaatttaacagtaatcagaaagctgatatgaaaaaaaatctttttttttttttttttgagacagagtctcattctgtcacgcaggctggaatgcagtccagcggtgcaatcttggttcactgtaatctctgtctcctgggttcaagcgattctcgtgcctcagcctgccatgtagctgggattacaagcgtgcgtcaccacgtctggctgatttttgtattctttgtagagatggggttttgctatgttggccaggctgttcttgaactcctggcctaaagtgatctacccgcctcagcctcccaaagtgttggggttgcaggcatgagccaccatgcctggcctaaaaaatctttaaaatttaaattttgtctgaggaggctagctgtactttccactttatcttcttcttaggtttttactgaaaaactttgttttgttgtttagaaaaacaatttcagagatggcagatacctgagaaaacatgttacatgaaaaagatgtttcagtttgactacaacactcacattatcaaatcctccaagtttgtgtacaagtctgaataacttaaagagattcaaatttcgatatccaagtacaggtcgtttgttaataggtgtacctgttacagaaaacacaaactatattagatccacactacatttttaatttaaaatttcaaaagattcaaataatacaagtatttatagtattttatatatatatacacgtatatatatatatacacgtatatatatgtgtgtgtatatatacatatatatgtatatatatatatgagaaattatcttgttaatcaaagacatggtatctacacataaataagcccatggccactttaaaattttttaaattttaaaaaccataaccagattcttgaaaccttttattttcattctactttcttccctctgctgagggaagaaatactagataactgcttcccaataagagttacttttatggcattttctttgtattttaccaatttactactactctaaataatgattctatagtaaagctacatttttttttttttttcattctaacacaagaaaacgcaaggcaaggatgctaaatcaaacaaaccatgagaaagtggtagaggaggtaacagggtaggggtacaatgcctcatatggccatttctacaaaatatatgactggcttaatcatattttttcattcttttctagtattagattttattcattttctttgctttttcatttatcttatacaagagcctatgaaacagcatacttcttaggccaaccctccattcatgtaaagaaataatacaagaatcaaagacattttatattgaaaaagaaaatatacttatattgtgttaggcgttgttatcatttatgaaaactaaacatgacaaacagagtcagtttctactcatcagcattacaatcagggatttagaaaacgttcaattcccagagtattgtggtgtttccaaacactaatcattcattttgcccttcccttccagctagaaagcctctccttactcccttacaagcatcttcccagaaaagaagaaagtagactctgaccaagaagataagctagagaataacagtgttgaggttacggaaggattagttcattaccctaagttattcttcttccttcaatccttccgtggccttagcagcttctggcagattaaataagctgagccaaggctcacttttgagactttgtcacacttctttatctatttctggcttaattcccattttgctactgttctttagggacccatggataggtaaagggattggcaggacagggtaataagtgcatttatgtgtccatagccacaatatctgtcaaaatgctatcaaattcctcattctacttgttacgtgacaggcgctatgctaggtgctggtgatatcagagtcaaaaagacagccataattactgatgacataaagttcagtaaacaaaattctattcttatttttaagatactaattatctgtccaaaacttaccacgttaatgataaataaaaaatactcacctctatcttccataaatttgtacaattgctgaagaaagttctccctttcttctggaaatggttctatttcttcctaattttaatcacagaagaatattattttcttcaattaagcattttaataaaacaagcagatttcttaccaatagcaaagactagtgttcattaaaatacttcaaaggctttttacgtaatcaaagttactcttttaacactaagctgttcaaaaccaggtaagtctagacattttatgttttatagaggaatatgccttaaaaagtatcccaatagttagaatccccacagtaaaaattcccatatgagaaaagggactagcaagactgttcgtggttttgttttgttttgttttgttttttttaccatatgagagagctatttttcaaatcaggatcacaggttcaagaatacctactctcaacttatgcgaaactggatcagagttaaacatcaaaactaattctattattgctcctcaaggtactataaaagtatgggtcccattagctgactgcaagtatccttcattttatgcagccccactgtatatacttcaagcttacataatcagtaaagtggggaacaaatttgatctacaatacctgaagattcagacttagggaaatcttcaagtaataaaatagttccccaatttatcaattacaagggaaggactagcttcttgctgctgtggccaagggctgtggcagcagggagctggtcctgaagcaacctgcaaggagcagggtagtaggttaagattgaggaactcaccaattcaatgactttcatccattcaacaaacacttgagcacctgtaagtgtaggtactatgccaggtgctgaatcaaataaaagaaaaaataggctatggagcctactgttacagaacatgattaggagtaactgcagagaaaatgattccaaatatacagctaggctttacagttactctggcttaaatatacagatttgtaacagtaaaagttaggatattcaactggtaatctaaataaataaaaacatagcatttttcaatttggaaaatcatgtgcctaatgccactgctttagcgagattgtctttttaatttaaaagctagtacaacaaagaaaggtaattttttttttaaagcctatgttgatcaactattaggttttctaattgggcagagaaaaataaatgacaaccattaatttgctaatgatgaatctgtatttctcaatttaaacacactccatacattcaggttttggtaaggtgatcaaatacaaatctaaggacatctattttctagatgttatcttaaatgttcccatggtacaatatttaactttaataaacagcacaatttttcctattccaaaaacatttaaggtaagcttttaactcaagaaaatgtttacactacactacagatttgcttttacaaaaacacttgtgaaaacactaagcaccaaaaggtttggtagctatttatcatctgttatattttacacactatgacagacactttaagtatgaatacgagtaagacagcattcctaactttaaggaacttacaaattcgtggggaagaaaaaatagacaataaatataaatgacaaaaatatgtataaggagcagtagtaattctttttttgttttgtcttgtttttgagacagagtcttgctctgtcgcccaggctggagtgcagtggtgtcatctcggctcactgcaacctccgcttcctgggttcaagcaatcctgctgcctcagcctccctagtagctgggataacaggcacctgccaccacgcccagctaatttttttttttttagatggagtctggctctgtcacccaggctggagtgcagtggcgtgatctcggctcactgcaagctccgcctcccgggttgacaccattctcctgcctcagcctcctgagtagctgggactacaggcgtccaccaccatgcccggctaattttttggtgtttttagtagagacagggtttcaccatgttagccaggatggtctcgatctcctgacctcaggtgatctgcctgccttggcctcccaaagtgctgggattacaggcgtgagccaccgcgcccagccacacccagctaatttttgtatttttagtacagacggggtttcaccatgttggccagactggtctcaaactcctgacctcaggtgatccgctagcgtcagcttcccaaagtgctgggattacaggcatgacccaccgtgcctgccaggagcagtagtagtttagactagcaaatgaactggtgctttcctgaggtgagggaggtgatggttcacaggtttctctttagagagatggcacctaagtagggttctgaaaattgaacaggaatgtaccatgctgactaaggaaggaggggaggaaaaggtggtgcctacagaggtactagcatatgcaaaggtgagtagcagcaacatatgtaatttgacattgctatagcataaagttcaagggggaggacacagaaagggaaatgatgagaaaaaattgaggcaggaattggactataaaggagattctatatgaaagcttaacttttacagtgacaaaaagctactcaggaggtttttagcagcaagggaatgattgctgattttagcaatttaaatagaaagcagtcagggagaagactgaagcagggaaatttctacattatacattgtcattacagatcactacaccctaaaatataacctccaaaacaatctcatttcattaatactttactacagttaaaaggcagaatttcataacttacctaaagtattacatactgaccaattaatttactaaacacattaaatacatttcatttcatggtcaaatatagcagccttcactatctgcaccactcattaacttttacgaggctgttcagcaaaccattaaagagtaccttgtcactgccagatctaaagctccaggtaaaataaaatccaaaatttgagctctttgagccatattttatggcttatttatgatctaatcagaactatctacccatttgtcttagataaaatgattcaagattctctgaatcaaagagatattgatctttacttttctgctattttttttttttttttttttgagacggggtctcctactgtcacccgggctggagaacaatggcgcaatctcagctcactgcaagctccgcctcccgggttcaagcaattctactgcctcagcctcccgagtagctgggattacaggtgtccaccaccacacctggctaattattttgtatttttagtaagagacggggtttcaccatgttagccaagctggcctcgaactcctgatctcatgatctgcccgcctcggcctcacagagtgctaggattagtcatcccagcatgagccacagtacccggcctgatttttcttttaaatattaaatgaaagatgtattttatacttttctgggttaatcaataaaatatggagatgtaagcatttcatgaggtgacagctgtcaacatggtaatgaaaagcattttaaagaattaggtaggtaggttctttttttttttttttttttttttttaataagacagggtctcactctgtcacccaggatgtagggcagtggtaaattcacggctcattgcaacctccacctccagggctcaggccgtcctcccaacacagcctcctcagtagctggggctactgagtgcactggggctggagtgcactgacatgccctgctaattatttttatttttatttttgttgagatggggtttcaccatgttgcccagtctggtctcaaactcctgagttcaagttagccacctgccttgccctcccaaagtgctacgattatggtcgtgagtcaccgtgcctggcctagatggtaagtttttttgtttttgttctcgttttttttttttttttgagacagagtctcgctctgtcgcccaggctggagtgcagtggcgcgatcttggctcactgcaagctccgtctctcggtttcatgccattctcctgcctcagcctaccgagtagctgggactacaggtgcccaccaccacccccggctaattttttgtatttttagtaaagacggggtttcgctgtgttagccaggatggtctcgatctcctgacctcgtgatccgcctgccttggcctcccaaagtgctgggattacaggcctgagccactgcgcccagcctggtggatactttcttaatcatctcattaaaaaaagcataggaagactaagacatgtttttgaggttattaggaaaatcaggcttaatattttctatttcacaagatcatatatctaaagtaaccaagtaaactatctgattatgaggatctcaaatacaagattatgaaatatttctcatactaaaaatacttatatgagtaatgacttaatgccaaatcctaacccacaagggaaacccaactgttatttataattttaaaaggtatcaactgttttcacttacttcttcttcactgctattatcctccttttctttttcatcatcttcctcctcctcttcttcctctgcttcactgctagagctatcttctttcaattcagtcttccagttagcaggaatagttctacttttgtgaaattcaagtgcctgttcaaaggctggaaacagaccacaaggtacatgaactgaagaaattaagacaattgttttctcaaaaagtattaaacacgataaagaaataaaaactactgtgctaataccactgacatttattgtttgctatgtaccagaaactgtgttaagtgcttttaaatgtagcaatatatttaatcctatccatcctatgcattaggtagtcattttatagatggcaaaactgccaccattggaagattacttaagtttaaataaataaaagaacagcagttttattcttttaaacaaagattaagcttcactagtaaaaacctttaatacaggaaatcatgtaatatcttatgcaacaaacaattatcaaacagtattaataccaggcacagagccattaaaataaatatacaatacctgaaaactgaccacacatgatttttacattttcagttgaacttcaattaaaactatggtaacaattaccttcaactaaaattagctagacacaattattctcattttataatatatgggaataaattatataccaaaaaatcttgatgattttaaccaatctacatagcatattactgaattcaaggaataagggcaaagagaagacaactatttacagtgccaaaaatcaagtgacagatgcaattaccacatattcctcaaataaaactactggagccttgtggttaaggatgtacattcattagtgagaaataccaaaccaaaattactttgattcctcagtcaggcgtgatggcttatgcctgtaatcccagcacttaggaggccaaggcgggtggactgcctgagctcaggagtttgataccagcctggtcaatggtgaaactctgtctctactaaaaacacaaaaattagccgggcatagtggtgggcccctatagtcccagctacttgggagactgaggcaggacaatcgcttgaacccgggaggtggagggtgcaccgagattgtaccactgcactgcaacctgggcgacagagcaagactccatctcaaaaaaacaaaacaaaacaaaacaaaacaaaacaaaaaaaacaacaacacaaagttactttgattcctttcttctaccattcccagaaactaatattttatttaccaggcaaaagctagattatagtaacagctgactacacagttctctcccattattctagattattatgcctgactataagctaaaaaaaaaaaaaaaaaaaaaaccagaaaaaaaaaggaaacctatggttgggcgcagtggctcacacctgtaatcctagcacttcgggaggctgaggcaggtggactgcctgagctcaggagttcgagaccggcctgggcaacacggtgaaaccccagctctattaaaataacaaaaaattagccgggcatggcggcgtgtgcctgtagtcccagttactcgggaggctgaggcaagagaattgcttgaacccaggaggcagaggttgcagtgagccgagattgcgccactccaccctgggcgacagagcaagactctgtctccaaaaaaaaaaaagaaaaggaaacttataacacagaagacacatgggtttataaaaataaaggtcacaaggaaccaaatataaccataaaaacataatttaaagaaaaattttaaagagcaaagaaaaatttaatcttcaaaaacactttagcagtttttacagtacttgtaatttattccaagattatccttaccttgctttaaaacagcatcaggctttggtgcagtgtcactagtaatttcatggacatcttttcttggaactgaagtactatatattttttttaattataagagaagaaaaaaaacccaaaatatgactgagattaattaagaatccagatgattacatatcacagaaagatactgaaaatatgggaatgttgacgtttacaataaaagtgattgcacacagagtagcaagtcagaaataacatacaagacaggatgttaaaatacgtaatcatctacagaaggatcctaccataagagctattttataaacaccaacgtgttcccaaataccagagtcccctgcccaaatgcaacactgaaaactttttttgttttgttttgttttgtttttgagacagggtctcactctgtcatccagactggagtgcagtggcacaatcttggctcaccacaacctctacctcccaggctcaagcgattcttctgcctcaacctcccgagtagctgggattacaggcacatgccactaccacccggctaatttttgtatttttagtagagacagggtttcaccatgttggacaggttggtcttgaactcctaacctcaactgatccacccacctcagtctcccaaagtactgggattataggcatgagccaccacacccggccaaaaacgatttatggcaatataatgataaaatgtttggggccagccatggtgattcatgcctgtaatcccaacactttgggaggtcaaggtgggaggactgcttcatgccaaagttcaagaccaggataggtaatatagcgagacccagtctccacagacaaactaaaaaagtaagcaaagaattagccaggagtggtggcatgtgcctgtagtcccagctacttgggagtctgaggcagggagctgactggaaaaaacccagggcagggttacagtgagctatgatcgtgccactgcactctagcgtaggcaacagagcaagatcccatctcttaaaaaataaaggttgagctgagtgcagtggttcacaactgtaatcccagcactttgggaagctgaggcgagtggatcacctggggtcaggagttcaagaccagcctgaccaacatggtgaaaccccatctctattaaaaatataaaaattagctgggtgtggtggtgcatgcctgtagtcccagctactcgagaggctgaggcaggagaatcgcttgaacctgggaggcggaggttgcagtgagctgagattgcgccattgcactccagcctgggcaacaagagtgaaactccatctcaaaaaaaagtaaataaaataaaataaataaataaataaaggttggacacagtggctgacaactgtaatcccaacactttgggggccaaagtgggcagatcacttgaactcaggagttcaagaccagcctgggcaacatggcaaaaaaaaaaaaccctacaaaaatttgccgagcgtggtggcacacacctgtagtgctagctacttgggaggctgccagaatactagttaccacactgtacatcagatcctgtacattttattcatcttaccaataaaagtttgtgccgttttactaacgttttcccattttccttaccccccaacaatttaatattaagtcaatattcaatttctgtgctcaaattcctctgattatcccaattttgttaaagttggttctacatttttttttgttttgttttgttttgttttgagatggaatcttgttgttgtcacccaggctggagtgcaatggcattatttctgctcacggcaccctccatctcccaggttcaagcgattctcctgcctcagcctccctagtagctggaattacaggcgcccaccaccatgcctggctaatttttgtatttttagtagagacggagttttgccatgttagccaggctggtcttgcactcctgacctcatgatcccacctgcctaggcctcccaaagtgctgggattacaggcgtgagccaccgcgcccagcctacatactgtttttgaagctaacttttcagactgggtgcagaggctcacgcctgtaatctcagcattttgggaggccagggcatttggatcgcttgagctgaggagttcgagaccagcctggccaacatggtgaaaccttatcactacaaaaaatacaaaaatagccaggtgtagtcccagctactcaagagaaattgaggtgaaaggataacctgagcccaaagggtcatggctgcagtgagccatgatcatgtcactgcactccagcctgggtgaaagagtgagaccctcaccaaaaaaatgaaataaagtaaaataaaataattaaaaataaaaatacctttcccgaacttgaaaattcaaacatcaaatcttaaaacatgatgacctttttaaggtatttatacccaatacaattctgtataaaatatctggcttctctagtcatataattcttaaagaaaaattaacaaatcattttcttaacacttaccatccatatacaagtaacccattttaatcctcagactactgcaaaagttgagtattatccaacaggtatcactataaccattagacataactagtagaagtattggaaattcctaattagaccatcaagaacaaaccctaaggaaataatgtcaataaatacatcaataggccgggcgcgatggctcacgcctataatcccagcactttggggttcgaggcgggcagatcacgagatcaggagttcgagaccagcctggacaacacagtgaatccccgtctctattaaaaatataaaaattagctgggtgcggtggcatgcacctatagtcccagctactcaggaggctgaggcaggagaatagcttgaacccaggaggcagaggttgcagtgagccgaaactgcaccactgcactccagcctgggtgacagagtgagactccgtctcaaaaaaaacaaaaaaatcaataaagtattaaatacattagatatggcaaatttgcctcaaataaccagctattatgtggacaagtgttgacaaattagacagtactgagtgtctagtttggaaaagattaccaaaattagtaaggaaaaacatactataagactacaacacattaagataatatgaaaaacagtgactctttgaaacattctgtatgatgaaaaataaaagcctaaggtaattggaaataactaattaatcatttaacatcctaattcaaaataacagcatatatttataaactggtttttcaaaccaagtaaattatacttacaattttccatctttgaaagatcgaacaagaatattgtccttttttacagcaatctcatcactacaatcaggacaaaccaccttttaagaaaaagggtgaagctattataactaaaagaactcatagataggtaagtacccaccatttaaatccttttaaaaagtgtaagcttgaagtttaaaaactaattttagtttgagggtaaacaggcacacacacacacgtgggagcacacacaagcaattttaaattggcatcctacatccttccagctgctggataatctagaatttttggcataggcaaggcattgaaagcagaagcacagctatgactaggatgaagctgtggacgaagttctagtcagaaacagaaaaaaggtagagttagatccttaactgaagggatacatcatggctaagaaaaaaacaagggtccagaatttccagagccttgtaggccatattaattcttaggataaaatctaacatctttgttgaaagaatctgaaaccaaagaatgtcataatagattttccttttaaaaatctactttggctgctatgaagaaaatggaccacgcagaggcaactgttcaaagaaactaagctactgtgatcacctgagtgagaggtggtggcttggatgtaaagtggtggcaatggcaaattaaaggaatgagaaatatccaagataattagggaagtagaaagatgaacaataagaggatgcttagttttctgccttgtacaaataggcagatgacagagttattcactgtgaaagaaaaacaacaaaaaagggccaagtttgtgcatgagggaagggataataagaggagttttgggactactaagttttaggtggctaaaagacatccaaatgaagacagtgaacagaaaaatcaggtctggagcaaagcgtagaggtctggactcaaggatataaatttgagagcccacagcctaaatattaggggtctaaaacttggggcttgtgagccaaatccactcattacttttccctgatgagcgaaggatttcgaaaactgcacatgtgatagctttggccagtgatgacactggtgtatgagtaagtgggctcactgtccagttctgccacagaacgacaatatgcattttatcccattcacccatgtatgttattttcttggtcactttatctctttgctatctctgcaaggtgaagctttaaaaggagatgagatcaccgtaaagaaaatacagcgatacattctgaatcctgaattacagcttgaaagggtgattagaagaggagaacctggtgaaaaaaactgaaaaggagaactgcatgagccatggaatctaagatttccccctcttaaaatgaaattggaaaataaaaaattgagactgagagtaagtctcaattaggattaaacaatactacttatattaataagctcagcacagtcctagtcagggtaaatactcagtgcatggtagttatttatagttcctgggactatgtagttgtttcctttttctttttctttttttttttttgagacaaggtctcactctgtgcagtggcgtgatcacgactcaatgcagcctcaacctcccagggttcaatcgatcctcccacctcagtctcccaagtagctgggactacaggcacaggccacccagacccagttaactgttttcttatgatgttactaaaacactttgaatttactcgatttataaaaataacataaattagaaacacaaatactatttgtgcgattatatcaagattggtcgatttagaacataatttttcactctagttaccaaaaactatccatcaccgtccaatggatctcaattttgggaggagataacatacatcaataattctaagaatttaaaaacaacagtgaaatggctgactaaacagattactaacctttcaatattaaaaatccttagatttttcattttcgtcaaagaaactttttagtgattatggtgtgagaagcttaaattaataactcaaaacactaatattaaaaaatttaatgttcctattgagaaaaagacttacaaaacagttgtgtgtgtgtgtgtgtgtgtgtgtgtgtgtgtgtgtttgagatggggtcttgctctgtcactcaggctggagtgctgtggcacggtctcagctcactgcaacctccacctcccgtgttcaagcaattctcctgcctcagcctcccaagtagctgggattataggctcccgccaccatgctcggctaatttttgtattttagtaaagatagggtttcaccatgttggccaggctggtcttgaactcctgacctcaagtgatctgcccacctcggcctcccaaagtgctgggattacaggtgtgagccgccgcgcctggcccacaaaacggttttataaaaaatatatatatatatatatatatatatatatttttttttttttttttttttttttttgagataaaagtcttgctctgtcacccaggctggaatgcagtggtgtgatctcagatcactgcagcctccgcctcccaggttcaagcgattctcctgcctcagcctcccgagtagctgggactataagcacgcaccaccatgtcctgcaaatttttccatttttagtacagaaggggtttcactatgttggccaggctggtcttgaactcctgacctcaggtgatccgcctgcctcggcctcccaaagtgctgggactgcaggtgtgagccactgcagctggccttaaaacatactttcaaaagaaactcacaaagactcctagtgctttagaaagaaagaaagaatcgcaaacactgatgctttttttcagcttaataattaacccaaagtgtggcaactaacttaaccctgctaatactcagtttccttatctctacatcgggataaataataatacctatctcataataggtgttagcacactccttgtacatataggtatccactaaatgttggatacacaggaaggtacaaaggtattataaaatatttatatttattaaaacaaataattgtcctcatttttcactatcattacaagagctgacatttactgcatatttaatttgtgccgaacactgaactaagcagtggagataaagaaataagacatgttgactaaaaagggtaaatggacatcacaagtagaaaacagtaaaaacaaaggtagttctattgtttctttttcatttgagaccatggttacctagtttagcacaaaaaccacaaatatacaaaagagtttatatatattatggacataagttttcatacaaatacatataaacaaaggacagtgttttaatcccatttctaagtctctgcaattgttagtcaatgagcaggaaaatgagagaatgagaataaagagttagcagattctcaagcacaaattgtagagaaaagtttattaatcatcaccgggtgtgctggctcatgcctgtaatcccaacattttgggaggctgaggcgggcagatcacctgaggtcaggagttggagaccagcctgaccgacatggagaaacgctgtctctactaaaaatacaaaattagccgggcatggtggcttgtcataccagctactcgggaggctgaggcaggaggatcacttgaacctgggaggcggagttgcagtgagccgagatcgcaccattgcactccagcctgggcaacaagggcgaaactccatctcaaaaaaaaaaaaaagaaaagaaaagaaaagaaaaaaggaaagtttattaatcatgagaacaaaaaacctctacaccactaaatgagtctatctttgttaaatattttgaacagaacttggtatatgataaatgcatacctaacaaatatgtgttaatcttgagaacacaaaaattttattgaatgtcattaacataagggaaaaaagcattagaggagaatttggctaattatttttagtaagggagtgagaacatacaaaacagagacagagaataattttgacccattctgtctctcgatatttgagaacaaattagttgtcaaacgtgagaatagtactttcaaagtgtcttttgtttatcagcggatcttcagtttatagcttattaaatatgaagtgaggggaggacatatttgtaaaagatgtgggctgggctcagtagcccccacctgtaatcccagcactctgggaagccaaggtgggaaggtcacttgaatccaggagtttaagactagcctgggcagcatagggagacctcgtatttacaaagtatttaaaaattagccagatgtggtggtctccacctgtagtgtgagctactcaggaggctgaggtgggagaattgttgagcccaggaggtcaaggctgcagcgagtcaggatcacaccactgcactctaacctgggtaacggagtaagcctctgtctccggggaaaaaaaaaaaaagtggatctcactgtttgatgcaaatgactcaatggtcttcagataaaatcatcataggacaattcagacatatcaaaattttaaagagttcaagataattctttttttttcttcttttttttttttttgagagggaatcttgctctgtcgcccacactggagtgcagtggcgcgatcttggctcactgcaacctccgcctcctgggttcaagctattctcctgcctagctgggattacaggcatgtgccaccacagccagctaatttttttgtatttttagtagagacggggttttgccctgttggccaggctggtctcgaactcctgacctcaggggatttgcccacctcggcctcccaaagtgctaggattacaggtgtgagccaccacaccccagccaagataattcttaagagatactgattattaacttcagtctcctacttgaaatttaaaaccttaagtgatttatccaattatatgctgtccagaaaaaaatgcattcttattgccacagagttaaatcttcattaaagtatcatatatagctaattattagttgaacctctatttgctttaagagctacaaattattttgtctaccaaaagattatttgaaaagcagcctagttatgtccgtgaaagatattagtatatgttccctttctaaaagtcaaagaaaatggtctatacatggccctttcaacttgctaaagaagctagtggttacgaaaaacagagagataaaaagctcaaaaggctttctgtcatgtcttaacagtttgaaatacaagaacttgggacaatcatgaggatactcctgataataaatcttgagtacctcctcagaatcacaaaaaggcaacgtgagaaaacaaggaaaaaatgcaaaatattcaacctggaatctaaggaattgcaatcttttggagagaaaaacattaaaaagtaggtagaattaacaatctactgtagagaaaattgaagagtggggtaatgtataattgcagtcatgattatatagggagtacctaaaaggcaagattaagatcaaggatggaaacaccctgattcactaagtatgaggaaaaggtctagttatccctgtcaaccaagaaagattctgttgttcttttgcaatctagacctacatggacttaggagctttaaaagtttgcatcatgaattttctaccgagagagagagaattcaacttccacatagctaaacctctaagattatcaagattttgcctttcctgaatgacatcaagagttctttgtattcaaagacaacgttgaaagtaagcttagtgtgaactaaataatgctaaaaacatttcctcattttgtacctatgaaaaacattagtaagaaaattgttttcttcataaacttataaagtttgaaattaaactcttgtatactgaagctactcaccaatgcaggaaaccacagtgctttctttttatccaaactaatgtaatctacacatacaactttgcctagtagctcatcaatctgtttcctatcatcctcatcttcatcactggaggatgatgaagactcttcctctggtctagggagagaaaaaaataaaatatttccatttatcctcacaaagaataagcatgccaatgatgaatataggtattcccaaactcttattacatttcctaagacctgtaaaatggctaatttaaatcttaaatcattttctaaatttctaaaaaataacagcaagagtttatcatgagaggaaagcacatcattttcccaaaaatatttctggtttatttagtgctactgtaaaaaattgaggaggaagatcaggacaaataactggttcccaaatcctcaaaaaggtgaaggccccatattaaacatcccagtattacactaaaatatacacaatcccaatctcaaattaaaggaattctggagacagtaattctatatctccagtacaaagttaattttaaaaggtaggagagcagacctttattaactgaggttaggttgggaagaggaggcaatctgaaaagagatcaccactgctatccataacaacaaatacacaccaattaggtattcataaaatgtccaataagcctcttttgtatgatgctaaaaactttcaaaattaaaagaaaaacagaaaatcctttcagtaacattaaatattggactagtaaattagaaagataactgtcagaagaaaaaggaagtatctgaaaccatcaacttgatgtttgaggaaagtgtagtaaaaaggaaaacaaaacaaaaagctattccaatttgaatctgattctaataaagaatcagcaccaaagaaaatgcccagaatgagtaaagactaggaaatgtttgatggacaacaacatatgtcctttttagaatggctattattgaatacctacaaagataaaagtgtttttcagatagtttgcaatgatcagtttcactgcccaaaaaaggaaaactgacagattaaactactaaaaaactttaaacatgatttacctatttagtatactatctagtatactctgaagttgtctttgatgcctttccaaaagtatgacaaagtaaccgtcatgcctttatatttatatattccaatataaatgtaaacaaagtgaaaactatttttttcttttttgaggcggagtctagctctgttgccgggctggagtgcagtggcaccaccttggctcactgcaagctccgcctcctgggttcaagcaattctcctgcctcagcctcctgagtagctgggattacaggtgcctgccaccacgcccagctaatttttgtatttttggtagagaaggggtttcaccatgttagccaggatagtctcgatctcctgacctcgtgatccgcccacctcgcctcccaaagtgctgggattataggcgtgagccaccccacctggccaaaaaagtaaaaactattataataatattaagctttttaaagtgacatggggaataccacccccttgatttcaatgatcagtcaaataacttaaaaattgttccctggcagaaacaaagcaaatcttcaaagcttgctattgaatagaagtactgtactttggctggaagtattgtactcccagcactttgggaggcgaaggcaggtggatcacctgaggtcaggagttcgagaccagcctggccaaaatggtgaaacctcgtctctactaaaaatacaaaaattagccaggcatggtggcgggtgcctgtaatcccagctactctggaggctgaggcaggagaattgcctgaacccgggaggcggaggttgcagtgagccgatatcgcaccactgcactccagcctgggcgacagagtgagactccgtctcaaaaaaaaaaaaaaagatgtattgtacttcaatggcacttaaagaagttcaatctctacttagaaagtaggtaacaataagaaaactcaaccacctttacattagtggagaataagaccctacacatagacacacagcttgggacagtaacgacagtcctcacaagtctgatttctacttgatttacaagagcttaagagtagtgactttttttactgtctaatgactacaggatacaaccaagcttaaaatcataattactgctttctcaaagtagccacagaagactcattcagctaggggtttatgaacactctattatcagtagcagctagaaagctacaatgtcagagataacacatatcaaaatctgtacaacatagagaaaattgggctttatttgactaacaaaattatctgcatcattgtaaaaattgtaacttttcttaagacttaacaagtgttaagacttcagatttcacagtatatcaaaaagaaaaacaaaacacctttgttcagctagctgaaacatctatccaccttacatataaaattgcaaggttcctgtctaaaatcatctccatttttagactagatgccccttccccctcacctactcaagactttgttccaccttattcaaatttacagtccctgcccatctacctcttttcattttgctcttcatttccacagcattcacttttatcatactatataatttacttatttcttatgtttattcttttttttcacaccaagtatgtgaatccaatgtttaattcgctatctcctcccctgagagaatgtaagctctcaagttgaagattttttaagtaatttttttttgtttattgatatatctcaagtacctgaacaatgcttggcacagtatagatgctaaataaatacttgttcataaaataaaaaagatgcatttatttttttattatggtatttctgatttttattctaaaatcacaaaatgtatacatcagtgtaaaccatactattacacatgaagctccttaacttttccttttagaggagcttagccagaaaactgtttacacaggtactcaataaactaatgaactaaaattaatgagcatccaaaatattttacaggagcaaagacagagcaagcagagagcctgcttgatttttattcatttctgacattgttatttctttggtggcaaggtatttgtagagccacaacaaaataatgcgctgtctctatgaaataaaatctgatgatgtcactagaaagaaagctaattacatggaaatttttaccataatactctaacagccaatcacttaaagctgatcacacttcactattaactctaattagttgtaaatcaagaaagacgaactttagacaagatatgggccaaggaataccaaataatgatacaaattgagctagaaacaagaggctcaacctttgacatgcaattctgattattttttattttaggcaaatcagtttactcagtttcaaactttgtaaattgaaatgttctattagtatctggaagactgacaacgtatacataccttcttagaaacacacagaacctatgtacgcttaactataaaagggttttaatttttttctcaatttttatcaaggaggaaatgaatcaaattctcatattaaaataaagcggcaaaataaaaagatcttctggaattagtgatgatagttacacaattttatgaatatactaaaaaccactaaactgtacactttaaaagggtgaagtattggatacaaatctacagattaaaatatatgagtaaattttatgatacatgaattatacactaatttaaaaatgtgttcagatctgcaggcctgtatttaaatagcaagtataaaccaggtattgggtaaatcttagcactgttactgggtaaaatccatactcataaataatcccttgttaacaagattcattgtaaaccttatgctttatcttttttctgaaggggaaaaatataacagcaaatagactgctttcctattgtagcagttgcacataaacttttgccagattatgggaaaacaacttcaagaggagagggacaaacaagtatttccataatttcaggtattctattcttctggatgacttaaacacaatcgctgcaaacaatgggtaagttataaggagaaaattcaatccagtaatacattgattaaaagaatcaataacttgctttaaaaaaaatttagctagaggatgataatcattaaaaaaagaaaatacttgaacttactaggattaaaggtagaatatactgaaactcaatttaatggaagatgttaaaagtaatcaattttggaataactaggggtagattaactgatacgtggaataacagctgctaaaagaaaacaaatttggtgatacatcactccaacaacgaagtcctgggaatcctaagaagagataactttacatatctttgtacaaaaatacattttaaatggcaatctgagatcacagcaaagacttttttcaatggagtaatggaagaggaaatgaaggtcagatgaatgcccttaagatctaggtttaagactttgttgcagaaaatcactttgaagaaaggggagaaagaactttgaggaaatgtaatcaaggagatgggcatttcaaactgtagtacttgcctgtaatgcttacacaccaaggcttaaaacgccaagcaagagtaacattgtcaggttccttggcagtgagaatgaccaaccgtggtagagaagggcaaggaagagcaagcaaaacaagattacagatggagcaggtcttcattcctacactagtaatcttcaaccttttgtctgcattcatactttacacatgtataacacaatctcaacagcaaatctctcattacacatagagattctcaacaggaaaaccactaacttagaatgtttgctggagtctttagaaagcaaagatcaacttattcagcaacaaatgcgtgctttattctcatattcacaaaacggacgcctcaactaagaaacatctaacagttggggaacgacagaagaggaaataaaaaataactgactttttaacagatcataatttttagtcacatttgcaggtcaatattacgtgatattgcacaataaattcatttttaaatttatttttacactttaggatgatgtgtataaaatcgtaaaaatatgtctaaatactagatgcaatcttctaaaaattaaaaaaacttattgacaaataagagactatttttcctataatatatataaaaacgtagaaattttttaaagttcgaataattcagcaagaaccagtcctaattgtcagacataaacaccaggaagcagaatttttatatatacatgtaaacacattttcatatataaatgaaactgttacatactggtatttcatcatgaaatttttcatgtcagtatatgatgttgattatctagtacttatgtaacatttactctataaacacttaaaggatatgaattcacttaattttcacaacaacactaagagataggtaatattattatccaaattttatagataggaagtgaggtatgaaaagattaagtaaccatcccaagatcacacagcaaggaagtggcagagccaggattcaaacccagaccaactggctccacagttcatactatgccagagaattgggtttacaggggagagaaacatctctggtttcaaggaaagtgtggggagacacaaaatggttcacataaaggtttaagcatttttgttgagaattaaggcatggacaagacagttaccaggaagggaggcatggagaccaaaaataatagcatgaataaaagcatgatattagaaaacaagcgatgtattcaggaattattgactggtttcattttgactacagcatcaagataacatgcagggagaaattgaaggcagatacagctgttaagtaaggttggctgagcatggagaacctcaatcacccatgctgaggagtctgaaattactattagatccgaaattactattagatctggttagcattttgcaaattacaattttaaaataactataaacaatactagaaggagaaatgaattcaggttcaactaacagtcatgaaaatggacttacatatgattagatcttcttcctctatttgttttctttcctatgactggagtgccaaaatgctcagggttggtgagtgggagctggtctaatgtctgtgggtaagaacataaacccatcaaaaaattaacactttgcaagtgccttctttgttttaaaccaaatcaatttaagaatatgctcagattttgagattaaactctccccccagggaagctaaaacacagctttcctaaagatagaaaattctagtttcaaagatattagaataaagatgaatgagctcattactggaaaaaaaaagtgaaaagaaatttggctgctctctctagatgattcattacctatgtgaaggttgataggcatctaagaatgattaaaatacaaaacaaacacagctcagtggaaagacaaatgtgagaattaagaaatctatttgtaaggttagggccaactgcagctccaatattaatttgtacatggggaatcataatccataaaataaaattattaataagaaacaaaattaattatgaagataaagcatcaatcgcacgaacaaaaagcctcggagtaagttatattactactctgcaaacattttctgcaataaaccttttttaataaaatgtaacattaatttaattttttaaattacatttaatttctacatttgatttttttcctttcctacgttttcttaagattttccacagtttctgttcctttcctcatcctaagaagaatctttcctgttataaataatttcacaaacatcagagcaactagagatttccaagaaaactgcccagatgaaaataaaagtgaggaactatttaagacagagacttcttaaagatacaaaccagggtggtataagaaagagtatccatgaacttagaattaaagagcaggcatctaaactaatgtaatatgtaaaaagaaatgttatataacttttttaaaattgagacaattttgttataactacaatgaacaaaactgtgaaaagatgaaccatattaacacttttttacataattcattagaatatatgtaaatgtgtttaaggtacatagatgtatgtatctaacaacgaacagtatgatcaagaaaaaaggtactagccataaaggattaactaaagattgattccttcaaaagactgacaaaaatcatagctttcacaactctcatagggcaaaaaatctaatctttcaaatttagtttgtacagaacctaaccctgtcctaatgaaccttaaatcaggcatttaaaaaatattatttgggccgggtgcagtgactcacgcctataatcccagcactttgggaggccgaggcaggtggaatacctgagatcgggagttggagaccagcctgaccaacatggagaaaccccgtctctactaaaaatacaaaattagcctggcatggtggtgggtgcctgtaatcccagctactcgggaggctgaggcaggagaatcgcttgaacccggcaggcagaggttgcggtgagccaagattacaccattgcactccagcctgtgcaacaagagcgaaattccatctcaaaaaataaaaataaaaattatttggaggcaaaaactgtcctaaactcagtatataccaaacagaaactatttttattgagacagaatgtcaccctatcattcaggctggagtgcagtggcggcatgatcattgctcactgcagcctcaacctcctgggctcaagtgatcctccaacctcagcctcccaagtagctaggaccacaggtgtgcactatcacacccagctaatttttgttttttgtagagatggggttttgccatgttgtccaggctggtctcgaactcctgggctcaagccatctgcccaactcggcctcccaaactgctgggattacaggcatgagccaccacacccacccggaaaatctagacgttgcctgtcattaactcctatggtgaaaatttctatgtaatctgaaatattattttggtaatactgtatcactatagagtattactaaatgactttatttggtaaacagggaaaataaattaatccggattcactttctgtcaagcaaacagatggattaaatgtatgctctccccaccgaaaattaaggttgctctctttaaagcagaaaaataaaagagagagagagatttatatcacacagtgtgatttctattttaagtatctgttagtcatttcacttgctacaggaaagaaaatttctaaagagttgtttaagaatcacacatagtaattttcaaataagagaccacagtctctccctagtacataacaagaagaaacataagcaatatctctgtccctatctcaatgtccaggaaagtaggggcatgtttgtttcaagggactaaaaagacctgggggtagggtagaatttgtcccatcttagacctaaagagcaaaaaccagaggctcctgaaagctgtattaaaggcacatagaaaactccgtaggcctagagggaaaatgtctatggccctgttacctaaaatgggctgcagaaaatatggaactgggattttacctaaacttctctagagttttcaattgcacatagtaaatacaaagaaagaataccagataattggctgggcgcggtggctcacgcctgtaatcccagcactttgggaggccaaggtgggcggatcacttgaggctaggagttcaagaccagcctggccaacatggcgaaaccccatctctactaaaaatacaaaaattagtcaggcgtggtgctgcacgcctgtagtcccagatactcaagaggctgaggcacgagaatcgcttgaacccgggaggcagaggttacagtaagccaagatcatgccgctgtactccagtctgggcgacagagcaagactctgtctcaaaaaaataaataaataaataaatatcagatgatgaatctacttttgtataatactcaaagtatgaatggtctttagaaatacctaaactgtcctacagatgttaggcagcaggtaacatactcattaagctggttatggctaaaaccagtggcttcagtgttggaatttaaactgactgaggctgggcgtggtggctcaagcctgtaatctcagcactttgggaggccaaggcaggcagatcatgaggtcaggagatcgagaccaccctggctaacagagtaaaaccctgtctctactaacaaatatttaaaaattagctgggcgtggccgggcacggtggctcacacctgtaatcccagcactttgggaggctgaggcgggcgtatcacgaggtcaagagatcgaggtcagcctggccaacatggtgaaaccccgtctctactaaaaatacaaaaattagctgggcgtggtggcacacgactgtagtcccagctactcaggaggctgaggcaggagaatcacttgaacacgggaggcagaggttgcagtgagccgagatcgtgccactgcagtccagcctggcgacagagagagactccatctcaaaaaaaaaaaaaaaaaaattagccaggcgtgggggcaggtgcctgtagttccagctactcgggaggctgaggcagcagaatggcgtgaacctgggaggcggagcttgcagtgagccgagatcgcaccactgcactccagcctgggcaacagagcgagactccgtctcaaaaaataataataataataataaaataaaataaaaagataaactgactgaagtgcaaatgtgatctctttccatgaaaatcctgaatttcagtgtttatgagatgggattaatttcagtagtttattaaatgggattagtgacccaaaatactggcagtatgaagcagctttcctcttaaaggacaatgttatggactactactactactaatactctgaatggtctttcaaaaacgttaaaacttttaaaacaatatgaaaaataccaaataaagagaaaagaacatacagatggtagattaaattcccctattgggtgcactctggaccacatcttcacagggcttaatatactcaaattttaaaatatgtttgattgtttgattaatgctttttctcctccaacggagagtaagtatccaaggataagttccatgtttacatggcttggtttgattaatgctttttctcctccaacagggagtaagtacccaaagataagttccatgtttacatgggttggcttaacctttgtcccggtacctagcactacacagctccgggcacatgggaagggaattgaagaatcacacaccagtattctaatttccttctagcaaaacataaattagaagtacacacctgcacagacacactaaaactgaacctccttgaagatatgaaggatacatagccacttgttcatattaccttcagcatttaacttacaactgtcttatgaaccattccaactgaaaattctcctggttaaaaaaaataatattttggctatttctctagactaaaaaaataaaatgcagaccttcacttaacaggagaaaaaccatgtcttcaagtcctcatactcactgactgtacggaaatgaaattaaaataattccacgaactcagggagaattctgtactttatcactatacttgccccaaagctgtctgtatttattgtatgtaaaccttcagtttattccacacatatttattgaaggcttttgtgtagaaattgctaggaaaaggggggcctatcaagtgaggaaagaaaggatattcccctaaaacagcttaaaatcttacagcaaaaatgagaaaagttaaaaaaaaaaaaaggtcctaaaacaagaataagcaagagaagtgcaaaacgaccaatttgggtagagagctcacgaaagacatagaggaggaagcatttataatggccttcaacataagtgagattccaacaagaggaaaggagtcaataaaggaaagtatggaccatagtctgaaaataccaagcagtctaataaggcagaagtacagggaagtggttgaatatgagactaaagggataggctggaattataatacagagaacctgtccaaattctaaatttaagtgggaattcaatcattaagagaagcaaaaatttttcaaaacaaaaacataaagtctaataggttaataagtaatattaaaatatccccaaagaaacactattccaaatagtgtttaagtaataacactactaaataagtaatattaaagtaatattaaagtaataaataataacaaataagtaatattaattagtaatattaaaatatccccaaagaaacactattccaaatagtgagtagagaaaagaaatagctcggccacactgtgtatcaatgaatatctgtagactggattagagaacgtaacaccatttagagcaacatctaccttttaaattctgaattgcaagcgagttagttacaaaactttgtgaaccctctgctcttagtaacatctttcaatttaaggatatggctttggtgctagaaagtgctggttagaaaaccagctctagctatccatttcctaatctgaaagttggggataataatagtaactacctcataatgttgcaaatacaataatgtatgtaaagcacttagcaaaatccctggcaattataagcacctcatctattcatccaactaacacttatgaagttcatactctgcatcaggcactgttacagcaactaggaacaaagccatgaagaagatatacaaagtctctgaccgtgtgacacattctagtgaggaaggcagacaataaataattatgtactcatattttgatgttagggaataagacctaaatcaatctgaaaggatgataaggaatggaagggacaattttaggaagggcagtcaggcaagaggaaagggcataataatatcagctaatagcagtagcagtagttaaagactgttgtatctacacatcctttaactacgacaaggatcaagtagattacaaatcagaaatctgttttctagttatttacaaattttaagtctgtttaaaaactgcctaaagataataattaaagcccattgtattttctctgtggacaaatactgaaacactttacatagacaaaaaagaagacagaacctggtgctcaaacacagggccttaaacaggcttcacagattacatcataagggtattgtgtattaatgaactttcctgattaggaagtaggtttactgagttgagaaagcaaaaatttattcctcccaataaaaaatattaagacatgttcatttgttaaatgatgacttacttcactttcagcaaaatgcctctctcctttcaggcacagtgaagatcgtctcagtgtcttctcatctccgtcatcaaaaactatgagagggggtaaaaatggaagctactgaaggattttttcaaagatcaaagagatgacatgtattacaattttctgagtgcaaacagatctactatttaagactacatttggaattcaattcacattttatgttttctagtgagtaacttcaaatatagagttattaaagtaacttttccaatttctagtgaaaaagaaacaacatatatgaaatgaaaacatcttgtataaaacaggatataccaaataaaaataagaagttggtatttcaagaggaaaacatttaaatgctaattaactcttctcaaaatggtaaagaaatgacaagttttcctactgacagatattgacagatttacctaagaaagattacaagtatatgcaatcagactgcccctttaaaaaaataactgtattttcattatttaaagtagggtttctcacccttagcactgtcactagtgacatactgcaccagaaaattctctgttgtggcaggcttgtcctgtgcactgcaggatatttagcagcactcctggcctctacccactagatgtcagtagcacccccttcccagctgtgacaacctaaaatgtctccagctccaggcattgccaaatgttccctgggggtaaattcatcccagttgaaaactagcgacttaaaatactaaaatgtctattaaaaggtgatggaagtgttaagcaacttggctgcagtaattacttcacaatatatttgcctatcaaatcatcatgttacatatacatttatatgattttgtcaattatatctcaataaagtaggggaaaaattttaataaaaataaagtacttaaagcaccccagcaaaaccaccataagttaacagatatggaatgtatgactatttgtattatatgcataaatctgtgatatacataaataatttagggatatgctacattccttagaaatcatgggaagacagtaactctgttttaaataatgttaccagatctctattttagaaattacattttctgcctacctactaaaattagatactcttctttccttttctttttctgatgctcaacaggatctcacgtttattgagaaatgattaatggttaaaagaaagccaataccctttccttactggctgaactaaaattagattcttatacgttacataacaagttacattatgtgaaactggataaataattttcagtacatctttaaatgatgtaactaaaatatacaacataagtgtcacatttagtagactattacaaccaatcaccatctagacttcctacatagaattgctcacagtcttctcacttacataaagtcaaatatttccttatgtctcaaaatcaaataattttccctctattttcaccaggttttattctcacaccaaagaagtataaacaaaactcacctattctatctgaaagttctatcaaactctgaaatcacgaaagacattttactaggtgtttactttcatctctgaggtcattaaatggtaagaattgttacctttaataaataatactggaataaatggctaccaatctaggacaaatactttttaatcattattttagaatgttggaaaaaatacatactactgtaggtgaaataaaaatctgtttgtaaaacaaaaataaaaataaatttaaaaagtataaaaaatttgaagaatacattagaaaatagatttataacactgatggaaggctttaagattcaaaactaaaattacaaaataaaaggtgaccatacaaaaactgactacatgaaaattaaaagcagagacaagaataaagcaacaggagaaatatatttataactgaagtagtaaacagttaatatccaaaatatataaagaacacatataccaaaactaataagaaaaagataaatcatctcaagagaaaaagggaaagaataaaagagccagcaactcaaaacggagaaaacacaaatgaaattatgttcctttcaataaacatatgaaaagatgttcaatctcactagtaatcatgggaagggcatactgaaacaaaactgagatactactttatgtccaaattagcaaaaaatttttttaaatgacataaaatctgacaaggattgagaaaacagacagtgtcttttaggaaggcagttttcattaactactaaagtttttggagtatatttttcttcaacctctatttctcagtatgtacactaaagaaatactaggatacagtaggtatcctaattaagtacctaattaggtaaaaaagacattcaatccagcatttattgtaatagtaagaaaactggaaacctcatcagtaagaaaaaataaactagcacatcaactattataaaatacactactactttgtttcctgctgggagctagatagatagatagatagatagatagatagatagatagatagatatatatctctctctctctctctctatatatatatatacacagttaaaagacatttctattataaaacaacatgaatatccttaacattactgaactataaacttaaaaataggtaagattggggaaaaaaagaaatttacctaagatatactttgaagtaaaaaaagctagaattccaattgcataatatacacattaaataatttcaatttttgttacatatacatacatatactttggaaataaatttttaaaagatgtggaaagataaaatccagtaacagtaataatatctagggtattaagaagtgaatccaggaaatttcattttatttgtattaagttttctttgtgtaactaaaaacacatttttaaaagaaaatttattttcttacctacagtgtaccaactcgcatctgttagtttattgataacagcttcctgatatgcaccatcaagattcttcacttccacaatagctcctacctaaagtatttttaaacatgttagaaaaacttttaaaaggtaaattaacaaaccaaaacctgggtttgttttcttttaactgagtgcatgatggtgaagaataaaatgactattgacttcatttaaaagtaccagcagttggcgtgagcacagtggctcacgcctgcaatcccagcactttgaggggctgaggcaggtggatcacttgaggtcaggagttcgagaccagcctggccaacatggtgaaaccccgtctctaccaaaagtacaaaaattgggcaggcgtggtggcaggcgcctgtaatcccagctactcgggaggctgagccaggagaattgcttgagcctgggaggtggaggttgcagtgagccgagatcgcgccactgcactccagcctgggtgacagagcaagactctgcctcaaaaaaaaaaaaaaaaagtgccagcagttttaccgatcaatatttttgtaccatcagtgaaaatgttaatgtagtaaaaaaggcaaataatacctaagtactattataaagttttacccttacaacccccgccaaaagaatcctgggaacccccagggtcagtagactacaccgtgagtaccaccatctgtgaaactgactgtccttgccccgtatttccactcttctttcaaggaacctcaggaaggatagggacaatttaaaaattgctctggggtttccttttggccctaaaccagccaaagagcacatagtggtttacccacacattctcttttagcttgctcactggcaaaaagcaaagcagcatttatttcacttgccaatgaggaaaaatgaatgcaaagaaataaaactctccaactgttagtgtaaaggctgatgacccttaaaagatttcatttgccagtagtggctccaaagaagtaagagctccgatttttttggttttctaactttctcacttttcagatcatcgtggaactgacatcactaatccctagttcatcatctattaattttggaaaatccatcattttagtaatggaaatatggtggattaagtaaataaatgtagtcaatgcttctttgatactcattttatttctgaataaactggttttactaccatatcaagtattatttaatattaaatcttttttttaaaagacagcatctcatgctgtccccaagtgcagtgtacacaatcataacttattgcaaccttgaactcctggcctcaagctatcctcctgcctcagcctccttagtcactgagattaagtctattttttctattagtctttttagagaaaattacatattgaatttatcaactcaataacaaaagagccaatgaattaataccaagtatgattattttttcccaaacaaccattagaattaacaatgaatacatgaattacctttagtgggccctttatgtggtcatcctgaacttccactgttgaagaatcatgtctaaatgtcacctagagattataagtttaattagccaccaaaaataaaccaagcaacacaagctcatcaatgcaccaattattcatttgtagtaaaagaaatataaaataatagctgcctagtttatacaacatcccaatccctaagtagattaactaaaaaattatttacagacaactgctcagaccgtatctgttttcaaaaataaaagtaatcaatgatagcacatctaaattactagatgttccacatgtcattttttttttttttaacttttttcttttttgatacacagtctcactctgtcgcccaggttggagtgcagtagcgcaatcttggctcactgcaacctccacctcagggttcaagtgattctcctgcctcagtctttcaagtagttaggattacaggcacctaccaccaggccaactaatttttgtatttctaatagagatggggtttcaacacattggccaggctggtctcaaactcccaacctcaagtgatccgcccgccttgacctaccagagtgctgggattacaggtgtgagtcaccacgcctggtcccacatatcatcctttatttcaatactatcagttatgaatttagttgtaaaattgcttttcctaaaaaatgagaaagaaagatatggggattttaggctattaggtattatatcattttgtgaaggcctaccttaataataaacagtagcagcaaacacttaactgagatctgagcatcagtctctagtaccaaacatttaatcttcacaacaaccctattaggtaggtatgactgttcccattttgttgataagaaaactgagaaacaggccaggtgcggtggctcatccctgtaatcccagcactttggaaggccgaagcaggtggatcacctgagatcaggagatgggaccagcctggttaacatggtgaagccccatctctattaaaaatacaaaaattacccaggcatggtggcgcatgcctgttaatcccagctactccggaggcttaggcaggagaatcacttgaaccagggaggtggaggttgcagtgagccgagattgcgtcactgcactccagcctgggggacagggcaagactccgtctcaaaagcaaaacaaaacaaaacaaaaaacagaaagtgtaagtacctggtccaagtttacagagctagacatggtggagctgatatttaaatgtaggcagtctagttccagaactttactgtgctctatatcattacagaaatcagagaatgggaaaccagaggtgaaaagagtaagttaaaataatgagttcaaatttaaatacttaattagctggtgaaaaacaagatagcttccactactcagtatagaaaacaattgttttctctaacaagggaaaagagttcttatagggattgaatcattaacatggtctttatcaggtatatgtgataattattttaggtaacaggcaggcccactcaaaaaccagctatgaaaggagatgccttatacccacagcatcccaggcatttctgtgtcatacaaaagcattatcacactttttatttaaatcacatgtttagatatctgtgcccttcacttaaactataagctacttacagatggagactaggtcttaacactagagtttcacctttagatagagcttagcacatagtaaatgttcaacaaatgaaaacaggtagtgaaaacatatcaacaaatttgttaaaaatatattaactttgaatcataaagaaattacacatgttaaaaaatatatccctatatctactgacaaaatcactgaatgaaatacactttctttttccttgtgtatgtgttttaatggacatcacctccacagaaacaaatttttagggcagccgaaaaaattaaaaataagctttagatattcattacttataaagcacaaggtactctgtgctatcaatagaggcagtagagtccagtaagagttttgttcctttcatttacagcaagaaatggcaggactgctacatgtcattttcctagttcattcattacacaggaaatgtgcagctaaggatgcaagatggggcttaaatccagcctttgctttgtgggccaaagcatgggtcctggagtgacacagctccagtccaaagagaatgtcttttccaactggcacaaacttgctatctgcatgccaagcgctgctaagaaggctttccaccaggagagagggcttttgtctacttcacacaaaggtgatacatgtgctaccagtagtcctgaaaaagtacaaacattgataaaaggctttctcttcctctacaggatagtactggcaaaaaacagtgcttggggaataccagtgtgtgaagccagaacaggaaatgcacactataaaagcaccaaccaccaagcatgtggaaactgaaggtagggtggggccaagactagccccctaccagtttgtagttaatttaaaggacttatcacaatggttcctaaccaggagtgtaaattagaatcacccaggtagctttttcaacacatccatgcataaggaatataggaacagtaaaagctccagaagagactgataccctccacagaagcacaacacctctacagtctatgtaattggtgaaataaaaaccaatggcttaaaaggtatctgctaatctagattataaattccttgaggacagatcaggtcaatctcatcctaatatccccatcctccttcccacctaaaagttccctgcaaaaggtttgtcactcaataaattattgacaaatgaataaatgtctatattcaagttcacttgtctggtatttttcagtgctgataatttattaaaatggaagcaattacactcctttttctatattaagacaaaactcaagtactttagaaagatgtttcaagaaaggcagagcataaggagtcaacaactagatgtaccttatttcactgttatctaaggcaccatcaattacaagtcacattctaattttatggctgaaatagagggggtgatgccttaaaattgatgaactatggtagttccaattctgccatgaatttggcataatggccttggagaaatcactaaccctctccgagcctcatttttcttgtaataaaatgaagcaattaaactagatgacttctaacttcctttccagctctaaaacactatacaaacaataagacgtctatagtgaaatggcattcaaaataccaactgtgataatctaatttctttccaattataatacttttaaaataacaaaaaatgctttgttttgaggtatttttacaaccttcactcctagaaacttattttgcagaaaaatcttaaatacactcaccaaataaaagtttacatatcaaatgctgaacatacaatttatgaaatctataaatactgtaccttgactttgacaagtctttttgctgtcttgatcttggcttcacaaaaggctcctctgtatttagcactcacatcagtgcccactgtcaaatagggaggctcatcaagggcctaaaaatgcaaagaaatataattagatttaaactctctaattctttcccataatcagacctcagaatagtgagcctaatcttgttaagctacaacagttataaatatgaaatgtatgttaacaagaccaatctataaaatactataaattaaaaaacaagtaaaatgtttatcataaagactatttaaatgtacatcacataaaatataaaggtatcttatttccattaaatacatatggtccatgatatgaattagctcactcacaagtatacccctctagtcactcattcattcaaatatttatttattctatgaccacttacaagaaaagggtccgttggccagaaggcagatctttaaagctcaaattctggggtgggggggaaatcttctaatatttaggctgtatcttggcagtcacccagattcagaatagctctgttatatctctatctagaaaagtctaaggtagtttagtgtagtgcctggtgtggtggttcctgcctataatcccagaactttggaaggccaaggctggaggatcacttgagcccaggagtttgagaccaccccaagcaacatagggaaaactcaactctacaaaataaaaaaataaaaactggctggctatggtgccatgcgcctgtactcctagctacttgggagactgaagtgggaggagtgcttgagcccaagaggtcgagactcgagtgaaaagtgatcgtgccactgaactctagcctgggccacagagtaagaccctgtctcaaaaaagcaaacaaaaaagaatgtagtatagcatacaagggagaaaagttagtatatttaaactactagtgaaaactatatgaagaaagtcatctggaaagtctcaaaactttgaagccaaaatatcttaaatgctttaataggagggattcgctggatatttactcttctaccttaactaatatttatgtttcctcagttgtgatttagtttttaatagctgctcttacgttttacattcaggtacatttctacatttttatttctaaggagttcttctgcttatagtaattccatagccaaaggaaaatcatggaagtaagctttttccaaagtgctttataaaaagtactaacatcccaggacgttccaccaaaaggaaaggaggcaggagttgggggaaattcactatattgaatgaattacttctctgcctcaactttggagattcataaatgtaagctaaaagatctgagaaaccctataatagagaaaatgattacattttaactcaacatttcccaatctatttgtccaaagaaccctttcttttctattgacatctattaacatcctacagaaatcccatagaatataaagtgagaaatgctgttacgagtaataaataatgaaagaataatttcatttagattttaaaataaattctcccctaaaagttgtagctatcatacagagtaatctatttcccaaagaaaaagggaaaaaaacaatattctagtgctataacaggagtgcccacaattatatcagacctccataatggccacctgcttcacattccatgtatttcataaaaagtaaactcaaaacatatcagttatacaatttttaaaatcaacttaggaaaatgcctattcatcagttcatttataccataatgggaatatacccttacagaaagataatcatttctgcactaatactttctaatttttttatattattaactacaacttgataactttacattgctgttgtacctagtgaataaatgcatttctactttacctacctgccttaggtctcttaaaatatcattttccctggccaaaattatggttacattccaggcatactagtggctttatttaagcaataatatgaaaagggactcacaccacttcgctccaaaatcataaaaatggccacgcattgtggctcacacctgtaatcccagcaatttgggaggccgaagcaggactgcttgagctcaggagttcaagatcagcccaagcaacacagcaagatcctatctcaattaattaaaaaaaaatttttatcataaggatgggaatataatgtacagcacaagtgataatgaatgtgtttgttaatttaactgtggtaatcataaaatgtacatcaattcatcatgttgcacatactgaatatattcaagctttactcatcaattaaattttttttaaatgttttatagagagagaaacaatttaaggaaatttcagttcactttgtggttcaattggtactgggtattactgctataaaaacccaaatggcagggcagtcttcatgaccacaggctcataactttccacaatttgcaacctcctctattaacacattctgccatactagccagtaaaattttattttcagagacaaacagtatagttaaaaataaattaaaactgatgaggcaactaaaattatgaaacatagaagagaacaataaatcaactaaaagttgcatatttgtacctactgaggaacatataaaaatttaggaattgatacacttttaaatttttaatagataattcttaacaaaaatagggtatagaatactaacatctttagactattagtattcagaaacccatttgcgtattcttttcattaacattcacagacactagcaacatttcaactacagcaaactgcagatttgcttattgggcatatttattaaagctgaatttgagaaaggggactccctccgcccccaaattaagcccatcccacatcttcaacaatataaaaatccgtgttgacgggagaagggtatttattacttcaaattattgtggggcaaactattcttttgaagggcaatattttctttccttcatgctagaacacaggaaaaggaattacaaggcatataaagaaaatgcctttagaaagacttgcagaaggagggctgggcgcgggactcacacctgtaatcccaccactttgggaggctgaggcgggcggatcacgaggtcaggagatcaaaaccatcctggctaacacggtgaaaccccgtctctactaaaaaaaaaaaatacaaaaaaatagctgggcgtggtggcgcacacctgtagtcctagctactcaggaggctgaggcaggagaatggcgtgaacctgggaggcggggcttgcagtgagccaagatcgtgccactgcactccagcctgggtgacagagcgagactccatctcaaaaaaaaaagacttgcagaaggaaaccaaagtctaataaaagctgctaaaactgaaacacatcatcagagcagtgttaattcgttagaaagagcacagaaaaagcagtgatctgtgttctgatcttactgctgccacctctatttattatacattatctcaggtaagttacttttctgttcctaaattctcattcagcacaataatttgaatcttacacataattgtttagcaagcctatatcaaagcactggcattacaaaggtggtcagaacggcaagttttgagacatatataatcatctagaatgaaactgtcaaactatttttcaatgccaaccaaaatatgaatgagactttacacagaaacccaaatcaaatccataactgaggtggtcagatttgagtatgtaattttagctgggcataaggtatcactctatcattactttaacatgaggtaatagagcagactgattaatagcacaggctttgaaagcagagaggcaaggtcctaatccaagctctactccttacaccaactagatgagtttttgtaggctactgaacctctcacctctctaagcttcagctgccacatcaaaaaaacagagtcaatattagaaagcactccattgtgatgtctgaggtagtcagctaggaagttataattaatattatgaaacacttgatgtggacaaacaagtcattttatcaatagtaattcagatttggttcccttccttatttcttcttaatattcgaggggcaaaaccacattttggctgggcaaggtggctcatgcctgtaatcccagcactttgggaggccaaggcgggtggattacctgaaggtcaggagttcgagacaagcctggtcaacatggtgaaaccccatctctacttaaaatataaaaaattagccaggcatggtggcgggcgcctgtaatcccagctacacgggaggctgaggcagaagaatcgcttgatctcaggaggcggaggttgcagtgagccgagatcatgccgttgcactccagcctgggcaacaagagtgaaacttcgtctcaaaaaaaaaaaaaagttttcggctgggcacggtggctcatgcctataataatcccagcactttgggaggctgaggcaggtggatcacgaggtcaggcattcgagaccagcctggccaacatggtgaaaaccccctctctactaaaaatacaaaacattagccaggtgtggtggcgggcgcctgtaatcccagctactcgggaggctaaagcaggagaatcacttgaacctgggaggtagaggttgcagtgagtcaagattgtgccattgcactccagcccaggcgacactgtgagactccatttcaaaaaaaaaaaaaagtcagtataatacagtaattaagagtataggttcccaagccaagcacagtggctcacacctgtaatcccagcactttaggaagcctaagtgggcggactgcttgagcccaggagttcaaaaccagactgggcaacatggcaaaaccctgtttctactaaaaatacaaaaattagccaagcatggtggcacctgcttgtagtcctggctatgagggaggctaaggtgggaggaccacttcagcctgagagactgaggttgcagtgagcagagatcgcgccaccgcactctaacctgggcgacactgagaccttgtctcaaaaaaaaaagaaaagaaaaaaaagggtatatgttcctaaactagatgcctagcttcaaatctatcccttagtagtgaggtgaccttgggctaagccacttagctaagtgcctcagcatacaataacagttctgtcacaaggatgaggagtaagacggtgcacacaaaatgcttagaagagggcccagcacacattgccaaataaaggctattatttttactttacaacctgggaggcaattgttttttaaaaaaaaatgtttaagtctatatacaaatgggttaagtcataaaaaaaattcccacataaatagagcagatgccaatgtaattgtgtatatacgtggggaagaggggttcctttaaaatattttctcccttattcaatccagacatgaagtaatcatgttgaattccagcggcaagagaatcttaaatctttgtggggatgctccataataaaagtgtatcacgaccccttagtgtaccaagattgcaccagtattttgaggttaatttactttggtccaatttagagacataaaaaagattatgtcagcaggttaactaagattcttttgaccaacaccaaccctgataaatatgcatgtctatctatacgtagccagaaaaaaaaactcttgccttttctttttgctctgcttctctaattctgatcagtagtatggatcatctcagaggctaaaataagatgtttttatgtagcacctccatgccaaaaaggaaattaaactactaaattaccatccctttgttgagcaaacagaacagttttctggttgtcaaggcaacagctacctcacagttttccagcattgcttaaataattattttcctagccagtctacgaaatgtcctaagtggcacctaaaaaacactgaattccatgggaacactaaaaagcataagcaattttaaaattagctattagtggataataatccttcaagatgccaaaatgccaaggaagcacagaagtgcacaaatgaatcaacagtaatctctaatgtgtctctgggctgcagcacatcaaatacataaattaagttttagaaagacaatagttaaatcaaatcttcaaatggctggctaacacagacactgactaggaaatactcaattattcgagatggtttttaaaaagcaaaacatgctagatgacattttattgaggtagtttattttaaaaagtgagggattcaaattggttacagtgccaatgtagccagaagaatcagaaaacaagagtattaaatttgatcataaaaaccatcagtaggctgggtgcaatggctcacacctacaatcccagcactttgggagcccgaggtgtgtagattgtttgagctcaggagttcaagaccagcttgggtaacagggtgaaaccccgtctctaccagaaatacaaaaattagccaggcatagtggcatgcacgtatggtcccaactactaaggaggctgaggcgggaggatcgctagagctcaggaaatggaggctgcagtgagccatgactgcaacacggcactccagccgggttgacagagcaaggctctgtcaaaaaacaaaacaaaacaaaacaaaaaaccatcattaataaatgtacttaaacacaaaccacgtgacaataaatctatgaaaacagcctattttatatatagcaatcccaatgaactattaaaataatggagataattccaaaagatgaatgaacaaaatatacttgcatttatataccaaacagtgtaccatttaaaaaccaagcttaaaatgcacaatttggtgggagggaatataaaaaaaatgaatacatcgaggaaatgaagaaaaccatggccaggtgtggtggctcacgcctgtaatcccagcactctgggaggccgaggcgggtggatcacgaggtcaggagatggagaccatcctggctaacccggtgaaaccccgtctctactaaaaatataaaaaattagccgggtgtggtggcgggtgcctgtaggctaacaaggtgaaaccccgtctctactaaaaatacaaaaaagtagccgggcatggtggtgggcacctgtaggcccagctactcgggaggctgaggcaggagaatggcatgaacctgggaggcggagcttgcagtgagccgagatcgagtcactgcactccaacctgagtgacgtgagactacgtctcaaaaaaaaaaagaaaagaaaagaaaagaaaaccatgcaatataacttcaaaatattctctggggccatttcttctctcctttttcatgtggcactaaggacatggatttgtgaaggggtaagggttgaataggcacaaggacagaagctgaatatacaaggcagtgaagaggaggcctgggggaaccacatggaggtgcagtcctgtggcggaggacatggatgagagctgaatagggacagaggagataagctgcaaggctggaagatccattacccggaccaaataagtaaatggactaatcaaataagtaaatacactgaatatagtgggggccatgtttttcactccaaagaagttaaaatggaaggaagggagcagactacagagaagtctaaatattggactggaattggaaatttggtttgaattcatgattgtataatatatatatatgtgtatatatacatacacacacacacacacacagaaaaataaacaagtacttctaggtgtgcgtgtgtgtccctatattttcctagctctgtccaaaaagaaagtactaagagcaaccaaaagacagcccagtaacaacaacaacaaacagcaatagcctacatcttgatttatttatttatttttaattgagatggagtcttgctctgttgcccaggctggagtgcaatggtgtgatatcggctcactgtaacctctgcctcccaggttcaagcaattctcctgccccagcctcccaagtagctgggattacaggcgctcgccaccatgtccagctaattagtagagacgggatttcaccatgttggtcaggctggtctcaaactcccgacttcgtgatccacccgcctcggcccacgtcttgatttctaaataactctctccattataaggaattaggatccttagaaaaatggttgatttcaaggttggacagagaaaagcacaagaagaatctgaaacatcttgtgtcagaaagtaaagaaatggtgcgattaatgatagggacatttcaaacagacacaggaagcatcttgaaggggttttcctcttactggtcaaatgggggaaagtttgagcattaaaataaatattatttgtgctattatctccttagggatatatatgtatgtcaaactgatcaacttaagatctgtgtattccacagtaaattaattatatctcactttaaaaagttggtaacaaattacaatgcattcagtaaaaatgaaatccgtgagtccatattgacaagaatgaatgaatgaatgttttaaaatgtagaaaagataaagcttttccttatactaaaatgttaataactgtaacagaactgacagagaatcagcgtttggcaaccatcataaaggtggctgattcagagagctatcaaaagatgctaagctgacaggtggtttgatgaacagaatattcacatcatctttgaatactactgaattatttttagtggtgtaattgtgcaacgttttgcactgtaatatcaaaagagcaactttctgtggtatatctgccaagagtaactggaaatgagaaaaagtagacagaccgaagttgaagttattctgttctatttatcaggaattacacactggagtacaatgggtgacagaacattgtgttttaagcttgctcttaaaaagtttgaacgtaatgataatgagtacatacatatgtacacatatatgtatacaatatatatgtgtatatatacacacatatatatacacacacatacaaatctgtgtatatatctctctctgtgtatacacacacacagagaaaaagataaattagatatagagcaaatgacatcgaatgttaacaactggccagtctggtgaaggagattacatgaactatttatacagcaaatttggaattatttgaaaataaattattttgtaaagtaatatatatttattgggcatttgcatatttttctattaattatctatttatattatttacccatctttctgaattgctcatttttgtttttgttttttgtttgtctgttttttttgctggattgtaagagttactgcatattttaaaactcaacgccagccgggcgcggtgcctcacgcctgtaatccaagcattttgggaggccgaggcggacagatcacaaggtcaggagatcgagaccatcttggctaacacggtgaaaccccgtctctactaaacatacaaaaaattagccgggcgtcatgacaggcgcctgtagtcccagccactcaggaggctgaggcaggagaatggtgtgaacccaggaggtggtgcttgcagtgagccgagatcatgccactggactccagcccgggcgacagagagagactccgtctcaaaaaaacaaaaaacaaaacaaaacaaaaaaactcaaccccttcccaaaacacgaaaatctttggatgttatctatatttcttaatattcttcttacaattttttaaagtttatttttggttttttacatggccccactgtgtatcttcttaaaatttaagctactttaggagacaaaacctaagctactttaggttataagtaaattttagatccacatctcataaaccagagggatatctgcatagtcacaaatattaacagaagagtatctgcatattcctggaaatttaagtaactccaaagaaatattctaactagaattttctgcctcggcaaacaggcaagagagaaattgggagagacattattaaaagccaactatacttaaggcactgttctaagtatcaaaaaagcaaaggagctttctcatgtaacacagccaatctactctgccttgagaagaggttatttgtcatcttgctagtgaggtcacaatcatattcaaatgcaaatgaatcttctttggagtaacagcactctcagaacataaactttcatgatctggaaattagaggagcctagtggaggattcaggcagttcaaaattcagaatacaaacagaaacagaaactggcattgttatggtttaatgtatctgggcatgttagtaataactactggcatggattagaaggcaataagtagaacattttttagtataacaagtcactaaagacagcatctggagaacatttaaaagagtttgatttaaaaaaaaaaatccttaaaatccctactgggccagtcctgtaatcccagcacttcgggagaccaaggcaggaggatcacttgagcccaggagtttgagacgagcctgggcaacatagcgagacttcatctctacaaataattttgaaaaataagccagaagaggtggtgaacacttatggtcccagctactaaggaggctgaggtgggagaactgcttgagcccaggaggttgtggccgcagtgactatatcactgcactccagcctggatgaccaagctaaaaaaatgataggtcggatgccatggctcacacctgtaatcacaacactttgggaggctgagacaggcggatcatctgcagtcaggagttcgagtccagcctggccaacatggtgaaacccagtctctactaaaaatacaaaaattagccaggcatggtggtaggcacctgtaatcccagctacttgggaggctgaggcaggagtatcacttggactcgggaggcggagattgcagtgagccgagtttgcaccactgcactccagcctgggcaacaaaagtgaaactctgtttcaaaaaaataaaataaaataaataataataataatccagccaggcacggtggctcacacctgtaatcccaacactttgggaggccaaggtgggcagatcacctgaggtaaggagtttgagaccagcctgaccaacatagtgaaaccctgtctctaataaaaataaaaaaaattagctggccatggtggcaggcacctgtaatgccagctactcacgggttgagtcacgagaatcacttaaacccaggaggtggaggttgcagtgagccgagatcacgccactgcactccaacctgggcaacagagcgagactccatctcaaaaagtaataataataataaataataataataatccccaccaaccaagtttttaatcgtgtttcatatcctcaagaatatgattttgaaagacgtcatcaacaagaaacatcaatctttaatcacttgaaaacctatcaattacttgtctagtgaccaaaagaaacggacccacacaacatgtattaaacactaagtcacaaaattcattctagattcagaatattactgtagtaagccctttggtaacttatgctaaatactcattgatgtaacactatatactgactttccttttcccaaatataccaacattttgcaaaagtgaccattttataccatattttaatgattcctatctgtcctctagactgagctacttaagatagaaatagtgtcttattcacctatgaatgccctggtcctagaatagcacctacatatagaagaaattcatgagataattgttaacacaaaaaagattagacattagttaagccctgctaaatgagattcctcttaagttgaatattatttatatttcaaaaataccttataatcagaagcgtcttatataaacaggtgaaaaagcatgagctatggaatcaatatctgagatcaaactttaggttcataacttactagatccatcatccttgggaaaaattatttaacttatctgagcatagcttcacatttgtaaagtgtagtttatcatactaataaaacatatgttcacttttatattatacatttattacatattataattaaatataaattacatattaaatacatacaataccaatgtggcctattacacataaaatcacatgtaataagcactcaatataaataaatgtctatattaatttattattaccattctttttaaagaagattttgtacttaacaatcagatcacgtagaaattagtgacagaagcagttcaagaataggtatgagcagctaagcagctaagcttatgagtacaggactacagagaagaatgataggggcattggtagcaaatatccacaagtggcaattttgtttgggtaagccaggtgattttccagatactctggagaaatgttttctgaaatctcaagttcctggcagttatatttacaggctagagtgcagtggcgcaatcttggctcactgcaacctctgcctcccaggttcaagtgattctcctgcctcagccttccaagtagctgggactacaggcgtgcaccaccccacccagctaatttcatgtgtgtgtatttttatagagacgagttttcaccatgttggccaggctggtctcgaactcctgacctcagatgatccgccagccttggcctcccaaagtgctaggactacaagcatgagccaccgcactcagcctacacagctgttcttaaacttaaaaaaagtaaattatctctcctttacagagatgatggtttatttttatgttactgaaattcatacaaacataaagttaccatatttcatctaatttaagtcactaattgtaaaccacacctaccactaaaaaagaaaaaagctgccaattaaactacgatataccatcaattgactgctaaatgcatcctgatttcagagatgttaaaatgtagaaaatgtatacttgtacctgataaaatgtagtcatatagtagctaagaattatttattcttacggaactgtacaagtataaaaccaaatctgcaaactaaattccacaaaccaacaaaatcaatgaaattcaagtaagaacattaattcaatatgatggatgatattctgctacaactacacactcaaaacacaaatatggcacagactactttggactagcatgcttttaatattgagcacagtgtaacgaatcaattctcccaccacttttccctatgtaaactagtacaaaacctttgctggagagatcaatgttgcctcatgatgtaggaacatatcacttactgtgaactccatctccgttgttttataatcaaacctgcaacaagcgaagtaatactactcactatgaacgctggttgtaaaacataaaaagtaattgcagaaactgaaattatactagtttggtgcaaaactaattgtggtctttgccattaaaagtaattgcatgccaggcacagtggctcacacctgtaatcccagcactttgggaggccaaggcaggtggatcacctgagctcaagagttcaagaccactctgggcaacatggtgaaatacaaaaaagctactaaaatacaaaaaaaaaaaattagctgggcgtggtggtggcttgggaggctacttgggaggttgaggcagagagaatcacttgagcccgggaggtggaggttgcagtgagctgagattacaccactgcactccagcctgggtgacagtgagactccgactcaaaaataataaataaataaataaaaataaaagtaattgcaaaaccacaattacttttgcaccaacctaatagttctctgctatccagatgtacaaatgacccagaaaatgtttatattaaatctttttagctctctgtatgaaatgaaatggaagaaactcaagataaaacaataataaagtatataccttttgaatttagtgtcatttgcatgtattacttgataaaaataatcaattaaaaatgtaattttttattctacacagagaacttgcaaactaggccaaagagaatttcggagaagtccagtttgatatacactcacatagaggtaaaaggatatagaagaataaggccataatttgtgtaaagaatatctcaactcagctatggctacgatctgcaacctattagttgactgatttttactccctgattctcagtttctccacttctaaaaagagggtaaataataccttctgccttaaaaacactctatatataaatgttaagtctgctgcagacttatctttgaattatgattatcatgtgctaaatcaaatgcatactaaaaacaggcacaatggtaagagtaggaaaatccaacactaggcctaattttgtgtgtgtgtgtgtgtgtgtgtgtgtgtgcacgcgcgcagaccgctctgcctattcaatgactatgcacatatgagggacccaacaaatcatattttaataagtaaaataaggacaaactatcttacagatgaccaaatttttacgacaaagaagcccacacagctttacaaagactaagtcactaacatgacaagtatcaattacaagttatttctcttaacaaagagatatgttctggcaatatgctttgccaacaagtaattcattagactgctagccacctgatccaaactgggccgatcggttttactctgctatgaagttaaagctaggttaaccaattagccggtagagaaaggatgtgatgcagcctatggtagccattttctggcatgcacagggagaagtagagaaaaccagtctgctgagaggaagtaagaaataaaacagatgcagagggggaaaaagtgcacataagaaactgtgggttctctgagtgactgagagaatagctagccttagttcctgctagctttccaactgcctcctcaagccaaactggagttcccctctttgggtaccatgagatgctctgtacccttataatagattctcttttctgcttttcatcacctgaaatgggttctattacccataaccaaaatagctttaattaaacccatcagatgcctattatcaaaatagaaataatatcaaatacagttacaattccacaaacattaattgagcacccacaatgccctgggatattcagaacttagatcacatctagacaaatattaaaccaattccagtttacatttttaagctaaactgtcaaaatatacaaaaatcctgggctgggcacagtggctcacgcctgtaatcccaacacgctggaaggccaaggtgggaggactgcttgagcccaggagttcaagaccagccgggacaacacggcaaaacctcatctctacaaaatatcaaaaacttagccaggcgtggtagcacacacctgtggctcctagctagtgagggggctgaggcagaaggatcacttgagcctggggagtagaggctgcagcaagctgtgatcacaccattgcactccagcctaggtgacagacagagactttcaaaaaaagaaaaaaaatcttgaccagtaagaaataatgaaatgtgaacatacgaagcaaaaaaaaaaaaaaaaagattttttttttgaaaagctatttgaggtcatcagatcattattataacattagtagcattagcaaactaacgctaattagtagcattagcaaacattagtaagatataacctctggctatcaatttttaaaaatcagcttttaagcccttaccagatgcgtctggccctacaatcttattaaaaatatatttacactttttaaaaaacaatagtttacatcttcaacagactcttacatttctactcatatttttcaaagttataaacttcttatcaaataaaaagaaaaaataaagcaagaatactaattgtcatggtggtgcacatctgtagtcctagctacttgtgaggctgaggcagtaggattgcttgagcccagaagttcaaggctgtattgagctatgatcacaccactgcactccagtctgggagacacagcaagaccctgtctctttaaaaaaggaaagaaagaaattacaagttatttctcttaaaaaagagatgttggccaggcgcggtggctcatgcctataatcccagcactttgggaggccgaagcaggggggatcacctgaagtcaggagtttgagaccagcctggccaacatggtgaaacctcatctctactaaaaatacaaaaaattagctgggagtggtagcgggtgcctgtaatcccagctactcgggaggctgaggcaggagaatcgcttgaacccgggaggtggagattgcagtgagtcgagattgtgcactgcaatcaagcctaggtgatggagcaaaacaccatctccgaaaaaaaaaaaaaaaagatatgttctggcaatatgcttttgccaagaaaaaccctgagcaacaaaggaagacatggctctataaaaaataaaaaaattatctgggctcagtggcacacgcctatggtcccaaccattcagggggctgaggtgagaagatcacttgagctcaggaggccaaaggtgcaacaagacatgatcgtgccactgcacttcagtttgggtggcagagagagactctctctctaaaatttaaaaaagattttagaggctgggtgcagtgtaatcccagcactatgggaggctgagaagggtagatcacctgaggtcagaagttcaagaccagcctgaccaacatagtgaaacccggtctctactaaaaatacaaaattagcctggcatggtggcgcacgcctgtaatcccagctactcgggaggctgaggcaggagaatggcgtgaacccgggaggcggagcttgcagtgagccgagatcccgccactgcactccagcctgggcgacagcgagactccgtctcaaaaaaaaaaaaaaataataataataatgtaaatgagaccatttttaatgccttatattgtgtgtgtgtgtgtgtgtgtgtgtgtgtgtgtgtgtgtgtgtgtgtttcattggttttgttttacatttttctcctgatgaccttgcccagcatctttcaggattttaatggtggcactaaatggcttttcttggccattccttccatactacctcacactaaatggagattctattagttgctgaggatatctattccaactattcacttaggaccataagaaacaatttcaagatgagtgtaaggaaacatatttaagtcaaaactctatcaaaatgctatttcctgactctccatatgcacctactcttactggtaggtcacagtggtattcttttgagtcaccagtaattaatggttaagtcagagccaaaatcagattttaaaacctgagtattattcccctatcccactgcacagctatttaagtaaatgtacacacacaaagtatcattagcaaaggcaagtagaaagggccatgctacatacaggggtatgtaacaggccttccaggatactcggtcttgccttctttcaatggcctctcagaactaaacagactcaatttcaaagcattcaatagaatagtttatattagattatcatcagacctggagttttaaaaaactataccaatcaaataagttactaggttacttatctacctagggatctcaatgcacatgcaaacattttcagaatttcattatcaaacatgccctcctacctaaatgtgttaaccatgcccacctagcctccgttctgctggaattttctgatccccactgagatcatgaaaaacatttcatggcatcccctcctataagcattcccagtgggacagaaaagccaataaatcccttaaaatagtctagcatttcccttgccaatccattttccctaagaaaatggtgaagagagaatctactagactgtgattacccaagggagatgataaattccaggtgatatgaggaagattaactgagcacacacaaaaaatagtgaactgttaatttacttatcttaaaaacagataagaaataaactttactagtaagtatttcttatgttgatctacaaaagcaacacaccttgtgaacacacacattctgagggaaaagtggcagctgcacaacacagcagggttgacaatgaagtcttcaattgtcctaccacttttggcacactgtatttggtattcctgtacatgggaattttacagattacatttttcttgtttacataagtttgtggattgtattataaactagaaaagtggttcccaaagtatgctcccaggaccaacaccatcagcaacatctgaaaatttgtttttttgagacagggtctcactcactctgtcacccaggctggaaatcctaactcactgcagcctccacctcccaggctgaagtggtccacccacctcagcctcccaaagtgctgggattacagcaaagtgcatacagcgccaagccaacacctggaaatttgttagaaatgcaaattcccaggcaccgctccagacattccgaattagaaactctccgggagggaaacagcattttgtgtcttaacaagccctccaggacactctgatgcaccccccacccccggcaagactgagaaacactgacccagaggttattcctctaggtcttaagtagatatttgtaatagatatgctcagaaactaacagaatctccatttagtttcctgaaccacgtagtatgaggtattctggtaggaatcaaaatctgaaagccattttggaaatttcagaagtcattaaagacctgaaagatatcaggatagtgataatgaaaacaatgtaacatacacacaaaataaaatacggccataaaggcagaccaatttaaaataatacattatttaaaaattgagaggactctagcaaagaaatcagcaattgagataaaataatcaacgcaaacaactaaagaattagtaaataaaaagctaatcttctatgcagaaaaaagttaacagcagacctgagatggctttccttagaaagggctgcttgcaaagctggcccttggctaagaactcacaggaacctggatttagggagggttcctaccaccaactggtaagagtgggtggttgtgtctaaaacaatatggcttaagctttcattatcagagtctagaatttgatatatgccagacatgcagtacctatgtgaacagctcccactaaaaaccctggatgctgagttttaaggagcttcccgggttgtaacatttcatgttgtcacaattcttggttaggggaattatgtgtgtcttgtgtaactctaccgggagaaatttgcacctggtttcctccagactttacccaatgtatcttttccttttgctgataatgcttcctatcctcttgtaataaatcgcagccgtaaacatgactaatacaatacactgagtcctgtgagcgcaccttgtgaattaccaaatctaacactggtgctggaaatatccaacacattctcttaattctattatgagctctttgacagtcatataatgataaaaacactgacagtaacttcaagtctaaaacatttgtattactcttactccacccattaataaaataaaacattttaatattattttatttccattgtcttattctttttaacatatccagtaaccttatttgaatcacatgcttagttcttgtacagtaaagaacaggacaccttcactgacaatccaagggaaattggtatgttgttaacaaacaaggtggaatacatactgggcaggctctaacaagagacgatcactaaaatcaggctatttgacaaacaaaattgacttaaagaatattggggaagcatcgcaaagaaatagtcatgatctcccacaactcaggtcctgagcagctcactgggttcctgcctctccgctcctcgccacgcaaacggctcctgccagaacccaagatggcagcttcaggtgggcaggtggccaggatcgccgaaagcacaccagtgcccaggcgaagaacagccaggggcccctccttgctcggtgcctaacagcaggggcgcagggtggggctgccatcagccacgcgcagagcccacttggttatggcaaggaaaaccctgtgacctagggagtcgccaggcttccagtcctgctggcgggaaggactggcaaggcagtggggataaaggtgcaagcaaagaaaccatggtttcggaaggataatgtacagagaggccttgtgttgacccgagcacgttttttgaaagaaattcttaatattgggtgagcgctaattctcagttcaaaaattaaatcatatgtataaaaacgaaaaaaaaagagtcctgagtaacttctgattattattttacatattaaaagataacagaaaaaaaaaagcggtttcaaatgtgagtcctaagtaaacactcaccaactctacagcttacaagcttgccatcaaggtggcttctcaccaggacaactctatacagcatgctttaaagtgagcaggagggttgggtgcgatggctcagcctataatctcagcactttgggaggccaaggcgggtggatcacttgagcccagttcaaaaccagcctgggcaacatagggaaactgcctctgttaaaaacaaaaataaaggccgggcacagtggctcatacctgtaatctcagcactttgggaggctgaggcgggtggctcacctgaggtaaggagttcaagactagcctggccaacgtggtgaaaccctgtctctactaaaaatgcaaaaatcagctgggcgtggtggtgcatgcttgtagtcccagctacacgggaggctgaggcacaagaatcgattgaacccaagaggcagaggttgcagtgagccaagatcatgccactgcactccagcctgggcaacagagcgacattccgtctcaaaaaaacagctgagcgtggtagcccatgcctgtggccccagctactcgtggtggaggctgaggtagaaggatcatttgagcccaggagatcaagcctgcagtgagttgttatcatgcctctgcactccagcctgagtgacagaccaacagcctgcctcagaaaaacaaaaacaaaaacaaaaaacaaagggagcaggagttatttatttaacagtggtaagaggtactctcatgcaattcttagggaggctggtgaatgtatttttaaaaacctgttctttatacaattcagaagaccaataagaaatgctgaaaaaatcagaaatacaaaaattaaaagaaattatcacattacttatattagatatcaacattataaataagggaatacttttcagatacaaaatgatctctaaaactttcctattttgggtaaaatactagcctaggaacatacatcatgaatatacaccatgattcagaaggggactctgctatgaaataaaaacagtgaaatactagaatatagtggcatatttgaaggaattgaaaatcatcaaaaacacaatcactcctaaagcatataatctaacaatgtcttcagggagtcctggttaacctagtatcacttgctcatcccttagccctgtgatacttatgaaaactgtttacagttttgtttaattatatcctcaggattcaaagtttttacatggtctcagaaacccaagatctacttgagaaatgcattgattttattcctcagcgctgtctctaacttacaaaaagtaatatttgctgctcaaggctacttcacaggatataatcaacgcaaagcaaccttctttttggtaggctttgggataacagtcaatgcaaatttagtgaatgcgaaaattagttgtatgagtgtgtcaaacttttggaagcacaagtaggtaaaccaaggtgccatggacaatgggtgaaaactattataaatatggaaaattttaacctggaaaccataacactgtttctgtggatttctgaagaccctacaagaattttcagagatgatatatctacacaataaagcctgtactttcgacagacccaaaaaagtttaagaactcctattgtaccctgaattttcagaaaaattagagaaagagaaaacaggaatacttaaagacaaccaaatttaaccagacatggaaatatttacattacatactatttaattttatttatttatttatttatttttttgagacggagtctctgtcacccaggctggagtgcagtggcacgatctcggctcactgcaacctccgcctaccgggttcacgccattctcctgcctcagcctcccgagtagttgggactacaggcgcctgccaccacacctggctaattttttgtatttttagtagagacggggtttcaccgtgttagccaggatggtctcgactcctattgtgatccacctgccttggcctcccaaagtgctgggattacaggcgtgagccaccgcacctggccgatactacttcattttataacaaaataagaagttttatgtatcttttaaaacacattcattttcatcacaaaaacaattatgtagataaataaaaaagtattattacccactggtataaaagagcaaagagaggtggagctttaagtgattttaaggacataattcactagaggcaggaaaaagagcttaaatccagatgtcataccataactgccttatcaggtagtaacaacttaacaccctcttaaaaaaacctatctgtaaccaacataaacttacctactaattcagaagctaatgtttaaaatgttgaaaaaagatgattacaaactatgttttaagaaatacacaggtaaagatttgaaagtatatactaaaatgttaatagtagttacctctgtaacgtctgaattacgagtgatctttttcctacctgattttctggattttccatactttctaccatgagttttttaataaccagaaaatgttaaaatcaaataaaatgctttatgttcattattaaattataaaattattaatattaagtactattatttaacatttacttaagacagtcaattttaagatttcttgctgatacttttaagaaaaagttaacttagaccctaaagaaaatgaaaccaatcctttatttacttatttattgagacagtctcgctctccaagacagtcttgctccagctggagtgcaatggtgcaatcgcggctcactgcaacctccgcctcccagttcaagcgattctcatgcctcagcctcccgagtagctgggattacagacatgcgccaccacaccctgctaattttttttttattttagtagagacggggtttcgatatgttggccagactggtctcaaactcccggcctcaagtgatccgcctgcctcggcctcccaaagtgttaggattacaggtctgaaccaccacgcccagcctcattctacatttaaaacaaatcaacattaattcttcaaggccaggccggcacagtggctcacgcctgtaatcccaccactttggaaggcctagacaggcagatcactgaaggtcggagttcgacaccagcctggccaacatgtgaaaccccatctctactaaacatacaaaaattagctggacgtggtggcaggcacctgtaatctcagctattcgggaggctgaggcagaagaatcgcttgaacctgggaggcagatgctgcagtgagccaagattatgccactgcactccagcctcagcgacagagcgagactccgtctctgggggaaaaaaaattcttcaaggcctaaattatctgctctccaagtatcctataaaattgatgatgcaatgtgatgaattgatcagagaaatttaattacatatacttcactagctttttctattacaagtgatctttaaaaccataatgtgattatgacctagtatttcaaataaaaattgctgggcacagtggctcatggctataatcccagctacttggaaagctaacgtgagaggatcccttgggcccatgagttccagaacagcctatgcaacataacaagataccatctctaaaattaaaatttggaattattcccaactcattctacaaagccagcattattctgatatataatgacattatgagaaaataaaactagaggctggacatggtggctcatgcctataatcccaacactttgggaggctgagaggagaggactgcttgaggccaggagctcaagaccagcctgggcaacatagcaaaaccacatctctacagaccaatatccctcatgagcaaaaatgcaaacaatatatatatattttttttttggagacagggtcttgttctatcacccaggctgcagttcagtggtgccatcttggctcactgcaacctccaactcctgaagtcaagtgatcctcccacctcagcctcccaagcctcccaagtagctgggacctacaggtgcagaccaccaaacccagctgactttttttaaaatttattttctgcagagacagggttttgtcatgttgcctaggctagtcttagactcctggacttaagccaacccaaagtgctgggattagaggtgtgagccatcacgcccagcccaaaaattctaaataaaattctagcatgtagaatccaacaatatgttctaaaaggtaatatatcatgaccaagtgcatttattgtagaaatggaggattgttctaaaattcagaagtcaatgagtgtaattaacgtatcaacaaactttaaaaacagattacctcaatatatccagaaaatgcattttattaatacaaaatccataagccactcctgatgtaatctctcagcaaactaggaacagaatgaaacttcctcaatcggacaaaaggcatccatgaaaaatctgcaactaacattatacttaacggtgaaagactgaatgcttttccctacaattaagaacaagacagggatatccacctcaccacttctattctgcattgttttggagagccaatgcaatcaagaaagaaaagatatttgaattggacatgaagaatagtagctgcctttactgacaacatgatccgctaccaaggaaatccaaaggaatctacaaaaatcctgctgtaaccaataggtggttttagcaagatcacaggatacacaatatagagaagtcaataggattcctatacattagcaacaatcagaaattgaatttttaaaataccattaacaacagaataaaaaattactaaatatttagagatctggcagagagttctcattctgagagttctaactagtaaatcaggattccttacacaagtgtttttcaaactgagccacaacctattaattactaggtagggaaagaacaagagaaaaaaatgatatgagagaaaaaatgactgagttaacgctcattcacacatttgtttctggcttttgggttttgttttgttttgttttgagatagggtctccctctgttattcaagctgagctctgtggctcactgcagccttgacttcctgggctcaagcaattagcctgtttcagcctcccaagtagctagaactacaggcatgtaccacaatgcccagctaatttttgataatttgtagagacagggtctcactatgttacccaggctggtctcaaactcctggactcaagtgatcctcccaccttggcctcccaaagtgctgggattacaggcatgagccatcgcacccaggcttattcatacatttaaactaaagcctataatgtatcaggtgctggttaggaaccagagacttgatttaaaactcagtctttgttttcatggagtgtagtggaggaatctgttaaacagttaagttaccatatgaagttaactactatggtcagattctgcacaagaggagcacgaagaaggacgtaaatctatcttaggatctcagagaaggatacctgaaggatgactggtaatctagtaaaagaattctgatgggttgaaatgagaaacaatatagattctggagaagagctatagtgcatgaggaaagtagacaatatagaaagctgcaattattaatgaccatagccagagttctggagaagcaaggcctgatagcaacaggagaagaactactacaaagttttatgagcaagagttacattatctgatgtcttagatcactgtggctgcaatgtgaaaaacagataccaatgtacaaatacaaggctgaatcagacagatcagttaggaatctgctaccataatctagaatgagatacaatggcttgcactaatgctgggatggagagagaagaactgggtaaagacattctcacatttagtgactaactgaataaagggattaaaaattttaccttttggccaggcactgtggctcacgcctgtaatcccagcactttgggagggtgaggtgggtgaatcatttgaggtcaggagttagagaccagcctggctaacacggtgaaaccctgtctctactaaaaatgcaaaattagccgggcgtggtggcaggtgcctgtagtcccagacactcaggaggctgagggaggagaattgcttgaacccaagaggcggaggctggagtgagccaagatcgtgccactgcactccagcctggacgacagagtaagactctgtctcagaaaaaataaattttttttttttaccttttttctcctcactgctgacttctatttcagaagagcagatctgatcccagactactaaacaaagaaaagagaactagagagacacccaaactgcaggggaggttgtagtaacaaagcagaagacaaaaggaaattccaggtgaggctacagggcaagaacagtctcattgtgtgttctgtcttgaatgtaccagaaactaccagtgttcatgatggtatatgagaaagaatctacttatttttatttttctacttgccctaaagtaataaacatgcatcacatcaagcaaattaatgcctaattatcagcaaattagtaaactatttctgttgacacctttattctctacccagtaattcaaccggcagctactattttcactaagtactgttaaataagcttgacaaaatgagatactcttacatgaattcctggtcctaaagaatttagtcctttcttcagcatacaaattaatgcatgaattcatttgctttataaaactataaaaatacagaagtatacaaaaagcaaatgtctccttttatcttctctgttcccacatccctcggggacataactactgtctccttatttagggtatttttccagtcttactctgcctttacagggacctatgtacaaaacaatgtattttttccaaataaattttaaattggcctttagttgtacagtctatgagcatattatccttgtaaaaataataaaacattaatgtggctgggcgcagtggctcatgcctgtaatcccagcactttgggaggccaaggcgggtggatcacctgaagtcaggaatttctcaagaccaggctggccaacatggcgaaaccccttctctattaaagaaatataaaaattagccaggcgtggtggtgggcacctgtagtcacagctactcaggaggctgaggcagaactgcttgaactcaggagacggagattgcagtaagctgagattgcaccactgcactccagcctgaaaaacagagtgagactccatttcaaaaaaaaaaaagtaagtcctaaattactacactcaattcccattaataatcactattctcattttggcatatgttcttccaggttttttccagaccttcacttacatacacgtacatgtatccatatttaataacatttctgtgaatctatttttacataactggtactacatttaatatactgtctttcaacttttctttcattcaaaaaatgttttagagatctttctacatcagtaaacacaaactgtcgaattaattttgtgctataaccattgtaggaatttgccatggttatttagcttgtcctctactggtgatattaagtggttttctgtttttccctattaaagagggcagccacaaacatattcatgccagcttccttgtgcacctgtacatgggctgcttctgggtaggtatcaaaagggagcacaaagaacatgaacattttttattttaagacataacccaaattctcccaaggaatttctgaagtataattctggtgccttaaaggccaacacataatgaaaaaagaagactcttagttacagttaagtgttctattttcaaccaaaacttttctaatcctagaggagtttaacaatctggcatcttgaacagaaatcaccattaatttctgcaccagttattagcaatgcaatatcttaacagtcttgaaagatccatttattcaacaataattaccaaaattaaaaacacacaaccctggccccaggaataaatggccaaattcatccaatagctatacttgcacatgtgtgagataacatatattcaaagttattcatcacagatgcaagtcagtaggtctggccaaaagtccagctaaattcaaagtgacataataaattatgatcctggaagggaattcaatgtatgacttacttcaaacagtaaattaactcaaagtttgggagctataaaatattgataaatttaaccattaaaaaattgctcaatggcaaaaaaatacacaaagcaaatatatcaaaatataaatgacaaactctacaaaaagttatttataattcacatcactaaagagcttgactctcatacataaagaacatctaaaatcagtaattttttttagagaccaaccattcaggccaggcaaagtggttcactcctatagtcccaacactgggaggccgaggtaggtgaggtgcttgagcccaggagttcgagaccagcctggacaacatagtgaggccttatctctattaaaaaatttaaaaattagccagcatggtagcatgtgcctgtagccccaggtactcaggaggttgaggtgggaggatcacttgagcctgggaggttcaaggctgcagtaagccgttattggaccactgcactccagcctgggggacaggaaggagattctgcctcaaaaaaaaaaaaaaaagccaaccattcaacagaaaaatgggcatatgacataaaaggatatttcatataaaaagaattacaatggactcaacacttgaaaagatgctcatactcattcataaattcgatgtaaaacctactaaataaaaacaattcaaaacacaatttttcgcacgcatccatagtttcaactacttgggaggctgaggcagaagaactgcttgaacctgggagacagaggttgcagtgtgcccctatcatgccactacactccctccagcctggacgatatagtgagactctatctctaaaaaaaaaaaacccacaccatttttcactatcagattggcaaaaattcagaaattcagaagtctagtaatgtacacggcaggtaagttatgggaaaatgttagccttcatattgctgctgagaatgtaaatctgtataacctgaacgggaaacgattatagaaataaaaaatgcaggccgggcagatcacttgaggtcaggagttcaagaccaacttggccaacatggtgacacctgtctccactaaaaatacaaaacttagcggggcatggtggtgcatgcctgtaatcccagctactccagaggctgaggcaggagaactgcttgaaccagggaggcagaggttgcagtgagccaagatgacgccaacctggacgacagaatgagattccatcaccaaaaaaaaaaaaaagcacatgtgctttaatcagtaaccctactcttaggaattaatcctacagatactcttacagatgtatgaaataatatatgtacaaagttacctcatctcagacctgtttgtaaaagcaaaaggtcaaaaacaacctaaatgtccaaaaataggggtgtggctaaataaattatgttacatcgtaaatcttatacatctgtcctatacagaactgcaaaaacaattgaggaaactggttgtttgcagctggacatgggcatgaaagaccagagacggggagacaactttttaaggattacaaaaatattcttaaactggactgtggtgatgggtgaacaaccctagacatttacaaaaattccataacagccaggtgtggaggcttacgcctgtaatcccagagcttcaggaggccaagtggcagtatctcttgagaggaggtgttcaagaacagcctaggcaacatagtgctaccgtgtctgtacaaacaaatttgttttaattagctgggcatggtagcacacacctgcagtcccacctgttcaggaggctgaggttggaagattgcttgagcccaggagtttgaggttaacactgaactatgatagtgctactgcactcctgcctgtgtgacagagtaacaatttgtttctaaaagaagaaaataggccaggcgtggtggctcacgcctataattccagcactttgggatgcggaggtgggcagatcaccaggtcaggagatcaagaccaccctggctaacacgttgaaaccccgtctctactaaaaataaaaaaaattaaaaataaattagctgggcatggtggcgggtgcctgtagtcccagctacctcggaaggatgaggcaggagaatggcgtgaacttgggaggcagaggttgcggtgagctgagatcgcaccactgcactccagcctgggcaacagagcaagactctgtctcaaaaaaataataaataaataaataaataaaataaatttttaattaaaaatgaatctaaaattccttgatttttacacttagaatggtttaatttttttggtgtgcaagttatacctcaataaaagttgttaataagaacacacaaggctaggcgtggtggctcatacctgttaattccagcactttgggaggccgaggtgggcagatcacttgaggccaggaatttgagactggcctggccaacgtggccaaaccccgtctctactaaaaaatacaaaaaatactaaaaaatagcccgggtgacatagcaagactgtcttaaaaaaacaaaaacaaaacaaacaaaaaaacacccacaaatgaggggatctctatgtaataataacacaaacatctcccagatgtgttaagtgacaaaatttaaaagtgcagaacagtgtgtgtaatttacaagctgaaagtaaagggtaggagagatagggaagtaagacggcaaacttgtgtttgcctttctacgtgtggaaacaatacacaaaaacaatgactgtacagaaagaagggaaatttaacaattggaggtaaaaggtaggatgaaagggtttttactatattcttttataagtattttttaaaacttttcagccatatgtttgaatattcaaaaaattaaactaggatatttggactttaataatacagatacaacttataatgtaagttgtttgcttcttcatttcgttacatattatatttcatatgattttgcaatcatcctgattgtccccaagagtctgcctttgtgaagaattgtgcctacagaaactttgcatcctcaatattctggggacagttccagtttcaaatattcaattccaatgttactgatttacaaattaataaaggctcttagaaattccaagttttggctgggtgcagtggctcacgcctgtaatcccagcactttgggaggccaaggcaggtggatcatttgaggtcaggtgttcaagaacagcctgtccaacatggtgaaaccccatctctactaaaaatacaacaaaagtagccagttgtggtggctcatgcctgtaatcccagctacttgggaggctgaggcaggaggaacgcttgaacccgggaggcagaggctgcagtgagttgagatcatgccactgcactccagcctgagggacagggtgagactgtgtctcaaaaaaaaaaaaaaaaattccaaattttccatctacagtgataggaaaaggaacccctaaaaaatctttttttcaatcacatgaccaaattaaaggttgggtaaggtaaaactcatccagaatatgcataaaacttgaactttaacttttttgattactaacaagataaatttatagatctacttttatgtaacagtaacagaacaggtacaacatggaccccaaagtctctgctgagcagaaaactggaaatgactagaaatatactgacagaagagaaaagctaaagtagaactacatagtcaagaagaaagctccgagggaaggttgtggattcaaatgaatacgtagatagctcttctaagactccacaatacattcctcattcctgtagagccagactactccttcccaaaacctacagggcagcaaatctaagatccacaaaaaccagagctcctattttattaactgctccccttgtgccaagcattatgctttagtaatctcatttcatctcagcaacactatgacataggtgctgctatcctcagtaccgaagcgcagtaactaaagatcaacatcacacaaacgtcaaagttaaggccaaaaaaatatatgctactagaggatttccacttttcctctcttattttttactatattttaaatactgatcattaacacaaacttctacaagtaaaaaaattttatataatgaagtagtacatgctcattttaaaaaccaaacattgtaacttcacaaagtagacattaaacattttctatactgtcaccagctagagaccatcactattaacttgttacaggtctttccagaccttttcttaaaagcattaacagctgatgtgccaagtcagtacaattatctacttatactatacatatgtaaatatgaggtaaaatgtctacctatagatagtataaattgtaagcaaaagcaaattgttgctcaaacctaggttaagtcaagtttggatttaactatatagaatattctaaaaagcacataaaccaaaaaaaaaaaatgatgaaagagaaggtggaaagatgaaagcaggaaagggccaaatacagtctagcaactcaattcagcaatacagccagtttgtcactacctacctacttaagagctgattctaacatctatttccatggtaactaggcattaagcaaaaaatatatatataccagacttttaggaaaagattcctttctcctccaccagaaaaatgcctagtttggcaaatttaagcaatgtaatctggaagtctgactttatgtcagaaatttcagtatattagactgtaaaacatcttaaaatagttattaagtaattggagggggtggactacaaggagtaaaactgatcatctacaaatatcataatcttagtttctaaaattagagttccagttgccttctattgacatacaatatgtccaaaacccagtaaaatatttaaaattataaaacgcaatatataaacaagaactatttactgacatctagtaccacctggccacctggaaaattgacactggactttcaaatctgaacctttaaaaattaatgtaagcataaattaaattttaagtaaaaacatacagtaaaataatacctctttcgttactgataggatatgggcagaataatgatatgcaaaccagcagcatttttttttttttttttttgagacagagtcttactctgtcacccaggctggagtgcagaggtgtgatctcggctcactgcaacctccgcctcccgggttcaagcaattctcccgcttgaacccaggggttcaagcaattctcccgcttgaacccaggggttcaagcaattctcccgcttgaacccaggggttcaagcaattctcccgcttgaacccaggggttcaagcaattctcccgcttgaacccaggggttcaagcaattctcccgcttgaacccaggggttcaagcaattctcccgcttgaacccaggggttcaagcctcctgagcagctgggattacaggcgcttgctaccacacccggctgattttttgtatttttagtagagacggggtttcaccatgttggccaggctggtcttgaactcctgacctcaagttatccgcccgcctcagcctcccaaattgctggggttacaggcgcaagccaccgtgcccagccatatctttttaaaaatatgctcaacattttgaaaccatgtaaatattttacatcaaaaaaattgaaaaggaaaaaacagcactccttagaaaccaaaaccaaactgaagtaaatgttctattttcaactgctgacataaatacacagagaattattatttcaagtatcttaaatattaatatttatttaaaatattattttttattaaaatttataaaattttattttcatttaaaaagtattctgagcttacatccctactggaatacagcctaaggatgtaaatagacagacaaaggaatctcaaactacattatggtattgttatctcaaagctaatatgtgttatatgtataatataatgttaatgttgttaggaaccaacatttttagcataagataaaaaatgatataggccgggcatagtggctcacgcctgtaatcccaccactttgggaggctaaggcaggtagatcacttgaggtccagagttcgagaccggcctggccaacatggcaaaacctggtctctaataataatacaaaaattagccaggcatggtggcacgtgcctgtaatcccagctacttgggatgctaaggcaggagaattgcttgaacctgggaggcagaggttgtagtgagccgagatcatgccactgcactctagcctgcggggggacaaagcaagactccatctcaatttaaaaaaaaaaaaggccaggcacggaggctcacgcctgtaatcccagcactttgggaggccaaggcaggcggatccggaggtcaggagttcgagatcagcctggccaatatagtgaaaccctgactctactaaaaatacaaaaattagccaggcatggtggagggtgcctataatcccagctactcgggaggctgaggcaggggaatcgcttgaacctgggaggtggaggttgcggtgagccaagatcacgccactgcactccagcctggacaacagagcgagactacgtcccaaaaaaaaaaaaagacacaactataaaagaagttacatggctgtactcatcaagaaggcatcacaggcaaagagggaagcccctgctctcccaacgtcaaagccaaaccaaaggctctaaaggccaaaacagcagtgctgaaaggtatccgtatccacagccacacaaaaaagagaagatcttcacgtcacccacctaaggacagcccaaaacactgctgctgttctggaggcagcccaaatatccttggaagactggtccagtccaggagaaaccagcttgaccactatgctatcaagtttcccctgaccactgagtcagccatgaaaagaacagaaagtcaacaacattcttgtgttcactgtggatgtcaaggccaacaaataccagatcaaacaggctaagaaaaagctctgtggcactgacatggccaatatcaacaccctgatcaggcctgatggaaagaaggcccatgttctaccggttcctgactatgatgacgttgccaacaaaattgggatcatctaaagtgagcccagctggctaacactaaatagacatatttttcaccataaaataaataaataaatcataaaataagttaaacaaaacctctgtaatttttcatgaaaactggaaatatcagtatgaattgaaaatttattcttctctttttttttgagacagggtctcactctatcacccaggctagggtgcagtggcacaatctcaactcactgcagccttgacctccaggctcgggtgatcttcccaagtagttgggactataggcacacaccaccatgcctggctaatttttttgagctttttgtagagacagggttttgccatgttgcccaggctagtctcgaactcctgggctcaagtgatccgcccacctcagcctcccagagtgcttaggttacaggagtgagccacctcacccagccataatttactctaattaaaaaaaaaaaaaaggaggaaggaaggaaggaaggaaggaaggaaggaaggaaggaaggaagggaggaaggagggagggaaggaagggagagagtacttcctgtatctaaatactaaaaaaccatagaagtcatgaccaacccagcagcaatgagcacccttaacaccctgattgtgatctctaaaaaccatttcccacttgagaaaaccagggctacttgttcttttctttttatatatatatttgatgtcattaatgtctcagcaaccagggttccttaaagaaatagctgattccagatgcggagcaggaaatgtacaaagtgaacctgatatcccttgtgccagaaagagagtaagttattgaaaaccgatgggacaatattcaaaagaacacaggaacccatctgaaggggttccaactggccaaagatgagacaattgaaacatgaaaaacagcaactacaatggattaaaacacatcacatacataaaaatccctaacactaaaaataataaaagaaagaagaaaaatttactggtcgttttagtgggttcctaggacaccaactcattattataaaaactggcaaaacgaggtgggagaggaattaaatttttatagcctccacttctagattttaaagacagtaaatacatgaaataaaagttttctttacaaaagaatttcaactaataaatgtaggagtgatataattccaaaatcaccgttttgcaatccttatataatggatctagtcaacaatcctcagatgctgcgaaaacctttgtgtgaaagttgataagaactttataaaggatagatcaagccaacataatctaaaaccactgaccaatcccagcaatactgaaagtgaaccaacctcatgatggtaactaatagaaagaatacagcacctcttataaacaatgctcaccaaaaaaaaataccctctagaacgaatgttcagtttacaggaaattacaggggttaaaccaaaccacaaagatgtaatcagccaaacagaatgtgggaaattctacaggttaaataacagtttcttcatcaaataaagggcatgaaaagggtggagatttaagagaccatttagaaccgtatcttccaactgcaatatgaagactttatttgggtcctaatgtaaacgaacaaattgcaaagacattttagagacaggctaatctgaacatgttcttgctaccagatgccattaaggaattaatgttaatgttattcattgtgacaatggtatgacagttgtactatgaaaggaaagttcaagtgtgtcagagatacataccgaaatacatatgggtgaaatgatatctggaatttgctttaaaatgctacatggtgagggagaaaggagagaagaggggcagcagagtgaaacagataataccaagatggcaaaatattggcaactggtgatgctaggccatgaatatgtaaaacatcagtgaactttatttttgtatgttgtaaatttccataaagttttaaagctgtatcaccagcatgtttgttaccatgaagtgtattcgtctctaatcatttatttttactagtctccagaattaacaccactaattttccaaaaattagaaaatgttatgtttcaacttatatatttagtctaaaaatcaattaccgtattacattatatatatccatatatatgaatataacgtatatttatatatatccatatatatgaatataacgtatatttatatatatccatatatatgaatacaatgtatatttatatatatccatatatatgaatataatgtatatttatatatatccatatatatgaaaatgactatctgcattataaagtcactgtgcctatccacagttaaatatttgtttagcagaattgtatttacatatagcgtttcattctacttcaattttatttgagatcttcattttacttaattagaactccatatctctttcatcaacacctaatcacagttaatactacaatcagaacaatttaagttataactcaaggggcacagagatggggaaccaaaccatactgttaatgtttgccataaaagctggcttcaatccatgcacagaggcatttcattcattaaaaactgcagtctcagcccagcacagtggcatttcattcattaaaaactgcagtctcagcccagcacagtggcatacacctgtaatcctcctgtaaagctactcgggaggcagaggcaagaggatggcttgaacccaggagttccaagccagcctagacaacaaagtgagatgccacgtcaaaaaaaaagcagtcttactgtaagtctctcattatactttctagagccaccttaaagtgtgaccctaatacaagttcatgtacataagaagctttttggtgttttcctaagggataaactgtggtttggttttgttttttattgagacagagtcttgccctgtcacccaggctggagtgcaatggcgtgatcttggctcactgcaacctccgcctccagggttcaaacgattctcctgcctcagccgcccgagtagctgggattacaggagcccaccaccacgcccagctattttttgtatttttagtagagacggggtttcttgaactcctgaccttgttatccacccacctctgcctcccatagtactcagattaaaggcgtgagccactgtgcctggcctaaactgtgtttttgaaattatctgaaggtttaatacctgaagaaataataaacgctcagagttcagcctagtcaaaaattaacaccagcctctaatacatcagagagttatttactcatagaaacaaatgcttcttgcctatcagtgtttaatggtatcatttgagatctgaatcctggcactggtttttaaaagcggagcagttctctggaaaagaactctggattatgagttaggagatccaagttagggggttggtctatgccagagtttgaactcataattcttgttcattggtggttagctgcttgaagcagtagtactatcttgcaaaggattctaaagcttcatttaggagcaaccaatttttaaacgtatgatgcaaaaaatatagaactaaaaaagagtgtagcttcctgggtatctttttattgtcacagaagtaatttaagtatttagtcctgttcttaaatatccaaatgggttcctgaaacactgtccctctacccacatgttactctaccctcgctcccccataaaagaaacccagaaaaactactggtggggagaggtacttccatttgctttttcattctatccagcaaccaataagcggtgtgactgtcagaaaaacaggctctgggccaggcacagtggctcatacctgtaatcccagcactttgggaggctgaggcgggcaaaccgcttgaggtcaggagtccgagaacaccctggccaacatggcaaaaccccatctctaccaaaaaatacaaaatttagccaggtggggtggcgggtgcctgcaatcccagctacttgggaggctgaggcacaagaatcacttgaacccaggaggtggaggttgtagtgagccgagatcatgccactgcactccagcctgggcgacagaatgagactccgtctcataaaaaaaaaaaaaagaaaaacagactctggaggtcaaaattgagttcaactctatgctctataactttctctggtccccattttccctatctgtaaacagggaaaattaaagtattctcatagtgctatcatgaagattaaatgagatatctgtgcttagaagacaacataacacatacaaagcagtactcaataaacttcatcatttttaattattattattattactatatttagcttattctacattaaagatgccttgcaaggagaaaaaaggaactacaagaatacttttttttttattttttgtgagacagagtctcgctctgtagccaggctgaagtgcagtggcacgatctcagctcactgcaacctccacctcccaggttcaagcgattctcctgcctcagcctcccgagtagctgggactacaggtgcatgccaccacgtccagctaattttgtgtgtgtatatttttagtagaggcggggtttcactatattggccaggatggtctcaatctcttgacctcatgatctgcctgcctcggcctcccagagtgctgggattataggcgtgagccactacgcccagccaacaatacatttttttaagtattctttttttttttttttttttttttttagtatacagacagggtctcactatgtttcccaggctggttttgaattcctgggctcaaacaatcttcctgcctcagcctcccaaagtgttgggattataggcgtgagccaccacacccaggcgaatctactttttctactgtaaattttattaaatctaaatacagaacaagcatctctgctgaaaatttagtgcccagtgtggtggctcacgcctgttatctgaacactttgggaggccaaggcgggagaatcgcttgagcccaggagtttgagaccagcctgggcaacatggtgaaaccttgtctttacaaaaaatacaaaaaattagccaagcgtgctggcacacacttgtagtcctaattacttgggagactgaggtgggaggatcgctagagcctagaaagtcaaggttgcagtgagctgtgatcacaccactgtactccagccggtgagagtgagaccctatttcttttttttttttttttttttctccttttgagacagggtggccttgccctggcccaggctagggtgcagtggtgcaatctcagctcactgcaacctccctccacctcccaggctcaagcaatcctcccacctcagctaccggagtagctgggaccacaggtgcccaccaccttgcctaactaattcttttttttttgtgagatgcagtctcgctcttatcacccaggctggagtgcagtggcctgatctcagctcactgcaacctctgcctcccaagttcaagtgattctcctgcctcagcctcccaagtaactgggattacaggtgcctgctaccacacccagctaatttttgtgtttttagtagagagggggtttcaaaactcctgacctcaggtgatccgcccacctcggcctcccaaagtgctaggattacaggcatgggccaccgcgcccagccaactaactcttttatatttttagtggaaacggggtttcgccatgttgcccaacctggtctcaaactcctaggctcaagtgatccacccacctcggcttcccaaagtgctggtattacaagcataagccactgtgcctggctgactctgtctcaaaaaacggaaaaaaaaaaaaaaaaaaaaaaaacagcaaaaaaaaacaaagaaacaaggaaaaggaagggaaggggaagggaaaggggaaggggaaagagatggggagggggaagtgtaaagggagggaggggaggaaggaaggaaggaaggaaaaagggaaagggaagtggaagagaaggaggggaaaggaggggaggggaggggagggaaaggagtggggacagaaagacagaaagaatttagtatccaaattgagacatgccataggtataaatatacaccagatttcaaagatatagtattaaaaaatgtaaaatatctcaataattttgatatcattacatgttgaaataacaatgttttggatatgctgggttaaattaaacattatcataatgaatttcaacacctgtttctttttatttacttaatacagctattataaaagttaaaattacacatggcttgcattatactcctattgataacactgctctaaacaatacacgttagcacttgaacacctgcccactgcttctcctttctcttatttgtcattactaataactgctgtgggtcacttagtagaggccatgctaaatgctttacatggattacctcattcaatccttccaaagtaggaggtacattttatcattgtcctcatttcagacaagattaaaatttaagcatcacagaaggttacattacttgcctaacatcacaaggcagtaagtaatagtgccaggattagaattcagtttgagagtttatattcttctttttttcttttttttgagacggagtctcgctctgtcgcctaggctggagtgcagtggcgcgatcggctcaatgcaagctccgcctcccgggttcacgccattctcctgcctcagcctctcgactagctgggactacaggcgcccgccaccacacccggctaattttttgtatttttagtagagacagggtttcaccgtgttagccacgatggtctcaatctcctgaccttgtgatccgcctgcctcggcctcccagagtgctaggattacaggcctgagccaccacacccggccagagagtttatattcttaaccaatgacgctgtactatcttccacccaaaatttgtattcctgaattttatgttatctaaagacactgcccccaaaacaaatattttccagtggttctaaaagccagtccttttttaaattaaaaactagaggtgggggaaaaaaaaaaaagcaaagcaaaaaacaaagcctacacaacttgactccaagaacgaagattaggctggacacagtagctcactcctgtaatccagcactttgaggggccaaggcaagaagatcatttgaggccagaagttcgagaccagccttggcaacatagtgagatcccatctctaaaaaaaacgagaaacagccaggcatggtggcacatgtctgtaatgccagctatttaatacttgggacactaaagtgggaggatcacttgagcccaggggttcaaggctgcagtgagctatgatcatgccattgcactgcagcctgcagaacacagcgagaccctgtctaaaatacaataaaatgtaaaaagaacaaagattaaccaaagctatatgaatctgacttccaaaaattaggtgcacaggtaataagcactcttttatcataatgcaatgcacactagctatactacatattctaaattattagaaattggttatttggagacatttagtaaagtggttcatccctaactctacaatatattacaggtatttttttttggcacatataaaccaaacatgagtattttacatgcatcatcatatttaataacaaagcaagcaatgaagtaaatgttattagccacatttctcatatactgaaaataaaactcaaagaagtaaattgcctaggccaggcacggtggctcacgcctattatcacagcactttggaaggctgcggtggacagatatcttgagtccaggagtttgagaccagcgtggcaacatggtgaaaccctgcctctacaaaaaacttgccaggcgtggtggcatacacctgtagtctcagctacttgggaggctgaggtgggtggatcacttgagcccaggaggtggaggctgcagtgagccaagatcacaccacagcactccagcctgggcaacagaggaagaccctgtcccgaaaataaaaaaaaagaaaagaaatgacaacattaacttcaaaaaataccatctgagcacatacaaaacaatcttgtgtgatttaaaagtgcaattactcaaggtcccttttcattatcttctatagcaatcctttagaaaatcatgttaaacagaaaagctgcctacttaaaaagtgaactgtatcttagagattaagacagattcaaatcataaaacaaattaagagttaaggggcactcatctgtttttccaccattgtgctataaatcatcaccatcctcatcatgcaaaggtctggaaaggctgaattctaaaacaaacatctgcctttagaagagtcaggcactcaaattggagtttatcaaacccagtggttaccttggagactacccatcaccacaagcatatacctagcagataagatcaagcagaaagcatctgctaattaagtgtattctatgcatggcctgtctgtattagtacgtaatttccatcttcataaaattcctttgtggtaaatagtaaatactaatctcattttatagcgaggcctaagaagctaaatcattttgccacactaaggaaactctggtaggcagaatgcactccccctccccacaaaatgaccacatccgaatctccaaaacatgtgaaaatgttatctatcaaggggaaatttaaagctgacatggaatcagagttgctaattagttgaccttgaaagggggagattagcttgtattatctgggtgagccctatttaatataaacacaaggatacttataagtgaaagagggaggcaggagagatagtgtcagagacagatttgaagacaccaggctgctggctttgaaaataggagagaccagaggcaaaggaggaaatacagcctctagaagctggaaaagaggcaaggaaaccaattctcccctagagcctgaagaagaaatgcccagtgagacccacgtcagacctctgacttccggatttgttcaaaactcctccctctcgatacacacataaaaacacacatacacttacaactaacaactcacacagtatttggcacttctaaatgttctgtgtactaagaaaactagatatccaagtaaagatatatattaaagaggcagaaacagcattaatattagtaggagctctggtttgaagtagtttaggtttaaatcctcactatgccacttactagtggcatgaccttagttaggtaaattatataatctctctcggccttgagtttttcatctgtaaaataagaatatatctatgtacctctcagggtattttgagaattaaaattttaaatgggccaggcacggggactcacgcctataatcccagcactttaggaggcagaggcagggggatcacttgaaccggggagttcaagatcagcctaggcaacatagtgagaccctgtctctatgaaaaaagttaaaaattcgccaggcatggtggtggacacctgtactcccagctactcaggaggctaaggtgggaggatcacctgggcccaagaggtcaaggttacagtcagccatgatcacgctactatattcctgcccaggcaacagagcaagaaactctgtcttcaaataagaaaaaactacatataatgtaagaaaagactgacatatattaagcactgaataagcagtggcaaaattatcatatgataataacaaaaacaataataattacagcataaagaacatgatgaccaggaaagaggctggtgtgataaatattttaatgctatttcagaacaagacaagactgatgacagttagtttgagataaatgggatgttactttagcaataaagacaaatttagaaattacatgcctactaaaaaataagattgtgctggctgggcacggtggctcactttgggaggctgagacaggcagatcacaaggtcagaagatcgagaccatcctggctaagacagtgaaaccccgtctctactaaaaatacaaaaaattagccaggcgtggtggcacacacctgtagtcccagttactcgggaggctgagccaggagaatcacttgaacatggaaggcagaggctgcagtgagccgagatcataccactgcactccagcctgggcaacagagtgagactccatctcaaaaaaaaaaaaaattggactgtgctaattactaaagtatatgaggattaactactatttattattacagatttataatatatcatgtcaaagcatctgcttaacattccaaatgtgaatatataattttagggctctgtatgatcccttaaataaaatctctttttttaagacagagtctctccctctgtcgcccaggctggagtgcagtggtgtgacctcagctcactacaactttcacctcccggattcaagcgattctcacgcctcagcttccagaacagctgggatttcaggtgtgcaccaccacacccggctaatttttttgtatttttggtagagacagggtttcgcgatgttggccgggctagtctcaaactcaaagtaaacttgcaattttccccgcctcagcctcccaaagtgctgggattacaggcattagacactgtaccatgccaaataaaaactgtttacaatagttgtaaattacctgaacctccccttcactacctccatcaatgcagaaaaactacaattggaaagcttttcagtgagagaaagaacttgtacctacaaattacagagaaaaaaaattataatgggggaagggggaatgggatagacagaattaagtccatacaagtaaatagaaaatgtctggctgggtgcagtggctgatgtctgtaatcccagtgctttgggaggccaacaagggaaggtcacttgaggccaggagttcaagaccaacctgggaaacacagtgaggccacagcactacaaaaaaataaaaaacttagctgaatgtggtggcgcaagcctgtattcccagctactcaagagactgagatgggaagatcccttgaatccaggagttcacggctacagtgaattatgatcacaccgctaaattccagtctaagtgacagagctaggccctgtctctttacaaaaaaagaaaaaggaaaaagaaaagaaaaaaagaaaatgtttcaaatggccaaaggaaacttgcaatttaagagaaggttgactgttctaaagattcttcagccaaagaaaaagagagagagaaaaagagagacaaaccacccagattgtaaaacttttctgagctagatcatattctgtgtcatcacttggcagaagagataggttctgaactcaagggctcaaatgacctttcaaagtctcttcaggctatatgggccacagtgtttcaacgcaaaattacttgtggcaatataaccagaggattcatttttctcctactttaaaatattaactcttcaaagctttgtacaaagcctctaattttctaatttataatactaattttcctttcttttagagatagagtctcgctctgtcgcccaggctggaatctagtggtgcaatcaaggctcactgcagccttgagctcctgggctcaagctcctcctgtctcagcctcccaagtagctggaattacaggcacaagccacctgtccagcttgacactaattttcaagctagcaaagttctcccagaagaactaagtccactgtcgttcatttttatgttttttcatatgatttcttctaattttttttttttttttttttttggagggggacagagtcttgcatcttgctctgtcgcccaggctagagtgcagtgacctgatctcagctcactgcaacctccgcctcccaggttcaggcacttctcctgtctcagcgcctgagtagctgggaccagaagcacatgctaccatgcacagctaatttttgtattgtatttttagtagagacagggtttcgctgtgttggccaggctggtcatgaactcctcctgacttcaagtgattcgcccaccttggcctcccaaagtgctgggattacaggcatgagccaccgctcccagcctgattttttctaatttttaagaaacaggggctccccctccccctccccctccctctccctatccctctccccacggtctccctctccctctctttccacggtctccctctgatgccgagccgaagctggactgtactgctgccatctcagctcactgcaacctccctgcctgattctcctgcctcagcctgccgagtgcccgcgattgcaggtgcgcgctgccacgcctgactggtttttgtatttttttggtggagacggggcttcgctgtgttggccgggctggtctccagctcctaaccgcgagtgatccgccagcctcagcctcccgaggtgccgggattgcagacggagtctggttcactcagtgctcaatggtgcccaggctggagtgcagtggcgtgatctcggctcgctacaacctccacctcccagccacctgccttggcctcccaaagtgccgagagtgcagcctctgcccggctgccaccccatctgggaagtgaggagcgtctctgcctggccgcccatcgtctgggacgtgaggagcccctctgcctggctgcccagtctggaaagtgacgagcgtctctgcccggccgccatcccatctaggaagtgaggagcgcctcttcccggccgccatcccatctaggaagtgaggagcgtctctgcccggccgcccattgtctgagatgtggggagcacctctgccccgccgccccgtctgggatgtgaggagcgcctctgcccggccgtgaccccgtctgggaggtgaggagcgtctctgcccggccgccccgtctgagaagtggggagaccctccacctggcaaccgccccatctgagaagtgaggagcccctccgcccggcagccgccccatctgagaagtgaggagcccctccgcccggcagccgccccatctgagaagtgaggagcccctccgcccggcaaccaccccgtctgggaagtgaggagcgtctctgcccggcagccacccgtccgggagggaggtgggggggtcagccccccgcccggccagccgccccatccgggaggtaaggggcgcctctgcccggccgcccctactggaaagtgaggagcccctctgcccggccagccgccccgtccgggagggaggtgggggggtcagccccccgcccggtcagccgccccgtccgggaggtgaggggcgcctctgcccggccacccctactgggaagtgaggagcccctctgcccggccgccaccccgtctgggaggtgtacccaacagctcattgagaacgggccatgatgacaatggcggttttgtggaatagaaaggggggaaaggtggggaaaagattgagaaatcagatggttgccgtgtctgtgtagaaagaagtagacatgggagacttttccttttgttctgtactaagaaaaattcttcggccttgggatcctgttgatctgtgaccttacttacccccaaccctgtgctctctgaaacatgtgctgtgtccactcagggttaaatggattaagggaggtgcaagatgtgctttgttaaacagatgcttgaaggcagcatgctccttaagagtcatcaccactccctaatctcaagtacccagggacacaaacactgcggaaggccacagggtcctctgcctaggaaaaccagagacctttgttcacttgtttatctgctgaccttccctccactattgtcctatgaccctgccaaatccccctctgtgagaaacacccaagaatgatcaataaaaaaaaataaaaaaaaagaaacagggaaatttacataaaaatgtttcataccatgatacaagtaaattctaaatttaaaactttttcaacaaagtaagtaggcaaaaggtttgtaaactacacttactattcaataaagccatcaaaaagtcactaaatggcaacaactttattatttatttataataactagtagagaggcagcatggttcagtttactaacaaaagaacaggctctgtgatcagtttaatgtgtgcctgtgggcaaatcactcaacatctttacacctgcttcttcgaccataaaaagggaaaaatgttgctgacctgcctcaaagggatgttattagatataactaatgattatggaactttaaaaacgtaatgtgccatataactgtacggttaaagaattccttataaactatatattctgactttgagcatatgctggggacacttcctatagagatccattccaaaattaacgtgtttttgattttgtttttaaaacggggtcttgctctgtcacctaggctggagtacagtggctgcaatcacagctccactgcagacttgacatcctgggttcaagcaatcctcccagcctcaacttcctgagtagctggaaatacagtcacaggccaccactcctggctattttaaaacttttttgtagaagcagggttttgccacattgtccatgctggtctcaaactcctgggttcaagtaatccacccatatcagcctaccaaactgctgggattacaggtataagccaccgcacccggcccccaaaattaacctgtctaatcaatgctaacagggatcccaaagaacagcataagcttttttagaaccagccatatagcacagggatgctccctcactaatcctcatagattaccttttagtaacaatgtcatgcaatgatatttaacagttggtggctgcaataattcacagggcaagagttcaagaccagcctaggcaacatagtgagaccccatctctagaaaatataaaaaatcaacctatggtgacccacacctgtagtcccaactactcgagaggctgaggtgggaggatcgcttgagcccagaaggtcaaggctacagtgagccgtgattgtactgtgcactccagcctgggtgacagagcaagaccctgtctcaaaacaataataataataataataataataataataataataataataattcataggactataagaagctttgtatatataataggtactgggactatttgccacctactagtactaggcatccaaataagttaacaatacttactgaaggccaggcacagtggctcacacctgtactttgggaggtcgaggcaggcagatcacttgaggtcaggagtttgagaccagcctggccaacgtggcaaaaccctgtctctaataaaaatacaaaaattagctgggtgtgatggcacgggactgtagtcccagctacttgggaggcagaaacatgagaatctcttgaacccgggaggcagaggttgcagtgagccaagactgtgccactgcactccagcctgggcaacagagcaagaccctgtctcaaaaacaaaaaacaaaacaaacaaacaaacaaacaaaaacagtacctactgaatactaagcactgctacatacctgcaaaacttaaagaaacataccggtgccctatataaattatttggttgtagaaaaaataacatgttgaatgcaaataaaatcttactaaagccatcaagaagaatgacacagacttgtgtaatatgtactgatatagaagaatgtaaaagaaaattatgggccaggcatggtggctcacgtctgtaatcccagcactttgggaggccgaggcaggcaaatcacgagctcaagagatcaagaccagcctggccaacatggtgaaaccctgtctactaaaaatacaaaaattagctgggcgtggtggcgcgcacctgtagttccagctactcaggaggctgaggcaggagaactgcttgaacccgggaggcagaggttgcagttagccaagatcgtgccaccacactctagtctggtgacagagcgacagtccgtctcaaagaaaagaaaagaaaagaaaattacgaacaatatgcatagcataagcccatttcaatacagtcaaacataacaaaataaatactcatgtttgattcatatgtgcaaagaaaaaggtgtggaagaatacacccaaaaactgttgaatcaagttaccaggaagtaagacttctactgtccactgaatactactatgtaatttttaatgtttacagaaaatctttattgctttcataataaaaatttctttaattttgctagaagaactagtttagaaaaatatttctccaagttagagcaaagcacgaataggtgacttactaaatgccaaaagctctctggcttgcctttaaaaaaaacaacaacactttagcaaagaatattcagattaaaaaaaacagaaatggggctgggcgtggtggctcccacctgtaatcctagcactttgagaagccaaggcaggcgatcacctgagctcgggagtttgagaccaccctaggtaacattacaaaaccccatctctactaaaatacaaaaaattagccgagcatggtggcgcatgcctgtagtcctagctactcaggaggctgaggcacaagaatcgtttgaacctaggaggcggaggttgcactgagccaagattgcaccactgcactccagcctgggatgcacagcaagattctgcttcaagaaaaagaaaagaaaagaaaagaaaagggttctttgatgaggtatccttatcaagataaaactgaaaatgtgaaaagttgaatttttgagatgcagtctcattctatcacctaggctggagtgcagtggtgcgatctcagcttactgcaatttccacttcccgggttcaagagattctcctgcatcagcctcccaaacaggcataccaccatgcctggctaatttttatattttcagtagagacaaggtttcaccatgttggccaggctggtctcaaactcctgacctcaagtaatctgccagcctcaaacgcccaaagtgctaggattacgggcatgacccaccgtgcatgcctaagttgaattttttttttttattctgaaatagacataagccaagctgcttcacttaactttgacagcaatagtggctcctccgtgttcaggcttgttcagctttttttaactcctctctggagtagagactcgggtttagcagggctcctacagtcattcgccctacctgcctaggctgcccatgctagatcagcttcaggtggctgactacaccacatcagaacagtattctgatcaagaaatgaaaacaatttttgccatacataaaaggctatacagatggatgcttatccagaaaataagtatcttcagtagttcacctaatccataaataaccctctaggcttggaagtaaaatttacttttcccttacaaggaaagacgggagcaaattaggagagaggagatgtattatatttactaagagaagcttctgcatcagtaagtaccaggaaaataaaggttagacatgagagcaaagagttcttggaataaagaaatctggttatcaccttctactaaacattctgtttttaaggatttcagaaggaaagaataacagatttaaggcttaatcacaaaactgcaacttcaaaattaacttttaaaagaccagagtcaatctatctccccgaaagcctacttaaactcataagaatctgcacattctttctaccgaactaataataatagctacaatgtattgagaacttactatgtagtaaatcctactacatttagtcaccccaaacaaccccatgaggcaattactgtaagcatttcgtattttagatgaggacaccagtcttcttggaaagtttaagaaaaactgcctacactctggtaagcaggagtggcaattcaatcccaaacagtcttgattaaaagaatcctcactctatcagcttatttaaaaaaaaacaagacaggcttcctctaataatacaactgccacgtactaactgctcagaactatgccaagcacagtgtaaagcattttaaatatggtatttcatttcatatttacacaactttacaaggtagctgttattattctcattttacaaaaattgaaactgatgtttactttcatttcaaaaacagtaactttacccaaacctcagcagccaagtaaaggacataaaaaggactggaaataagaccactgactttccaagccatatgctcttaatcatgaagctacaatgtttactgggcactttaaacaaagacagttttcacagtcatattcaagcagtaaattaagagaggggacaagtagatttaccaagaaaagcttctgcatcactaagtagcaggaaaagaaaggttagaaacaacagcaaggttcctggaataaagaaatctggtttatatttaatttacatataaattatcttaaatgatatataacaatatatataacattttactatcagtaaaatatgtttataaatacgtatttatatatatttcggtatatacattattttggctatcaatataaagtaaatcctttctttaaataccacttgctcaaaggttttagtttataatcttcatttgctattgaagtgcattgttaaaatatgatgttcaatgaaacttactaaagttatcaatgactatgttctcataagcaattataccctgaaatcaaaaggttatcaattagcagatagcattaatagaacttttatataggatttcagatattctagttgtcacattgccaaaaatttatctataaactagagaaaaatggcttaaatgagaaaagtctacatataaagtatctgtcccattgtccaggccaggcttggtggctcacatctgtaatcccaacattttgggaggccaaggtgggaggatcacctgagctcaagagttcaagactagcctgggcaagataaggagaccccgtctctaccaaaaatacaaaaaaatttagcgaggcatggtggtgtgcattatttgtagtctcagctacttgggtgactgaggtaggaagatcacttgagcccaggagctggaggctgcagtgagctatgattgcgccaccgcactccaacctgggccgcagaacaaggctatgtctccaaaaaaataaattatctgtcccactgtccaagatatagtgtaagtaatctcacacattttaatggtataaacctactgcctaattattattctcttaattgatgacaggtaaatttgtaacttaaaagtgatataccctattttcttccttataaatgtaaatttgtaactttaaagtgatacaccctattttctaccttataaatcagtaataatggcccagagaattagcccgttctaccaccttactatcaacactaacattaatctggaaagacattagttacagggatgttgaattctatacttacgtctaactgtatcctaaagctaagcatatctggttattcacagttagatactattcttgccttagataacccgattagagtaaataattgaatatgcaaaaggtaagagtaagcatatactaacatttgtaataaatagtttcataaataatatccaatgtgccatggtggtgtgcacttacagttccagccactagagaggctgaggcagaaggatcactcaagcctaggagttcgagaccagccaacgcaacataccaagactctgatctcataaattaaattaaattaaattaataaataatcccaatttgctacagactacaattccagatttccaggaaattattttggaaattattttataaaatgtttccatggatcaaaggctagttataaatttaaaaaattcaaattcttcttaggaattcaacgaggtaaacatttcaagcaattcacattgagtatccctaactcaaaaataagtggggtgcagtggctcacacctgtaattccagcactttggaaggctgaggcgggcggatcacttgaggtcaggagttcgagaccagcctggccaacatggtgaagcctcgtctccactaaaaatacaaaaaattagccaggtgttgtggcacacgcctgtaatcccaactactctggaagctgaggcaggagaatcacttgaacccaggagccagaggctgcagtaagccaagatcgcactactgcactccagcctgggcgacacagcaagacttcgtctcaaaaaaataataatatatttatataaggctgggcacggtggctgatgcctataattccagcactttgggaggctgaggcaggaggatcacctgaggtctggagttcgagagaccagcctggccaacatggcgaaacctcgtctgtactaaaaatacaaaaattagccaggtgtggtggcaggcgcctgtaatcccagctacttgggaggctgagggagaagaatcgtttgaatccgggagccgagtgttgcagtgagctgagatcgcaccactgcactccagcctgggtgacagagcaagattctgtctcaaacaaccaaacaaaaaaacaagatacagatatacatatacatacgtaaaacacaaaaaatcagaaatgctacaaaaactgaaactttttcagtgttcatgttacaccaaagggaaatgctcactggaacattttggattttcagatttgggatgttcaaatactaagcatataaatgcaaatattccaaaatctgaaaaaatcccaaatatttctggtcccaagcatttcaggtaagtgatactcaacctgattaagcatttcacctaaatgttaacatttcagaaacaatataataaaaatttttttctgattctgcaatgatttaagcaaaaataaatttgaaaataaaatgaacagtgactagttgattactttttctttaatggtaaaagtagaaggatatagaaacaactcttcctattaaatagattagcagcagatcagtcaacagatgataccacagagctgtgtttcttaacatttgtactgtgggtttcatcaagaatctgatgaaagctatctatggctcctctcctctgaagcctacacttggactttctgagtaatatatgagcaagcgttaattaaggaaaggggaaactatgctcagagtaagccaagtattgttttaaaacttttccctttttgactctttcattatgtcccttgcttctattaaccagcttaaaataacagccactatggtaaggtgaacatgaagatagtttgtctatgctgaccttagtagacctgctttttattttctagtaaactgtttatatacttccataaactcatttttttcttccccaaatctgaatgctgtctccaattttagaacgaaaattatgatttctaaaagcacattattttctacggaaaccttgaataccagagtttcctgtactcctaagagatccaaagagccaggaatttctacctgttttgttccctgacatattccaactgactagaacagagaccaatacataataagtattcaataaatattgaattaattttttaaatgtccaactccttggtggccacttgccacaacacaaaatacatgaagttaaatactcagcactccccaggttatcacacaggtaatattagtaccctaagaactgaaaggtccactcccaggacccaagagaattaaaaatacatgttcgcacagaaacttacatacaaatgctcatagcagcattactcacaataagcaaaaaagcagaaataacccacatgtcctccaaataagtagactgacaaaatgtcgtatcttcataagatggactattattcagcaataaaaaagagcatagtattaacacttgctactccttttttttttttttttttttttttttgagacggagtcttgatctgacacctaggctggagtgcagtggcgccatcgcagctcactgcaacctttgcctcccaggttcaagcaattctctgcctcagcctcctgagtagctgggattacaggcgcccaccaccacacccggctaatttttttatttagtacagatggggtttcaccatcttggccaggctggtcttgaactcctgacatcgtgatccacccacatcggcttcccaaagtgctgggattacaggcgtgagccatcgcgcctggtcaacacttgctacttctttcacttatgggaagtaaaagaaatcagacacaaaaaggccacatatgtattacaggattccgttaacagaaaatgcccagaatacgcaaatccttatagacagaaagtaaatgctaagctcagtgtctgaatcttgtaatcccagcactttgggggccaatgcaagaggatcacttgagctcaggagttccagaccaggctagggaacatagtgagacttcactactacaaaaaattccaaaatttgctgggcatggtggcgcacacctgtaatcccatctacttgggagctggaggcaggaagatcgcttgaacccaggaggtcgatgctgcagtgagccatggtcgagccactgcactccagcctgggtgacagaatcaaaactcttctcaaaaaaaaaatttagattagttactggagggataaaagaaagggagaacagtgaatgactgctaatggataagaagtttcttgttgggaatttggaaatgttctggagttaaatagcagtgacagatagctagggataagtaacgtgcctgaagtctcagctactcaggaagttgagggggaaagatcacttgaccacaagagttcaaggccagcctaggtaacacagcaagacctcatctctaaaaaaacaaacaaaagaaattaacaaaaaagttttcaaaagatagtagtgatggatgcacaaacttgtgaaaatactagaaatttatgaacactttaaaaaggtgaatttggtgaggcgcggtggctcatgcctgtaatcccaacactttggtaggccaagatgggaggatcatttgagcccaggagttcaagaccagcctgggcaacacagtgagacctccacagaaaatttaaaagttagctgggcatggtgccgtgcacctctggtcccagctacctgggaggttgaagcaggatcacatgagcccactgaagatcaaggctgcagtgagctgtgattgcgccactacactcctgcctgggcaacagactgtggccatgtctcaaaaaaaataaaataaaagggtgaattttatggtatgtgaattatatctcattttttttaattaaaaaaacaagtgaaaggattgctcaactcaatgttcactgctcactgagaaggctaagatttgacaatgccttcatggtcatactcagttccaagaatcccatctaccaactaatcacagcaaaaagacttttttaaaaaaagggaggacggccaggtgcagtggctcacactttgggaggccaaggcgggcggatcacttaaggtcaggagttcagaaccatcctggccaacatggtgaaaccccattgctactaaaaacacaaaaaaaaaggccgggcgaggtgactcacacctgtaatcccagcactctgggaggccgaggcaggtggataacaaggtcaggagtttgagaccagcctggccaacatggtgaaaccccgtctctactaaaaatacaaaaattagccagacatggtggcacatgcctgtagtcccagctacttgggaggctgaggcaggagaatcgcttgaacctgggaggcagaggttgcagtgagccgagatcgtgccattgcactccaacctgggtaacgagcgaaactccgtctaaaaaaaaaaaaacaaaaaatacaaaaaaaattagccaggcgtggtggcaggtgcctgtaatcccagctacaggggagtctggggcaagagaattacttaaactcgggagacagaggctgcagtgagccgagatcacatcactgcactccagcctaggcaacagagagaggctccgtctcaaaagaaaaggagggagggcacttgtgggaggacatacatgtgcaagttgcagtaagtagaattttcccttcacacccaatccattgaaatccaatcatccccatcttcaaatatattcccaatactactatttctcctcaccaccatctctccccaggactagcttgacagccttctgactgatctccctacttccactcttgtgttcccatgatctgttcgaacccatgatgtgttcactacccagcagtcaaacatttttgaaaatgtttatcacatcacttcactcaacacccttcaaagggttcctaacacattcagattttactcaagtccttaccatgtcctataaggccctacaattgtactggccctttgtgaccctctctgacctcctctcctaccactccagccctgatggccttaatgttccttaaatgtatcacactcaaacatgccaagcacactccatctcagggtatttgcacttgttttctgcagggaatgctcctcccccagaaacctgaatggctcactctatcacttgtttcacagcacacttaaatgtcatctcgaaaaggccctccattatcacctaatctaaagtaacccaccctctgtcactctaacctcttattctgattccgtatcatttctcttcaaagcacttagcattattttttttcttaacgtgtgtccaccatagtagaaagtaaactccacgagggtaagaactcttgttctattcactgctgcatcctcaaaacccagaacaatgtccggtacaaggaaagtacacaatgtgttcaatgactgaattcactggctgacttggcaaaaacattcttcagtgacataggtactcacctagtattttttttaattacaataaacaaagatttagcaatttggacagaaaacatgttagtattttacaagattacctattcatctaaaggaccacaaatttatagcacaaaatttgccatgttatggatcttaaatcccttcaaatatcatagatatgaggttaacattcacaccagattaaccaagcctctgacttcatcctacctacttactcttacatcttaactagcaggtccaatgacagcatgcttcaaatgacagtaacatctatctaatttcctaagaaaaaaacctccatcttcttcctaccccaggatgagttactaggtcctgaattctacttcttttaagacagactcttgctctgtcgcccaggctggagtgcagtggcgtgatctcggctcactgcaagctccgcctcccaggttcgcaccattctcctgcctcagcgtcctacaggcgcccgctaccaagcctggctaatttctattttttgtatttttttagtagagacggggtttcactgtgttagccaggatggtctcaatctcctgacctcatgatccacccacctcagcctcccaaagtgctgggattacaggtgtgagccactgtgcccggccctgaattctacttcaaaaaggctcagatctatcctctctgctccacttccaatgcattagttcaggcccttattcattttccacttggacttcttacctggaatttccatccttacattcagctctccccttgtttttgcagtggcctgatctcagctcaccgcaacctccagctcctgggttcaagcaattctcaacaactttcaatggttccatgtagttttcaagaaaaaatttttttttttttgagacagagtattgctcttgtcacccaggctggagtgcaatggcatgatctcggctcactgtaacctccacctcccgtgttcaagctattcttctgcctcagcctccctaatagctggcattacaggctcacaccaccatgccctgctaattttgtatttttagtagaaacagggtttcaccatgttggccaggctggtatagaactcaggtgatccacctgcctcaacctcccaaagtgctgggattacaggtgtgagacaccatgcctggccaagaaaattttcgactccctcactcagcttcatctcccaccactgcccttttattcctacccaaacatatcatgctttaagttaattcagtcacaccaaattacttacagtttccagatacttcaccttgtttcgttcattttccagtacgttatcctctatctgaaaaacttttcttcccttctttgcctagcaaaagccttcgcactcagcttagatgtcaactccaccagaaaactttccatagctctctgatttagctgtcctcttctgtcctctcatagcatttcctacaattattttatgttggaatactcataaatagatatgctaggagttttgctttatttatctgcatcttctgctacactgtgggctccctgaaagcaggtcagatgcctcacccaccttcattctatattacctgatatatgaaacgggttgttgttaaatgaatgacttatgaaaggggtgagacagaaggaagagggggaaggaaaagaacagagaggggggaacgaactgacagagtggatagggagacaaacaaaggtagaggtagggggagagagagagagaacatgtacacacacacagggcattaaaaaagggaatttgtaatcaatccattattttttcatgtggcctaagccaatcattgttgaagaaagaaaagtacatctggaaaattcaatctacgtggattctaaatataaccacctttttttttttttttttcctgaaatggggtctccctgtcacccaagctggagtgcagtggtgccatctcgactcactgcaacctccacctcctaggttcaagcgatcctacctcagtctcctgagtagctgggaatacaggcatgcgccaccatgcccagctaatttttttatacttttagtagagacggggttttcatcactttggccaggctggtcttgaactcccaacctcaagtaatccacccacctcagcctcccaaagtactgggattacaagcatgagccaccatgcccgccaaagtataatcatctaaatcattcctcctctaaagattctggtatatccagcccaaccagcccattttaattgaaaatttactgctacgtaataaaagacgttaataacatgtacaatatagatacaggaaaaaaaagtttgagtttaaaaaaagtaaaaatcggccgggcgcagtggctcacgcctgtaatcccagcactttgggaggccgaggcgggcagatcacctgaggtcaggagttcgagaccagcctgaccaatatggagaaaccttgtctctactaaaagcacaaaattagcccggcatgatggtgcatgcctataattccagttactcaggaggctgaggcaggagaactgcttgaacctgggaggcagaggttgcagtgagccgagatcgcaccactgcactccggcctgggcaacaagagcaaaagtccgtcttaaaaaaaaaaagtaaaaatcaacctgacataataaaaataagtcttggaattatttacaaactttaataatctaccacctccttataatgtggtactgctgatttttattttattttatttagtttttttttttttgagagagagagtttcacttttttcgccgaggctggagttcagtggcgcaacctcagctcactgcaacctccgcctcctgggttcaagcagttctcctgcctcagccttccgaatagctgggattacaggtgtgtgccaccatgcccagctaattttgtatttttagaagagacagggttttactacgctggccaggctggtctcaaactcccttgacctcaggtgatcctcctacctcggcctcccaaagtgctgtgattacaggcgtgagccaccatgcccagccggcaccactgatttttaaaagtctatcaagagcatgaaaaataaattcaacataacaccaacatcacgatctatgttacagcacaaattccttatgtattacgaatcatattcctcaaaaacatactgtgaaaaaagtaacatagcatatattagacagtaatgggaatgtatttgtttacataaattcttaaaggtagtacatgggaaaactgctaaaacatacaacacttcaactttaaaacaacacctaaaaagtattactacataatctaactttcaatcacctcaataaactgtcacttaataaaatttaaagatttgttgtcgttaatacaacagacaattcaaacttaaaagcttgctcccaagtacaaatatgtttggtaagatccaataaatggcataaaaccttctgtagctcaatgatcatcgtaatacagaaattacaccaggcacggtgactctcgcctgtaatcccagcactttgggaggctaaggcgggagagtcacctgagcccagaagttcgacaccagcctgggcaacacggcaaaacctcatctctacaaaaactacaaaaattagccaggtgtgcctgtagtcccagctactcaggaggctgaggtgggaggattatttgagcccaggaggcagcagttacagatcgtgccagccagggtgaaatagtgagactctatatcaaaaagaaaaataaaaaagaacgaaagaaattgggaacacacagaaaaagaaacaaaatttaggcctaatacactcaacattaaatagattctgaattgcaatttttgctaaagcaaaatacaaattacaagaagcttctcatcttttatcacataagaaataaagttgtaagaaataagctaagtttttagtactaataattactagcaaattctctgagatttgctatacttataataacaggaagtacttgtatgaagttagaaatttattttagtaactttttccttttaacgttaaaagcacctttttaaaaaatgcagtagaatgtaatgctgagcacttaaaattagtatttctaaaaagataccaaaaaatttgcatttggctagtattaccaagaaacttttaaggctaaagtttccaacatactttcatttttttaaacagactacttaaaaaaaaaaaggaaacgaaaggaagaaaaaaaacattttaatctcagactttcaacttaactacatttcttttaaccaaacatttatagagcacctaagaagtgacaagcactacaacactgggaaatgtgacacattacatttactccaaactaaaccttttatttattcggcttctgaacttattatttcttactcaaaccaaaacttttcttaagaaattctcacccaacatcaaggtacatatacgagttacctaataaatgcactttcaccactgttttacacaggtgatgagagttatagctaggatttgtgactaacaaaagggattcattcctgaaacatgtctatgcttcatgaaatgagataggaataaactgtttcaggtagtttacagcatcccaaactcaaagagaaaaccttaaaaaaattagactaaacttaattactctgtatagtagaccaagatttaagtagccacagcttttaccttctacaaccacaagtattacaaattttaatttggatgcaaaattgtcaaagcagtcttgattctgaggacaagtgaaatatttttttaaatagttcaaaggaactgtcaaaagtagacaacgttgatattctaacatgctatctgttgcatttctacacttgtgaacactctacccttttcaagcacttctgaatttgtaatggatgaaaaaatacaagctagtgtctaagttccaccagttgaatccagacttttcaaaaatctaaggttttattctagcatgtgtttaaaaaaaaaaaagacagcattcatatacatattctctcaagtaacaaaaatacctgtatttttatcgttatcatttcttccaacaattaagcaaattttttgaccctattctccactcagttaacatattgacatctaagaggaacctggccatcagttttccacacatcataatgcaacagagcctctgacttatttacagaccaaccagatcaataaagaaaaataaaccatataaccccaagtcactggaaatacaagaaacaactggtatctctgaattgtgtaaaaaatcacaaaaattctctttttaaatctttcaattaaattatttttgtgacgagtcaaagagttttctgctaaaattttacagtactgttcacacaataaataagattctctttcatcagtgtaactgatagaaccacaatacagttcagtttctagggtcagattacctgacttgctttttattttaccttttaaaacactttaattcatgccgttattcctctcattccctacaaaaagagatgttcaatatgggagaatcatcttcagttgagacatcctataactgcctccaactccacagcaaagcccgccagctgaccccggtctctctggggaagggctcggtcaccaagtcaccaaacacaccttcctctgcaaaactcggaagccccacacgacgacctcgtcgaaacctcctacttcctgaattcgataaccccagagattcgttttccgcaggcaatcttaccttcatgatgactctgggaccaaggtatcctctaaaacaccaggttcagctgcacctggaggggaaacaaaagacacccagtcaacaccacaggagcccctctgcactggcggaggcggagggaaagaagcgagcgacgtccgaaccccgaagaaagagccgcaaccaggcgccagcccccgaaccatcacacgccgactcggggctccctccggccccgccatccccgcaaacccaaccacctacacagctcggcagcttcccgtccccattgtcgagacccgacggagtttcccgtctacgacaatgacgccatttctgtcagagaagaaactcacaacaagcccggcgtccggcgcagggccggccgctctcccctagggcctcggcgcccggccgagcgaatccgcgcccccacgcgccgcgtccgagcgagaggccggccgggggccaccgaggggccaggagggcctgtgggccgcgggcaggaccggcccgccacagagcccctgcccacgtcccgttccgggctcagacccgacaagtgggagcgagatcaacatctggccccgccgcggggacaacgtgagggccgagggccccggaggcggaacggcccccaccctgcccgggcccccgaccgcggccgctaaaccgctgagtgtgcggccgcccagccagggggcggctcggacacagcggctgcggggggtgggggttcccgggaggccgaggccccgaattcgggcgccgcagggaccaccaccgcgatcttcctctgctccttggccgggcccagcgactcccaaaagaacccccttaggagaccacgaaagccccagaaaatatccctaccttcctcggaggcgagatctgaccctggcacgtccagagtcccctctctccttctcccccccaaaaccagcaggcccgggggagagatggggaagaagggcggcgggtccagcggctgctgaggcagaggctccggctcctcctcctcccgcggcggcgactggtacctttgtttggcggccgctcgggctccctggttggggggagggggacgacgaaaaatcccccccggactggaggtccgggcccccaatcgcgctgccctccagaggacggcggcgatggaccctctgcagctccctccgggcaaaggtccaggcggtggccgtggcggcggcaagatgaagctcaagagtctccctccgcttcggcgaccgagctcctcactccggactcgactgacgggcaaacatcgcttcccccccaccgactctaggttcccccccttt

SEQ ID NO: 2059 - DNA, 160594 bp, Homo sapiens
atcaaggattcacaaactatggcattttatttcagagcctttgcttacatttgtacaatatattacataattcttcattgtttgcagatcctaatatatactttatagcttttattctataagcttttttcttcaacattttgctgtcaacaaatctttacagtcctgtacaaatttgaataacttgaaaccattttcaacaaaattagttactgtaagcacacactacaagactgaaaatgcttttcttagaaaagttgaatgtaaaggattctgacacgttagcatctacaacaaaacgcattgaaattcccacgtcgtattgccaggaaacaaagaaaacatgccagccccatccaaaaaaagtacacagaactacaattaaaacagtaaaacagtctgtacaataaagtactgtgtattaacagtgccagatattaaatagcttgaatgaacacatccacaatatacaaatgtcttacaaaggtgaagaattaaatacaagtgccaaacagaacagagattggaatcatacaacataaagtcaatacaagtgaaaacaattttgcattcattttggattttatacaaggcatttaattttataggcctaccacccccattagctatttatatttaaaataaccaccatccttttgagacagttcctatcaacaatcttgaaccatactaatacattacttgttcctgaagtccttttgttgtagctcataataaaataagcaatacaaatgaattatctgtatttaagggaaaagaaacatttacaagaaaacacaaaaatataactgttataattcattatgaataaatatacactttgaactggctaagtacaatctttatacattgtttaagatttaatacagtttattagccattttcttttttcacacaatgtatatcaaaattaaaaaaaaatactgatttatagaaaaatggcaaagtacagtagttccattccaatttgaagggccatgaaaagccactgcaagaccttttagcctaattcaaacctgtaaacatgttcagtcttttttaaagagaatctttaatatttggttaccaggattgatgtctaatatcctgttaactgcaggttttgaatttattacatgtgcttgacttatacaattaaagccaccctaaggtgacttgctttaaaaaacaattaccttgtacaaatgaaaataggttcatattttttcataaataaatggaaaaatatcaaatgttccagctttaacaaaatacaagggaatacatatacagtaagttatcttaacatgttctgacccaccccttaactatgcttactgtattgtctctacaggcagtgaaaagcctccatttgccacagtggaaggccttccagttaccagacacacaattcccagacaagttggaaacaattattgcttgaggaaaagcagttcattgtactttttcttcataaaaaagtgcacttaagtgccaagtcagcttgtcaagaaacaatttttaaatataaaatagtgcttgtctgatatttttttgtgccactgtgcagtataaaaaaaaagtggccctcaacagccattaagtgcaaagtgctttagcaagtcctgctgtcacctgcactcaactgacattccattttgtgatgcgctggacattgacggttcagctaaagttaacataacagcagctgttatggaactggatgaaggtgaagaggaggatgaggatgtagcagcacctaaggaaaagggagaccaaaccaagagcttaataaaaatttatgtctaacaatagacagaaaatactagtcctctgaactaaaattccgctatattgtccaaaatcatttagcttacaacaacagtggtcaattctcacagttctacgatgtgaagaaaggaaaagctagtgtagctcaagaagctagacagtgcccaactacagaagtaatgaaaaggacagaccagggaaggctcctgcgtgggtcaaagagggaaagaactgtgcctagtctacaagacacagaaataaaatacagaatacactttttgtaacagtgaaacaagtatcaaaacaggaaaaatctgcaatccatccaaaaatcatttgtcccctcctaatccctccatctttctgtacttaggagttttcttgtacatgtaaatggtgacaagagtgggaggcttaattgcttcttcaagttggatcaaaacagtgcatagctcaactgttgcattctccgccactaggtttacaaagcaaataacacattagttattttcatcagaggaagtctctcactgtttccttttttcgtttttttttgtttgtttgttttttgagacaaagtctcgctctgtctgtcgcccaggctggagtgcagtggctcgatcttggctcactaaaagttctgcctcctgagttcacgccattctcctgcctcagcccccccagtagctgggactataagcgcccgccaccacgcccggctaatttttttgtatttttagtagagatggggtttcaccatgttagccaggatggtctcgatctcctgacctcatgatccgcccatctcagcctcccaaaatgccgggattacaggtgtgagccaccgcgcccagcctgtttgtttttttgagacggagtctcactctgtcgcccaggctggagtgcagtggtgcgatctcggctcactgcaagctccgccttccaggttcacgccattctcctgcctcagcctccttttttttttttttcctttgagatgggggtcttgctctgttgcccaggctggactgcagcagtgcaatctcagctcactgcaacctttgcctcctgggttcaagcaattttcctgtctcagcctcctgagtatctgggattacaggcatgcgccaccatgtccggctaatgtttctatttttagtagagatggggtttcgtcatgttggccagtctggtctcgaactcctgacctcaggtgatctgcctgccttggcttccctaagtgctggaattacaggcgtgagcaattgcgcccggcctctctgttataaattagtgttcataaattaatatttttaaatacatgcacagatttaaaaaattcattcagtacaggggtaataggatagaaaagcaaatctcactctcatccaggaacctcctaatcacccaaattcccttccccattgctaccagttgattcatattcattacaactctagaaaaaaggctggcaaaaaaactaccccaggggcaaatctggcttacttgtctttggaaagaaaaattgtactggaacacagccatgcctatttgtttacatattgcctatgggagttttcacacttaccatggcagagataagtagtttctacagagaccacatggcccacaaagcctaacatatttattgtctctttacagaaaatgtttgcaacccctgttctacaggaattttatctctagaatctagagatatgatatgcaaatttaaaatatatagatatagcaacacctttaaaaacataagtggaggccgggcacggtggctcacacctgtaatcccagcactttgggaggactaggtgggcggatcacaaggtcaggagatcgagaccatcctggctaacacaatgaaactcagtctctactaaaaatacaaaaaattagccagatgtggtggtgggcgcctgtagtcccagctactagagaggctgaggcaggagaatggcgtgaacccgggaggcggagcttgcagtgagccaagattgcaccactacactccagcctggatgacagagagatactctgtctcaaaaattaataataatattacaaaaattagctgggcatggcggcacgcacctgtagtcctagctacccgggaggctgaggcaggagaatcgcttgaaccggaaggcagaggttgcagtgagccaagatcgcgccactgcactccagcctggtgactgaccgagactccgtctcaaaaaaaaaaaaaaaaaaaaaaaaccacacacacacaagtggaagcatagttcagtgtctgacttttttttaaacaatatattttaagagattgttccatatcagtacatacagatccttttcttttcaaagttgagtaatattctactatattacaactcataacttatatatttcactacactgttcctgcattggttttagttttaatttttttggtaagaatgataccttatttgggccagtcgcagtggctcatgcctgtaatcccagcactttgggagactgaagcaggcggatcacgaagtcaagagatcgagccatcctgcatcctggccaacatggtgaaaccccatctctactaaaaataaaaaattagctgggcgtggcagcacgcttgtaatcccagccactcgggagactgaggcaggataatcgcttgaactcaggaggcggaggttgtagtgagctgagatcgcgccactgcactccagcctgggcgacagagcaaaactccatctccaaaaaaaaagaatgataccttatttgatttgcatttctttggtaaccaggataagcattttcctatggatttttcttaaaatagtatttaggaaccgacttttaatgctaacccagtagagaggctctatttagcaaaatcattcattataaagaatttgtggtgactatatttacaaaacattgtttagaaggagtttctggatagatgtctttttttttttgagacagagtttagctcttgttgcccaggctggagtgcaatggcatgatctccgttcactgcaacatctgcctcctgggtttaagcaattctcctgcgtcggcctcccaagtagctgggattacaggcacccgccaccgcgcacagctaattttttgtattttttagtagagacggggtttcactatgttggccaagctggtctcgacctcctgacctcaggcaatccacccaccgcagcctcccaaagtgctgggattacaggcatgagccactgtgcccggcctcctcccagattttaatttatctcacttcctcatgtcattcaggtatcaacaaaaatatactgaccatttgtaatctaaagtaacccatccaatcactaccttaacatcattttcttcatagtgctttcaatatctgaaattatcttattaggatgtttttggtagagtataaactctatgaaagtgaatattatgatctgaaataatttttttatttgagataatttcactttagagatgaggaaaataagataaagaaattaaagaatttgcctgaaaatagacaaagtcatggcagtctaactgcagagtgagaaattctggtttatgtttaaataaagtaaaaatactggcagggcactcttggctcacgcctgtaatcttagcactttgggaggccaagacaggtagatcacctgaggtcaggagttagagaccagcctgattgacatggcgaaaccctgtctctacctaaaaaatacaaaattagccgggcttggtggtgcatgcctgtaattccagctacttaggaagctgaggtaggagaactgtttgaacccaggaggtggaggttgcagtgagccgagattgcgccattgcactccagcctggcgacaagagtgaaactctgtctcaaaataaataaataaataaaaataaagtaaaaatacttactttctctctctttcttctttaaacgctttctcctccgatcaatggaagctacttcagattttaatgacagataatgttttctgatttcttgaagtttttcttgaagaattgtgatgcgttcggcacttgtcatattttccaggtccgctataaatttaaagctttcattaacagacatttttaaagaaaattttaacatacaaaaaggagagaacatcgagcatggctgctgaataaggttgaggcagatgaactaaaaaactaaggcttctgaaatatttgttttccaaattttttatctagcctagaacaatgcctggcacataataaatgcacagtatttgttgaatgaatatgtacagcattaaacaccttaagatctacatatatccacatccatatacagtattaccacagtaaaaaatcacacttaaaaataaaactggggctgggcacggtggctcacacctgtaatcctagcactttgggaggccgaggtgggcggatcacgaggtcaggagttcgataccagcctggccaagatggtgaaaccctgtctctactaaaactacaaaaattagctgggcatggtggcgggtgcctgcaatcccagctactcgggaggctggggcaggataatcgcttgaatctggaaggtggaggttggagtgagccgagattgtgccactgcacgctagcctgggcaacagagtgagactctgtctaaaaataacaaaaacacaaaaacaaaacaaaacaaaaaacctggaaagacaccaaaatgctaaattgtacacattttgtgagtaacaagactgtggataaatttttctcttctgttctctgttattttttaggtttttttaaagagtgtgtaaaaatttaaattagaaggcaattttaaaaagctctaaagcaatcttcaatctcctaagaatacttaaggtatttccttgtgtgaaaaactctagagtagtattaaaaaaatatacatattggctgggtgtggtggctcacacctgtaatcctagcactttgggaagtagaggtggaaggatcagctcagtcttgagctcaggagttcaagattagcctgggcaacataatgagacctcgtctctatttaaaaaaaaaaaaaaaaaaaaaaaaaaaaaatatatatatatatatatatatatatatatatatatatatatgtatacctaaaacatatatatatatacctttttttaaatgaagatttatgaagatttctcacatatacaaaagtatagagagaaggatagtgaaccccatgtactcattatccagcttcagtaatcatcaatttatggcaaaacctgtatcatctgcacccctatccattcctcacccctaacaccagatacttttaaatcaaattaccgacatcatatcagaagtatctttttttttttttctgggatggggtctcactctgtcgcccaggctggagtgcagtggcgcaacctcggctcactgcaacctccacctgccaggtgcaagcaattctcctgcctcagcctcctgagtagctgggactacaagcgcgtgccaccacgcgcagctaattttttgttttattagtagagacagggtttcaccatgctggtcaggctggtctcgaactcctgacctcgtgatccacccacctcagcctcccaaagtgctgggattacaggcatgagccactgcgcccagccatatcagaaatatctagtcagtgttggcatttgcctcaactgccttaaaatttttctttaaccaatttatttattcaaaccgggatccaaataaggtctatacattgtacattagtacatctattaagtttggtaaagcctctttttcagagtattggcatgaagagttactaggattggggctgggcatggtggctcatgcccaaaatcccagcactttgcgaggcagaggcggatggatcacctgaggtcaggagttcaaggccagcctggccaacatggtgaaaccccatgtctactaaaaatacaacaacaacaaaaaaattagccaggtgtggtggtgggcgtctgtaatcccaactactcgggaggttgaggcaggagaatcatttgaaccagggagatggaggttgcagtgagcagagactatgccactgcactgcactctagcctgggcgacagagagactctgtctcaaaaaaaaaggccaggcgcagtggctcatgcctgtaatcccagcactttgggaggccgaggcgggcggatcatgaggtcaggagatggagaccatcctggccaacatggtgaaaccctgtctctactaaacacacaaaaaaattagctgggtgtggtggcgcgtgcctgtaatcccagctacttgggaggctgaggcaggaggatggcttgaacccaggaggctgaagattacagtgagccaagatcgcaccaccgcactccagcctggtgacagagcgagactctgtctctaaaaacaaaaacaaaataaaacaaaaagagttactaggatgaagtttgtatgcttgtcaatttaacatgtcacttacacatctgaaaactccatttgtaaactttgggtaatcgattactgggttccttgagatcaggatccttatcaccattctttccacattttcctggagactgcgtccttgcgggagatttggtactatgagacttcattccagtggaaactgatttgactggctgactcttagttatactttcaccagctgaaagttcttcactatcactactatttgctgaaagagaaagaaaagatttaataaacaaaaatgtaacaataaatttgtcacagattttagtaggtaatttaaaattagccatttgaatttagtcctacagaaaacaacctgcctagaaacctggaaaatcatatacaaatgcagcagcatcttaggaaaagcaaaaacaaaaaattcttcttacctgaactgccaataatatgtatacttttaaaatcactcacactaatctatcattatgcttggtagactgtcaaatatacagtaatcatctgaatggctttttactctattatgttaatacataaaatatatcatcttttaaaatgattaattgtagaaacctctacaatgaatatgtaacattgggtatatgcaacattttcctgctcctttggccacaaacaaataatgatgcacaatcatcatattcaataaagaactcctcgggaataaactctgaagtttgatatgtataatgaaattactcttaaataactcctatgctgtgggttgactaaaataatcagtttcaccctaataaaatattcagtattttatgaacaattcagaagtctgtgtaacaattatgttacaactgctattgctaattaaacttcagcactaaaatggaaatacttgaccttgacagcttaccatgtgaacaggtaggtgatgggattagtatttccatagataacctctttctggatacaaagtattagtttagattccatcagaattaattcatgttactaaattattctcttgaatggttaactcattctgatttaccatggcagaatcccaataagtaaaatgggagaacactatatctctgtattatatgaatatactaaataactcattgaagatgcgctctcttaggaaatgtcatttaaatagtaaactcttgaagacaaaaacatcacagtgaaagaaaaaacactttaaatatcctaccagttacaccaaacaattgatgactgactgatttggcatatatttactgatttttcacttaacaacatcaccaaaaaaaaaaaaaaaaaaaaaaaaaaaaaaaggagttaaactctcaaagccagaaattattccaaatagtaaaggtagatagcagcaactcctcccactgtgaaattttgggaataaagaaactccaccactggttgacacatatacacaaattccctcccagctcccccactgctgctctggaacccctggcaactcctagctaagccacccaaggcttggccccactctatgcagtggactgtctcagcctggctttcatggccttgctgagcacagccgcccggggccccagggacgccatattcaccgcctggaagtcatatgggctcagcagaacctcggggagctggccgaataacccttttctgcactgaagtgcagccaagccggctgctagcaaaggtcaggcagtggaggtggcaggagtctcctggaagagcagcaggaggtcagtgtggggcacctgaaaaaaaattctttacatattttctgcttcttactttgtctacaaaagagagataaaatgtgcagccctcagaagaaatacagtatatatattttctgtggattgatgcacggagtcgttgctaaagttggagcatacttagcaaaaagtattgtttgtagttactctcaggtcacataatatagagtaccaaagacaaatgttgtagactggagttgttggaattatagttctaaagttatcttgattgttatacttctatgctgattttgccttgaagaattactaagcaatcaatttcactgtaataaaaataacatgtagttgaaatatttcacaatgtgtgatacattttatagcaagtgaaaagaactgtggaatacaaaggtaacaaatatgttgatgtttataatatattggctattatttcaaaaacagattacttgatttttcatcagcaatcaataccaccgctgaataacaccaacttgcttaaaactagaatttacctaagattagaaaacctgtgttttttttgttttgttttgtttgtttttgcagaaattcttttttctttttattattatactttaagttctagggtacgtgtgcacaatgtgcaggtttgttacataggtatacatgtgccatgttggtttgctgcacccatcaactcatcatttacattaggtatttgtcctagtgcatgttttttttttgtctattttgttttttaaagcaagtagccttacagaatttgtgtgactttttttgagtgtacagacaaaatcaaaatagtgtactatcccataccctgaataccattttcttactgggggtaaaattatcagctattatttttatattttaaaaattagagatttcacacttactgccttttcccttctttttgttgtttaccactgttgctttatggcttcttttctgcttttttgatgaacttcctcctccctgagcatctttcactcttttctgacctgtacaggctatgaagggaaaggaattaagtaacacaaaataaaatccaacattccctaagtataaattaattccacattttagaaacatagaacaatccaaaactacatgttctttatgacatttataagttgtcacagaacttactacaatttttaaataaactgtcattaatggaagctcaattcttatacataataaaagtcagggtttttaaaaaggcaaacaaagtatgcacatccttctttaaaaaaatcagatataaactgaaaatagtccttaatatagtactgggagtttataagcctagtaattaaaagtatatgctgaaaataaaaactgaaatttgttaagattcaataaaaccaaaatattaagacttaatcacaggttaaaatgttaatgacattatgtcttataatcatattaatataatttttaaatgatataaatgaggtaaattttagcagtaattcatacttggttcttttttaccaatttatgtcaagaataactaagctcccagggcactgtttggttaacatgcataccatttacaaatccaacatagtagttctaaaaaacgtctcatcttcttggtgggaaattattgcaaaacattacaaataaatgtctcccttttcttcaaggactagcccaagtcctacatcttcactaagatgttccaggcttcactgatcaatcactactctgaactgtagcatttttctatactactcatttggtccttaacatctgctatatttctgtctaattcatatatgttatctctcagactatataaagtaagattttttctccagagactaataaagtactatctccattcagttccaatgtcagacaccaaatcaaccttctgtgtataaaacctaacttccttgatcaaaaacaggacaagtaattaactgtctgcaacttcctagcttttttttaatgggtcatataatcttacttacaacttttcctaatacctttttaaatttttaatatttcttttttattttttacaccaagtatgtgacccacctaatgtcattttaatatcacaatttaagtgaaacataaaggagacgtagatattgaccatactgaagcacagaaccataattgtcaggtttctctccaagagagtttaattctaaagtgttcagatactaagaaataaaaaccttcaatgtagagtaaattaagaggaaaaaactacatctaaatagtaaaacttaaattttaacttgtgatatagtggggagtctccaatattcatagtaagtaaatttattaaaatgtggccatgtgaaacaggtgcttaagaacctatttctggctgggcgcggtggctcatgcctgtaattccagcactttgggaggccaaggtaggtggattacctgaggtcaggagttcgtagaccagcctggccaacatggcgaaaccccatctctactaaacaaaatacaaaaattagccgggcgttaatcccagatactcagcaggctgaggcaggagaatctcttgaacctgagaggtggaggttgcagtgaaccaagattgcaccactgcactccagcctgggcaacaagagcaaaactctatgtctcaaaaaaaaaaaaaaaaaaaaaaaaaaaacccaacaaaaagaaaaacaccaattatttctaaagagatataaattaccctaaatttaggagtagctttcaaattccacaattattaacctagtcaagattaagattcaaaagggcagtgttgacttagtctattagcagagaagatatcctctttttttttgttgttaattttaatcttttgtaagatattacgaacataataaggatacaacctcttaaaaactacaacaataggctaggcacggtggctcatgcctgtaatcctagcactttgggaggccaaggcaggcagatcatgaggtcaagagatagagaccatcctggctaacatggcgaaatgccatctctactaaaaatacaaaaaattagctgggcatggtggcacacgcctgtagtcccagctactcagcaggctgaggcaggggaatcacttgaacccaggagacggaggttgcagtgagcccagatcacaccactgcactccagcctgggcaacagagcgagactccatctcaaaaaaaaaacccccaagaaaacctataacaataaaacctgtttttttctttcttttcttgttttttcttttttttttttttttttttttgagacagggtcttgttttatcacccaggctggagtgcagtggcgtgatcttggctcactgcagcctttccgggatcaagtgattctccctcatcagcccccaaggtagctgggactacaggcatgcgccaccacagctggctgacgtttgtatttttggtagagatggggttttgccatgttgtccaggctggtcttgaactcctggactcaagcgatccaccgccttgacctcccagacctcccaaattgctgggattacaggtgtgagtgaccacacctggccagtaaaatcttactgttgaaagcctaatattctgaaataaaggattctttcattttgaagattagtcatgcctggatagttcagttgcatgagatagtatggcacagataaaatcatagtagttatacttgtaaatgtgaaaaaaagcaaagaacatttcaatttaattgcaagtatttttttaatttattttaaaacagaaatgttttaagtcaagattcctgagaaaacatagaattaactaatttgatctagaccatatctctttaagctttgctgaaaacctaaagctagcattctaaaatcttttacggtatataaaaaacatactccagtgctctgtctttacgatggaaaagtgtgttccaaagccaggtgtcagcctagagtatactgatttaaagatacctgaatgaagtggtttataagaaaaatgatgacagaagtatggctatggcaccatcgaaaggcactaatactttgggaaggtaccgatttgaatttccacttttaacaatttcacggaaaatcaaaaaagtattactgtaggttattaacgtacacattggtccttcaatttggaagctatgcatctaagaaagcatcaaattcctttacaaactcacacaagttagtcaggcttgaaaatcagtttgacacggttgtctgaggaaagcagtgcctggacagttggttgctccaaacccctacatacagtatttggttaagggtggaggggtctgtcaataaatcaaaatgttcgtgagaaactgcacattacaattgcaaaaacaatgttacagaaatagatttaagctgctcatgccatatagtcaaccactgcatataatgaattctcaaacaggtttggatttgggcctgggtgcaatttctagcatgtgttctggtccacaataaaatgccatggatggctcaagcaaagcacattaaagccttctcaagcttttaaatgcattccactattcattttcaaattacctttaaaatttccatttttaccatgttcacacaaatatgacacttaatcgcctcaggttataacaagagatactgtgaaatcattgaaactttaagaggggaaaccctaaaataagtcaacatacacattttccttctcacctttttcaggatgttctggttctggctgattactactgcttgagctcacactggcatcaaaacctgctggcgagctattcccttcagactggaggtcttggagctccccagcaacactatccacctcaattgtgctatcagtttcactcttgatacttcgaacctcttcttggtttggagccagtggttctgatactgttacagaagactgctgccggctgccttctgttacagtgactgatgaaggcgattcaggtgtagtaggaggggtatttagcactgaattactgccactacttggaaattctgcttttctgtcattgacctctactgttttttcttcaatgggtttactatcgacattgactggaggtggtttttctagttctacactgggtgaacaactctcctcttcagccacagtctgcagtgactcctctgccaccccctcctctggggcaggatgcggtggggaagctgcagcctcagtatcagagtctgaaaaaagctctttcagcgtttttttaggccactgtccctgaatacttgaccagacatcttttcgatctttggccctgctgttttgaagtctttcatcagagttatttaaaagtttaatccttttttctgccacttctgaaaatcctgaatagaaaccagttgtccgtagagattttcttttttcctccaaaccattgtatttcttagttggtgtcatctttgcttttgtttcttcttcatcttcatctgaagagctgttgctactgttttccatgcaaagtgattctttgttcttggccttctcttcctttttgccaggtgatccagtttttagacactcttctgtattgcaataccttcttttaccacgttttatttgtggttttgaagatttatctgttgtgtccttcttgacatcctttctcttttttgtgacttcatcttcttcataatcagtatcttcggataatacttctatatctttccttaatctttctggagattttgacactggtttggatattaccaaatctgcatgaactttgttttcttctagcaaagatgaactgttctgttcctcctttgaaataagatcatttctgttgttggtcaaatgatcaatcttagattcctctttgccattattatccatgtcttgagcacctctctcatcttcctgctcactgtcttcagcagaactttcagaagctagaaaataacagaaaaaaaaatgatgagtatgataagaacactagcaatgtcttctatgtgccagggactgtatatattaggtcctgtgtatacagccacccgaggttgctggcttttatctctatgtaacatgcaaagaaactgggtttcaaagaggctaagaggctcttccaatgatggaaatgttctattacgatcacggtgatggttgtaacactgtatacttttgtcaaaacccatcacattttaaacataaaagtcatcacttttatgtaaactgtaccttaataaagctgaaataaaaaagaaaaaagcttctccaagtttatataagtataatatttttatcataatatatctgagaaaatagtggagtcaggatataatcccagattgtgctacctccaagttaatattcttctttttttttttttgagtctcactttgtcatccaagctaaaagtgtaagtggcgtgatgtcggctcacagcaagctctgcctcctgggttcacgccattctcctgcctcagcctcctgagcagctgggactacaggcgcccaccaccacgcccggctaattttttgtatttttagtagacacggggtttcactgtgttagccaggatggtcttgatctcctgacctcgtgacccgccctcctcggcctcccaaagtgctgggattacaggcgtgagccaccacgcctggccccaagtttatactcttatgaaactatagccttcatttttcttttcatcagagacggtctcactctctcatccaagctggagtgcagtggcacaatcacagtgcacttcagcctcaaactcctaggctcaagagatcctcccacctcagattcctgagtagctgggatcacaggagcaagctactgcacctggcctctcatttttctttcctttgttttgttttgttttattttctttccctccctgcctcccttcctttctctttcctttctctttctttatttctctctctctctctatttttttctgagacagggtcttactctgttccccaggcactatcatggctcactgcagcctcaacctcctgggctcaaatgatcctcccacctcagccacccaagtagctgggactacaggtgtgccacatccagtgaatttttgtattttttgtagagacagggtctcgtcatgttgccaaggctggtcttgaactcctgagctctagcaacctgcctacctcagccttccaaagtgctgagattaaaggcatgagccaccacacctggccagcttcatttttcaatgtaataatgaatatccaataattttgtaatcaatgatttccatgatgttttaaagaatagatataattaattttagttactgataacttatgtaaaattaattatggaacttactgcttcagtgtgttcattctggtaaatcattttattgttattttaagataacatttcctgagaacttactacatgctggttacttttgatacactttgaacagaccatctcattcaatcctcagaacaatgctacgagatacatgttatcagccccactttatagttcaagagactagggtcttaaataaataagaaaaacaaacaaacaaaaagcaacacaacaaaacaaagcaaaaaaaaagggactggggtttagaggttaatctaccccccaaggtagttaaatctaagtcatttaactccagaacttacaaccttaactatagctctctactgagaaatccatgcatgttctttagctaaattcattaaatgtaaaacataactgacataactaagattgtgaaaccatttcacctttacaatgtgtgtctgcatggccacattttttaaattatcaaaacaatacatatacatcattaaaaacaaatctagactcataatgaaaaaccaaaaagaggataaaaatctgtttttccacctccaaagtgttaacatctgatagttatagtcatctcttactattcataatatactatttgttttatttatttttttgtgtgtgtgacggaatctcactctgtcacccaggctggagtacagtggtgtgatctcagttcactgcaacctcctcttcctggattcaagcaattctcctgcctcggcctcccaagcagctgggactacaggcacatgccaccatgcccagctaatttttgtatttttagtagagatgaagtttcatcattttagacaggctgatctcgaactcttgaccccaagtgatctgctcatctcagcctcccaaagcactgggattataggcatgagccaacgtccctggcctgctgacttatttataaagtttatcctctatgagcaatggggattcttacttatcaacacccatatctcccctctaccatcctttctatatatagttatctttcatttttacaatatagtatttataacatatgtaaatgtggttccctgcagaaataagtagtacatttgataaacttcctttcttatacagcattttatttttccaagagtttccaactacttttctgcatgttacatcttcctttgtatctcttttacattattttatttcattaaattaagcgttgtatccaatttccccttattcatcctatctctgcaccctagagagctattttctgcagtagcatctgggtggtatctctctgggtctgctctaacagctgtcatccggggaatcctcctcactgctttcttttgagctaggtccactgttaactgaatctcacatcttcttcttccttggttatctcatctgtactagagctcatcgagtagtttccttaaaaaggtacatgggatataaatattcatcgtccttacttatctgaatacatccttaccctcaaacttcattgattgagagtttcacgaggtacagaattctaggttaaaaattgtttccttcagagttctgaatccttccgaatgtattgcttctttgcttaaggggttataagccataaccttcctttggtttctcattcctttgtggtgattttttcattcttgatattttataatttcataatgatgtactacggtatgactctattaatttattcggtacctagtgagcaatttcaatgtaaagatttgtgtctgtcagttctggaatttttctttagttatttgctttttttttttttgagactgagtcttgctctgtcatcaggttggagtgcagtggtgcaatctcagttcactgcaacctccacctcccaggttcaagtgattcccctgcctcagcctcctgagtagctgggactacaggtgcatgccaccacacccagctaatttttgtactttagtagagacagggtttcaccgtgttagccaggatggtcttgatttcctgacctcgtgatccgcccacctcagcctcccaaagtgcagggattataggcgtgagccaccgcgcctggcctctctcctctgttttcatagttcccccttcctagattaatacattatgtaacctatcttttctctaaaatttccatcactgctcttttaaactttctgaagatttcctccatttaaaattcttaatgctctactgaatttgcttatttttttttttttttaagagacagagtctcgctctgttgcccaggctggagtgcgctggcaagatctcagttcactacaacctccacctcccgggttcaggcaattctcctgtctcggcctccccaatagctgggactacaggcacacgccaagctaatttttgtatttttagcagagatggggtttcaccctattggtcaggctggtctcaaactcctgacctcagatgatccacctgcctcggcctcccaaagtgctgggattacaggtgtgagccactgtgcccagctctactgaattttaatttagattttttgtttttgttttttttgagacagggtctctctctgttgcccagactggagtgcagtggtgcaggttcaagcaattctcatgcttctgcctcctgagcagctgggattataggcaccaaccaccacattcggctaattttaatatttttattagagacacggttttaccatgttggttaggctggtctcgaactcctgacctcaagtgatctgcccaccttggcctcccaaagtgctgggattacaggcatgagccactgtgcctggcctttagatttttatctccaagtctttcttgttcttttctttttcactgcatcttattcttttctttttcactgcatcttattcttttttttttttttttttttgtagacggagtttcactcctgttacccaggctggagcgcaatggcgtgatctcagctcaccgcaacctccgcctcgtgggttcaagtgattctcctgcctcagcctcccaagcagctggaactacaggcatgtgccaccacacccggctaactgttttctattttcagtagagacgaggtttctccctgttggtcaggctggtcttgaactcccgacctcaggtgatccgcctaccttggcctcccaaaatgctggaattacaggtgtgagccaccgtgcccagcttattcttgttttatagatactgtaggttctctgagattaacaagagatgattaagaatgccctattaaaacttgattgacactactgttagtaggatttattaactgataggctttacgtgattcatcccggatctagtttactctaggggatttccactgccagaatgtagaagattattctccagagacattcaatttctccacagaactccaactaccactgtacctctagttttattcccaacccatctcaggacaagaggatagaatcttagctgtctgtgttctctactcacaaggggcatcaaatttttatgtatacatatacatacacatatgcattcatatgatgatcattaattaactggaaatatttgaaatgtcttcaatttgatctgtggccaaagataaaaaataaaattcactgaaaaaagaaaatatgaagagaatacttaaaatgttaaaagtatgcaaatatgatactcattgttgaactaacaggaaaaatatgggaaaggatcaaaatgtctttttttagcaactaattaaataaattatgatatatctattcagtagatgtggatgtgccgatttggaaagatttataagttataccactaagtaggggaaaaaaagagtttgtaatatgttaatgatcccatctgtaaaaagactgcacacatgtgagtgtctattacacatataggataaatatgtgtgtgggggggtttggggtcattgtatatgtgttatatgtatgtgtgtgtgtatatatactcatatgtcatatatatggtatataaatgcaatttctgaaataatataaacctataaaaatgggggaaaatacgaaagaaaagcaacacaatttgcaagtcagaaagcagataaatgaatgacgggcaccaaagaaggctaaacctcataccagcagtgaggaaagccaaaaaccaacccagtttaccatagaaacctcaataattactgactgccctagtgcctatgaaaattaaaaagggcagtggggagcctcatacaaggagcactgggtgaagactaaaaattacttagatgcctagatccccacctcacttcaggttggaaggtgactgcccttctagagctttattctctgaagacagtaggagagggctcctagcctgggagatgctaacaactgttgaaggcacaggtacagatgcgatgctgaaattagggggattcatgaacatatctaaccactaagaatcctccaccccactctctgttcttcaactagatcctagaacactggaaaccattctcttaccaccctccagtcaagagattggaactcttttctctggaagccaactagtctaagagaaaaagacctaaagacttcatattatgaattccctaggacatggccaaccagatcacccgatagtgaaactcaaggtcaacaagtgccaaccatatgcttgcaatttccaaatcagtttagtctttccttcataatcataagacagccaggaaaaaaaattcttaatagggaagagctcaaaacaacaacacagaaaaaagcaaattagaggtaactgaaaaaaccaaaaattataaaatcctttgaaagatcaaaatccgaaaggtaaggtattgcatccatctataagaacagagtggtacaaaacacacagaaaacagagctcttgaaaaattaaactagtttaatttaaaaatattcattgaaaggctgggcgcagtggctcacgcctataatcccagcactgtgggaggctgaggcaggtggatcacaaggtcaggagttcaagaccagcctggccaagatggtgaaaccccatctctactaaaaatacaaaaaattagctgggtgcggtggcaggcgcctgtaataccagctactcgggaggctgaggcaggagaatcgcttgaacttggagggcagagattgcagtgagccgagatcatgccactgcactccagcctaggcaacagagtgagactcagtctcaaaaaaaaaaaaaaaaaaaaaaaaatcattgaaaacttaaacattacagcaaaaagtcaacaaaaggattaaaagacaaagcagataaaatttcaaagaaataaaaagacaaaaaaattaataaaaagcaagaaattaaaaggtgagcatattagagtatattacagaaggtataatatcaaataatggctggccaaagaaagataacagccaagtgcagtgtcatgcacctataccccagctacccaactacttgggaggctgaggcaggaggactgcttgagcccagaagtgtgagaacagcctgggctgaacatagtgaaacacagtctcaattaaagaaaaaaaaaaatttggcagggctgggacagtagctcatgcctgtaatcctagcactttgggaggctgagacaggaaaatcgcttgagctcagaagtttgagaccagcctgggcaatatagtaacacctcatctcaaaaatagtaacaatgaacaaaaattaaaaaggagagaacagtaaaatgcaggagaggaaatcatcaagaaaatcattcaaaaaaactgcctagaacagaaagacagaagttgctagaatgaaagagtctagcaagtaggcatcacaggggatgaaaatatatctacacaaggctaaagaaagagaacagccaagtgtactgtggatatatctgttctcttcctttggccttgtgtagatatatttcagagttaaatttctggatacgaaaaacaaagattcaagattcctagcagggcatggtggctcatgccagtaatcccagcactttgggaggctgaggtgagtggatcacttgaggtcagcagttcgagaccagcctggccaaaatggcaaaaccccatctctactaaaaatagaaaaactagccaggcgtggtggcaggcccctgcaatcccacctactcgggaggctgaggcaggagaaacacttgaacccaggaggcagaggctgcagtaagccaaaattgtgccactgcactccagcttggccaacagagtgagattccatctcaaaaaaagaaaagaaaaaaaaaagattccagagacagaaaagcaaaaaataaagaataaaacaagtcacatacaaagaatcaggaattggaagagctctggacttcacaaaagcaatactggaagcaaaaaaacaattcaacactgccaataaaatactgaaggaaaaacttccaatccagccaaactatgaatagaataaagatatttgcaaaaataaatacagatatttaaatgcagccaatctctaaaaattccatctcatgcacttgttctttagaagctactagagaatgtgctccaccaaaatgaaagtatgggggtggggaggaacctgagatgccaaaaacaaagaaatccaagaactacattaaaggagatccctagaatgggatctccctaggaaaatagctgtgcaacagatatagagggaaaccagtccagactacagcagtgttatttccaaagaaagtcatactgcaggctattatcattaagctacctgctaccgcctctctgtagtctttgaatgcctgagtgacccagactggattttaaaatctgtatttatcttgtttcaactatgtgtcaatgaaattccagctctcccttccatgtcttatgtgccactacctagatcagctaatgacatcattttatccagcagaaacattctgacctacttgtgaaaaataggggtaaatcaccataagcctagaatgagaatatatatagagtagtctgctactacgactgagcacactcccacataacatccactgcgaatgtgtcacatattctttttattttattttttttaagatggagtttcgctgttgctacccaggctagagtgcaatggtgtgatcttgactcactgcaacctctgcctcctgggttcaagcgattctcctgcctcagcctcccaagtagctgggattacaggcacccaccaccacacccggcaaagtttttgtatttttttttttagtagagacagggtttcaccatgttggccaggctggtctcaaactcctgacctcaggtaatctgcccgccttggcctccaaaagtgctgggattacaggagtgagctactatgcccagccaaatgtgtcagatattctaactgtagtggacccctaggtttatcagaactggcttatgacctgtccaactgaattctctagaggggcttttgtaaactctcagagaagctaaatctgaaatcagagtatgacttagaatctctattcaggtaacattctcagaaagccttcatctgagccttcttataaaactaggcttatgcttgttactcaatttttaaaaaactaaaaaacaggctgggtgcagtggctcatgcctataatcctaacactttggaaggctgaggcagatggattggattgcttgagtccaggagtttgagacaagcctgggcaacagggtgaaaccccatctctacaaaaactacaaaaaatagcctggcatggtggcacacacctgtagttccagctacttaggaggctgagatggaaaggtcgcttgagcccaggaggtcacttgagtcgtgatagcaccactgcactccagcctgggtgacagagcgagactctgcctcaaaaacaaaaacaaaacaaaaaaacaccctaaaaaaatgaagtaaaataaaaattacttaggaatataaatatagataattcaattctgaagaaaagtaaagcaaggattacacaaaagtccagactataattacttctgggaggagacatactacgaagtaaaataaaaattacttaggaatataaatatagataattcaattctgaagaaaagtaaagcaaggattacacaaaagtccagactataattacttctgggaggagacatactacatgttttaagtaaatagtatttgattgctactgtggagacatactagtatccatattattactgttctttaaactatacatgtattttccatgcactatttgcatgtaggatacatgggaaaattttttaaaaatcaatttaaaaatattgccctaattagtacagtggtgagtaaataaaaatatagtacagcatttggtttataaaataatgagttaatataaacacacatctacaataagaaacaaaaactagcttctattaacattcaaaataagtaaaaatgaaacctcttttaagttatgagaaatgataagatatttttatggagatccattcttttatctcatagatatgtccccttccctgccagtcagatttaataaatctctgctccaatcctcattgcttttattacctatacttcattttgccttaaatactaagcaataatcccatcataaaagaggtcatgtcaggccaggcgcggtggctcacgcctgtaatcccagcactttgggaggccaaggtgggcggatcataaggtcaggagatccagaccatggtgaaaccccatctgtactaaaaatacagaaaattagccaggcgcagtggcgggcgcctgtagtcccagctactcaggaagctgagacaggagaacagtgtgaacccgggaggtggagcttgcaagtgagctgagattgcgccactgcactccagcctgggtgacagagcgagactccgtctcaaaaaaaaaaaaaaagcagtcagtccaggtgcagtggctcctgcctgtaatcctagcactcgggaggctaagacaggccaattgcttgagcctaggagctcgagacgagcctggtcaacagggcaaaaccccgtctctagaaacaatataaatattagccgggcatggtggcatgcgcctgcagctccagctccttgggaggctgaggtgtgaggatctttagagtctgggaggttgaggctgaagtgagctgagattgcaccactgtactccaacctaggctacagagtgagaccctgtctcaaagaaacagagatcataatagtcataatcaggacaaacaaagtttggtgttctttacaacaacttgtcagtatacttttatggtctgatgttgtataacacaaactatgcattacattgcaacagaaaggatggcacagaaaagattaaaaaactaaagtaacaatgctaaaagttgaatattaaatgttaaccaaaattttatggtgcccttggatctactagtaataaaaaatttgaggcctcaatcaatggctgattttatttcaagtacaggttgaacatcccaaatccaaaatctgaagactccaaaatcatacactttttgagtgctgacgtgattctgaaaggtaacgctcactggagcatttcagatttagaattttcggatttggcttgtggaatgcaaatattccaaaatcaaaaaaaaatctgaaatccaaaacatttctggttccaagaatttcagttaagagatattcaacctgtaataagagagcaaacaaaactctggtagaaaaaacagtagttggtaatgtcactgaattacctttatagaacttgactcataaattaaaatcaaatacttgcacaacagaacgattgttatgtttaccttgaagtccattaaggatcgaagtaatttctatggacttaatatgagcagtatcagagtttttggcatcagtgagatccagtttggataccatttcaggagatggatttgtctgaaatggtggtttggacaagcgccgaagtttacagttttttggagagtatttttcatctttgtctttttctttgtctaatttattctaggttaagaaaaaaagtatgtcgtaatttatcataaggcatttatcagaaacaatgttaatgtccacttttaactcactattacagaatatgttgttaaatatttaacataaaaagaaagaacataagaagcccctcaaaacagccagatttttaaagctacttaacaaaatactacacaggatgatcaaaaggttttgtatttatactttaataacgggaatcaaattagcaatcagataggtgattaggactagcaaacctacaacttgctcttcagaattaaaatcacaatacgtttaaattaaatactaactaaaaaaagaggccaggtgaggtggctcacacctgtaatcccagcactttgggaggccgcggcaggtggatcacctgaggtcaggaggtcaagaccagcctgaccaacatggagaaaccccgtctctactaaaaatacaaaagtagccggggtggtggcgcatgcctgtaatcccagctactcgggaggctgaggcaggagaatcgcttgaacctgggagatggaggttgcggtgagccaagatcgcgccattgcactccagcctgggcaacaagagtgaaactccgtctcaaaaaaacaagaaaaaaaagaaacgattgcaacgtggtcattttaaaatctcactatatgtgggttgggaatgacaaaattccaggtacttttgtaaagtcaagtcaggggcaaccttcctacctcagtgatatattaatgttttgagaaaagatgagaaattttctcaaattatttgtttacaaatagataagcaaaggccgatatatttcctggaaactactcttaaaaattttgttgatttataggaaaaataagctctctgaagcatgagttagcagtaagcactataaattttgagtgagagtaattctcctaaggatggtacatatctagtatcattccagatgcatagaagatgctaatcaaacatttaggaaaatttagtcttagaatgaataattctatcatacataaaagtaacattaattttccatatgagctcctaagtaaatcctcatggcattttcgtggttaataggatcctgtggggctgggcgtggtggctcacacctataatcccggcattttgggaggccaaggcgggcggatcacctgaggtcagaagttcgagaccagcctggccaacatggtgaaaccccatctctactaaaaatacaaaaattagccaggtgtggtggtgtgtgcctgtaatcccagctactcgggaggctgaggcatgagaatcgcttgaactgggaggtggaggttgcagtgagccgaggttgcaccactgtactccagcctgggcaacagagcgagactctgtctccaaaaaaaaaaaaaaatcttgtgaatatattctaagccactgactataatcagataaagaagaagagaaaaaggagttgccagatagccttttcttccttggaatggtttacagctacaataataacctatgtctctccaagtcacactgccttatggctcctggttgggaactagaggggaaggaaatggcagaaatagataaataaaatctggttgaatggctttatataatgttgggactgaaaaagtctcaaagatcatccagtactgtttctaaaatgctttccctaacctgacaaaattaattatatacaaatctagcatttgaaaaatgtgctatttcaataaagtgtaacactaacacatatttaattgcatcatttggaggaaaacttctttttaagagctaatagtgtgtagtaaaaacaagcacttacctttattttcttccgatgttttatctttggcacatttttatcagcaggtcttactattttatctgctttaatccattcatcgtatctaaaattaaaggaaattaatataaatatgtacaatatataccacggaaataacctatgccatattaaagagaaactcatatagaatcttgacattttagaagggaaaggaccttggaaatcatctcagcttcctggtttgaagagcaagctaccaaggcacaaagagagggaggtaataacttgcccatggacttaaagttagctactggccgagccaagactagagagcatgatctcatgattcctcaactagcactgcttactcggctacaacaaagagaaactgaatctgtacagtaagtattaagataaatcacagtattttctacattttgttttactttgtttcattcttaagcagcaggtaggcaatttttctctagacacatcagagagctaaggtaatagcttcagttttaaatggcattgtgtaatagaaaagcaccgtattacagccaggcacagtggctcacaccagtaatcctagcacttttgggagaccaaggcgggcagatcacgaagtcaggagatcaagaccatcaacgctaacacggtgaaaccccatctctactaaaaatacaaaaaattagccagacgtggtggtgggggcctgtagccccagctactcaggaggctgaggcagaagaatcgtgtgaacccaggagcggagcttgcagtgagctgagatcgcgccactgcactccagcctgggcgacagagcgagactctgtttcacaaaaaaaaaaaaaaaaaagaaataagaaaagaaaagcaccatattgtaacgtatggataatgcaaaatcaactagaaaaaaaaaatgcttgctcataaaataccagaaaaacattactctgcaaagtttttcagtattctgaaatgctccctacatgtacagacagctgagtcaacagctgtgatggcctcttgattcaatgctgatggtcttcacaatttcatagggtgcaaattactattaactgcaataaaactatttgtttaaagcaaaaaaaaaagaatgacagtttattcgttcttcattcattcaagaattataacagctagaagaagtaaacattaaaaactaattgacattctctttttgtgttcaaagttatatacattactcatagaaaacacaaaactctagaacatggacacctgaaaacgagcttttaaattaaaatgtcctcattgttagaggtattaaaaggaagtaacaaagtccccaaatcaagaagtaaatgacttgagtcattacttgactaataaattatattcttactctagcataggcctggaaagtatctgtagcaaactcctgggcagttactctgctggtacaaactactggcttgtagccagtaaaagccagaaaagctgaggattcatccccatgcaaggggttctgtttatatgctggaagatgctgagggccgtaataagaataagagggaatggaatgagctttaggacagacttaacataatccctgcttcctagttatgtggtcctgatcaactcattctcaatctaaggcttagtttatttctgtataaaataagactacaatttaaaaacaaaataaaaaataatggtacataccatatatgggtttttttgtagaaatatatggtaagtactggtgtaagtacaaatatatggtaagtactttgaaaagctttaaagtaagtattcttctactaaatacactccttttggtacttctacctggcactgtagcatctatccatatatttgcagcagtacttttacctttcctattaatatcgaaaattgtataatgcttaggaaagcaatttacttccttccaaaatcgggggcatggtgggaaacgaaaagaaaacacctccatcctctgtagatttcagtatgaactcctagaagttgctctattagaagagttatggaaagaagaagtcaagatatcaactttgtttttaaaagaaaacaaaacaagctttctaattttttatgagagaaactgaagtcagttcatgatggctgcacataacattaatgtgagctaaacaaagttataatcatgttctacctttcttaaccaaaggctatctgttctgtagctagttttataccagacatgttttactatcaataaaaaactgactcaattcaacctgggttttattatcaattatattttgaagtagggtaaaatagtagttttcaatttaagaatacatgcatgatattgcacatttgtatattttacatgcaacaccaaacacatcaaacaaggaaaaacagttactgcctcatgggtaaggccactgtgataaaggaagattcctttattactcagatataatgtatgttgtttaaattctcttaagaacaaggtggcaagaacatacacataaataataaaatgatggatgcttggtatggtacaggctggggcccactgcctaagctctgtaaatcctatatggtaatcatgttctcttctactcaattataaaagaaggatggtacaagaggactggatgtcagaaaaatgttaagtagttgagtttagatgtcaaaagtgtgttggagcaggcaggacacacacacaaaaataaattcttaaattagatgaaacaaactacatacatagttgtaattaacagtatggccttactattctggaaaatttttgttttaaaattctcatggggccgggcgcagtggctaacgcctgtaatcccagcactttggaaggctgaggtggacagatcacctgaggtcaggagttcgagaccagcctggccaatatggtgaaaccctgtctctacaaaaacacaaaaattagccaggcatgatggcgcatgcctgtaatcctagctactcgggaggctgaggctggagaatcgcttcaacccgggaggcggaggttgcagtgagccgagatcgcgccattgcactccagcctgggtgacagaacaagactccgtctcaaaaaacaaaacaaaaaaaattctcatggaatactctgtatggttttaagaaattccctgaaaacttactatagagtaataatgtaatctaacagcaaacataatgtataataatattacattatatttatagatctaacttaacagatctataaatattagctaatattatgactcttctgttatttggcttctttctattctactttctcagtgcttttatttgtttaattcaggcccttgttttgacactaagtttttgcatttttttttaccttgccaattatgctctttgtataaaacacagttacacaatattgttactgttatcaaaactaataacttttagaactagagcatatcttaaaaatttatcagggcctttatttcacaagttaagaaattccaacaatgaaagtgaaagacagtgcttgccaaaaagcactcctgtggagaattagagaagagaaggaaatggactgcccgggaaaagattctaacacgaaaataacggtagggggcattccaggccctattcagagtaagtttagtgaagagtgagagaccagtggcgtgaagaggaagaaaaggagaaaataacatgtgagaattttggttggggaagctttttcgaattacaaatgtccttaccaaatacaagctgagatcactgacacaaacatattggcagacaagtatttcaaaacctaatgagacgttaaatagcactttagttgtctgatagatcttacaagaaaaataaagatggtcagaagattaaataactataactgatcattgcttttaaaaataagaaatgttccttccgtatatgtaattacccattacaatactacccaagtgttccttctattttctctacaggatattttcaaagaatagggaaaaaaaaaaaaaaaagcaaattcatgtggggaggccgggcacggtggctcacacctgtaatcccagaactatgggaggcccagacaggcagatcacccgaggccaggagttcgagaccagcctggccaacgtggtgaaactccgtctctaacaaaaagataaaaattaggccgggcgcagtggctcatgcctgtaatcccagcactttgggaggccgaggcagaggtgggcagatcatgaggtcaggagttcgagaccagcctggccaacatggtgaaaccgtgtctctactgaaaatacaaaaatcagccaggcgtggtagcgggcgcctgtagtcctagctacttgggatgctgaggcaggagaagagcttgaacccgagaggcggaggttgcagtgagccgagatcgcatgccacggtaccctagcctgggtgacagagcaagactcatctcaaaaaaataaaattcatgcggggaaaaactctacatgaaaaccccatatttcctacagacattaaaattatataagaaagaacgtcttagactggcataattactggtgccaattaatttaagaaagcaatattagtgggtcaagatttctcattccttaccaaagaagcacaggcttcaaagaagaatttacttcagaactacaacaaaaagctacagttaatcctacttcttctttataaatttagacttttaaaaatacagtacatttagtatatattaaaaagagacaacaccaaatttaccttagacataatagataagaaaatagtcaatgcagatagaaaatgggaaattttagctcaagttcacatatcttgaatttcataaaaaattaaaataggccaggcccggtggcttatgcctgtaatcctagcactttgggaggccgaggagggcggatcacaagatcaggtgttcaacaccagcctggccaacatagtgaaaccccgtctctaataaaaatacaaaaaaaattagctggctgtggcggcgggcacctgtagtcccagatacttgggaggctggggtaggagaatcacttgaacccaggaggcagaggtggcagtgagccaagatcgcaccactgtgctccagcctgggtgacacagcgagactctgtctccaaaaaaaataaaataaataaaaataaagtaaaacaaaataactggaaaggaagtggcaaagagtgaaactgcagctaagaaatagaaggccataaaatatttctcaatttctccttggggtaccacgtcaagtaagatatctattcatccccgaaagtacattcttaaggaatacgagaatcttctttttttttttttcttcttcatacagagtctctgttgctcagactggagtgcggtagcgccatcctggctcactgcagccttgacctcccagtatcaattgtcccacctcagactcctgaacagttgggactccaggcattcaccaccacacctggataatttttttatattttgtagagagagggtgtcactatgtttctcaggctggtctcaaactcctgggctctagtgattcgcccaccttggcctcccgaagtgctgggattataggtgtgagccaccgcatctggcggaatacaataatcttagtaagtaagttaaatacaaaccttttggttttaaaatgcttccagaccagcctggctaacatggcgaaaccccatctctactaaaaatacaaaaatcagctgggcacggtggcgcatgtctataatcccagctactcaggaggctgaggcaggagaatcacttgatcccagaaggcagaggttgcagtgagccaagactgcactactgcactccaacctgggaaacagagcaagactctgtctcaaaaaaatatgtaaaataaaataaaataaaataaattgtcttgcaattttagattcaagcaatacagttttctgaaaatgtgaaaattcaggtagactgggttgttattttatatatatgtgtatataatatatacatatatatacacaatatatacatatatatacaatccaggatagtttatctatcctggctttaactggtcttaacctttaggaattatgattacaaatcataattggccttttcataataacaggaaataaattaattttgcagggcacaagggaaacagcattactaaatgcttccatttaaaaagaaatactgaaataaacaaaaagtattgaaacaaatattaaaaacaaatattgagttagaaaattaagacagtgattagcctatactttttcaattcagttatcaatacagtcaatgtaattaattctacagatggaatctaaacaagtatcttattgaatatttatctaaagtactaaggaaaatatttccaaggtatatatatgacttgtctgataatatttctattgagatcacttaacattcaactaacaaaacataaaataacatatgcatgataaactcatttaacttctgaagatctagtatgttccctgacctacataaaatgaagtacaatgaaaaaaaaatttttttttttttgagacggagtcttgctctgttgccctggctggagtgcaatggtgcgatctcagctcactgcaacctccgcctctcaggttcaagtgattctcctgcctcagccccctgagtagctgggattacaggtgtgtgccaccacgtccagctaatttttgtatttttagtagagactgggttttgccatgttggccagacttgtcttgaactcctgaccttaggtgatttgcctgcctcagcctcctgaagtgctgggattacaggcgtgagccaccacacctggccgtagaatgaaaaattatatgagactccaagaccataagtacacatgtggacgtattcatttgacaaacacctctaaggtatctattatgtaataacagagtctgctaggcactgggtactcagcaatgaatcaacaaacacagcccttgcctgcgaggagcttacaattcaacaaaagaagacaatactaaacagtaatgacaaattgtgaatacaaacgtgaaactttctgaaagaagccaccacacaaatatttgatttttcaaatgtttaaaaatattcatacaaggctaaaagataccattcagagaccacagcatacttgctctcaccacagaaaaattggatttctaaaaagaaaactttatggcttttgtacagatgcattggcaaattatgtaagaaatcattttgtaataataaaaatggaaaagaacattagtcgaccagatatactaccaaaatggttaatatgcccacatcaattcagcttttggttcttcttaaacccaattttaaaagaaatattatcagcatatagttaatatatacctaaaaagcacagtcttaagagatttaaaaataaacagcatgcagaataaaggtattttaaaaataacttcgtaagtaaaatcaaattaatataaacttgaaacctcactctttgaaatatgtatagataagataaaaatctaataaccaaccattaagtaaatgttaaaatcatctatattttgctttctataatgaatagattcatttaataattgttgcacaatatgtattttatatcttgcctctctataatcaaaaaagttaatgtatgtcatataattaacttacttagtttttaagaacctcacatctaaagtggaaatttgtactgtcttagtatggaaagggatttccccacctgaattaaataaataaaagtatgacaaaataatagaaaaaaacaccaagtcaagataaaaagcagtgttaatcattattaattataaacttcataagcaattttatcaatatttacctactttatgaattttatataatctcaatttatatgtattttaatctgactatctaaaacaagatatatgaaaataacaactgatcacaattaatacttttaatcatgtatctacaataaaatgaaacaaaaaagtagtatattattcaaaaataaaattcctgccgggtgcagtggctcacatctgtaagactaacattttgggaggccaaggcaggcggatcatgacgtcaggatttcaagaccagcctggccagcatggtgaaacctcatctctcctaaaaatacaaaaattagccgggcatggtggcacacgcctgtagtcccagctactcgggaggctgaggcaggagaattgcttgaacccagaaggcggaggttgcagtgagccaagatcatgccactgcactctagcctgggtgacggagcgaaactccgcttcaaaataaaataaaataaaatgaaattcctaagtatgatataaacatttcatatttctacttcatataacacttaaatctacatcagagagacagcgatggtattcctcacacttaagaatataacagcagaatgacagaaccataaatattatagcatagtcatatttaagagttgacataaacagctcaacggaatggtatagtaattatatcaataggttttcctaagcaatgtaacgctataaaatgaaacggaagtataggtctttaggcagaggtaatatgtaataataagaacactaatacagcattttaccaaagcgtacaaagacaactgcaaatggttaactgtgccattaattgcatattgtaatgcagatgctaagttttttaaattccccaaaagtgtactttgttaatatttgataaatgtatggaattagttatttgtgcgtacttagacaaaaatatcaatgtacctgccaatctacgaaactactgaatgaaacaggtccaagtttagtaaacattctaagatgaatacacaaagaaaaattaaagcccatttgagtacaacacataactgaattatcatctttttttcatgaaggaaatgtttatgttcatttgtactcaaaatctatggttaactcaaaagccactctcttttaatacaaacttacagataatggaaaccactgtcaaatggtcattttataggcctctgacttctgtactatagaaacaacgcagacaacttcccagggtaccttgctttctatcattaccaggacaattatttcaaagaaaatgagtagaacaactttgtactctatttcaatattcctaaatccaatggcatacacaactcaagtacagcagggatcagattacatggaaataagaaagaaaaaaaatgaaggacacaaaacattttagagcaggaaagaacaaagaaattaagctgaaaagtgacttaaaaattttttaaggacaaaaggagactaagaatagctaaaaagtaacagaaaattaatatttccaatcaaattcattccagtctctcagtctcgactccattttgtttgctaagagatgagctctttatgtaacccaaagaggtcacatatatcatatacaaatatgaactcagattagaacaacaatgtaaacattacagctaaaactataaagttcttagaagaaaacataaaggaaaattttcagaacactggatttggcaatgtttctttggaaataacatcaaaagcagaggcaacaaaagaaacatttgcaatcatgtatctgataagggaataacatctagaatatatgaagaactataattcaacaacaacaaaacaactgaccaattcaaaaatggcaaaaacttgaagggacgttcctctaaagaagatatacaaatggctaataagtacatgaaaaaatgttcaactctacatttcaagtacatgaaaaaatgttgcattaggaaaatgcaaatcaaaaaagcacaatgagataaacagagaataacaagtgttgacaaggctgcagagaacctggaaccctaacacattgctggtgagaatgtaaaacggtgtcgtctctgtggaaaagtttgacagttccttagaatgtgaaacacagagttatatataaatgaggtgagaagcagctccagtgagagggtcaagccatatctgtcccaatcccctattataggtatcactttaaaaaaccagtggcttttatttggattttaccttctgctctacttccattttgttgtcaggaggtccaatttagttcaacattcatttagtacttatcatatgccaaatgaatacttttctagatgtggtaagggatattaggagaatagatatgaaacagaaatttttttcatattttaaaattaagttcacttttgtaataatacataacgtagtcctaatgtagaaagcttgaacgatgaagaaaaaaagaaaaggagggggaggagagttgaagggaaagaatttacccagagtcctaggtgaaagttatattccagatcaaattcctttggctcggaaaaataatttagaaaaattcaatatcagaattgtgactcaagttaggattggaaaaataggaacagaaaccaaaaaaatgttaaatggatatcagaaagaaataggggaaaaattagaagggagaaaacacataaagatgaggaagacagaaaagataattgaggagtggtttcttaattttgagaaaggaagaaaaggaaaataaacaagaaaaatggttgtagctggagcagctggagcccaagcaaagcatatcacggaaggagtgatcaactgactgtaaagccactgataaggtacgtaagagggcaagaaaagcaggaggaatttatctacaaagggtcactagtgttcctggtaagcacagttgtggagacacagtgaacaaaaggctgatgagagtggatttacacagaaaaaggagagaaactgagtaacaagtgtaggtaactttcaaacagttctgctgaatgaaaatggagcgaagaaatgtcacagtagaagtcaggctccagaaaagattttccttgagatgtgacaaataaccacagatctgtaagtagtgggaatgactcagaacagagcaagaaaatgggccatgtctttgatcagtcaagaagggatgcttatgaagactggcttcagacagtagcatgactgtatatctatggctaaagatgaaaacacagagaatgtggcagcaaacgcagttaggtaggcagatcttatgaagtgtgtagaaatgtttttcttgtttctatctctcagtaggtacaaagcaaggtcaccagctgaaaatgaggatagggaagagatgttggggatgtgaagacataagcagcagtatgaaatagtcttctaagaaagtaggaaagtgaatggaagaaggacatagagaattaaggacccacttgaggttcacagtaatgaatttaaaataagaacagtcattgtggttgcttgctttactccaaccacgatcggctgcacaggtgcaggcaaggagctggagggttagatttaatcaaggttcttgtggttttgtcagatgagtactataaagcaaaaggagagaaaaagaacagcttgagtcaaaagaagtgattataataataatgccagggaatgtaagcaatatcaagggaagactgagtgcattaactggggtgaagaggtaaggggtggtaggatcaataccttaataaagaatttattattattatgaattccttaataaggaccacttcttggtatctttggtgacaagcacagtatttggcacatagtgggtattcaacttatgtttggaaaataaaggaataaagtgtgataaaaagcaactgaatgatggcaaaaaataggattgagcctactcatttgtgaaagccttttaccaggttttttcatcccctaactcattccctcctaagaggatttaatttgtttggcgaaaatattttttaaatgtaacacatttttaatttcaaataatatatttagcataatttagcttattttcagttctctgtaactgttaacatgcactagaactgttgtggcttatttaagagttttacaactgaagttttacagtgtctcttttacttttgggttcccattaatgcagctggtgatcttcaacatacaaaaaattattctctaactaaatttgcaactctttgattacagaaagccaagttggaaatgagcgagaaaattcaatcagtattgatacactattacaaaatattgatgtattttaaattccatgccaattagtctagatagtttcactcagttgttactaaacaaagaaatccaacacactcaactagtttacggcatgttaatttcaatgtgtacccttactttcaaaaatcaatcccatatttacgacacgacttagaaacttgagagtgaaagggatcaattagataattatgctaagattctctataaaatattaacatcactaagaaaagttaaatagagagcctactattaaaaactacttaagcagaactaaattttttttaaatgtagggagacattttaaaagactaaaagagaacacactataatattagtaattttattattattttttttctatttttttgagatggagtttcgctcttgttgcccaggctggagtgcaatggcgcaatctcggctcaccgcaacctccgtctcccaggttcgagcgattctcctgcctcaccctacctagtagctgggattataggcatgtgcctccatgcctggctaattttgtgtttttttttagtagagatggggtttcttcatgttggtcaggctggtctcgaactggtctcgaactcccaacctcaggtgatccgcccacctcggcctcccaaagtgctgggattacaggcgtgagccaccgtgcccggccggccagcaataattttatctttctacttttatgtatttttctaaattgttatttttagaagagtttaaaaaataatttatgagcatactccaaacatgcctagtgcttggtgacatagtaagtaatatagtgctagacaatagttttagatactgtcactgcatcagaaaaattctgtaagagtattataatatttgtggttaaagagttcaagccctttccagtaaatgtggtgtgaacatgttaaaatatgactttttttcatcacaacagtagaaaacaaacttgcccaaatgttaacctttgtataacaaaaatcaacattttcagctgtgaaatagggacatacatgaaaattatattaaagatttatacaggtcgggcgcagtggctcacgcctataatcccaccacttacgggggcagaggtggatcacctgaggtcaggcgtttgagaccagtctggtcaacatggtgaaaccccatctctactaaaaatacaaaaatttgctgggcatggtggcatgtgcctacaatcccagctacttgggaggctgagacaggggaatcttttgaacctgggaggcggaggtgacagtgagatgatatcacggcgctgcactccagcctagacaacaagagcaaaacctcatctcaaaaacaaacaacaaacaaacaaacagcattttagttagaaaaaaaagaaaaatgtaaaaattaacaagaaaattgatttttttgttttttgttttgtttttttttttttgagatggagtcttgctctgtcacccaggctggagtgcaatggtgtgatcttggttcactgcaacctctgtgcccctggatcaagtcattctcatgcctcagcctcccaagtagatcggattacaggcacctgccaccatgtctggctaatttttgtatttttagtagagatgaggtttcgccatgttggccaggctggtttcgaactcctgacctcaggtgatctgcccgcctcggcctcccaaagtgctgggattatgggcatgagctacccgtgcctggcctaaaaacagtatttttaaacaaaaagacagacactcttacattatttgagaaaatctctttaccggaaaaacatgtttcatggccaggagcattggttcatgtctataatcccagcacttttggaagccaaggcaggaggactgcttgagcccaggagtttgaaaccagcttgggcaacatagtgagaccccatctctacaaaagataaaaaattagccaggtgtggtgatgcacacctagagtcccacctattccagaggctgaggtgggaggatcactcgagcccaagaagtcgaggctggagagccatgattgcaccactgcactccagcctgggtgacagaacaaggtcctgtctgtctctctctttttttttaatctgaaatacttgtttcagattaaaaaaaccatggaaataggtccacacaaatctcccaaactgcttgtcatgaatgactaccactgaagataaaactattttcatgaacctccacgcataaatcttcatttccaatttcacatctgttaagtataaatttagagatcaagctgaagaccctaaaaataaaagaaaaattgtcatacagctgatgaggatttgttgcagtccttattaaattagcttcagaactggaggagccgcaaaaataaaaattattgcttatttatcaataagacagactgattattgcagaaagaaataaaatagttatgttaactctaagaagattaactgcttaatctactgaagtacatttgttttctccatgatgttggagtgtatagagatccatcctacaggtcttcatcaagatgttaagttttcttcttttgaaagttcatagcatacaagcacttgagttctcagaaatagatggcaacgttcacagtaacacaagcatgtcttgttgaactaggtcgcattttcctccctatattattaaaaacttgaatgcctcaatttaaattctttcctttcccttcctgctatttaaaaactaaattactagagattctttctaccatctaaaatcaaaatactcctggaattctctttcttttagtcaatcttttcttaacaaaacaaagctatatcttaattgtaaaacagtttcatgaatgactcagttcttatatctactaagccttttttgtttaaagagccaattaatagaaaataagccttggccgggcacggtggctcatgcctgtagtcccagcactttgggaggctgaggcaggtggatcacctgaggtcaggagtttgagaccagcctaacaaacatggagaaaccccatctctactaaaaatacaaaaattagctgggcgtggtggtgcgtgcctatctcagctactcaggagactgaggcaggagaagcgcttgaacccgggaggcggaggctgcggtgagccaagatccagccactgcactccaggctgggcattaagagtgaaactccgtggaaggaaggagggaaggagggaaggaagaagggaaggaaatgagccctgattatatacagtgaaagttggagaacacctaaattctatccctttttcatagaatttcaaatacttcataaaggccaagaggaaaaactgcctctacatgtaaactagcaaaataatcagaaaaactaaaaagagaggcaaaaggtgttgtgactctatctcatgggcattatgcagtaattattcgtttttgctaatccaagtatttcttaatttaagagatgaggtctcattctggcactcaggctggagtacagtggcatgatcatagttcactgcagcctcgaattcctgggttcaagtgatcctcccacctcagtagctgggactacaggcatgcaacaccacacccagcttttttcttcctaattttaaactaacatattctacatttacatttatatcctaggcagaagtagaactccctctacatttatattcggtaagataatttagtaagatcaaaatgactagaagtaaaaaattgggcaaaatattcttttggtagctatatctgagatctcaagtaccttctttggaatatattcattaatagccagaccttcaggtgaggaaaatcacataccagaaaggcagcataagaaccaacagctgacacccgtaatcccagcactttgggaggccaaggcagatcacctgaggtcaggagttcaagacaaacatggcaaaaccccatctctactaaaaatacgaaaattagccaggcacaatggtgggcgcctataatcctagctactcaggaggctgcagcacaagaatcgcttgagcctgggaggtggaagttgcagtgagtagagatcgtgccactacactccagcctgggcaacagagctagactctatctccaaaaaaagacaaaaacaaaaacaaaaaacagaaaaaaagaaccaacaggtgaaaggataaattgtgcagtgtgttaaagtggtatctggaaaaacttatgtttctggatgactatcacatctaagctctgacgataggtattcttaaaatctaaaactgtatcctgattagacataataaagaatgagaccaaaacaaaacttctgaacatctcctcatgacttaagttgctatttgctatttgctattttcttccaagcatcagaatggatcggactggtacttttctcaaaataagaaaggtaatcagattagatcatgagcttcctattacacaacaggacaacaaaaaatttaagaaacagaattttgtatagtataatttatttaaaacacatgcatgtaagaatactatatattttctatgagtacatttatatgtatgtgaaagtagaatgaaaagttagtaaggacagcctcaaaactctcagaagtgattttctttagagaaagggcattgtgggaagtgattaaagagaatcaaaatttcatttgcaacactcaaacacagaatttgagatgatgccttcctattaacttcccaaaccacagaatataatttaagtataaagcatgagaactgtattcctccttgaagacactaggtacaccatgaaaccacaacttaaacttctatggttaatctttccaggtatctgtcttataggctacatttcaaatatactatcaaatattctaaaataaatgattcttaaaagataactgaatgaatagatcccaaaactggcttgccaattttggataaaatcaaaatacaaaatttctttggaaagccaaagaaaatttatctaagaaaaatgcttaagtcattgaacatgacttaaaaccaaatttcactcttgcctttcagttccctaggttaggagcagtcaaaaagtgcattctattttagtgaagcaggtctgcttacatgttcaaccagattttttcaaagatactaataaatttctgagacttctgaataaggctgtaatgcaatagctgttaataaggagataaggctttcttaaaatagctaatgtttcctaggattttaaatccctgactacagaaggaaagaaatgacttcagaatacaaaaaagaggttactgtggcaatgtagtttaaaatgcaagacagcaagcagcctgataattggtttgtagatgtccagaagttctgatcatttcaacaatgttttgtctgctgatctacatgtagtacataaaaatcaagtgtgtagacctcggttttctagacattagggatatcttctaagtagtgaaaacattaattgtaagtcactaagtgaggtatttacatgctaaaaactattttttataaggtactatgacctcaattagaatactaataaatctgtaatccattacttaagtttttaaatagaaaagtattttataattgtttttaggtaataatcactagctaaaactcaagttacctcacattccatccgcagtaatgcaccaagtaaaggacctctccaccttcgacatcagaatctttaatactagcttcatacattttttgatttttccctcgtccataccgcacttggactttcatgcctggtggatagcactcaaactcctcttcctcattgttgtcatcatcatcttcatcctcttcttcttcttcctcctcctcctcctcttctgcttcttcatcatcttcatcttcttctttattcgtttcatctcttgaaaggtttaaaaaattgcagagttaataaaagacacttcataagtttttcagttccaaaccacatatattgataaaagttgtggctgtgattgttccaggaaaagcaggttccacgtgtatgaaattctcagagtttcattttactattaaaaactaaaactgtaagacaaccaaggttacagaaagacacatttagagaaaatgaagattcaaaaataagtgcagtaaaagaaaatttccaaaagtcagaagaacagaatttgtgccgaacagcaagaagcaagtatggtcaactctaacaattttttcatgttttattaataaaagtgttttaacatctcaattgacaaaaaaattcattatacttcattgccattttacaactaaaaattatttttcattcaaatatttccagcctcaagatgtttgtttcatttttttagagacagagtcttgctctgtcacccaagctggaggcctcaggaagtttgaaacaataatttttactagcagatggcagtcttaataactttaaaacattctccaaccgaattttcaaatgttataataactgaaatactattttaatttaaacagaaatattctaataatgtactaccaatatcttatcatgtttgttctttcctttaaacttcaacacaatttctactctcattaccacagatttattaacatcttctacaaatcttctcaactttgatgttccaaagaaatagacagatgagaggccaattacaagtatatgaaactaaaagtcaaactattctagaaagagtattacatccttttttttttttttttttttgatagattttcactcctgtcgcccaggctggagtggtgcaatggcgcaatctcggctcactgcaacctccgcctcccaggttcaagcgattctcctgcctcagcctcccaagtagctgggattacaggcacccaccaccacacccagctaattttttttgtatttttagtagtgacagggtttcaccatgttggtcaggctggtctcaaactcctgacctcaggtgatccacccaccgtggcctcccaaagtgctgggattacagccgtgagccaccacacctggccttacacccatttttatcttcttagtaccatgtactttctaaaactgagcattcatatcctttttatattgaccaccaatctgtattcaacaagttggagaaaatcttcaatcataaatctttccaaacactagatttattttttaaaaaatttcaatatgaaatccaaggctacatttagtctggttttatttgctgtcctgtatgtctgtacttaaagactccatcactttagggctcacaaatgactaaacatcataaggcagaacaaccagatagtttagtatttaagctttaaaaattaataatatgtaaaatacatgatatattaaaatatatgctatattatatattaagagtaatgattatatatatacatatattacaccatgcacacatatatatgtgtgtgtgtgtgtgtgtgtgtgtgtgtgtgtatatatttttcccccccttggagacatggtctcactgtgtcatccaggttggagtgaagtggcctgatcactgctcactgtggtcttgacttcctgtgctcaaatgatcctcccacctcagcatcccaagtagctgggactacaggcacacaccaccacacccagatagttttttattttttatttttgtagagacaggggtctcactatgttgtttaggctggtcttgaactcccgggctcaagcaatcttcatactttggccttccaaagtgctgggattataggtgtgagccactgtgcccacctgatgaatataatatttatattaaaaaaaaaacttcctccactgaaaatttcagctttatatctctatatgcaacctttttagggataatatactttatcattcctaattaattatacaggcaacaaaaataatatataaatagtgatataagcagcactataatgcttttttattctccttgtccttttgtatagtggggcaggagtgttggcaggatgtttaatggaccggtggaagtaagtccgtgttcacgaaagtatcaaatatatcaattttgtctgaactataacacaaattcctcaaaaattctcaagatttattcctattttaaagactcagttacagtcaaatatataagtatttaaaaaatctaaaaccttcatgaaaccagctataatctgagatatacatatatatgtatacacacacacacacacacacacatatatacgtgtatatatatatactttttttttgagacagagtctcgctctgttgcccaggctggagtacagtggcgtgatctcagctcactgcaacctccgtctcccaggttcaaccaattctcctgcttcagcttcccaataagctgggactacatgccactacgctctgctgattttttgtatttttagtagagatggggtttcaccatgttggccaggctggtctcgaactcctgacctcaggtgatccgcctgcctgggcctcccgaagtgcagggattacaggcatgagccaccgcacccagcctgagattaaaatattaacaatgttattgaaaataatatttctattataaaaaagtaattttattaaggctaaaatatcaaaaaaattaacagaaatgggattatcaatgataaattattatgaggaattttattttatatagtaaattaaaacaatttttttttgaaagaatacttgcctaagtcataagactctatctttgcatagtggggaaaagaagcatattttattgtggccacaataaaagagatttatcatgcacctcagaatcatcatataaaaatgagatatagaatcaaaattctaaattttttgaaatgacgacaaactccaagctgtatcttacatcatagaatacactgagttgatgaatacaaacaattctaaatgccaacagcaagcacaatcatactttaagtagtagcccaggcaaattttcattcaatctacaacaaaaacccaacactcttttattaatgaaatcaagcaatcaaaaattaaaaatatacatttaatatcaccctcagacacaaaccaaatgaaattcactttaataatacactgaagtataaagaaaaaaacaacataattactggcaatcaaccaaagaaaactattctactctctaagacttcagtggcaaattcaagactaatgtgctaaaccagatggaacacagaatgccaagaaagagagcctctgaaagtataaaatgcaaccaacatacatacaggttaaaaaaaattaagttgatgcatacactacatacatgcactcatatacatacatacactcacatacatacatacatacatacacacacatatgcatttaagctagtcatattttagagaagaatatcttgggaaacgaaatgtatcagcaaggattttcatctgaattcacaaagaaatatcaaatcttccctacttgatattacactctttacaatgaaacaaaaattttaaaaaagatagtgtattaagtacgtgctatggccaaggcactgaactagacattttacatatatcaacttcttcaatctcccacatctggacaatggaagaaggacactgaacattcttggtagtagcctattacttagagaaagtttatatgccagaaaaatacctatatattaattatcactgtaaaattttccactgcaattatctaataaaactcaaaaatcaattacagtaagcccctcttatctgcaagggatacagtccaagatccccagtggatgcctgaaaccgtggatagtaccaaaccttatatatactgtgttttttcctatacatacatacctctgataaagtttaatttattaataaggcacagcatgagataagcaatgactaataacaaagcaattataatatgctataataacagttatgtgaatatggtcttgtctcactctctcaaaatattttattgcactgtactcacctgttttcagaccacagttgaccacaggtaactgaaactgtggaaaagcagggagtactatataaacagtcccaactgcaatgcttctaaaaaatatctaccaaactagggcagtcacatcaggaaaattttagtttgaggtacgcatatactaataaatatctgtagtacataaaaatccatataattatacagttaaaggggttgttaaaaacctacaaaatacagtttattctataaaataagcagaagcaccaacttaaaaaattagcaaagaaaaaaatacagatttatcacagtgccttgcaaacagcagatgttccagaaacatctgcagatttaaaaatcagattttttggtaaaaagctgaatctttattaagattcttatcaaaatgatctcctttagcagtactttaaacatacacttctacacatagaaatataacaaagtataatcaacaaacacttttactacattcttctaaacccaggatgtttttcttccatgtttgtatggtgccaccaaaatttcagaactctgatcaatcaaaagattttaggcaaaaagctgaaatctttactgtttcttaatacttgaaatagtctccaacagcagtaaggcatacttcaaatatatatttttatacacaaaaatacaacaaagtataataaacattttttactatattcatataagccccattttttattttccccttccctgttcgtctgcatactgtggccaaatgtcagtacgctaaatgatttttttttttttttttttgagacagagtctcactcgatcccccaagctggcctacagtggtacgatctcagctcactgcaacctctgcctccagggttcaagagattctcctgcctcaccctcctgagtagctgggattatgggcacatgtcaccacgcctgacttctttgtatttttagaagagacagggtttcggtatgttggccaggctggtcttgaaatcccgacatcaagtgatctgcccgccccggtctcccaaaagtgctgggattacaggcgtgaaccaccgcacctggcctgctaaatgattttttttttaattcattgtacttatttaaatgagacactaacagatatgtttatgttttttaagcctcagaaaaaagattcaatgccaaagattatctataaaatccaggggtccactagcagtgcataaattacattgtcaaataattcatcattccaagtgactaaaacaaacaaatgctactatcacataaaatagaacatacaatttttggccttttaaaactttagtatttttccactcttgcttttgcttaagaaataaatacaactctcagaatctatagccaacatacaatatataaaacatggacatagccccaagtttatattatcaagtaattcagcagacctaaaaagtactttgctctagctaaaaattttatcaatttccatgatgagagcaagaagggtggatcaaagtatgatctttctctacaaatttctatcagtagggtctctgaaagaagtgaatgctatttaattaataaatgccaatcactctattatttaatattttgtcaattaatttagattcatacataaacacatacaaagagcaaatgataagaatccatcaagctgaaatgcatcgtaaccaaaaacaattttcttacccagattttgctttttcttcctcagcttctacctttatgttgagggattcatctaccctagttgtgtcatcatctttgtcatccagattttcattgtcttctggttttttaatgttaacttctttttcctgatcagaatgtgtaggtatagattctaataaattctttttacttccctagaaaaagatcagaggaaagaaaccaacaaaagtaaaaattttcaacctatatccatggtttatctcttagcaacaggaggtatcaaccaattctaatattaaaagttataaattacttttaagaaactcctgctactttaaagctctagacaaaaatagctaacagctattttgaagttatgataaaaattatacaaaagtagcacttaatgaagaaaataaacaaataataaagaataatattatacaatatattgattttggaactttatagaggatatggaaaatataccaaagaaagcaaaagacaattaacaatatctgatttaccagagagggcttaatattttcttttctttcaatttcatcctcaataggcttttcttctcttggtattatattcctctcctcctccatctttatttctttgatctctgtttcattttcctccttaacttttatttcttttacattttcacactccttacattgcttgttaacaactttctctggcaatgccatctgaaattcaatgttggctgatctacagtactcctcaaaaccatataagtatctggaaacatgaagagaaattacatttggtgaaaacatttcaaaatataactatagagttatttttaatgtgtattcatttcttttgtctaaactctcagatattgagccatattaacattctaatttattctagttctttctaatcttttcaatgcaaaaaaaaaattttgtcaaaaaattcatttaaaacactgtgctcagagtcataacaataacagctattaaaagtattagtaatagcatctattttttgcacatttcttatgtgtgaggctggactccttagtaaatctcatttagtcactacagtaaccctggggcacacagcagcatcctttttttgtttttttttgtttttttttgtttttttgagacagccttactctgttgcccaggctgaagtgcagtggcgcaatctcagctcactataacctccgcctcctgggttcaagcaattctcctgcctcagcctcctgagtagctgggactacaggcgttagccactatgctcaggtaatttttgtatttttagtggagacaaggtttcgccatgctggccaggctggtcttgaactcctgacctcaagtgatctgcccgcctcggcctcccaaagtgctgaagttacaggcatgagccaccgtgcctggccaagcattccattttacaaatgaagaaactgaggcttaggagaataaataactggccctagggcataaacagttaataattggcagaactaggattcaaatgtggatttacttgacttcagaatattagctttttaacctctatgaagtacttgacaaatgtacttagccacaaaaactttcttcacagaatttctcatagatctagtatcatagaatacactttagaaaatactatcatagaatgactactctagtaaaatgttctgatttctttaaagaaataattaacctcagttataaggtaaatttcatcctgctttctaggtaaaaatactgaagataatcatatcaattatactaacttactttttataagcacatttaacattgtatcctgcagctgaatttaagacagggattccaagatcttggtagacttgtttccaaacagctccactttcaatctaatggacaaagtgaaacaaaaactctcaaattaaaaggtgttaatataataacattttgatagacacagtatatatgagtatatttttatatttattggtcctagactcaaaagaatttttaaaaacttgataaattctaaatttggtttaaaaataaaggttttagtactctaacaaatatcagaaaattataaatgttgaaatattaagtcatttgactattttttttttttttttttttttttttttttttttggagacaggatcttattctattgcctaggctaaagtgcagcaacagtggcacaaacacagctcactgcagccctgaacttccgggctcaagggatcttcctgactcaacaacccaagtagctgggactatagatgcacaccaccacacctggctaattaaaaaattttttttgtggagatggagtctcaccatgttgcccaggcgggtctcaaagtcctgggctccagcaatcccctggccttagcctcccaaagtgctgagattacaggcatgagtcaccataactggccccatttgacttttaaataaacccagttatggaaaatggaaaaatattcaggctcttaaatcaaaatttttaacaaagaaatggagacaaacatttttaaaggatttattatttcgcataaaatatacaggctaataaatgcagttctgcagaaatttgtaaagtattttattccatagaatattctcaattggataagtatcgtacatcacgtcaaccttaaaataatttcttcagatcagttcaacaaacatttcctgctttaatccctttatattctgaaagggattaagaatatacagaatattaagacagatccctgctcttaaggagcatactgtctaatgaaaaagagacacaggaaggatttccaccaatatggctgtgctgtgactcagataaaaaaagaaggtttatgaaagattgaccaatttaacagtaatcagaaagctgatatgaaaaaaaatctttttttttttttttttgagacagagtctcattctgtcacgcaggctggaatgcagtccagcggtgcaatcttggttcactgtaatctctgtctcctgggttcaagcgattctcgtgcctcagcctgccatgtagctgggattacaagcgtgcgtcaccacgtctggctgatttttgtattctttgtagagatggggttttgctatgttggccaggctgttcttgaactcctggcctaaagtgatctacccgcctcagcctcccaaagtgttggggttgcaggcatgagccaccatgcctggcctaaaaaatctttaaaatttaaattttgtctgaggaggctagctgtactttccactttatcttcttcttaggtttttactgaaaaactttgttttgttgtttagaaaaacaatttcagagatggcagatacctgagaaaacatgttacatgaaaaagatgtttcagtttgactacaacactcacattatcaaatcctccaagtttgtgtacaagtctgaataacttaaagagattcaaatttcgatatccaagtacaggtcgtttgttaataggtgtacctgttacagaaaacacaaactatattagatccacactacatttttaatttaaaatttcaaaagattcaaataatacaagtatttatagtattttatatatatatacacgtatatatatatatacacgtatatatatgtgtgtgtatatatacatatatatgtatatatatatatgagaaattatcttgttaatcaaagacatggtatctacacataaataagcccatggccactttaaaattttttaaattttaaaaaccataaccagattcttgaaaccttttattttcattctactttcttccctctgctgagggaagaaatactagataactgcttcccaataagagttacttttatggcattttctttgtattttaccaatttactactactctaaataatgattctatagtaaagctacatttttttttttttttcattctaacacaagaaaacgcaaggcaaggatgctaaatcaaacaaaccatgagaaagtggtagaggaggtaacagggtaggggtacaatgcctcatatggccatttctacaaaatatatgactggcttaatcatattttttcattcttttctagtattagattttattcattttctttgctttttcatttatcttatacaagagcctatgaaacagcatacttcttaggccaaccctccattcatgtaaagaaataatacaagaatcaaagacattttatattgaaaaagaaaatatacttatattgtgttaggcgttgttatcatttatgaaaactaaacatgacaaacagagtcagtttctactcatcagcattacaatcagggatttagaaaacgttcaattcccagagtattgtggtgtttccaaacactaatcattcattttgcccttcccttccagctagaaagcctctccttactcccttacaagcatcttcccagaaaagaagaaagtagactctgaccaagaagataagctagagaataacagtgttgaggttacggaaggattagttcattaccctaagttattcttcttccttcaatccttccgtggccttagcagcttctggcagattaaataagctgagccaaggctcacttttgagactttgtcacacttctttatctatttctggcttaattcccattttgctactgttctttagggacccatggataggtaaagggattggcaggacagggtaataagtgcatttatgtgtccatagccacaatatctgtcaaaatgctatcaaattcctcattctacttgttacgtgacaggcgctatgctaggtgctggtgatatcagagtcaaaaagacagccataattactgatgacataaagttcagtaaacaaaattctattcttatttttaagatactaattatctgtccaaaacttaccacgttaatgataaataaaaaatactcacctctatcttccataaatttgtacaattgctgaagaaagttctccctttcttctggaaatggttctatttcttcctaattttaatcacagaagaatattattttcttcaattaagcattttaataaaacaagcagatttcttaccaatagcaaagactagtgttcattaaaatacttcaaaggctttttacgtaatcaaagttactcttttaacactaagctgttcaaaaccaggtaagtctagacattttatgttttatagaggaatatgccttaaaaagtatcccaatagttagaatccccacagtaaaaattcccatatgagaaaagggactagcaagactgttcgtggttttgttttgttttgttttgttttttttaccatatgagagagctatttttcaaatcaggatcacaggttcaagaatacctactctcaacttatgcgaaactggatcagagttaaacatcaaaactaattctattattgctcctcaaggtactataaaagtatgggtcccattagctgactgcaagtatccttcattttatgcagccccactgtatatacttcaagcttacataatcagtaaagtggggaacaaatttgatctacaatacctgaagattcagacttagggaaatcttcaagtaataaaatagttccccaatttatcaattacaagggaaggactagcttcttgctgctgtggccaagggctgtggcagcagggagctggtcctgaagcaacctgcaaggagcagggtagtaggttaagattgaggaactcaccaattcaatgactttcatccattcaacaaacacttgagcacctgtaagtgtaggtactatgccaggtgctgaatcaaataaaagaaaaaataggctatggagcctactgttacagaacatgattaggagtaactgcagagaaaatgattccaaatatacagctaggctttacagttactctggcttaaatatacagatttgtaacagtaaaagttaggatattcaactggtaatctaaataaataaaaacatagcatttttcaatttggaaaatcatgtgcctaatgccactgctttagcgagattgtctttttaatttaaaagctagtacaacaaagaaaggtaattttttttttaaagcctatgttgatcaactattaggttttctaattgggcagagaaaaataaatgacaaccattaatttgctaatgatgaatctgtatttctcaatttaaacacactccatacattcaggttttggtaaggtgatcaaatacaaatctaaggacatctattttctagatgttatcttaaatgttcccatggtacaatatttaactttaataaacagcacaatttttcctattccaaaaacatttaaggtaagcttttaactcaagaaaatgtttacactacactacagatttgcttttacaaaaacacttgtgaaaacactaagcaccaaaaggtttggtagctatttatcatctgttatattttacacactatgacagacactttaagtatgaatacgagtaagacagcattcctaactttaaggaacttacaaattcgtggggaagaaaaaatagacaataaatataaatgacaaaaatatgtataaggagcagtagtaattctttttttgttttgtcttgtttttgagacagagtcttgctctgtcgcccaggctggagtgcagtggtgtcatctcggctcactgcaacctccgcttcctgggttcaagcaatcctgctgcctcagcctccctagtagctgggataacaggcacctgccaccacgcccagctaatttttttttttttagatggagtctggctctgtcacccaggctggagtgcagtggcgtgatctcggctcactgcaagctccgcctcccgggttgacaccattctcctgcctcagcctcctgagtagctgggactacaggcgtccaccaccatgcccggctaattttttggtgtttttagtagagacagggtttcaccatgttagccaggatggtctcgatctcctgacctcaggtgatctgcctgccttggcctcccaaagtgctgggattacaggcgtgagccaccgcgcccagccacacccagctaatttttgtatttttagtacagacggggtttcaccatgttggccagactggtctcaaactcctgacctcaggtgatccgctagcgtcagcttcccaaagtgctgggattacaggcatgacccaccgtgcctgccaggagcagtagtagtttagactagcaaatgaactggtgctttcctgaggtgagggaggtgatggttcacaggtttctctttagagagatggcacctaagtagggttctgaaaattgaacaggaatgtaccatgctgactaaggaaggaggggaggaaaaggtggtgcctacagaggtactagcatatgcaaaggtgagtagcagcaacatatgtaatttgacattgctatagcataaagttcaagggggaggacacagaaagggaaatgatgagaaaaaattgaggcaggaattggactataaaggagattctatatgaaagcttaacttttacagtgacaaaaagctactcaggaggtttttagcagcaagggaatgattgctgattttagcaatttaaatagaaagcagtcagggagaagactgaagcagggaaatttctacattatacattgtcattacagatcactacaccctaaaatataacctccaaaacaatctcatttcattaatactttactacagttaaaaggcagaatttcataacttacctaaagtattacatactgaccaattaatttactaaacacattaaatacatttcatttcatggtcaaatatagcagccttcactatctgcaccactcattaacttttacgaggctgttcagcaaaccattaaagagtaccttgtcactgccagatctaaagctccaggtaaaataaaatccaaaatttgagctctttgagccatattttatggcttatttatgatctaatcagaactatctacccatttgtcttagataaaatgattcaagattctctgaatcaaagagatattgatctttacttttctgctattttttttttttttttttttgagacggggtctcctactgtcacccgggctggagaacaatggcgcaatctcagctcactgcaagctccgcctcccgggttcaagcaattctactgcctcagcctcccgagtagctgggattacaggtgtccaccaccacacctggctaattattttgtatttttagtaagagacggggtttcaccatgttagccaagctggcctcgaactcctgatctcatgatctgcccgcctcggcctcacagagtgctaggattagtcatcccagcatgagccacagtacccggcctgatttttcttttaaatattaaatgaaagatgtattttatacttttctgggttaatcaataaaatatggagatgtaagcatttcatgaggtgacagctgtcaacatggtaatgaaaagcattttaaagaattaggtaggtaggttctttttttttttttttttttttttttaataagacagggtctcactctgtcacccaggatgtagggcagtggtaaattcacggctcattgcaacctccacctccagggctcaggccgtcctcccaacacagcctcctcagtagctggggctactgagtgcactggggctggagtgcactgacatgccctgctaattatttttatttttatttttgttgagatggggtttcaccatgttgcccagtctggtctcaaactcctgagttcaagttagccacctgccttgccctcccaaagtgctacgattatggtcgtgagtcaccgtgcctggcctagatggtaagtttttttgtttttgttctcgttttttttttttttttgagacagagtctcgctctgtcgcccaggctggagtgcagtggcgcgatcttggctcactgcaagctccgtctctcggtttcatgccattctcctgcctcagcctaccgagtagctgggactacaggtgcccaccaccacccccggctaattttttgtatttttagtaaagacggggtttcgctgtgttagccaggatggtctcgatctcctgacctcgtgatccgcctgccttggcctcccaaagtgctgggattacaggcctgagccactgcgcccagcctggtggatactttcttaatcatctcattaaaaaaagcataggaagactaagacatgtttttgaggttattaggaaaatcaggcttaatattttctatttcacaagatcatatatctaaagtaaccaagtaaactatctgattatgaggatctcaaatacaagattatgaaatatttctcatactaaaaatacttatatgagtaatgacttaatgccaaatcctaacccacaagggaaacccaactgttatttataattttaaaaggtatcaactgttttcacttacttcttcttcactgctattatcctccttttctttttcatcatcttcctcctcctcttcttcctctgcttcactgctagagctatcttctttcaattcagtcttccagttagcaggaatagttctacttttgtgaaattcaagtgcctgttcaaaggctggaaacagaccacaaggtacatgaactgaagaaattaagacaattgttttctcaaaaagtattaaacacgataaagaaataaaaactactgtgctaataccactgacatttattgtttgctatgtaccagaaactgtgttaagtgcttttaaatgtagcaatatatttaatcctatccatcctatgcattaggtagtcattttatagatggcaaaactgccaccattggaagattacttaagtttaaataaataaaagaacagcagttttattcttttaaacaaagattaagcttcactagtaaaaacctttaatacaggaaatcatgtaatatcttatgcaacaaacaattatcaaacagtattaataccaggcacagagccattaaaataaatatacaatacctgaaaactgaccacacatgatttttacattttcagttgaacttcaattaaaactatggtaacaattaccttcaactaaaattagctagacacaattattctcattttataatatatgggaataaattatataccaaaaaatcttgatgattttaaccaatctacatagcatattactgaattcaaggaataagggcaaagagaagacaactatttacagtgccaaaaatcaagtgacagatgcaattaccacatattcctcaaataaaactactggagccttgtggttaaggatgtacattcattagtgagaaataccaaaccaaaattactttgattcctcagtcaggcgtgatggcttatgcctgtaatcccagcacttaggaggccaaggcgggtggactgcctgagctcaggagtttgataccagcctggtcaatggtgaaactctgtctctactaaaaacacaaaaattagccgggcatagtggtgggcccctatagtcccagctacttgggagactgaggcaggacaatcgcttgaacccgggaggtggagggtgcaccgagattgtaccactgcactgcaacctgggcgacagagcaagactccatctcaaaaaaacaaaacaaaacaaaacaaaacaaaacaaaaaaaacaacaacacaaagttactttgattcctttcttctaccattcccagaaactaatattttatttaccaggcaaaagctagattatagtaacagctgactacacagttctctcccattattctagattattatgcctgactataagctaaaaaaaaaaaaaaaaaaaaaaccagaaaaaaaaaggaaacctatggttgggcgcagtggctcacacctgtaatcctagcacttcgggaggctgaggcaggtggactgcctgagctcaggagttcgagaccggcctgggcaacacggtgaaaccccagctctattaaaataacaaaaaattagccgggcatggcggcgtgtgcctgtagtcccagttactcgggaggctgaggcaagagaattgcttgaacccaggaggcagaggttgcagtgagccgagattgcgccactccaccctgggcgacagagcaagactctgtctccaaaaaaaaaaaagaaaaggaaacttataacacagaagacacatgggtttataaaaataaaggtcacaaggaaccaaatataaccataaaaacataatttaaagaaaaattttaaagagcaaagaaaaatttaatcttcaaaaacactttagcagtttttacagtacttgtaatttattccaagattatccttaccttgctttaaaacagcatcaggctttggtgcagtgtcactagtaatttcatggacatcttttcttggaactgaagtactatatattttttttaattataagagaagaaaaaaaacccaaaatatgactgagattaattaagaatccagatgattacatatcacagaaagatactgaaaatatgggaatgttgacgtttacaataaaagtgattgcacacagagtagcaagtcagaaataacatacaagacaggatgttaaaatacgtaatcatctacagaaggatcctaccataagagctattttataaacaccaacgtgttcccaaataccagagtcccctgcccaaatgcaacactgaaaactttttttgttttgttttgttttgtttttgagacagggtctcactctgtcatccagactggagtgcagtggcacaatcttggctcaccacaacctctacctcccaggctcaagcgattcttctgcctcaacctcccgagtagctgggattacaggcacatgccactaccacccggctaatttttgtatttttagtagagacagggtttcaccatgttggacaggttggtcttgaactcctaacctcaactgatccacccacctcagtctcccaaagtactgggattataggcatgagccaccacacccggccaaaaacgatttatggcaatataatgataaaatgtttggggccagccatggtgattcatgcctgtaatcccaacactttgggaggtcaaggtgggaggactgcttcatgccaaagttcaagaccaggataggtaatatagcgagacccagtctccacagacaaactaaaaaagtaagcaaagaattagccaggagtggtggcatgtgcctgtagtcccagctacttgggagtctgaggcagggagctgactggaaaaaacccagggcagggttacagtgagctatgatcgtgccactgcactctagcgtaggcaacagagcaagatcccatctcttaaaaaataaaggttgagctgagtgcagtggttcacaactgtaatcccagcactttgggaagctgaggcgagtggatcacctggggtcaggagttcaagaccagcctgaccaacatggtgaaaccccatctctattaaaaatataaaaattagctgggtgtggtggtgcatgcctgtagtcccagctactcgagaggctgaggcaggagaatcgcttgaacctgggaggcggaggttgcagtgagctgagattgcgccattgcactccagcctgggcaacaagagtgaaactccatctcaaaaaaaagtaaataaaataaaataaataaataaataaaggttggacacagtggctgacaactgtaatcccaacactttgggggccaaagtgggcagatcacttgaactcaggagttcaagaccagcctgggcaacatggcaaaaaaaaaaaaccctacaaaaatttgccgagcgtggtggcacacacctgtagtgctagctacttgggaggctgccagaatactagttaccacactgtacatcagatcctgtacattttattcatcttaccaataaaagtttgtgccgttttactaacgttttcccattttccttaccccccaacaatttaatattaagtcaatattcaatttctgtgctcaaattcctctgattatcccaattttgttaaagttggttctacatttttttttgttttgttttgttttgttttgagatggaatcttgttgttgtcacccaggctggagtgcaatggcattatttctgctcacggcaccctccatctcccaggttcaagcgattctcctgcctcagcctccctagtagctggaattacaggcgcccaccaccatgcctggctaatttttgtatttttagtagagacggagttttgccatgttagccaggctggtcttgcactcctgacctcatgatcccacctgcctaggcctcccaaagtgctgggattacaggcgtgagccaccgcgcccagcctacatactgtttttgaagctaacttttcagactgggtgcagaggctcacgcctgtaatctcagcattttgggaggccagggcatttggatcgcttgagctgaggagttcgagaccagcctggccaacatggtgaaaccttatcactacaaaaaatacaaaaatagccaggtgtagtcccagctactcaagagaaattgaggtgaaaggataacctgagcccaaagggtcatggctgcagtgagccatgatcatgtcactgcactccagcctgggtgaaagagtgagaccctcaccaaaaaaatgaaataaagtaaaataaaataattaaaaataaaaatacctttcccgaacttgaaaattcaaacatcaaatcttaaaacatgatgacctttttaaggtatttatacccaatacaattctgtataaaatatctggcttctctagtcatataattcttaaagaaaaattaacaaatcattttcttaacacttaccatccatatacaagtaacccattttaatcctcagactactgcaaaagttgagtattatccaacaggtatcactataaccattagacataactagtagaagtattggaaattcctaattagaccatcaagaacaaaccctaaggaaataatgtcaataaatacatcaataggccgggcgcgatggctcacgcctataatcccagcactttggggttcgaggcgggcagatcacgagatcaggagttcgagaccagcctggacaacacagtgaatccccgtctctattaaaaatataaaaattagctgggtgcggtggcatgcacctatagtcccagctactcaggaggctgaggcaggagaatagcttgaacccaggaggcagaggttgcagtgagccgaaactgcaccactgcactccagcctgggtgacagagtgagactccgtctcaaaaaaaacaaaaaaatcaataaagtattaaatacattagatatggcaaatttgcctcaaataaccagctattatgtggacaagtgttgacaaattagacagtactgagtgtctagtttggaaaagattaccaaaattagtaaggaaaaacatactataagactacaacacattaagataatatgaaaaacagtgactctttgaaacattctgtatgatgaaaaataaaagcctaaggtaattggaaataactaattaatcatttaacatcctaattcaaaataacagcatatatttataaactggtttttcaaaccaagtaaattatacttacaattttccatctttgaaagatcgaacaagaatattgtccttttttacagcaatctcatcactacaatcaggacaaaccaccttttaagaaaaagggtgaagctattataactaaaagaactcatagataggtaagtacccaccatttaaatccttttaaaaagtgtaagcttgaagtttaaaaactaattttagtttgagggtaaacaggcacacacacacacgtgggagcacacacaagcaattttaaattggcatcctacatccttccagctgctggataatctagaatttttggcataggcaaggcattgaaagcagaagcacagctatgactaggatgaagctgtggacgaagttctagtcagaaacagaaaaaaggtagagttagatccttaactgaagggatacatcatggctaagaaaaaaacaagggtccagaatttccagagccttgtaggccatattaattcttaggataaaatctaacatctttgttgaaagaatctgaaaccaaagaatgtcataatagattttccttttaaaaatctactttggctgctatgaagaaaatggaccacgcagaggcaactgttcaaagaaactaagctactgtgatcacctgagtgagaggtggtggcttggatgtaaagtggtggcaatggcaaattaaaggaatgagaaatatccaagataattagggaagtagaaagatgaacaataagaggatgcttagttttctgccttgtacaaataggcagatgacagagttattcactgtgaaagaaaaacaacaaaaaagggccaagtttgtgcatgagggaagggataataagaggagttttgggactactaagttttaggtggctaaaagacatccaaatgaagacagtgaacagaaaaatcaggtctggagcaaagcgtagaggtctggactcaaggatataaatttgagagcccacagcctaaatattaggggtctaaaacttggggcttgtgagccaaatccactcattacttttccctgatgagcgaaggatttcgaaaactgcacatgtgatagctttggccagtgatgacactggtgtatgagtaagtgggctcactgtccagttctgccacagaacgacaatatgcattttatcccattcacccatgtatgttattttcttggtcactttatctctttgctatctctgcaaggtgaagctttaaaaggagatgagatcaccgtaaagaaaatacagcgatacattctgaatcctgaattacagcttgaaagggtgattagaagaggagaacctggtgaaaaaaactgaaaaggagaactgcatgagccatggaatctaagatttccccctcttaaaatgaaattggaaaataaaaaattgagactgagagtaagtctcaattaggattaaacaatactacttatattaataagctcagcacagtcctagtcagggtaaatactcagtgcatggtagttatttatagttcctgggactatgtagttgtttcctttttctttttctttttttttttttgagacaaggtctcactctgtgcagtggcgtgatcacgactcaatgcagcctcaacctcccagggttcaatcgatcctcccacctcagtctcccaagtagctgggactacaggcacaggccacccagacccagttaactgttttcttatgatgttactaaaacactttgaatttactcgatttataaaaataacataaattagaaacacaaatactatttgtgcgattatatcaagattggtcgatttagaacataatttttcactctagttaccaaaaactatccatcaccgtccaatggatctcaattttgggaggagataacatacatcaataattctaagaatttaaaaacaacagtgaaatggctgactaaacagattactaacctttcaatattaaaaatccttagatttttcattttcgtcaaagaaactttttagtgattatggtgtgagaagcttaaattaataactcaaaacactaatattaaaaaatttaatgttcctattgagaaaaagacttacaaaacagttgtgtgtgtgtgtgtgtgtgtgtgtgtgtgtgtgtgtttgagatggggtcttgctctgtcactcaggctggagtgctgtggcacggtctcagctcactgcaacctccacctcccgtgttcaagcaattctcctgcctcagcctcccaagtagctgggattataggctcccgccaccatgctcggctaatttttgtattttagtaaagatagggtttcaccatgttggccaggctggtcttgaactcctgacctcaagtgatctgcccacctcggcctcccaaagtgctgggattacaggtgtgagccgccgcgcctggcccacaaaacggttttataaaaaatatatatatatatatatatatatatatatttttttttttttttttttttttttttgagataaaagtcttgctctgtcacccaggctggaatgcagtggtgtgatctcagatcactgcagcctccgcctcccaggttcaagcgattctcctgcctcagcctcccgagtagctgggactataagcacgcaccaccatgtcctgcaaatttttccatttttagtacagaaggggtttcactatgttggccaggctggtcttgaactcctgacctcaggtgatccgcctgcctcggcctcccaaagtgctgggactgcaggtgtgagccactgcagctggccttaaaacatactttcaaaagaaactcacaaagactcctagtgctttagaaagaaagaaagaatcgcaaacactgatgctttttttcagcttaataattaacccaaagtgtggcaactaacttaaccctgctaatactcagtttccttatctctacatcgggataaataataatacctatctcataataggtgttagcacactccttgtacatataggtatccactaaatgttggatacacaggaaggtacaaaggtattataaaatatttatatttattaaaacaaataattgtcctcatttttcactatcattacaagagctgacatttactgcatatttaatttgtgccgaacactgaactaagcagtggagataaagaaataagacatgttgactaaaaagggtaaatggacatcacaagtagaaaacagtaaaaacaaaggtagttctattgtttctttttcatttgagaccatggttacctagtttagcacaaaaaccacaaatatacaaaagagtttatatatattatggacataagttttcatacaaatacatataaacaaaggacagtgttttaatcccatttctaagtctctgcaattgttagtcaatgagcaggaaaatgagagaatgagaataaagagttagcagattctcaagcacaaattgtagagaaaagtttattaatcatcaccgggtgtgctggctcatgcctgtaatcccaacattttgggaggctgaggcgggcagatcacctgaggtcaggagttggagaccagcctgaccgacatggagaaacgctgtctctactaaaaatacaaaattagccgggcatggtggcttgtcataccagctactcgggaggctgaggcaggaggatcacttgaacctgggaggcggagttgcagtgagccgagatcgcaccattgcactccagcctgggcaacaagggcgaaactccatctcaaaaaaaaaaaaaagaaaagaaaagaaaagaaaaaaggaaagtttattaatcatgagaacaaaaaacctctacaccactaaatgagtctatctttgttaaatattttgaacagaacttggtatatgataaatgcatacctaacaaatatgtgttaatcttgagaacacaaaaattttattgaatgtcattaacataagggaaaaaagcattagaggagaatttggctaattatttttagtaagggagtgagaacatacaaaacagagacagagaataattttgacccattctgtctctcgatatttgagaacaaattagttgtcaaacgtgagaatagtactttcaaagtgtcttttgtttatcagcggatcttcagtttatagcttattaaatatgaagtgaggggaggacatatttgtaaaagatgtgggctgggctcagtagcccccacctgtaatcccagcactctgggaagccaaggtgggaaggtcacttgaatccaggagtttaagactagcctgggcagcatagggagacctcgtatttacaaagtatttaaaaattagccagatgtggtggtctccacctgtagtgtgagctactcaggaggctgaggtgggagaattgttgagcccaggaggtcaaggctgcagcgagtcaggatcacaccactgcactctaacctgggtaacggagtaagcctctgtctccggggaaaaaaaaaaaaagtggatctcactgtttgatgcaaatgactcaatggtcttcagataaaatcatcataggacaattcagacatatcaaaattttaaagagttcaagataattctttttttttcttcttttttttttttttgagagggaatcttgctctgtcgcccacactggagtgcagtggcgcgatcttggctcactgcaacctccgcctcctgggttcaagctattctcctgcctagctgggattacaggcatgtgccaccacagccagctaatttttttgtatttttagtagagacggggttttgccctgttggccaggctggtctcgaactcctgacctcaggggatttgcccacctcggcctcccaaagtgctaggattacaggtgtgagccaccacaccccagccaagataattcttaagagatactgattattaacttcagtctcctacttgaaatttaaaaccttaagtgatttatccaattatatgctgtccagaaaaaaatgcattcttattgccacagagttaaatcttcattaaagtatcatatatagctaattattagttgaacctctatttgctttaagagctacaaattattttgtctaccaaaagattatttgaaaagcagcctagttatgtccgtgaaagatattagtatatgttccctttctaaaagtcaaagaaaatggtctatacatggccctttcaacttgctaaagaagctagtggttacgaaaaacagagagataaaaagctcaaaaggctttctgtcatgtcttaacagtttgaaatacaagaacttgggacaatcatgaggatactcctgataataaatcttgagtacctcctcagaatcacaaaaaggcaacgtgagaaaacaaggaaaaaatgcaaaatattcaacctggaatctaaggaattgcaatcttttggagagaaaaacattaaaaagtaggtagaattaacaatctactgtagagaaaattgaagagtggggtaatgtataattgcagtcatgattatatagggagtacctaaaaggcaagattaagatcaaggatggaaacaccctgattcactaagtatgaggaaaaggtctagttatccctgtcaaccaagaaagattctgttgttcttttgcaatctagacctacatggacttaggagctttaaaagtttgcatcatgaattttctaccgagagagagagaattcaacttccacatagctaaacctctaagattatcaagattttgcctttcctgaatgacatcaagagttctttgtattcaaagacaacgttgaaagtaagcttagtgtgaactaaataatgctaaaaacatttcctcattttgtacctatgaaaaacattagtaagaaaattgttttcttcataaacttataaagtttgaaattaaactcttgtatactgaagctactcaccaatgcaggaaaccacagtgctttctttttatccaaactaatgtaatctacacatacaactttgcctagtagctcatcaatctgtttcctatcatcctcatcttcatcactggaggatgatgaagactcttcctctggtctagggagagaaaaaaataaaatatttccatttatcctcacaaagaataagcatgccaatgatgaatataggtattcccaaactcttattacatttcctaagacctgtaaaatggctaatttaaatcttaaatcattttctaaatttctaaaaaataacagcaagagtttatcatgagaggaaagcacatcattttcccaaaaatatttctggtttatttagtgctactgtaaaaaattgaggaggaagatcaggacaaataactggttcccaaatcctcaaaaaggtgaaggccccatattaaacatcccagtattacactaaaatatacacaatcccaatctcaaattaaaggaattctggagacagtaattctatatctccagtacaaagttaattttaaaaggtaggagagcagacctttattaactgaggttaggttgggaagaggaggcaatctgaaaagagatcaccactgctatccataacaacaaatacacaccaattaggtattcataaaatgtccaataagcctcttttgtatgatgctaaaaactttcaaaattaaaagaaaaacagaaaatcctttcagtaacattaaatattggactagtaaattagaaagataactgtcagaagaaaaaggaagtatctgaaaccatcaacttgatgtttgaggaaagtgtagtaaaaaggaaaacaaaacaaaaagctattccaatttgaatctgattctaataaagaatcagcaccaaagaaaatgcccagaatgagtaaagactaggaaatgtttgatggacaacaacatatgtcctttttagaatggctattattgaatacctacaaagataaaagtgtttttcagatagtttgcaatgatcagtttcactgcccaaaaaaggaaaactgacagattaaactactaaaaaactttaaacatgatttacctatttagtatactatctagtatactctgaagttgtctttgatgcctttccaaaagtatgacaaagtaaccgtcatgcctttatatttatatattccaatataaatgtaaacaaagtgaaaactatttttttcttttttgaggcggagtctagctctgttgccgggctggagtgcagtggcaccaccttggctcactgcaagctccgcctcctgggttcaagcaattctcctgcctcagcctcctgagtagctgggattacaggtgcctgccaccacgcccagctaatttttgtatttttggtagagaaggggtttcaccatgttagccaggatagtctcgatctcctgacctcgtgatccgcccacctcgcctcccaaagtgctgggattataggcgtgagccaccccacctggccaaaaaagtaaaaactattataataatattaagctttttaaagtgacatggggaataccacccccttgatttcaatgatcagtcaaataacttaaaaattgttccctggcagaaacaaagcaaatcttcaaagcttgctattgaatagaagtactgtactttggctggaagtattgtactcccagcactttgggaggcgaaggcaggtggatcacctgaggtcaggagttcgagaccagcctggccaaaatggtgaaacctcgtctctactaaaaatacaaaaattagccaggcatggtggcgggtgcctgtaatcccagctactctggaggctgaggcaggagaattgcctgaacccgggaggcggaggttgcagtgagccgatatcgcaccactgcactccagcctgggcgacagagtgagactccgtctcaaaaaaaaaaaaaaagatgtattgtacttcaatggcacttaaagaagttcaatctctacttagaaagtaggtaacaataagaaaactcaaccacctttacattagtggagaataagaccctacacatagacacacagcttgggacagtaacgacagtcctcacaagtctgatttctacttgatttacaagagcttaagagtagtgactttttttactgtctaatgactacaggatacaaccaagcttaaaatcataattactgctttctcaaagtagccacagaagactcattcagctaggggtttatgaacactctattatcagtagcagctagaaagctacaatgtcagagataacacatatcaaaatctgtacaacatagagaaaattgggctttatttgactaacaaaattatctgcatcattgtaaaaattgtaacttttcttaagacttaacaagtgttaagacttcagatttcacagtatatcaaaaagaaaaacaaaacacctttgttcagctagctgaaacatctatccaccttacatataaaattgcaaggttcctgtctaaaatcatctccatttttagactagatgccccttccccctcacctactcaagactttgttccaccttattcaaatttacagtccctgcccatctacctcttttcattttgctcttcatttccacagcattcacttttatcatactatataatttacttatttcttatgtttattcttttttttcacaccaagtatgtgaatccaatgtttaattcgctatctcctcccctgagagaatgtaagctctcaagttgaagattttttaagtaatttttttttgtttattgatatatctcaagtacctgaacaatgcttggcacagtatagatgctaaataaatacttgttcataaaataaaaaagatgcatttatttttttattatggtatttctgatttttattctaaaatcacaaaatgtatacatcagtgtaaaccatactattacacatgaagctccttaacttttccttttagaggagcttagccagaaaactgtttacacaggtactcaataaactaatgaactaaaattaatgagcatccaaaatattttacaggagcaaagacagagcaagcagagagcctgcttgatttttattcatttctgacattgttatttctttggtggcaaggtatttgtagagccacaacaaaataatgcgctgtctctatgaaataaaatctgatgatgtcactagaaagaaagctaattacatggaaatttttaccataatactctaacagccaatcacttaaagctgatcacacttcactattaactctaattagttgtaaatcaagaaagacgaactttagacaagatatgggccaaggaataccaaataatgatacaaattgagctagaaacaagaggctcaacctttgacatgcaattctgattattttttattttaggcaaatcagtttactcagtttcaaactttgtaaattgaaatgttctattagtatctggaagactgacaacgtatacataccttcttagaaacacacagaacctatgtacgcttaactataaaagggttttaatttttttctcaatttttatcaaggaggaaatgaatcaaattctcatattaaaataaagcggcaaaataaaaagatcttctggaattagtgatgatagttacacaattttatgaatatactaaaaaccactaaactgtacactttaaaagggtgaagtattggatacaaatctacagattaaaatatatgagtaaattttatgatacatgaattatacactaatttaaaaatgtgttcagatctgcaggcctgtatttaaatagcaagtataaaccaggtattgggtaaatcttagcactgttactgggtaaaatccatactcataaataatcccttgttaacaagattcattgtaaaccttatgctttatcttttttctgaaggggaaaaatataacagcaaatagactgctttcctattgtagcagttgcacataaacttttgccagattatgggaaaacaacttcaagaggagagggacaaacaagtatttccataatttcaggtattctattcttctggatgacttaaacacaatcgctgcaaacaatgggtaagttataaggagaaaattcaatccagtaatacattgattaaaagaatcaataacttgctttaaaaaaaatttagctagaggatgataatcattaaaaaaagaaaatacttgaacttactaggattaaaggtagaatatactgaaactcaatttaatggaagatgttaaaagtaatcaattttggaataactaggggtagattaactgatacgtggaataacagctgctaaaagaaaacaaatttggtgatacatcactccaacaacgaagtcctgggaatcctaagaagagataactttacatatctttgtacaaaaatacattttaaatggcaatctgagatcacagcaaagacttttttcaatggagtaatggaagaggaaatgaaggtcagatgaatgcccttaagatctaggtttaagactttgttgcagaaaatcactttgaagaaaggggagaaagaactttgaggaaatgtaatcaaggagatgggcatttcaaactgtagtacttgcctgtaatgcttacacaccaaggcttaaaacgccaagcaagagtaacattgtcaggttccttggcagtgagaatgaccaaccgtggtagagaagggcaaggaagagcaagcaaaacaagattacagatggagcaggtcttcattcctacactagtaatcttcaaccttttgtctgcattcatactttacacatgtataacacaatctcaacagcaaatctctcattacacatagagattctcaacaggaaaaccactaacttagaatgtttgctggagtctttagaaagcaaagatcaacttattcagcaacaaatgcgtgctttattctcatattcacaaaacggacgcctcaactaagaaacatctaacagttggggaacgacagaagaggaaataaaaaataactgactttttaacagatcataatttttagtcacatttgcaggtcaatattacgtgatattgcacaataaattcatttttaaatttatttttacactttaggatgatgtgtataaaatcgtaaaaatatgtctaaatactagatgcaatcttctaaaaattaaaaaaacttattgacaaataagagactatttttcctataatatatataaaaacgtagaaattttttaaagttcgaataattcagcaagaaccagtcctaattgtcagacataaacaccaggaagcagaatttttatatatacatgtaaacacattttcatatataaatgaaactgttacatactggtatttcatcatgaaatttttcatgtcagtatatgatgttgattatctagtacttatgtaacatttactctataaacacttaaaggatatgaattcacttaattttcacaacaacactaagagataggtaatattattatccaaattttatagataggaagtgaggtatgaaaagattaagtaaccatcccaagatcacacagcaaggaagtggcagagccaggattcaaacccagaccaactggctccacagttcatactatgccagagaattgggtttacaggggagagaaacatctctggtttcaaggaaagtgtggggagacacaaaatggttcacataaaggtttaagcatttttgttgagaattaaggcatggacaagacagttaccaggaagggaggcatggagaccaaaaataatagcatgaataaaagcatgatattagaaaacaagcgatgtattcaggaattattgactggtttcattttgactacagcatcaagataacatgcagggagaaattgaaggcagatacagctgttaagtaaggttggctgagcatggagaacctcaatcacccatgctgaggagtctgaaattactattagatccgaaattactattagatctggttagcattttgcaaattacaattttaaaataactataaacaatactagaaggagaaatgaattcaggttcaactaacagtcatgaaaatggacttacatatgattagatcttcttcctctatttgttttctttcctatgactggagtgccaaaatgctcagggttggtgagtgggagctggtctaatgtctgtgggtaagaacataaacccatcaaaaaattaacactttgcaagtgccttctttgttttaaaccaaatcaatttaagaatatgctcagattttgagattaaactctccccccagggaagctaaaacacagctttcctaaagatagaaaattctagtttcaaagatattagaataaagatgaatgagctcattactggaaaaaaaaagtgaaaagaaatttggctgctctctctagatgattcattacctatgtgaaggttgataggcatctaagaatgattaaaatacaaaacaaacacagctcagtggaaagacaaatgtgagaattaagaaatctatttgtaaggttagggccaactgcagctccaatattaatttgtacatggggaatcataatccataaaataaaattattaataagaaacaaaattaattatgaagataaagcatcaatcgcacgaacaaaaagcctcggagtaagttatattactactctgcaaacattttctgcaataaaccttttttaataaaatgtaacattaatttaattttttaaattacatttaatttctacatttgatttttttcctttcctacgttttcttaagattttccacagtttctgttcctttcctcatcctaagaagaatctttcctgttataaataatttcacaaacatcagagcaactagagatttccaagaaaactgcccagatgaaaataaaagtgaggaactatttaagacagagacttcttaaagatacaaaccagggtggtataagaaagagtatccatgaacttagaattaaagagcaggcatctaaactaatgtaatatgtaaaaagaaatgttatataacttttttaaaattgagacaattttgttataactacaatgaacaaaactgtgaaaagatgaaccatattaacacttttttacataattcattagaatatatgtaaatgtgtttaaggtacatagatgtatgtatctaacaacgaacagtatgatcaagaaaaaaggtactagccataaaggattaactaaagattgattccttcaaaagactgacaaaaatcatagctttcacaactctcatagggcaaaaaatctaatctttcaaatttagtttgtacagaacctaaccctgtcctaatgaaccttaaatcaggcatttaaaaaatattatttgggccgggtgcagtgactcacgcctataatcccagcactttgggaggccgaggcaggtggaatacctgagatcgggagttggagaccagcctgaccaacatggagaaaccccgtctctactaaaaatacaaaattagcctggcatggtggtgggtgcctgtaatcccagctactcgggaggctgaggcaggagaatcgcttgaacccggcaggcagaggttgcggtgagccaagattacaccattgcactccagcctgtgcaacaagagcgaaattccatctcaaaaaataaaaataaaaattatttggaggcaaaaactgtcctaaactcagtatataccaaacagaaactatttttattgagacagaatgtcaccctatcattcaggctggagtgcagtggcggcatgatcattgctcactgcagcctcaacctcctgggctcaagtgatcctccaacctcagcctcccaagtagctaggaccacaggtgtgcactatcacacccagctaatttttgttttttgtagagatggggttttgccatgttgtccaggctggtctcgaactcctgggctcaagccatctgcccaactcggcctcccaaactgctgggattacaggcatgagccaccacacccacccggaaaatctagacgttgcctgtcattaactcctatggtgaaaatttctatgtaatctgaaatattattttggtaatactgtatcactatagagtattactaaatgactttatttggtaaacagggaaaataaattaatccggattcactttctgtcaagcaaacagatggattaaatgtatgctctccccaccgaaaattaaggttgctctctttaaagcagaaaaataaaagagagagagagatttatatcacacagtgtgatttctattttaagtatctgttagtcatttcacttgctacaggaaagaaaatttctaaagagttgtttaagaatcacacatagtaattttcaaataagagaccacagtctctccctagtacataacaagaagaaacataagcaatatctctgtccctatctcaatgtccaggaaagtaggggcatgtttgtttcaagggactaaaaagacctgggggtagggtagaatttgtcccatcttagacctaaagagcaaaaaccagaggctcctgaaagctgtattaaaggcacatagaaaactccgtaggcctagagggaaaatgtctatggccctgttacctaaaatgggctgcagaaaatatggaactgggattttacctaaacttctctagagttttcaattgcacatagtaaatacaaagaaagaataccagataattggctgggcgcggtggctcacgcctgtaatcccagcactttgggaggccaaggtgggcggatcacttgaggctaggagttcaagaccagcctggccaacatggcgaaaccccatctctactaaaaatacaaaaattagtcaggcgtggtgctgcacgcctgtagtcccagatactcaagaggctgaggcacgagaatcgcttgaacccgggaggcagaggttacagtaagccaagatcatgccgctgtactccagtctgggcgacagagcaagactctgtctcaaaaaaataaataaataaataaatatcagatgatgaatctacttttgtataatactcaaagtatgaatggtctttagaaatacctaaactgtcctacagatgttaggcagcaggtaacatactcattaagctggttatggctaaaaccagtggcttcagtgttggaatttaaactgactgaggctgggcgtggtggctcaagcctgtaatctcagcactttgggaggccaaggcaggcagatcatgaggtcaggagatcgagaccaccctggctaacagagtaaaaccctgtctctactaacaaatatttaaaaattagctgggcgtggccgggcacggtggctcacacctgtaatcccagcactttgggaggctgaggcgggcgtatcacgaggtcaagagatcgaggtcagcctggccaacatggtgaaaccccgtctctactaaaaatacaaaaattagctgggcgtggtggcacacgactgtagtcccagctactcaggaggctgaggcaggagaatcacttgaacacgggaggcagaggttgcagtgagccgagatcgtgccactgcagtccagcctggcgacagagagagactccatctcaaaaaaaaaaaaaaaaaaattagccaggcgtgggggcaggtgcctgtagttccagctactcgggaggctgaggcagcagaatggcgtgaacctgggaggcggagcttgcagtgagccgagatcgcaccactgcactccagcctgggcaacagagcgagactccgtctcaaaaaataataataataataataaaataaaataaaaagataaactgactgaagtgcaaatgtgatctctttccatgaaaatcctgaatttcagtgtttatgagatgggattaatttcagtagtttattaaatgggattagtgacccaaaatactggcagtatgaagcagctttcctcttaaaggacaatgttatggactactactactactaatactctgaatggtctttcaaaaacgttaaaacttttaaaacaatatgaaaaataccaaataaagagaaaagaacatacagatggtagattaaattcccctattgggtgcactctggaccacatcttcacagggcttaatatactcaaattttaaaatatgtttgattgtttgattaatgctttttctcctccaacggagagtaagtatccaaggataagttccatgtttacatggcttggtttgattaatgctttttctcctccaacagggagtaagtacccaaagataagttccatgtttacatgggttggcttaacctttgtcccggtacctagcactacacagctccgggcacatgggaagggaattgaagaatcacacaccagtattctaatttccttctagcaaaacataaattagaagtacacacctgcacagacacactaaaactgaacctccttgaagatatgaaggatacatagccacttgttcatattaccttcagcatttaacttacaactgtcttatgaaccattccaactgaaaattctcctggttaaaaaaaataatattttggctatttctctagactaaaaaaataaaatgcagaccttcacttaacaggagaaaaaccatgtcttcaagtcctcatactcactgactgtacggaaatgaaattaaaataattccacgaactcagggagaattctgtactttatcactatacttgccccaaagctgtctgtatttattgtatgtaaaccttcagtttattccacacatatttattgaaggcttttgtgtagaaattgctaggaaaaggggggcctatcaagtgaggaaagaaaggatattcccctaaaacagcttaaaatcttacagcaaaaatgagaaaagttaaaaaaaaaaaaaggtcctaaaacaagaataagcaagagaagtgcaaaacgaccaatttgggtagagagctcacgaaagacatagaggaggaagcatttataatggccttcaacataagtgagattccaacaagaggaaaggagtcaataaaggaaagtatggaccatagtctgaaaataccaagcagtctaataaggcagaagtacagggaagtggttgaatatgagactaaagggataggctggaattataatacagagaacctgtccaaattctaaatttaagtgggaattcaatcattaagagaagcaaaaatttttcaaaacaaaaacataaagtctaataggttaataagtaatattaaaatatccccaaagaaacactattccaaatagtgtttaagtaataacactactaaataagtaatattaaagtaatattaaagtaataaataataacaaataagtaatattaattagtaatattaaaatatccccaaagaaacactattccaaatagtgagtagagaaaagaaatagctcggccacactgtgtatcaatgaatatctgtagactggattagagaacgtaacaccatttagagcaacatctaccttttaaattctgaattgcaagcgagttagttacaaaactttgtgaaccctctgctcttagtaacatctttcaatttaaggatatggctttggtgctagaaagtgctggttagaaaaccagctctagctatccatttcctaatctgaaagttggggataataatagtaactacctcataatgttgcaaatacaataatgtatgtaaagcacttagcaaaatccctggcaattataagcacctcatctattcatccaactaacacttatgaagttcatactctgcatcaggcactgttacagcaactaggaacaaagccatgaagaagatatacaaagtctctgaccgtgtgacacattctagtgaggaaggcagacaataaataattatgtactcatattttgatgttagggaataagacctaaatcaatctgaaaggatgataaggaatggaagggacaattttaggaagggcagtcaggcaagaggaaagggcataataatatcagctaatagcagtagcagtagttaaagactgttgtatctacacatcctttaactacgacaaggatcaagtagattacaaatcagaaatctgttttctagttatttacaaattttaagtctgtttaaaaactgcctaaagataataattaaagcccattgtattttctctgtggacaaatactgaaacactttacatagacaaaaaagaagacagaacctggtgctcaaacacagggccttaaacaggcttcacagattacatcataagggtattgtgtattaatgaactttcctgattaggaagtaggtttactgagttgagaaagcaaaaatttattcctcccaataaaaaatattaagacatgttcatttgttaaatgatgacttacttcactttcagcaaaatgcctctctcctttcaggcacagtgaagatcgtctcagtgtcttctcatctccgtcatcaaaaactatgagagggggtaaaaatggaagctactgaaggattttttcaaagatcaaagagatgacatgtattacaattttctgagtgcaaacagatctactatttaagactacatttggaattcaattcacattttatgttttctagtgagtaacttcaaatatagagttattaaagtaacttttccaatttctagtgaaaaagaaacaacatatatgaaatgaaaacatcttgtataaaacaggatataccaaataaaaataagaagttggtatttcaagaggaaaacatttaaatgctaattaactcttctcaaaatggtaaagaaatgacaagttttcctactgacagatattgacagatttacctaagaaagattacaagtatatgcaatcagactgcccctttaaaaaaataactgtattttcattatttaaagtagggtttctcacccttagcactgtcactagtgacatactgcaccagaaaattctctgttgtggcaggcttgtcctgtgcactgcaggatatttagcagcactcctggcctctacccactagatgtcagtagcacccccttcccagctgtgacaacctaaaatgtctccagctccaggcattgccaaatgttccctgggggtaaattcatcccagttgaaaactagcgacttaaaatactaaaatgtctattaaaaggtgatggaagtgttaagcaacttggctgcagtaattacttcacaatatatttgcctatcaaatcatcatgttacatatacatttatatgattttgtcaattatatctcaataaagtaggggaaaaattttaataaaaataaagtacttaaagcaccccagcaaaaccaccataagttaacagatatggaatgtatgactatttgtattatatgcataaatctgtgatatacataaataatttagggatatgctacattccttagaaatcatgggaagacagtaactctgttttaaataatgttaccagatctctattttagaaattacattttctgcctacctactaaaattagatactcttctttccttttctttttctgatgctcaacaggatctcacgtttattgagaaatgattaatggttaaaagaaagccaataccctttccttactggctgaactaaaattagattcttatacgttacataacaagttacattatgtgaaactggataaataattttcagtacatctttaaatgatgtaactaaaatatacaacataagtgtcacatttagtagactattacaaccaatcaccatctagacttcctacatagaattgctcacagtcttctcacttacataaagtcaaatatttccttatgtctcaaaatcaaataattttccctctattttcaccaggttttattctcacaccaaagaagtataaacaaaactcacctattctatctgaaagttctatcaaactctgaaatcacgaaagacattttactaggtgtttactttcatctctgaggtcattaaatggtaagaattgttacctttaataaataatactggaataaatggctaccaatctaggacaaatactttttaatcattattttagaatgttggaaaaaatacatactactgtaggtgaaataaaaatctgtttgtaaaacaaaaataaaaataaatttaaaaagtataaaaaatttgaagaatacattagaaaatagatttataacactgatggaaggctttaagattcaaaactaaaattacaaaataaaaggtgaccatacaaaaactgactacatgaaaattaaaagcagagacaagaataaagcaacaggagaaatatatttataactgaagtagtaaacagttaatatccaaaatatataaagaacacatataccaaaactaataagaaaaagataaatcatctcaagagaaaaagggaaagaataaaagagccagcaactcaaaacggagaaaacacaaatgaaattatgttcctttcaataaacatatgaaaagatgttcaatctcactagtaatcatgggaagggcatactgaaacaaaactgagatactactttatgtccaaattagcaaaaaatttttttaaatgacataaaatctgacaaggattgagaaaacagacagtgtcttttaggaaggcagttttcattaactactaaagtttttggagtatatttttcttcaacctctatttctcagtatgtacactaaagaaatactaggatacagtaggtatcctaattaagtacctaattaggtaaaaaagacattcaatccagcatttattgtaatagtaagaaaactggaaacctcatcagtaagaaaaaataaactagcacatcaactattataaaatacactactactttgtttcctgctgggagctagatagatagatagatagatagatagatagatagatagatagatatatatctctctctctctctctctatatatatatatacacagttaaaagacatttctattataaaacaacatgaatatccttaacattactgaactataaacttaaaaataggtaagattggggaaaaaaagaaatttacctaagatatactttgaagtaaaaaaagctagaattccaattgcataatatacacattaaataatttcaatttttgttacatatacatacatatactttggaaataaatttttaaaagatgtggaaagataaaatccagtaacagtaataatatctagggtattaagaagtgaatccaggaaatttcattttatttgtattaagttttctttgtgtaactaaaaacacatttttaaaagaaaatttattttcttacctacagtgtaccaactcgcatctgttagtttattgataacagcttcctgatatgcaccatcaagattcttcacttccacaatagctcctacctaaagtatttttaaacatgttagaaaaacttttaaaaggtaaattaacaaaccaaaacctgggtttgttttcttttaactgagtgcatgatggtgaagaataaaatgactattgacttcatttaaaagtaccagcagttggcgtgagcacagtggctcacgcctgcaatcccagcactttgaggggctgaggcaggtggatcacttgaggtcaggagttcgagaccagcctggccaacatggtgaaaccccgtctctaccaaaagtacaaaaattgggcaggcgtggtggcaggcgcctgtaatcccagctactcgggaggctgagccaggagaattgcttgagcctgggaggtggaggttgcagtgagccgagatcgcgccactgcactccagcctgggtgacagagcaagactctgcctcaaaaaaaaaaaaaaaaagtgccagcagttttaccgatcaatatttttgtaccatcagtgaaaatgttaatgtagtaaaaaaggcaaataatacctaagtactattataaagttttacccttacaacccccgccaaaagaatcctgggaacccccagggtcagtagactacaccgtgagtaccaccatctgtgaaactgactgtccttgccccgtatttccactcttctttcaaggaacctcaggaaggatagggacaatttaaaaattgctctggggtttccttttggccctaaaccagccaaagagcacatagtggtttacccacacattctcttttagcttgctcactggcaaaaagcaaagcagcatttatttcacttgccaatgaggaaaaatgaatgcaaagaaataaaactctccaactgttagtgtaaaggctgatgacccttaaaagatttcatttgccagtagtggctccaaagaagtaagagctccgatttttttggttttctaactttctcacttttcagatcatcgtggaactgacatcactaatccctagttcatcatctattaattttggaaaatccatcattttagtaatggaaatatggtggattaagtaaataaatgtagtcaatgcttctttgatactcattttatttctgaataaactggttttactaccatatcaagtattatttaatattaaatcttttttttaaaagacagcatctcatgctgtccccaagtgcagtgtacacaatcataacttattgcaaccttgaactcctggcctcaagctatcctcctgcctcagcctccttagtcactgagattaagtctattttttctattagtctttttagagaaaattacatattgaatttatcaactcaataacaaaagagccaatgaattaataccaagtatgattattttttcccaaacaaccattagaattaacaatgaatacatgaattacctttagtgggccctttatgtggtcatcctgaacttccactgttgaagaatcatgtctaaatgtcacctagagattataagtttaattagccaccaaaaataaaccaagcaacacaagctcatcaatgcaccaattattcatttgtagtaaaagaaatataaaataatagctgcctagtttatacaacatcccaatccctaagtagattaactaaaaaattatttacagacaactgctcagaccgtatctgttttcaaaaataaaagtaatcaatgatagcacatctaaattactagatgttccacatgtcattttttttttttttaacttttttcttttttgatacacagtctcactctgtcgcccaggttggagtgcagtagcgcaatcttggctcactgcaacctccacctcagggttcaagtgattctcctgcctcagtctttcaagtagttaggattacaggcacctaccaccaggccaactaatttttgtatttctaatagagatggggtttcaacacattggccaggctggtctcaaactcccaacctcaagtgatccgcccgccttgacctaccagagtgctgggattacaggtgtgagtcaccacgcctggtcccacatatcatcctttatttcaatactatcagttatgaatttagttgtaaaattgcttttcctaaaaaatgagaaagaaagatatggggattttaggctattaggtattatatcattttgtgaaggcctaccttaataataaacagtagcagcaaacacttaactgagatctgagcatcagtctctagtaccaaacatttaatcttcacaacaaccctattaggtaggtatgactgttcccattttgttgataagaaaactgagaaacaggccaggtgcggtggctcatccctgtaatcccagcactttggaaggccgaagcaggtggatcacctgagatcaggagatgggaccagcctggttaacatggtgaagccccatctctattaaaaatacaaaaattacccaggcatggtggcgcatgcctgttaatcccagctactccggaggcttaggcaggagaatcacttgaaccagggaggtggaggttgcagtgagccgagattgcgtcactgcactccagcctgggggacagggcaagactccgtctcaaaagcaaaacaaaacaaaacaaaaaacagaaagtgtaagtacctggtccaagtttacagagctagacatggtggagctgatatttaaatgtaggcagtctagttccagaactttactgtgctctatatcattacagaaatcagagaatgggaaaccagaggtgaaaagagtaagttaaaataatgagttcaaatttaaatacttaattagctggtgaaaaacaagatagcttccactactcagtatagaaaacaattgttttctctaacaagggaaaagagttcttatagggattgaatcattaacatggtctttatcaggtatatgtgataattattttaggtaacaggcaggcccactcaaaaaccagctatgaaaggagatgccttatacccacagcatcccaggcatttctgtgtcatacaaaagcattatcacactttttatttaaatcacatgtttagatatctgtgcccttcacttaaactataagctacttacagatggagactaggtcttaacactagagtttcacctttagatagagcttagcacatagtaaatgttcaacaaatgaaaacaggtagtgaaaacatatcaacaaatttgttaaaaatatattaactttgaatcataaagaaattacacatgttaaaaaatatatccctatatctactgacaaaatcactgaatgaaatacactttctttttccttgtgtatgtgttttaatggacatcacctccacagaaacaaatttttagggcagccgaaaaaattaaaaataagctttagatattcattacttataaagcacaaggtactctgtgctatcaatagaggcagtagagtccagtaagagttttgttcctttcatttacagcaagaaatggcaggactgctacatgtcattttcctagttcattcattacacaggaaatgtgcagctaaggatgcaagatggggcttaaatccagcctttgctttgtgggccaaagcatgggtcctggagtgacacagctccagtccaaagagaatgtcttttccaactggcacaaacttgctatctgcatgccaagcgctgctaagaaggctttccaccaggagagagggcttttgtctacttcacacaaaggtgatacatgtgctaccagtagtcctgaaaaagtacaaacattgataaaaggctttctcttcctctacaggatagtactggcaaaaaacagtgcttggggaataccagtgtgtgaagccagaacaggaaatgcacactataaaagcaccaaccaccaagcatgtggaaactgaaggtagggtggggccaagactagccccctaccagtttgtagttaatttaaaggacttatcacaatggttcctaaccaggagtgtaaattagaatcacccaggtagctttttcaacacatccatgcataaggaatataggaacagtaaaagctccagaagagactgataccctccacagaagcacaacacctctacagtctatgtaattggtgaaataaaaaccaatggcttaaaaggtatctgctaatctagattataaattccttgaggacagatcaggtcaatctcatcctaatatccccatcctccttcccacctaaaagttccctgcaaaaggtttgtcactcaataaattattgacaaatgaataaatgtctatattcaagttcacttgtctggtatttttcagtgctgataatttattaaaatggaagcaattacactcctttttctatattaagacaaaactcaagtactttagaaagatgtttcaagaaaggcagagcataaggagtcaacaactagatgtaccttatttcactgttatctaaggcaccatcaattacaagtcacattctaattttatggctgaaatagagggggtgatgccttaaaattgatgaactatggtagttccaattctgccatgaatttggcataatggccttggagaaatcactaaccctctccgagcctcatttttcttgtaataaaatgaagcaattaaactagatgacttctaacttcctttccagctctaaaacactatacaaacaataagacgtctatagtgaaatggcattcaaaataccaactgtgataatctaatttctttccaattataatacttttaaaataacaaaaaatgctttgttttgaggtatttttacaaccttcactcctagaaacttattttgcagaaaaatcttaaatacactcaccaaataaaagtttacatatcaaatgctgaacatacaatttatgaaatctataaatactgtaccttgactttgacaagtctttttgctgtcttgatcttggcttcacaaaaggctcctctgtatttagcactcacatcagtgcccactgtcaaatagggaggctcatcaagggcctaaaaatgcaaagaaatataattagatttaaactctctaattctttcccataatcagacctcagaatagtgagcctaatcttgttaagctacaacagttataaatatgaaatgtatgttaacaagaccaatctataaaatactataaattaaaaaacaagtaaaatgtttatcataaagactatttaaatgtacatcacataaaatataaaggtatcttatttccattaaatacatatggtccatgatatgaattagctcactcacaagtatacccctctagtcactcattcattcaaatatttatttattctatgaccacttacaagaaaagggtccgttggccagaaggcagatctttaaagctcaaattctggggtgggggggaaatcttctaatatttaggctgtatcttggcagtcacccagattcagaatagctctgttatatctctatctagaaaagtctaaggtagtttagtgtagtgcctggtgtggtggttcctgcctataatcccagaactttggaaggccaaggctggaggatcacttgagcccaggagtttgagaccaccccaagcaacatagggaaaactcaactctacaaaataaaaaaataaaaactggctggctatggtgccatgcgcctgtactcctagctacttgggagactgaagtgggaggagtgcttgagcccaagaggtcgagactcgagtgaaaagtgatcgtgccactgaactctagcctgggccacagagtaagaccctgtctcaaaaaagcaaacaaaaaagaatgtagtatagcatacaagggagaaaagttagtatatttaaactactagtgaaaactatatgaagaaagtcatctggaaagtctcaaaactttgaagccaaaatatcttaaatgctttaataggagggattcgctggatatttactcttctaccttaactaatatttatgtttcctcagttgtgatttagtttttaatagctgctcttacgttttacattcaggtacatttctacatttttatttctaaggagttcttctgcttatagtaattccatagccaaaggaaaatcatggaagtaagctttttccaaagtgctttataaaaagtactaacatcccaggacgttccaccaaaaggaaaggaggcaggagttgggggaaattcactatattgaatgaattacttctctgcctcaactttggagattcataaatgtaagctaaaagatctgagaaaccctataatagagaaaatgattacattttaactcaacatttcccaatctatttgtccaaagaaccctttcttttctattgacatctattaacatcctacagaaatcccatagaatataaagtgagaaatgctgttacgagtaataaataatgaaagaataatttcatttagattttaaaataaattctcccctaaaagttgtagctatcatacagagtaatctatttcccaaagaaaaagggaaaaaaacaatattctagtgctataacaggagtgcccacaattatatcagacctccataatggccacctgcttcacattccatgtatttcataaaaagtaaactcaaaacatatcagttatacaatttttaaaatcaacttaggaaaatgcctattcatcagttcatttataccataatgggaatatacccttacagaaagataatcatttctgcactaatactttctaatttttttatattattaactacaacttgataactttacattgctgttgtacctagtgaataaatgcatttctactttacctacctgccttaggtctcttaaaatatcattttccctggccaaaattatggttacattccaggcatactagtggctttatttaagcaataatatgaaaagggactcacaccacttcgctccaaaatcataaaaatggccacgcattgtggctcacacctgtaatcccagcaatttgggaggccgaagcaggactgcttgagctcaggagttcaagatcagcccaagcaacacagcaagatcctatctcaattaattaaaaaaaaatttttatcataaggatgggaatataatgtacagcacaagtgataatgaatgtgtttgttaatttaactgtggtaatcataaaatgtacatcaattcatcatgttgcacatactgaatatattcaagctttactcatcaattaaattttttttaaatgttttatagagagagaaacaatttaaggaaatttcagttcactttgtggttcaattggtactgggtattactgctataaaaacccaaatggcagggcagtcttcatgaccacaggctcataactttccacaatttgcaacctcctctattaacacattctgccatactagccagtaaaattttattttcagagacaaacagtatagttaaaaataaattaaaactgatgaggcaactaaaattatgaaacatagaagagaacaataaatcaactaaaagttgcatatttgtacctactgaggaacatataaaaatttaggaattgatacacttttaaatttttaatagataattcttaacaaaaatagggtatagaatactaacatctttagactattagtattcagaaacccatttgcgtattcttttcattaacattcacagacactagcaacatttcaactacagcaaactgcagatttgcttattgggcatatttattaaagctgaatttgagaaaggggactccctccgcccccaaattaagcccatcccacatcttcaacaatataaaaatccgtgttgacgggagaagggtatttattacttcaaattattgtggggcaaactattcttttgaagggcaatattttctttccttcatgctagaacacaggaaaaggaattacaaggcatataaagaaaatgcctttagaaagacttgcagaaggagggctgggcgcgggactcacacctgtaatcccaccactttgggaggctgaggcgggcggatcacgaggtcaggagatcaaaaccatcctggctaacacggtgaaaccccgtctctactaaaaaaaaaaaatacaaaaaaatagctgggcgtggtggcgcacacctgtagtcctagctactcaggaggctgaggcaggagaatggcgtgaacctgggaggcggggcttgcagtgagccaagatcgtgccactgcactccagcctgggtgacagagcgagactccatctcaaaaaaaaaagacttgcagaaggaaaccaaagtctaataaaagctgctaaaactgaaacacatcatcagagcagtgttaattcgttagaaagagcacagaaaaagcagtgatctgtgttctgatcttactgctgccacctctatttattatacattatctcaggtaagttacttttctgttcctaaattctcattcagcacaataatttgaatcttacacataattgtttagcaagcctatatcaaagcactggcattacaaaggtggtcagaacggcaagttttgagacatatataatcatctagaatgaaactgtcaaactatttttcaatgccaaccaaaatatgaatgagactttacacagaaacccaaatcaaatccataactgaggtggtcagatttgagtatgtaattttagctgggcataaggtatcactctatcattactttaacatgaggtaatagagcagactgattaatagcacaggctttgaaagcagagaggcaaggtcctaatccaagctctactccttacaccaactagatgagtttttgtaggctactgaacctctcacctctctaagcttcagctgccacatcaaaaaaacagagtcaatattagaaagcactccattgtgatgtctgaggtagtcagctaggaagttataattaatattatgaaacacttgatgtggacaaacaagtcattttatcaatagtaattcagatttggttcccttccttatttcttcttaatattcgaggggcaaaaccacattttggctgggcaaggtggctcatgcctgtaatcccagcactttgggaggccaaggcgggtggattacctgaaggtcaggagttcgagacaagcctggtcaacatggtgaaaccccatctctacttaaaatataaaaaattagccaggcatggtggcgggcgcctgtaatcccagctacacgggaggctgaggcagaagaatcgcttgatctcaggaggcggaggttgcagtgagccgagatcatgccgttgcactccagcctgggcaacaagagtgaaacttcgtctcaaaaaaaaaaaaaagttttcggctgggcacggtggctcatgcctataataatcccagcactttgggaggctgaggcaggtggatcacgaggtcaggcattcgagaccagcctggccaacatggtgaaaaccccctctctactaaaaatacaaaacattagccaggtgtggtggcgggcgcctgtaatcccagctactcgggaggctaaagcaggagaatcacttgaacctgggaggtagaggttgcagtgagtcaagattgtgccattgcactccagcccaggcgacactgtgagactccatttcaaaaaaaaaaaaaagtcagtataatacagtaattaagagtataggttcccaagccaagcacagtggctcacacctgtaatcccagcactttaggaagcctaagtgggcggactgcttgagcccaggagttcaaaaccagactgggcaacatggcaaaaccctgtttctactaaaaatacaaaaattagccaagcatggtggcacctgcttgtagtcctggctatgagggaggctaaggtgggaggaccacttcagcctgagagactgaggttgcagtgagcagagatcgcgccaccgcactctaacctgggcgacactgagaccttgtctcaaaaaaaaaagaaaagaaaaaaaagggtatatgttcctaaactagatgcctagcttcaaatctatcccttagtagtgaggtgaccttgggctaagccacttagctaagtgcctcagcatacaataacagttctgtcacaaggatgaggagtaagacggtgcacacaaaatgcttagaagagggcccagcacacattgccaaataaaggctattatttttactttacaacctgggaggcaattgttttttaaaaaaaaatgtttaagtctatatacaaatgggttaagtcataaaaaaaattcccacataaatagagcagatgccaatgtaattgtgtatatacgtggggaagaggggttcctttaaaatattttctcccttattcaatccagacatgaagtaatcatgttgaattccagcggcaagagaatcttaaatctttgtggggatgctccataataaaagtgtatcacgaccccttagtgtaccaagattgcaccagtattttgaggttaatttactttggtccaatttagagacataaaaaagattatgtcagcaggttaactaagattcttttgaccaacaccaaccctgataaatatgcatgtctatctatacgtagccagaaaaaaaaactcttgccttttctttttgctctgcttctctaattctgatcagtagtatggatcatctcagaggctaaaataagatgtttttatgtagcacctccatgccaaaaaggaaattaaactactaaattaccatccctttgttgagcaaacagaacagttttctggttgtcaaggcaacagctacctcacagttttccagcattgcttaaataattattttcctagccagtctacgaaatgtcctaagtggcacctaaaaaacactgaattccatgggaacactaaaaagcataagcaattttaaaattagctattagtggataataatccttcaagatgccaaaatgccaaggaagcacagaagtgcacaaatgaatcaacagtaatctctaatgtgtctctgggctgcagcacatcaaatacataaattaagttttagaaagacaatagttaaatcaaatcttcaaatggctggctaacacagacactgactaggaaatactcaattattcgagatggtttttaaaaagcaaaacatgctagatgacattttattgaggtagtttattttaaaaagtgagggattcaaattggttacagtgccaatgtagccagaagaatcagaaaacaagagtattaaatttgatcataaaaaccatcagtaggctgggtgcaatggctcacacctacaatcccagcactttgggagcccgaggtgtgtagattgtttgagctcaggagttcaagaccagcttgggtaacagggtgaaaccccgtctctaccagaaatacaaaaattagccaggcatagtggcatgcacgtatggtcccaactactaaggaggctgaggcgggaggatcgctagagctcaggaaatggaggctgcagtgagccatgactgcaacacggcactccagccgggttgacagagcaaggctctgtcaaaaaacaaaacaaaacaaaacaaaaaaccatcattaataaatgtacttaaacacaaaccacgtgacaataaatctatgaaaacagcctattttatatatagcaatcccaatgaactattaaaataatggagataattccaaaagatgaatgaacaaaatatacttgcatttatataccaaacagtgtaccatttaaaaaccaagcttaaaatgcacaatttggtgggagggaatataaaaaaaatgaatacatcgaggaaatgaagaaaaccatggccaggtgtggtggctcacgcctgtaatcccagcactctgggaggccgaggcgggtggatcacgaggtcaggagatggagaccatcctggctaacccggtgaaaccccgtctctactaaaaatataaaaaattagccgggtgtggtggcgggtgcctgtaggctaacaaggtgaaaccccgtctctactaaaaatacaaaaaagtagccgggcatggtggtgggcacctgtaggcccagctactcgggaggctgaggcaggagaatggcatgaacctgggaggcggagcttgcagtgagccgagatcgagtcactgcactccaacctgagtgacgtgagactacgtctcaaaaaaaaaaagaaaagaaaagaaaagaaaaccatgcaatataacttcaaaatattctctggggccatttcttctctcctttttcatgtggcactaaggacatggatttgtgaaggggtaagggttgaataggcacaaggacagaagctgaatatacaaggcagtgaagaggaggcctgggggaaccacatggaggtgcagtcctgtggcggaggacatggatgagagctgaatagggacagaggagataagctgcaaggctggaagatccattacccggaccaaataagtaaatggactaatcaaataagtaaatacactgaatatagtgggggccatgtttttcactccaaagaagttaaaatggaaggaagggagcagactacagagaagtctaaatattggactggaattggaaatttggtttgaattcatgattgtataatatatatatatgtgtatatatacatacacacacacacacacacagaaaaataaacaagtacttctaggtgtgcgtgtgtgtccctatattttcctagctctgtccaaaaagaaagtactaagagcaaccaaaagacagcccagtaacaacaacaacaaacagcaatagcctacatcttgatttatttatttatttttaattgagatggagtcttgctctgttgcccaggctggagtgcaatggtgtgatatcggctcactgtaacctctgcctcccaggttcaagcaattctcctgccccagcctcccaagtagctgggattacaggcgctcgccaccatgtccagctaattagtagagacgggatttcaccatgttggtcaggctggtctcaaactcccgacttcgtgatccacccgcctcggcccacgtcttgatttctaaataactctctccattataaggaattaggatccttagaaaaatggttgatttcaaggttggacagagaaaagcacaagaagaatctgaaacatcttgtgtcagaaagtaaagaaatggtgcgattaatgatagggacatttcaaacagacacaggaagcatcttgaaggggttttcctcttactggtcaaatgggggaaagtttgagcattaaaataaatattatttgtgctattatctccttagggatatatatgtatgtcaaactgatcaacttaagatctgtgtattccacagtaaattaattatatctcactttaaaaagttggtaacaaattacaatgcattcagtaaaaatgaaatccgtgagtccatattgacaagaatgaatgaatgaatgttttaaaatgtagaaaagataaagcttttccttatactaaaatgttaataactgtaacagaactgacagagaatcagcgtttggcaaccatcataaaggtggctgattcagagagctatcaaaagatgctaagctgacaggtggtttgatgaacagaatattcacatcatctttgaatactactgaattatttttagtggtgtaattgtgcaacgttttgcactgtaatatcaaaagagcaactttctgtggtatatctgccaagagtaactggaaatgagaaaaagtagacagaccgaagttgaagttattctgttctatttatcaggaattacacactggagtacaatgggtgacagaacattgtgttttaagcttgctcttaaaaagtttgaacgtaatgataatgagtacatacatatgtacacatatatgtatacaatatatatgtgtatatatacacacatatatatacacacacatacaaatctgtgtatatatctctctctgtgtatacacacacacagagaaaaagataaattagatatagagcaaatgacatcgaatgttaacaactggccagtctggtgaaggagattacatgaactatttatacagcaaatttggaattatttgaaaataaattattttgtaaagtaatatatatttattgggcatttgcatatttttctattaattatctatttatattatttacccatctttctgaattgctcatttttgtttttgttttttgtttgtctgttttttttgctggattgtaagagttactgcatattttaaaactcaacgccagccgggcgcggtgcctcacgcctgtaatccaagcattttgggaggccgaggcggacagatcacaaggtcaggagatcgagaccatcttggctaacacggtgaaaccccgtctctactaaacatacaaaaaattagccgggcgtcatgacaggcgcctgtagtcccagccactcaggaggctgaggcaggagaatggtgtgaacccaggaggtggtgcttgcagtgagccgagatcatgccactggactccagcccgggcgacagagagagactccgtctcaaaaaaacaaaaaacaaaacaaaacaaaaaaactcaaccccttcccaaaacacgaaaatctttggatgttatctatatttcttaatattcttcttacaattttttaaagtttatttttggttttttacatggccccactgtgtatcttcttaaaatttaagctactttaggagacaaaacctaagctactttaggttataagtaaattttagatccacatctcataaaccagagggatatctgcatagtcacaaatattaacagaagagtatctgcatattcctggaaatttaagtaactccaaagaaatattctaactagaattttctgcctcggcaaacaggcaagagagaaattgggagagacattattaaaagccaactatacttaaggcactgttctaagtatcaaaaaagcaaaggagctttctcatgtaacacagccaatctactctgccttgagaagaggttatttgtcatcttgctagtgaggtcacaatcatattcaaatgcaaatgaatcttctttggagtaacagcactctcagaacataaactttcatgatctggaaattagaggagcctagtggaggattcaggcagttcaaaattcagaatacaaacagaaacagaaactggcattgttatggtttaatgtatctgggcatgttagtaataactactggcatggattagaaggcaataagtagaacattttttagtataacaagtcactaaagacagcatctggagaacatttaaaagagtttgatttaaaaaaaaaaatccttaaaatccctactgggccagtcctgtaatcccagcacttcgggagaccaaggcaggaggatcacttgagcccaggagtttgagacgagcctgggcaacatagcgagacttcatctctacaaataattttgaaaaataagccagaagaggtggtgaacacttatggtcccagctactaaggaggctgaggtgggagaactgcttgagcccaggaggttgtggccgcagtgactatatcactgcactccagcctggatgaccaagctaaaaaaatgataggtcggatgccatggctcacacctgtaatcacaacactttgggaggctgagacaggcggatcatctgcagtcaggagttcgagtccagcctggccaacatggtgaaacccagtctctactaaaaatacaaaaattagccaggcatggtggtaggcacctgtaatcccagctacttgggaggctgaggcaggagtatcacttggactcgggaggcggagattgcagtgagccgagtttgcaccactgcactccagcctgggcaacaaaagtgaaactctgtttcaaaaaaataaaataaaataaataataataataatccagccaggcacggtggctcacacctgtaatcccaacactttgggaggccaaggtgggcagatcacctgaggtaaggagtttgagaccagcctgaccaacatagtgaaaccctgtctctaataaaaataaaaaaaattagctggccatggtggcaggcacctgtaatgccagctactcacgggttgagtcacgagaatcacttaaacccaggaggtggaggttgcagtgagccgagatcacgccactgcactccaacctgggcaacagagcgagactccatctcaaaaagtaataataataataaataataataataatccccaccaaccaagtttttaatcgtgtttcatatcctcaagaatatgattttgaaagacgtcatcaacaagaaacatcaatctttaatcacttgaaaacctatcaattacttgtctagtgaccaaaagaaacggacccacacaacatgtattaaacactaagtcacaaaattcattctagattcagaatattactgtagtaagccctttggtaacttatgctaaatactcattgatgtaacactatatactgactttccttttcccaaatataccaacattttgcaaaagtgaccattttataccatattttaatgattcctatctgtcctctagactgagctacttaagatagaaatagtgtcttattcacctatgaatgccctggtcctagaatagcacctacatatagaagaaattcatgagataattgttaacacaaaaaagattagacattagttaagccctgctaaatgagattcctcttaagttgaatattatttatatttcaaaaataccttataatcagaagcgtcttatataaacaggtgaaaaagcatgagctatggaatcaatatctgagatcaaactttaggttcataacttactagatccatcatccttgggaaaaattatttaacttatctgagcatagcttcacatttgtaaagtgtagtttatcatactaataaaacatatgttcacttttatattatacatttattacatattataattaaatataaattacatattaaatacatacaataccaatgtggcctattacacataaaatcacatgtaataagcactcaatataaataaatgtctatattaatttattattaccattctttttaaagaagattttgtacttaacaatcagatcacgtagaaattagtgacagaagcagttcaagaataggtatgagcagctaagcagctaagcttatgagtacaggactacagagaagaatgataggggcattggtagcaaatatccacaagtggcaattttgtttgggtaagccaggtgattttccagatactctggagaaatgttttctgaaatctcaagttcctggcagttatatttacaggctagagtgcagtggcgcaatcttggctcactgcaacctctgcctcccaggttcaagtgattctcctgcctcagccttccaagtagctgggactacaggcgtgcaccaccccacccagctaatttcatgtgtgtgtatttttatagagacgagttttcaccatgttggccaggctggtctcgaactcctgacctcagatgatccgccagccttggcctcccaaagtgctaggactacaagcatgagccaccgcactcagcctacacagctgttcttaaacttaaaaaaagtaaattatctctcctttacagagatgatggtttatttttatgttactgaaattcatacaaacataaagttaccatatttcatctaatttaagtcactaattgtaaaccacacctaccactaaaaaagaaaaaagctgccaattaaactacgatataccatcaattgactgctaaatgcatcctgatttcagagatgttaaaatgtagaaaatgtatacttgtacctgataaaatgtagtcatatagtagctaagaattatttattcttacggaactgtacaagtataaaaccaaatctgcaaactaaattccacaaaccaacaaaatcaatgaaattcaagtaagaacattaattcaatatgatggatgatattctgctacaactacacactcaaaacacaaatatggcacagactactttggactagcatgcttttaatattgagcacagtgtaacgaatcaattctcccaccacttttccctatgtaaactagtacaaaacctttgctggagagatcaatgttgcctcatgatgtaggaacatatcacttactgtgaactccatctccgttgttttataatcaaacctgcaacaagcgaagtaatactactcactatgaacgctggttgtaaaacataaaaagtaattgcagaaactgaaattatactagtttggtgcaaaactaattgtggtctttgccattaaaagtaattgcatgccaggcacagtggctcacacctgtaatcccagcactttgggaggccaaggcaggtggatcacctgagctcaagagttcaagaccactctgggcaacatggtgaaatacaaaaaagctactaaaatacaaaaaaaaaaaattagctgggcgtggtggtggcttgggaggctacttgggaggttgaggcagagagaatcacttgagcccgggaggtggaggttgcagtgagctgagattacaccactgcactccagcctgggtgacagtgagactccgactcaaaaataataaataaataaataaaaataaaagtaattgcaaaaccacaattacttttgcaccaacctaatagttctctgctatccagatgtacaaatgacccagaaaatgtttatattaaatctttttagctctctgtatgaaatgaaatggaagaaactcaagataaaacaataataaagtatataccttttgaatttagtgtcatttgcatgtattacttgataaaaataatcaattaaaaatgtaattttttattctacacagagaacttgcaaactaggccaaagagaatttcggagaagtccagtttgatatacactcacatagaggtaaaaggatatagaagaataaggccataatttgtgtaaagaatatctcaactcagctatggctacgatctgcaacctattagttgactgatttttactccctgattctcagtttctccacttctaaaaagagggtaaataataccttctgccttaaaaacactctatatataaatgttaagtctgctgcagacttatctttgaattatgattatcatgtgctaaatcaaatgcatactaaaaacaggcacaatggtaagagtaggaaaatccaacactaggcctaattttgtgtgtgtgtgtgtgtgtgtgtgtgtgtgcacgcgcgcagaccgctctgcctattcaatgactatgcacatatgagggacccaacaaatcatattttaataagtaaaataaggacaaactatcttacagatgaccaaatttttacgacaaagaagcccacacagctttacaaagactaagtcactaacatgacaagtatcaattacaagttatttctcttaacaaagagatatgttctggcaatatgctttgccaacaagtaattcattagactgctagccacctgatccaaactgggccgatcggttttactctgctatgaagttaaagctaggttaaccaattagccggtagagaaaggatgtgatgcagcctatggtagccattttctggcatgcacagggagaagtagagaaaaccagtctgctgagaggaagtaagaaataaaacagatgcagagggggaaaaagtgcacataagaaactgtgggttctctgagtgactgagagaatagctagccttagttcctgctagctttccaactgcctcctcaagccaaactggagttcccctctttgggtaccatgagatgctctgtacccttataatagattctcttttctgcttttcatcacctgaaatgggttctattacccataaccaaaatagctttaattaaacccatcagatgcctattatcaaaatagaaataatatcaaatacagttacaattccacaaacattaattgagcacccacaatgccctgggatattcagaacttagatcacatctagacaaatattaaaccaattccagtttacatttttaagctaaactgtcaaaatatacaaaaatcctgggctgggcacagtggctcacgcctgtaatcccaacacgctggaaggccaaggtgggaggactgcttgagcccaggagttcaagaccagccgggacaacacggcaaaacctcatctctacaaaatatcaaaaacttagccaggcgtggtagcacacacctgtggctcctagctagtgagggggctgaggcagaaggatcacttgagcctggggagtagaggctgcagcaagctgtgatcacaccattgcactccagcctaggtgacagacagagactttcaaaaaaagaaaaaaaatcttgaccagtaagaaataatgaaatgtgaacatacgaagcaaaaaaaaaaaaaaaaagattttttttttgaaaagctatttgaggtcatcagatcattattataacattagtagcattagcaaactaacgctaattagtagcattagcaaacattagtaagatataacctctggctatcaatttttaaaaatcagcttttaagcccttaccagatgcgtctggccctacaatcttattaaaaatatatttacactttttaaaaaacaatagtttacatcttcaacagactcttacatttctactcatatttttcaaagttataaacttcttatcaaataaaaagaaaaaataaagcaagaatactaattgtcatggtggtgcacatctgtagtcctagctacttgtgaggctgaggcagtaggattgcttgagcccagaagttcaaggctgtattgagctatgatcacaccactgcactccagtctgggagacacagcaagaccctgtctctttaaaaaaggaaagaaagaaattacaagttatttctcttaaaaaagagatgttggccaggcgcggtggctcatgcctataatcccagcactttgggaggccgaagcaggggggatcacctgaagtcaggagtttgagaccagcctggccaacatggtgaaacctcatctctactaaaaatacaaaaaattagctgggagtggtagcgggtgcctgtaatcccagctactcgggaggctgaggcaggagaatcgcttgaacccgggaggtggagattgcagtgagtcgagattgtgcactgcaatcaagcctaggtgatggagcaaaacaccatctccgaaaaaaaaaaaaaaaagatatgttctggcaatatgcttttgccaagaaaaaccctgagcaacaaaggaagacatggctctataaaaaataaaaaaattatctgggctcagtggcacacgcctatggtcccaaccattcagggggctgaggtgagaagatcacttgagctcaggaggccaaaggtgcaacaagacatgatcgtgccactgcacttcagtttgggtggcagagagagactctctctctaaaatttaaaaaagattttagaggctgggtgcagtgtaatcccagcactatgggaggctgagaagggtagatcacctgaggtcagaagttcaagaccagcctgaccaacatagtgaaacccggtctctactaaaaatacaaaattagcctggcatggtggcgcacgcctgtaatcccagctactcgggaggctgaggcaggagaatggcgtgaacccgggaggcggagcttgcagtgagccgagatcccgccactgcactccagcctgggcgacagcgagactccgtctcaaaaaaaaaaaaaaataataataataatgtaaatgagaccatttttaatgccttatattgtgtgtgtgtgtgtgtgtgtgtgtgtgtgtgtgtgtgtgtgtgtgtttcattggttttgttttacatttttctcctgatgaccttgcccagcatctttcaggattttaatggtggcactaaatggcttttcttggccattccttccatactacctcacactaaatggagattctattagttgctgaggatatctattccaactattcacttaggaccataagaaacaatttcaagatgagtgtaaggaaacatatttaagtcaaaactctatcaaaatgctatttcctgactctccatatgcacctactcttactggtaggtcacagtggtattcttttgagtcaccagtaattaatggttaagtcagagccaaaatcagattttaaaacctgagtattattcccctatcccactgcacagctatttaagtaaatgtacacacacaaagtatcattagcaaaggcaagtagaaagggccatgctacatacaggggtatgtaacaggccttccaggatactcggtcttgccttctttcaatggcctctcagaactaaacagactcaatttcaaagcattcaatagaatagtttatattagattatcatcagacctggagttttaaaaaactataccaatcaaataagttactaggttacttatctacctagggatctcaatgcacatgcaaacattttcagaatttcattatcaaacatgccctcctacctaaatgtgttaaccatgcccacctagcctccgttctgctggaattttctgatccccactgagatcatgaaaaacatttcatggcatcccctcctataagcattcccagtgggacagaaaagccaataaatcccttaaaatagtctagcatttcccttgccaatccattttccctaagaaaatggtgaagagagaatctactagactgtgattacccaagggagatgataaattccaggtgatatgaggaagattaactgagcacacacaaaaaatagtgaactgttaatttacttatcttaaaaacagataagaaataaactttactagtaagtatttcttatgttgatctacaaaagcaacacaccttgtgaacacacacattctgagggaaaagtggcagctgcacaacacagcagggttgacaatgaagtcttcaattgtcctaccacttttggcacactgtatttggtattcctgtacatgggaattttacagattacatttttcttgtttacataagtttgtggattgtattataaactagaaaagtggttcccaaagtatgctcccaggaccaacaccatcagcaacatctgaaaatttgtttttttgagacagggtctcactcactctgtcacccaggctggaaatcctaactcactgcagcctccacctcccaggctgaagtggtccacccacctcagcctcccaaagtgctgggattacagcaaagtgcatacagcgccaagccaacacctggaaatttgttagaaatgcaaattcccaggcaccgctccagacattccgaattagaaactctccgggagggaaacagcattttgtgtcttaacaagccctccaggacactctgatgcaccccccacccccggcaagactgagaaacactgacccagaggttattcctctaggtcttaagtagatatttgtaatagatatgctcagaaactaacagaatctccatttagtttcctgaaccacgtagtatgaggtattctggtaggaatcaaaatctgaaagccattttggaaatttcagaagtcattaaagacctgaaagatatcaggatagtgataatgaaaacaatgtaacatacacacaaaataaaatacggccataaaggcagaccaatttaaaataatacattatttaaaaattgagaggactctagcaaagaaatcagcaattgagataaaataatcaacgcaaacaactaaagaattagtaaataaaaagctaatcttctatgcagaaaaaagttaacagcagacctgagatggctttccttagaaagggctgcttgcaaagctggcccttggctaagaactcacaggaacctggatttagggagggttcctaccaccaactggtaagagtgggtggttgtgtctaaaacaatatggcttaagctttcattatcagagtctagaatttgatatatgccagacatgcagtacctatgtgaacagctcccactaaaaaccctggatgctgagttttaaggagcttcccgggttgtaacatttcatgttgtcacaattcttggttaggggaattatgtgtgtcttgtgtaactctaccgggagaaatttgcacctggtttcctccagactttacccaatgtatcttttccttttgctgataatgcttcctatcctcttgtaataaatcgcagccgtaaacatgactaatacaatacactgagtcctgtgagcgcaccttgtgaattaccaaatctaacactggtgctggaaatatccaacacattctcttaattctattatgagctctttgacagtcatataatgataaaaacactgacagtaacttcaagtctaaaacatttgtattactcttactccacccattaataaaataaaacattttaatattattttatttccattgtcttattctttttaacatatccagtaaccttatttgaatcacatgcttagttcttgtacagtaaagaacaggacaccttcactgacaatccaagggaaattggtatgttgttaacaaacaaggtggaatacatactgggcaggctctaacaagagacgatcactaaaatcaggctatttgacaaacaaaattgacttaaagaatattggggaagcatcgcaaagaaatagtcatgatctcccacaactcaggtcctgagcagctcactgggttcctgcctctccgctcctcgccacgcaaacggctcctgccagaacccaagatggcagcttcaggtgggcaggtggccaggatcgccgaaagcacaccagtgcccaggcgaagaacagccaggggcccctccttgctcggtgcctaacagcaggggcgcagggtggggctgccatcagccacgcgcagagcccacttggttatggcaaggaaaaccctgtgacctagggagtcgccaggcttccagtcctgctggcgggaaggactggcaaggcagtggggataaaggtgcaagcaaagaaaccatggtttcggaaggataatgtacagagaggccttgtgttgacccgagcacgttttttgaaagaaattcttaatattgggtgagcgctaattctcagttcaaaaattaaatcatatgtataaaaacgaaaaaaaaagagtcctgagtaacttctgattattattttacatattaaaagataacagaaaaaaaaaagcggtttcaaatgtgagtcctaagtaaacactcaccaactctacagcttacaagcttgccatcaaggtggcttctcaccaggacaactctatacagcatgctttaaagtgagcaggagggttgggtgcgatggctcagcctataatctcagcactttgggaggccaaggcgggtggatcacttgagcccagttcaaaaccagcctgggcaacatagggaaactgcctctgttaaaaacaaaaataaaggccgggcacagtggctcatacctgtaatctcagcactttgggaggctgaggcgggtggctcacctgaggtaaggagttcaagactagcctggccaacgtggtgaaaccctgtctctactaaaaatgcaaaaatcagctgggcgtggtggtgcatgcttgtagtcccagctacacgggaggctgaggcacaagaatcgattgaacccaagaggcagaggttgcagtgagccaagatcatgccactgcactccagcctgggcaacagagcgacattccgtctcaaaaaaacagctgagcgtggtagcccatgcctgtggccccagctactcgtggtggaggctgaggtagaaggatcatttgagcccaggagatcaagcctgcagtgagttgttatcatgcctctgcactccagcctgagtgacagaccaacagcctgcctcagaaaaacaaaaacaaaaacaaaaaacaaagggagcaggagttatttatttaacagtggtaagaggtactctcatgcaattcttagggaggctggtgaatgtatttttaaaaacctgttctttatacaattcagaagaccaataagaaatgctgaaaaaatcagaaatacaaaaattaaaagaaattatcacattacttatattagatatcaacattataaataagggaatacttttcagatacaaaatgatctctaaaactttcctattttgggtaaaatactagcctaggaacatacatcatgaatatacaccatgattcagaaggggactctgctatgaaataaaaacagtgaaatactagaatatagtggcatatttgaaggaattgaaaatcatcaaaaacacaatcactcctaaagcatataatctaacaatgtcttcagggagtcctggttaacctagtatcacttgctcatcccttagccctgtgatacttatgaaaactgtttacagttttgtttaattatatcctcaggattcaaagtttttacatggtctcagaaacccaagatctacttgagaaatgcattgattttattcctcagcgctgtctctaacttacaaaaagtaatatttgctgctcaaggctacttcacaggatataatcaacgcaaagcaaccttctttttggtaggctttgggataacagtcaatgcaaatttagtgaatgcgaaaattagttgtatgagtgtgtcaaacttttggaagcacaagtaggtaaaccaaggtgccatggacaatgggtgaaaactattataaatatggaaaattttaacctggaaaccataacactgtttctgtggatttctgaagaccctacaagaattttcagagatgatatatctacacaataaagcctgtactttcgacagacccaaaaaagtttaagaactcctattgtaccctgaattttcagaaaaattagagaaagagaaaacaggaatacttaaagacaaccaaatttaaccagacatggaaatatttacattacatactatttaattttatttatttatttatttatttttttgagacggagtctctgtcacccaggctggagtgcagtggcacgatctcggctcactgcaacctccgcctaccgggttcacgccattctcctgcctcagcctcccgagtagttgggactacaggcgcctgccaccacacctggctaattttttgtatttttagtagagacggggtttcaccgtgttagccaggatggtctcgactcctattgtgatccacctgccttggcctcccaaagtgctgggattacaggcgtgagccaccgcacctggccgatactacttcattttataacaaaataagaagttttatgtatcttttaaaacacattcattttcatcacaaaaacaattatgtagataaataaaaaagtattattacccactggtataaaagagcaaagagaggtggagctttaagtgattttaaggacataattcactagaggcaggaaaaagagcttaaatccagatgtcataccataactgccttatcaggtagtaacaacttaacaccctcttaaaaaaacctatctgtaaccaacataaacttacctactaattcagaagctaatgtttaaaatgttgaaaaaagatgattacaaactatgttttaagaaatacacaggtaaagatttgaaagtatatactaaaatgttaatagtagttacctctgtaacgtctgaattacgagtgatctttttcctacctgattttctggattttccatactttctaccatgagttttttaataaccagaaaatgttaaaatcaaataaaatgctttatgttcattattaaattataaaattattaatattaagtactattatttaacatttacttaagacagtcaattttaagatttcttgctgatacttttaagaaaaagttaacttagaccctaaagaaaatgaaaccaatcctttatttacttatttattgagacagtctcgctctccaagacagtcttgctccagctggagtgcaatggtgcaatcgcggctcactgcaacctccgcctcccagttcaagcgattctcatgcctcagcctcccgagtagctgggattacagacatgcgccaccacaccctgctaattttttttttattttagtagagacggggtttcgatatgttggccagactggtctcaaactcccggcctcaagtgatccgcctgcctcggcctcccaaagtgttaggattacaggtctgaaccaccacgcccagcctcattctacatttaaaacaaatcaacattaattcttcaaggccaggccggcacagtggctcacgcctgtaatcccaccactttggaaggcctagacaggcagatcactgaaggtcggagttcgacaccagcctggccaacatgtgaaaccccatctctactaaacatacaaaaattagctggacgtggtggcaggcacctgtaatctcagctattcgggaggctgaggcagaagaatcgcttgaacctgggaggcagatgctgcagtgagccaagattatgccactgcactccagcctcagcgacagagcgagactccgtctctgggggaaaaaaaattcttcaaggcctaaattatctgctctccaagtatcctataaaattgatgatgcaatgtgatgaattgatcagagaaatttaattacatatacttcactagctttttctattacaagtgatctttaaaaccataatgtgattatgacctagtatttcaaataaaaattgctgggcacagtggctcatggctataatcccagctacttggaaagctaacgtgagaggatcccttgggcccatgagttccagaacagcctatgcaacataacaagataccatctctaaaattaaaatttggaattattcccaactcattctacaaagccagcattattctgatatataatgacattatgagaaaataaaactagaggctggacatggtggctcatgcctataatcccaacactttgggaggctgagaggagaggactgcttgaggccaggagctcaagaccagcctgggcaacatagcaaaaccacatctctacagaccaatatccctcatgagcaaaaatgcaaacaatatatatatattttttttttggagacagggtcttgttctatcacccaggctgcagttcagtggtgccatcttggctcactgcaacctccaactcctgaagtcaagtgatcctcccacctcagcctcccaagcctcccaagtagctgggacctacaggtgcagaccaccaaacccagctgactttttttaaaatttattttctgcagagacagggttttgtcatgttgcctaggctagtcttagactcctggacttaagccaacccaaagtgctgggattagaggtgtgagccatcacgcccagcccaaaaattctaaataaaattctagcatgtagaatccaacaatatgttctaaaaggtaatatatcatgaccaagtgcatttattgtagaaatggaggattgttctaaaattcagaagtcaatgagtgtaattaacgtatcaacaaactttaaaaacagattacctcaatatatccagaaaatgcattttattaatacaaaatccataagccactcctgatgtaatctctcagcaaactaggaacagaatgaaacttcctcaatcggacaaaaggcatccatgaaaaatctgcaactaacattatacttaacggtgaaagactgaatgcttttccctacaattaagaacaagacagggatatccacctcaccacttctattctgcattgttttggagagccaatgcaatcaagaaagaaaagatatttgaattggacatgaagaatagtagctgcctttactgacaacatgatccgctaccaaggaaatccaaaggaatctacaaaaatcctgctgtaaccaataggtggttttagcaagatcacaggatacacaatatagagaagtcaataggattcctatacattagcaacaatcagaaattgaatttttaaaataccattaacaacagaataaaaaattactaaatatttagagatctggcagagagttctcattctgagagttctaactagtaaatcaggattccttacacaagtgtttttcaaactgagccacaacctattaattactaggtagggaaagaacaagagaaaaaaatgatatgagagaaaaaatgactgagttaacgctcattcacacatttgtttctggcttttgggttttgttttgttttgttttgagatagggtctccctctgttattcaagctgagctctgtggctcactgcagccttgacttcctgggctcaagcaattagcctgtttcagcctcccaagtagctagaactacaggcatgtaccacaatgcccagctaatttttgataatttgtagagacagggtctcactatgttacccaggctggtctcaaactcctggactcaagtgatcctcccaccttggcctcccaaagtgctgggattacaggcatgagccatcgcacccaggcttattcatacatttaaactaaagcctataatgtatcaggtgctggttaggaaccagagacttgatttaaaactcagtctttgttttcatggagtgtagtggaggaatctgttaaacagttaagttaccatatgaagttaactactatggtcagattctgcacaagaggagcacgaagaaggacgtaaatctatcttaggatctcagagaaggatacctgaaggatgactggtaatctagtaaaagaattctgatgggttgaaatgagaaacaatatagattctggagaagagctatagtgcatgaggaaagtagacaatatagaaagctgcaattattaatgaccatagccagagttctggagaagcaaggcctgatagcaacaggagaagaactactacaaagttttatgagcaagagttacattatctgatgtcttagatcactgtggctgcaatgtgaaaaacagataccaatgtacaaatacaaggctgaatcagacagatcagttaggaatctgctaccataatctagaatgagatacaatggcttgcactaatgctgggatggagagagaagaactgggtaaagacattctcacatttagtgactaactgaataaagggattaaaaattttaccttttggccaggcactgtggctcacgcctgtaatcccagcactttgggagggtgaggtgggtgaatcatttgaggtcaggagttagagaccagcctggctaacacggtgaaaccctgtctctactaaaaatgcaaaattagccgggcgtggtggcaggtgcctgtagtcccagacactcaggaggctgagggaggagaattgcttgaacccaagaggcggaggctggagtgagccaagatcgtgccactgcactccagcctggacgacagagtaagactctgtctcagaaaaaataaattttttttttttaccttttttctcctcactgctgacttctatttcagaagagcagatctgatcccagactactaaacaaagaaaagagaactagagagacacccaaactgcaggggaggttgtagtaacaaagcagaagacaaaaggaaattccaggtgaggctacagggcaagaacagtctcattgtgtgttctgtcttgaatgtaccagaaactaccagtgttcatgatggtatatgagaaagaatctacttatttttatttttctacttgccctaaagtaataaacatgcatcacatcaagcaaattaatgcctaattatcagcaaattagtaaactatttctgttgacacctttattctctacccagtaattcaaccggcagctactattttcactaagtactgttaaataagcttgacaaaatgagatactcttacatgaattcctggtcctaaagaatttagtcctttcttcagcatacaaattaatgcatgaattcatttgctttataaaactataaaaatacagaagtatacaaaaagcaaatgtctccttttatcttctctgttcccacatccctcggggacataactactgtctccttatttagggtatttttccagtcttactctgcctttacagggacctatgtacaaaacaatgtattttttccaaataaattttaaattggcctttagttgtacagtctatgagcatattatccttgtaaaaataataaaacattaatgtggctgggcgcagtggctcatgcctgtaatcccagcactttgggaggccaaggcgggtggatcacctgaagtcaggaatttctcaagaccaggctggccaacatggcgaaaccccttctctattaaagaaatataaaaattagccaggcgtggtggtgggcacctgtagtcacagctactcaggaggctgaggcagaactgcttgaactcaggagacggagattgcagtaagctgagattgcaccactgcactccagcctgaaaaacagagtgagactccatttcaaaaaaaaaaaagtaagtcctaaattactacactcaattcccattaataatcactattctcattttggcatatgttcttccaggttttttccagaccttcacttacatacacgtacatgtatccatatttaataacatttctgtgaatctatttttacataactggtactacatttaatatactgtctttcaacttttctttcattcaaaaaatgttttagagatctttctacatcagtaaacacaaactgtcgaattaattttgtgctataaccattgtaggaatttgccatggttatttagcttgtcctctactggtgatattaagtggttttctgtttttccctattaaagagggcagccacaaacatattcatgccagcttccttgtgcacctgtacatgggctgcttctgggtaggtatcaaaagggagcacaaagaacatgaacattttttattttaagacataacccaaattctcccaaggaatttctgaagtataattctggtgccttaaaggccaacacataatgaaaaaagaagactcttagttacagttaagtgttctattttcaaccaaaacttttctaatcctagaggagtttaacaatctggcatcttgaacagaaatcaccattaatttctgcaccagttattagcaatgcaatatcttaacagtcttgaaagatccatttattcaacaataattaccaaaattaaaaacacacaaccctggccccaggaataaatggccaaattcatccaatagctatacttgcacatgtgtgagataacatatattcaaagttattcatcacagatgcaagtcagtaggtctggccaaaagtccagctaaattcaaagtgacataataaattatgatcctggaagggaattcaatgtatgacttacttcaaacagtaaattaactcaaagtttgggagctataaaatattgataaatttaaccattaaaaaattgctcaatggcaaaaaaatacacaaagcaaatatatcaaaatataaatgacaaactctacaaaaagttatttataattcacatcactaaagagcttgactctcatacataaagaacatctaaaatcagtaattttttttagagaccaaccattcaggccaggcaaagtggttcactcctatagtcccaacactgggaggccgaggtaggtgaggtgcttgagcccaggagttcgagaccagcctggacaacatagtgaggccttatctctattaaaaaatttaaaaattagccagcatggtagcatgtgcctgtagccccaggtactcaggaggttgaggtgggaggatcacttgagcctgggaggttcaaggctgcagtaagccgttattggaccactgcactccagcctgggggacaggaaggagattctgcctcaaaaaaaaaaaaaaaagccaaccattcaacagaaaaatgggcatatgacataaaaggatatttcatataaaaagaattacaatggactcaacacttgaaaagatgctcatactcattcataaattcgatgtaaaacctactaaataaaaacaattcaaaacacaatttttcgcacgcatccatagtttcaactacttgggaggctgaggcagaagaactgcttgaacctgggagacagaggttgcagtgtgcccctatcatgccactacactccctccagcctggacgatatagtgagactctatctctaaaaaaaaaaaacccacaccatttttcactatcagattggcaaaaattcagaaattcagaagtctagtaatgtacacggcaggtaagttatgggaaaatgttagccttcatattgctgctgagaatgtaaatctgtataacctgaacgggaaacgattatagaaataaaaaatgcaggccgggcagatcacttgaggtcaggagttcaagaccaacttggccaacatggtgacacctgtctccactaaaaatacaaaacttagcggggcatggtggtgcatgcctgtaatcccagctactccagaggctgaggcaggagaactgcttgaaccagggaggcagaggttgcagtgagccaagatgacgccaacctggacgacagaatgagattccatcaccaaaaaaaaaaaaaagcacatgtgctttaatcagtaaccctactcttaggaattaatcctacagatactcttacagatgtatgaaataatatatgtacaaagttacctcatctcagacctgtttgtaaaagcaaaaggtcaaaaacaacctaaatgtccaaaaataggggtgtggctaaataaattatgttacatcgtaaatcttatacatctgtcctatacagaactgcaaaaacaattgaggaaactggttgtttgcagctggacatgggcatgaaagaccagagacggggagacaactttttaaggattacaaaaatattcttaaactggactgtggtgatgggtgaacaaccctagacatttacaaaaattccataacagccaggtgtggaggcttacgcctgtaatcccagagcttcaggaggccaagtggcagtatctcttgagaggaggtgttcaagaacagcctaggcaacatagtgctaccgtgtctgtacaaacaaatttgttttaattagctgggcatggtagcacacacctgcagtcccacctgttcaggaggctgaggttggaagattgcttgagcccaggagtttgaggttaacactgaactatgatagtgctactgcactcctgcctgtgtgacagagtaacaatttgtttctaaaagaagaaaataggccaggcgtggtggctcacgcctataattccagcactttgggatgcggaggtgggcagatcaccaggtcaggagatcaagaccaccctggctaacacgttgaaaccccgtctctactaaaaataaaaaaaattaaaaataaattagctgggcatggtggcgggtgcctgtagtcccagctacctcggaaggatgaggcaggagaatggcgtgaacttgggaggcagaggttgcggtgagctgagatcgcaccactgcactccagcctgggcaacagagcaagactctgtctcaaaaaaataataaataaataaataaataaaataaatttttaattaaaaatgaatctaaaattccttgatttttacacttagaatggtttaatttttttggtgtgcaagttatacctcaataaaagttgttaataagaacacacaaggctaggcgtggtggctcatacctgttaattccagcactttgggaggccgaggtgggcagatcacttgaggccaggaatttgagactggcctggccaacgtggccaaaccccgtctctactaaaaaatacaaaaaatactaaaaaatagcccgggtgacatagcaagactgtcttaaaaaaacaaaaacaaaacaaacaaaaaaacacccacaaatgaggggatctctatgtaataataacacaaacatctcccagatgtgttaagtgacaaaatttaaaagtgcagaacagtgtgtgtaatttacaagctgaaagtaaagggtaggagagatagggaagtaagacggcaaacttgtgtttgcctttctacgtgtggaaacaatacacaaaaacaatgactgtacagaaagaagggaaatttaacaattggaggtaaaaggtaggatgaaagggtttttactatattcttttataagtattttttaaaacttttcagccatatgtttgaatattcaaaaaattaaactaggatatttggactttaataatacagatacaacttataatgtaagttgtttgcttcttcatttcgttacatattatatttcatatgattttgcaatcatcctgattgtccccaagagtctgcctttgtgaagaattgtgcctacagaaactttgcatcctcaatattctggggacagttccagtttcaaatattcaattccaatgttactgatttacaaattaataaaggctcttagaaattccaagttttggctgggtgcagtggctcacgcctgtaatcccagcactttgggaggccaaggcaggtggatcatttgaggtcaggtgttcaagaacagcctgtccaacatggtgaaaccccatctctactaaaaatacaacaaaagtagccagttgtggtggctcatgcctgtaatcccagctacttgggaggctgaggcaggaggaacgcttgaacccgggaggcagaggctgcagtgagttgagatcatgccactgcactccagcctgagggacagggtgagactgtgtctcaaaaaaaaaaaaaaaaattccaaattttccatctacagtgataggaaaaggaacccctaaaaaatctttttttcaatcacatgaccaaattaaaggttgggtaaggtaaaactcatccagaatatgcataaaacttgaactttaacttttttgattactaacaagataaatttatagatctacttttatgtaacagtaacagaacaggtacaacatggaccccaaagtctctgctgagcagaaaactggaaatgactagaaatatactgacagaagagaaaagctaaagtagaactacatagtcaagaagaaagctccgagggaaggttgtggattcaaatgaatacgtagatagctcttctaagactccacaatacattcctcattcctgtagagccagactactccttcccaaaacctacagggcagcaaatctaagatccacaaaaaccagagctcctattttattaactgctccccttgtgccaagcattatgctttagtaatctcatttcatctcagcaacactatgacataggtgctgctatcctcagtaccgaagcgcagtaactaaagatcaacatcacacaaacgtcaaagttaaggccaaaaaaatatatgctactagaggatttccacttttcctctcttattttttactatattttaaatactgatcattaacacaaacttctacaagtaaaaaaattttatataatgaagtagtacatgctcattttaaaaaccaaacattgtaacttcacaaagtagacattaaacattttctatactgtcaccagctagagaccatcactattaacttgttacaggtctttccagaccttttcttaaaagcattaacagctgatgtgccaagtcagtacaattatctacttatactatacatatgtaaatatgaggtaaaatgtctacctatagatagtataaattgtaagcaaaagcaaattgttgctcaaacctaggttaagtcaagtttggatttaactatatagaatattctaaaaagcacataaaccaaaaaaaaaaaatgatgaaagagaaggtggaaagatgaaagcaggaaagggccaaatacagtctagcaactcaattcagcaatacagccagtttgtcactacctacctacttaagagctgattctaacatctatttccatggtaactaggcattaagcaaaaaatatatatataccagacttttaggaaaagattcctttctcctccaccagaaaaatgcctagtttggcaaatttaagcaatgtaatctggaagtctgactttatgtcagaaatttcagtatattagactgtaaaacatcttaaaatagttattaagtaattggagggggtggactacaaggagtaaaactgatcatctacaaatatcataatcttagtttctaaaattagagttccagttgccttctattgacatacaatatgtccaaaacccagtaaaatatttaaaattataaaacgcaatatataaacaagaactatttactgacatctagtaccacctggccacctggaaaattgacactggactttcaaatctgaacctttaaaaattaatgtaagcataaattaaattttaagtaaaaacatacagtaaaataatacctctttcgttactgataggatatgggcagaataatgatatgcaaaccagcagcatttttttttttttttttttgagacagagtcttactctgtcacccaggctggagtgcagaggtgtgatctcggctcactgcaacctccgcctcccgggttcaagcaattctcccgcttgaacccaggggttcaagcaattctcccgcttgaacccaggggttcaagcaattctcccgcttgaacccaggggttcaagcaattctcccgcttgaacccaggggttcaagcaattctcccgcttgaacccaggggttcaagcaattctcccgcttgaacccaggggttcaagcaattctcccgcttgaacccaggggttcaagcctcctgagcagctgggattacaggcgcttgctaccacacccggctgattttttgtatttttagtagagacggggtttcaccatgttggccaggctggtcttgaactcctgacctcaagttatccgcccgcctcagcctcccaaattgctggggttacaggcgcaagccaccgtgcccagccatatctttttaaaaatatgctcaacattttgaaaccatgtaaatattttacatcaaaaaaattgaaaaggaaaaaacagcactccttagaaaccaaaaccaaactgaagtaaatgttctattttcaactgctgacataaatacacagagaattattatttcaagtatcttaaatattaatatttatttaaaatattattttttattaaaatttataaaattttattttcatttaaaaagtattctgagcttacatccctactggaatacagcctaaggatgtaaatagacagacaaaggaatctcaaactacattatggtattgttatctcaaagctaatatgtgttatatgtataatataatgttaatgttgttaggaaccaacatttttagcataagataaaaaatgatataggccgggcatagtggctcacgcctgtaatcccaccactttgggaggctaaggcaggtagatcacttgaggtccagagttcgagaccggcctggccaacatggcaaaacctggtctctaataataatacaaaaattagccaggcatggtggcacgtgcctgtaatcccagctacttgggatgctaaggcaggagaattgcttgaacctgggaggcagaggttgtagtgagccgagatcatgccactgcactctagcctgcggggggacaaagcaagactccatctcaatttaaaaaaaaaaaaggccaggcacggaggctcacgcctgtaatcccagcactttgggaggccaaggcaggcggatccggaggtcaggagttcgagatcagcctggccaatatagtgaaaccctgactctactaaaaatacaaaaattagccaggcatggtggagggtgcctataatcccagctactcgggaggctgaggcaggggaatcgcttgaacctgggaggtggaggttgcggtgagccaagatcacgccactgcactccagcctggacaacagagcgagactacgtcccaaaaaaaaaaaaagacacaactataaaagaagttacatggctgtactcatcaagaaggcatcacaggcaaagagggaagcccctgctctcccaacgtcaaagccaaaccaaaggctctaaaggccaaaacagcagtgctgaaaggtatccgtatccacagccacacaaaaaagagaagatcttcacgtcacccacctaaggacagcccaaaacactgctgctgttctggaggcagcccaaatatccttggaagactggtccagtccaggagaaaccagcttgaccactatgctatcaagtttcccctgaccactgagtcagccatgaaaagaacagaaagtcaacaacattcttgtgttcactgtggatgtcaaggccaacaaataccagatcaaacaggctaagaaaaagctctgtggcactgacatggccaatatcaacaccctgatcaggcctgatggaaagaaggcccatgttctaccggttcctgactatgatgacgttgccaacaaaattgggatcatctaaagtgagcccagctggctaacactaaatagacatatttttcaccataaaataaataaataaatcataaaataagttaaacaaaacctctgtaatttttcatgaaaactggaaatatcagtatgaattgaaaatttattcttctctttttttttgagacagggtctcactctatcacccaggctagggtgcagtggcacaatctcaactcactgcagccttgacctccaggctcgggtgatcttcccaagtagttgggactataggcacacaccaccatgcctggctaatttttttgagctttttgtagagacagggttttgccatgttgcccaggctagtctcgaactcctgggctcaagtgatccgcccacctcagcctcccagagtgcttaggttacaggagtgagccacctcacccagccataatttactctaattaaaaaaaaaaaaaaggaggaaggaaggaaggaaggaaggaaggaaggaaggaaggaaggaagggaggaaggagggagggaaggaagggagagagtacttcctgtatctaaatactaaaaaaccatagaagtcatgaccaacccagcagcaatgagcacccttaacaccctgattgtgatctctaaaaaccatttcccacttgagaaaaccagggctacttgttcttttctttttatatatatatttgatgtcattaatgtctcagcaaccagggttccttaaagaaatagctgattccagatgcggagcaggaaatgtacaaagtgaacctgatatcccttgtgccagaaagagagtaagttattgaaaaccgatgggacaatattcaaaagaacacaggaacccatctgaaggggttccaactggccaaagatgagacaattgaaacatgaaaaacagcaactacaatggattaaaacacatcacatacataaaaatccctaacactaaaaataataaaagaaagaagaaaaatttactggtcgttttagtgggttcctaggacaccaactcattattataaaaactggcaaaacgaggtgggagaggaattaaatttttatagcctccacttctagattttaaagacagtaaatacatgaaataaaagttttctttacaaaagaatttcaactaataaatgtaggagtgatataattccaaaatcaccgttttgcaatccttatataatggatctagtcaacaatcctcagatgctgcgaaaacctttgtgtgaaagttgataagaactttataaaggatagatcaagccaacataatctaaaaccactgaccaatcccagcaatactgaaagtgaaccaacctcatgatggtaactaatagaaagaatacagcacctcttataaacaatgctcaccaaaaaaaaataccctctagaacgaatgttcagtttacaggaaattacaggggttaaaccaaaccacaaagatgtaatcagccaaacagaatgtgggaaattctacaggttaaataacagtttcttcatcaaataaagggcatgaaaagggtggagatttaagagaccatttagaaccgtatcttccaactgcaatatgaagactttatttgggtcctaatgtaaacgaacaaattgcaaagacattttagagacaggctaatctgaacatgttcttgctaccagatgccattaaggaattaatgttaatgttattcattgtgacaatggtatgacagttgtactatgaaaggaaagttcaagtgtgtcagagatacataccgaaatacatatgggtgaaatgatatctggaatttgctttaaaatgctacatggtgagggagaaaggagagaagaggggcagcagagtgaaacagataataccaagatggcaaaatattggcaactggtgatgctaggccatgaatatgtaaaacatcagtgaactttatttttgtatgttgtaaatttccataaagttttaaagctgtatcaccagcatgtttgttaccatgaagtgtattcgtctctaatcatttatttttactagtctccagaattaacaccactaattttccaaaaattagaaaatgttatgtttcaacttatatatttagtctaaaaatcaattaccgtattacattatatatatccatatatatgaatataacgtatatttatatatatccatatatatgaatataacgtatatttatatatatccatatatatgaatacaatgtatatttatatatatccatatatatgaatataatgtatatttatatatatccatatatatgaaaatgactatctgcattataaagtcactgtgcctatccacagttaaatatttgtttagcagaattgtatttacatatagcgtttcattctacttcaattttatttgagatcttcattttacttaattagaactccatatctctttcatcaacacctaatcacagttaatactacaatcagaacaatttaagttataactcaaggggcacagagatggggaaccaaaccatactgttaatgtttgccataaaagctggcttcaatccatgcacagaggcatttcattcattaaaaactgcagtctcagcccagcacagtggcatttcattcattaaaaactgcagtctcagcccagcacagtggcatacacctgtaatcctcctgtaaagctactcgggaggcagaggcaagaggatggcttgaacccaggagttccaagccagcctagacaacaaagtgagatgccacgtcaaaaaaaaagcagtcttactgtaagtctctcattatactttctagagccaccttaaagtgtgaccctaatacaagttcatgtacataagaagctttttggtgttttcctaagggataaactgtggtttggttttgttttttattgagacagagtcttgccctgtcacccaggctggagtgcaatggcgtgatcttggctcactgcaacctccgcctccagggttcaaacgattctcctgcctcagccgcccgagtagctgggattacaggagcccaccaccacgcccagctattttttgtatttttagtagagacggggtttcttgaactcctgaccttgttatccacccacctctgcctcccatagtactcagattaaaggcgtgagccactgtgcctggcctaaactgtgtttttgaaattatctgaaggtttaatacctgaagaaataataaacgctcagagttcagcctagtcaaaaattaacaccagcctctaatacatcagagagttatttactcatagaaacaaatgcttcttgcctatcagtgtttaatggtatcatttgagatctgaatcctggcactggtttttaaaagcggagcagttctctggaaaagaactctggattatgagttaggagatccaagttagggggttggtctatgccagagtttgaactcataattcttgttcattggtggttagctgcttgaagcagtagtactatcttgcaaaggattctaaagcttcatttaggagcaaccaatttttaaacgtatgatgcaaaaaatatagaactaaaaaagagtgtagcttcctgggtatctttttattgtcacagaagtaatttaagtatttagtcctgttcttaaatatccaaatgggttcctgaaacactgtccctctacccacatgttactctaccctcgctcccccataaaagaaacccagaaaaactactggtggggagaggtacttccatttgctttttcattctatccagcaaccaataagcggtgtgactgtcagaaaaacaggctctgggccaggcacagtggctcatacctgtaatcccagcactttgggaggctgaggcgggcaaaccgcttgaggtcaggagtccgagaacaccctggccaacatggcaaaaccccatctctaccaaaaaatacaaaatttagccaggtggggtggcgggtgcctgcaatcccagctacttgggaggctgaggcacaagaatcacttgaacccaggaggtggaggttgtagtgagccgagatcatgccactgcactccagcctgggcgacagaatgagactccgtctcataaaaaaaaaaaaaagaaaaacagactctggaggtcaaaattgagttcaactctatgctctataactttctctggtccccattttccctatctgtaaacagggaaaattaaagtattctcatagtgctatcatgaagattaaatgagatatctgtgcttagaagacaacataacacatacaaagcagtactcaataaacttcatcatttttaattattattattattactatatttagcttattctacattaaagatgccttgcaaggagaaaaaaggaactacaagaatacttttttttttattttttgtgagacagagtctcgctctgtagccaggctgaagtgcagtggcacgatctcagctcactgcaacctccacctcccaggttcaagcgattctcctgcctcagcctcccgagtagctgggactacaggtgcatgccaccacgtccagctaattttgtgtgtgtatatttttagtagaggcggggtttcactatattggccaggatggtctcaatctcttgacctcatgatctgcctgcctcggcctcccagagtgctgggattataggcgtgagccactacgcccagccaacaatacatttttttaagtattctttttttttttttttttttttttttagtatacagacagggtctcactatgtttcccaggctggttttgaattcctgggctcaaacaatcttcctgcctcagcctcccaaagtgttgggattataggcgtgagccaccacacccaggcgaatctactttttctactgtaaattttattaaatctaaatacagaacaagcatctctgctgaaaatttagtgcccagtgtggtggctcacgcctgttatctgaacactttgggaggccaaggcgggagaatcgcttgagcccaggagtttgagaccagcctgggcaacatggtgaaaccttgtctttacaaaaaatacaaaaaattagccaagcgtgctggcacacacttgtagtcctaattacttgggagactgaggtgggaggatcgctagagcctagaaagtcaaggttgcagtgagctgtgatcacaccactgtactccagccggtgagagtgagaccctatttcttttttttttttttttttttctccttttgagacagggtggccttgccctggcccaggctagggtgcagtggtgcaatctcagctcactgcaacctccctccacctcccaggctcaagcaatcctcccacctcagctaccggagtagctgggaccacaggtgcccaccaccttgcctaactaattcttttttttttgtgagatgcagtctcgctcttatcacccaggctggagtgcagtggcctgatctcagctcactgcaacctctgcctcccaagttcaagtgattctcctgcctcagcctcccaagtaactgggattacaggtgcctgctaccacacccagctaatttttgtgtttttagtagagagggggtttcaaaactcctgacctcaggtgatccgcccacctcggcctcccaaagtgctaggattacaggcatgggccaccgcgcccagccaactaactcttttatatttttagtggaaacggggtttcgccatgttgcccaacctggtctcaaactcctaggctcaagtgatccacccacctcggcttcccaaagtgctggtattacaagcataagccactgtgcctggctgactctgtctcaaaaaacggaaaaaaaaaaaaaaaaaaaaaaaacagcaaaaaaaaacaaagaaacaaggaaaaggaagggaaggggaagggaaaggggaaggggaaagagatggggagggggaagtgtaaagggagggaggggaggaaggaaggaaggaaggaaaaagggaaagggaagtggaagagaaggaggggaaaggaggggaggggaggggagggaaaggagtggggacagaaagacagaaagaatttagtatccaaattgagacatgccataggtataaatatacaccagatttcaaagatatagtattaaaaaatgtaaaatatctcaataattttgatatcattacatgttgaaataacaatgttttggatatgctgggttaaattaaacattatcataatgaatttcaacacctgtttctttttatttacttaatacagctattataaaagttaaaattacacatggcttgcattatactcctattgataacactgctctaaacaatacacgttagcacttgaacacctgcccactgcttctcctttctcttatttgtcattactaataactgctgtgggtcacttagtagaggccatgctaaatgctttacatggattacctcattcaatccttccaaagtaggaggtacattttatcattgtcctcatttcagacaagattaaaatttaagcatcacagaaggttacattacttgcctaacatcacaaggcagtaagtaatagtgccaggattagaattcagtttgagagtttatattcttctttttttcttttttttgagacggagtctcgctctgtcgcctaggctggagtgcagtggcgcgatcggctcaatgcaagctccgcctcccgggttcacgccattctcctgcctcagcctctcgactagctgggactacaggcgcccgccaccacacccggctaattttttgtatttttagtagagacagggtttcaccgtgttagccacgatggtctcaatctcctgaccttgtgatccgcctgcctcggcctcccagagtgctaggattacaggcctgagccaccacacccggccagagagtttatattcttaaccaatgacgctgtactatcttccacccaaaatttgtattcctgaattttatgttatctaaagacactgcccccaaaacaaatattttccagtggttctaaaagccagtccttttttaaattaaaaactagaggtgggggaaaaaaaaaaaagcaaagcaaaaaacaaagcctacacaacttgactccaagaacgaagattaggctggacacagtagctcactcctgtaatccagcactttgaggggccaaggcaagaagatcatttgaggccagaagttcgagaccagccttggcaacatagtgagatcccatctctaaaaaaaacgagaaacagccaggcatggtggcacatgtctgtaatgccagctatttaatacttgggacactaaagtgggaggatcacttgagcccaggggttcaaggctgcagtgagctatgatcatgccattgcactgcagcctgcagaacacagcgagaccctgtctaaaatacaataaaatgtaaaaagaacaaagattaaccaaagctatatgaatctgacttccaaaaattaggtgcacaggtaataagcactcttttatcataatgcaatgcacactagctatactacatattctaaattattagaaattggttatttggagacatttagtaaagtggttcatccctaactctacaatatattacaggtatttttttttggcacatataaaccaaacatgagtattttacatgcatcatcatatttaataacaaagcaagcaatgaagtaaatgttattagccacatttctcatatactgaaaataaaactcaaagaagtaaattgcctaggccaggcacggtggctcacgcctattatcacagcactttggaaggctgcggtggacagatatcttgagtccaggagtttgagaccagcgtggcaacatggtgaaaccctgcctctacaaaaaacttgccaggcgtggtggcatacacctgtagtctcagctacttgggaggctgaggtgggtggatcacttgagcccaggaggtggaggctgcagtgagccaagatcacaccacagcactccagcctgggcaacagaggaagaccctgtcccgaaaataaaaaaaaagaaaagaaatgacaacattaacttcaaaaaataccatctgagcacatacaaaacaatcttgtgtgatttaaaagtgcaattactcaaggtcccttttcattatcttctatagcaatcctttagaaaatcatgttaaacagaaaagctgcctacttaaaaagtgaactgtatcttagagattaagacagattcaaatcataaaacaaattaagagttaaggggcactcatctgtttttccaccattgtgctataaatcatcaccatcctcatcatgcaaaggtctggaaaggctgaattctaaaacaaacatctgcctttagaagagtcaggcactcaaattggagtttatcaaacccagtggttaccttggagactacccatcaccacaagcatatacctagcagataagatcaagcagaaagcatctgctaattaagtgtattctatgcatggcctgtctgtattagtacgtaatttccatcttcataaaattcctttgtggtaaatagtaaatactaatctcattttatagcgaggcctaagaagctaaatcattttgccacactaaggaaactctggtaggcagaatgcactccccctccccacaaaatgaccacatccgaatctccaaaacatgtgaaaatgttatctatcaaggggaaatttaaagctgacatggaatcagagttgctaattagttgaccttgaaagggggagattagcttgtattatctgggtgagccctatttaatataaacacaaggatacttataagtgaaagagggaggcaggagagatagtgtcagagacagatttgaagacaccaggctgctggctttgaaaataggagagaccagaggcaaaggaggaaatacagcctctagaagctggaaaagaggcaaggaaaccaattctcccctagagcctgaagaagaaatgcccagtgagacccacgtcagacctctgacttccggatttgttcaaaactcctccctctcgatacacacataaaaacacacatacacttacaactaacaactcacacagtatttggcacttctaaatgttctgtgtactaagaaaactagatatccaagtaaagatatatattaaagaggcagaaacagcattaatattagtaggagctctggtttgaagtagtttaggtttaaatcctcactatgccacttactagtggcatgaccttagttaggtaaattatataatctctctcggccttgagtttttcatctgtaaaataagaatatatctatgtacctctcagggtattttgagaattaaaattttaaatgggccaggcacggggactcacgcctataatcccagcactttaggaggcagaggcagggggatcacttgaaccggggagttcaagatcagcctaggcaacatagtgagaccctgtctctatgaaaaaagttaaaaattcgccaggcatggtggtggacacctgtactcccagctactcaggaggctaaggtgggaggatcacctgggcccaagaggtcaaggttacagtcagccatgatcacgctactatattcctgcccaggcaacagagcaagaaactctgtcttcaaataagaaaaaactacatataatgtaagaaaagactgacatatattaagcactgaataagcagtggcaaaattatcatatgataataacaaaaacaataataattacagcataaagaacatgatgaccaggaaagaggctggtgtgataaatattttaatgctatttcagaacaagacaagactgatgacagttagtttgagataaatgggatgttactttagcaataaagacaaatttagaaattacatgcctactaaaaaataagattgtgctggctgggcacggtggctcactttgggaggctgagacaggcagatcacaaggtcagaagatcgagaccatcctggctaagacagtgaaaccccgtctctactaaaaatacaaaaaattagccaggcgtggtggcacacacctgtagtcccagttactcgggaggctgagccaggagaatcacttgaacatggaaggcagaggctgcagtgagccgagatcataccactgcactccagcctgggcaacagagtgagactccatctcaaaaaaaaaaaaaattggactgtgctaattactaaagtatatgaggattaactactatttattattacagatttataatatatcatgtcaaagcatctgcttaacattccaaatgtgaatatataattttagggctctgtatgatcccttaaataaaatctctttttttaagacagagtctctccctctgtcgcccaggctggagtgcagtggtgtgacctcagctcactacaactttcacctcccggattcaagcgattctcacgcctcagcttccagaacagctgggatttcaggtgtgcaccaccacacccggctaatttttttgtatttttggtagagacagggtttcgcgatgttggccgggctagtctcaaactcaaagtaaacttgcaattttccccgcctcagcctcccaaagtgctgggattacaggcattagacactgtaccatgccaaataaaaactgtttacaatagttgtaaattacctgaacctccccttcactacctccatcaatgcagaaaaactacaattggaaagcttttcagtgagagaaagaacttgtacctacaaattacagagaaaaaaaattataatgggggaagggggaatgggatagacagaattaagtccatacaagtaaatagaaaatgtctggctgggtgcagtggctgatgtctgtaatcccagtgctttgggaggccaacaagggaaggtcacttgaggccaggagttcaagaccaacctgggaaacacagtgaggccacagcactacaaaaaaataaaaaacttagctgaatgtggtggcgcaagcctgtattcccagctactcaagagactgagatgggaagatcccttgaatccaggagttcacggctacagtgaattatgatcacaccgctaaattccagtctaagtgacagagctaggccctgtctctttacaaaaaaagaaaaaggaaaaagaaaagaaaaaaagaaaatgtttcaaatggccaaaggaaacttgcaatttaagagaaggttgactgttctaaagattcttcagccaaagaaaaagagagagagaaaaagagagacaaaccacccagattgtaaaacttttctgagctagatcatattctgtgtcatcacttggcagaagagataggttctgaactcaagggctcaaatgacctttcaaagtctcttcaggctatatgggccacagtgtttcaacgcaaaattacttgtggcaatataaccagaggattcatttttctcctactttaaaatattaactcttcaaagctttgtacaaagcctctaattttctaatttataatactaattttcctttcttttagagatagagtctcgctctgtcgcccaggctggaatctagtggtgcaatcaaggctcactgcagccttgagctcctgggctcaagctcctcctgtctcagcctcccaagtagctggaattacaggcacaagccacctgtccagcttgacactaattttcaagctagcaaagttctcccagaagaactaagtccactgtcgttcatttttatgttttttcatatgatttcttctaattttttttttttttttttttttggagggggacagagtcttgcatcttgctctgtcgcccaggctagagtgcagtgacctgatctcagctcactgcaacctccgcctcccaggttcaggcacttctcctgtctcagcgcctgagtagctgggaccagaagcacatgctaccatgcacagctaatttttgtattgtatttttagtagagacagggtttcgctgtgttggccaggctggtcatgaactcctcctgacttcaagtgattcgcccaccttggcctcccaaagtgctgggattacaggcatgagccaccgctcccagcctgattttttctaatttttaagaaacaggggctccccctccccctccccctccctctccctatccctctccccacggtctccctctccctctctttccacggtctccctctgatgccgagccgaagctggactgtactgctgccatctcagctcactgcaacctccctgcctgattctcctgcctcagcctgccgagtgcccgcgattgcaggtgcgcgctgccacgcctgactggtttttgtatttttttggtggagacggggcttcgctgtgttggccgggctggtctccagctcctaaccgcgagtgatccgccagcctcagcctcccgaggtgccgggattgcagacggagtctggttcactcagtgctcaatggtgcccaggctggagtgcagtggcgtgatctcggctcgctacaacctccacctcccagccacctgccttggcctcccaaagtgccgagagtgcagcctctgcccggctgccaccccatctgggaagtgaggagcgtctctgcctggccgcccatcgtctgggacgtgaggagcccctctgcctggctgcccagtctggaaagtgacgagcgtctctgcccggccgccatcccatctaggaagtgaggagcgcctcttcccggccgccatcccatctaggaagtgaggagcgtctctgcccggccgcccattgtctgagatgtggggagcacctctgccccgccgccccgtctgggatgtgaggagcgcctctgcccggccgtgaccccgtctgggaggtgaggagcgtctctgcccggccgccccgtctgagaagtggggagaccctccacctggcaaccgccccatctgagaagtgaggagcccctccgcccggcagccgccccatctgagaagtgaggagcccctccgcccggcagccgccccatctgagaagtgaggagcccctccgcccggcaaccaccccgtctgggaagtgaggagcgtctctgcccggcagccacccgtccgggagggaggtgggggggtcagccccccgcccggccagccgccccatccgggaggtaaggggcgcctctgcccggccgcccctactggaaagtgaggagcccctctgcccggccagccgccccgtccgggagggaggtgggggggtcagccccccgcccggtcagccgccccgtccgggaggtgaggggcgcctctgcccggccacccctactgggaagtgaggagcccctctgcccggccgccaccccgtctgggaggtgtacccaacagctcattgagaacgggccatgatgacaatggcggttttgtggaatagaaaggggggaaaggtggggaaaagattgagaaatcagatggttgccgtgtctgtgtagaaagaagtagacatgggagacttttccttttgttctgtactaagaaaaattcttcggccttgggatcctgttgatctgtgaccttacttacccccaaccctgtgctctctgaaacatgtgctgtgtccactcagggttaaatggattaagggaggtgcaagatgtgctttgttaaacagatgcttgaaggcagcatgctccttaagagtcatcaccactccctaatctcaagtacccagggacacaaacactgcggaaggccacagggtcctctgcctaggaaaaccagagacctttgttcacttgtttatctgctgaccttccctccactattgtcctatgaccctgccaaatccccctctgtgagaaacacccaagaatgatcaataaaaaaaaataaaaaaaaagaaacagggaaatttacataaaaatgtttcataccatgatacaagtaaattctaaatttaaaactttttcaacaaagtaagtaggcaaaaggtttgtaaactacacttactattcaataaagccatcaaaaagtcactaaatggcaacaactttattatttatttataataactagtagagaggcagcatggttcagtttactaacaaaagaacaggctctgtgatcagtttaatgtgtgcctgtgggcaaatcactcaacatctttacacctgcttcttcgaccataaaaagggaaaaatgttgctgacctgcctcaaagggatgttattagatataactaatgattatggaactttaaaaacgtaatgtgccatataactgtacggttaaagaattccttataaactatatattctgactttgagcatatgctggggacacttcctatagagatccattccaaaattaacgtgtttttgattttgtttttaaaacggggtcttgctctgtcacctaggctggagtacagtggctgcaatcacagctccactgcagacttgacatcctgggttcaagcaatcctcccagcctcaacttcctgagtagctggaaatacagtcacaggccaccactcctggctattttaaaacttttttgtagaagcagggttttgccacattgtccatgctggtctcaaactcctgggttcaagtaatccacccatatcagcctaccaaactgctgggattacaggtataagccaccgcacccggcccccaaaattaacctgtctaatcaatgctaacagggatcccaaagaacagcataagcttttttagaaccagccatatagcacagggatgctccctcactaatcctcatagattaccttttagtaacaatgtcatgcaatgatatttaacagttggtggctgcaataattcacagggcaagagttcaagaccagcctaggcaacatagtgagaccccatctctagaaaatataaaaaatcaacctatggtgacccacacctgtagtcccaactactcgagaggctgaggtgggaggatcgcttgagcccagaaggtcaaggctacagtgagccgtgattgtactgtgcactccagcctgggtgacagagcaagaccctgtctcaaaacaataataataataataataataataataataataataataataattcataggactataagaagctttgtatatataataggtactgggactatttgccacctactagtactaggcatccaaataagttaacaatacttactgaaggccaggcacagtggctcacacctgtactttgggaggtcgaggcaggcagatcacttgaggtcaggagtttgagaccagcctggccaacgtggcaaaaccctgtctctaataaaaatacaaaaattagctgggtgtgatggcacgggactgtagtcccagctacttgggaggcagaaacatgagaatctcttgaacccgggaggcagaggttgcagtgagccaagactgtgccactgcactccagcctgggcaacagagcaagaccctgtctcaaaaacaaaaaacaaaacaaacaaacaaacaaacaaaaacagtacctactgaatactaagcactgctacatacctgcaaaacttaaagaaacataccggtgccctatataaattatttggttgtagaaaaaataacatgttgaatgcaaataaaatcttactaaagccatcaagaagaatgacacagacttgtgtaatatgtactgatatagaagaatgtaaaagaaaattatgggccaggcatggtggctcacgtctgtaatcccagcactttgggaggccgaggcaggcaaatcacgagctcaagagatcaagaccagcctggccaacatggtgaaaccctgtctactaaaaatacaaaaattagctgggcgtggtggcgcgcacctgtagttccagctactcaggaggctgaggcaggagaactgcttgaacccgggaggcagaggttgcagttagccaagatcgtgccaccacactctagtctggtgacagagcgacagtccgtctcaaagaaaagaaaagaaaagaaaattacgaacaatatgcatagcataagcccatttcaatacagtcaaacataacaaaataaatactcatgtttgattcatatgtgcaaagaaaaaggtgtggaagaatacacccaaaaactgttgaatcaagttaccaggaagtaagacttctactgtccactgaatactactatgtaatttttaatgtttacagaaaatctttattgctttcataataaaaatttctttaattttgctagaagaactagtttagaaaaatatttctccaagttagagcaaagcacgaataggtgacttactaaatgccaaaagctctctggcttgcctttaaaaaaaacaacaacactttagcaaagaatattcagattaaaaaaaacagaaatggggctgggcgtggtggctcccacctgtaatcctagcactttgagaagccaaggcaggcgatcacctgagctcgggagtttgagaccaccctaggtaacattacaaaaccccatctctactaaaatacaaaaaattagccgagcatggtggcgcatgcctgtagtcctagctactcaggaggctgaggcacaagaatcgtttgaacctaggaggcggaggttgcactgagccaagattgcaccactgcactccagcctgggatgcacagcaagattctgcttcaagaaaaagaaaagaaaagaaaagaaaagggttctttgatgaggtatccttatcaagataaaactgaaaatgtgaaaagttgaatttttgagatgcagtctcattctatcacctaggctggagtgcagtggtgcgatctcagcttactgcaatttccacttcccgggttcaagagattctcctgcatcagcctcccaaacaggcataccaccatgcctggctaatttttatattttcagtagagacaaggtttcaccatgttggccaggctggtctcaaactcctgacctcaagtaatctgccagcctcaaacgcccaaagtgctaggattacgggcatgacccaccgtgcatgcctaagttgaattttttttttttattctgaaatagacataagccaagctgcttcacttaactttgacagcaatagtggctcctccgtgttcaggcttgttcagctttttttaactcctctctggagtagagactcgggtttagcagggctcctacagtcattcgccctacctgcctaggctgcccatgctagatcagcttcaggtggctgactacaccacatcagaacagtattctgatcaagaaatgaaaacaatttttgccatacataaaaggctatacagatggatgcttatccagaaaataagtatcttcagtagttcacctaatccataaataaccctctaggcttggaagtaaaatttacttttcccttacaaggaaagacgggagcaaattaggagagaggagatgtattatatttactaagagaagcttctgcatcagtaagtaccaggaaaataaaggttagacatgagagcaaagagttcttggaataaagaaatctggttatcaccttctactaaacattctgtttttaaggatttcagaaggaaagaataacagatttaaggcttaatcacaaaactgcaacttcaaaattaacttttaaaagaccagagtcaatctatctccccgaaagcctacttaaactcataagaatctgcacattctttctaccgaactaataataatagctacaatgtattgagaacttactatgtagtaaatcctactacatttagtcaccccaaacaaccccatgaggcaattactgtaagcatttcgtattttagatgaggacaccagtcttcttggaaagtttaagaaaaactgcctacactctggtaagcaggagtggcaattcaatcccaaacagtcttgattaaaagaatcctcactctatcagcttatttaaaaaaaaacaagacaggcttcctctaataatacaactgccacgtactaactgctcagaactatgccaagcacagtgtaaagcattttaaatatggtatttcatttcatatttacacaactttacaaggtagctgttattattctcattttacaaaaattgaaactgatgtttactttcatttcaaaaacagtaactttacccaaacctcagcagccaagtaaaggacataaaaaggactggaaataagaccactgactttccaagccatatgctcttaatcatgaagctacaatgtttactgggcactttaaacaaagacagttttcacagtcatattcaagcagtaaattaagagaggggacaagtagatttaccaagaaaagcttctgcatcactaagtagcaggaaaagaaaggttagaaacaacagcaaggttcctggaataaagaaatctggtttatatttaatttacatataaattatcttaaatgatatataacaatatatataacattttactatcagtaaaatatgtttataaatacgtatttatatatatttcggtatatacattattttggctatcaatataaagtaaatcctttctttaaataccacttgctcaaaggttttagtttataatcttcatttgctattgaagtgcattgttaaaatatgatgttcaatgaaacttactaaagttatcaatgactatgttctcataagcaattataccctgaaatcaaaaggttatcaattagcagatagcattaatagaacttttatataggatttcagatattctagttgtcacattgccaaaaatttatctataaactagagaaaaatggcttaaatgagaaaagtctacatataaagtatctgtcccattgtccaggccaggcttggtggctcacatctgtaatcccaacattttgggaggccaaggtgggaggatcacctgagctcaagagttcaagactagcctgggcaagataaggagaccccgtctctaccaaaaatacaaaaaaatttagcgaggcatggtggtgtgcattatttgtagtctcagctacttgggtgactgaggtaggaagatcacttgagcccaggagctggaggctgcagtgagctatgattgcgccaccgcactccaacctgggccgcagaacaaggctatgtctccaaaaaaataaattatctgtcccactgtccaagatatagtgtaagtaatctcacacattttaatggtataaacctactgcctaattattattctcttaattgatgacaggtaaatttgtaacttaaaagtgatataccctattttcttccttataaatgtaaatttgtaactttaaagtgatacaccctattttctaccttataaatcagtaataatggcccagagaattagcccgttctaccaccttactatcaacactaacattaatctggaaagacattagttacagggatgttgaattctatacttacgtctaactgtatcctaaagctaagcatatctggttattcacagttagatactattcttgccttagataacccgattagagtaaataattgaatatgcaaaaggtaagagtaagcatatactaacatttgtaataaatagtttcataaataatatccaatgtgccatggtggtgtgcacttacagttccagccactagagaggctgaggcagaaggatcactcaagcctaggagttcgagaccagccaacgcaacataccaagactctgatctcataaattaaattaaattaaattaataaataatcccaatttgctacagactacaattccagatttccaggaaattattttggaaattattttataaaatgtttccatggatcaaaggctagttataaatttaaaaaattcaaattcttcttaggaattcaacgaggtaaacatttcaagcaattcacattgagtatccctaactcaaaaataagtggggtgcagtggctcacacctgtaattccagcactttggaaggctgaggcgggcggatcacttgaggtcaggagttcgagaccagcctggccaacatggtgaagcctcgtctccactaaaaatacaaaaaattagccaggtgttgtggcacacgcctgtaatcccaactactctggaagctgaggcaggagaatcacttgaacccaggagccagaggctgcagtaagccaagatcgcactactgcactccagcctgggcgacacagcaagacttcgtctcaaaaaaataataatatatttatataaggctgggcacggtggctgatgcctataattccagcactttgggaggctgaggcaggaggatcacctgaggtctggagttcgagagaccagcctggccaacatggcgaaacctcgtctgtactaaaaatacaaaaattagccaggtgtggtggcaggcgcctgtaatcccagctacttgggaggctgagggagaagaatcgtttgaatccgggagccgagtgttgcagtgagctgagatcgcaccactgcactccagcctgggtgacagagcaagattctgtctcaaacaaccaaacaaaaaaacaagatacagatatacatatacatacgtaaaacacaaaaaatcagaaatgctacaaaaactgaaactttttcagtgttcatgttacaccaaagggaaatgctcactggaacattttggattttcagatttgggatgttcaaatactaagcatataaatgcaaatattccaaaatctgaaaaaatcccaaatatttctggtcccaagcatttcaggtaagtgatactcaacctgattaagcatttcacctaaatgttaacatttcagaaacaatataataaaaatttttttctgattctgcaatgatttaagcaaaaataaatttgaaaataaaatgaacagtgactagttgattactttttctttaatggtaaaagtagaaggatatagaaacaactcttcctattaaatagattagcagcagatcagtcaacagatgataccacagagctgtgtttcttaacatttgtactgtgggtttcatcaagaatctgatgaaagctatctatggctcctctcctctgaagcctacacttggactttctgagtaatatatgagcaagcgttaattaaggaaaggggaaactatgctcagagtaagccaagtattgttttaaaacttttccctttttgactctttcattatgtcccttgcttctattaaccagcttaaaataacagccactatggtaaggtgaacatgaagatagtttgtctatgctgaccttagtagacctgctttttattttctagtaaactgtttatatacttccataaactcatttttttcttccccaaatctgaatgctgtctccaattttagaacgaaaattatgatttctaaaagcacattattttctacggaaaccttgaataccagagtttcctgtactcctaagagatccaaagagccaggaatttctacctgttttgttccctgacatattccaactgactagaacagagaccaatacataataagtattcaataaatattgaattaattttttaaatgtccaactccttggtggccacttgccacaacacaaaatacatgaagttaaatactcagcactccccaggttatcacacaggtaatattagtaccctaagaactgaaaggtccactcccaggacccaagagaattaaaaatacatgttcgcacagaaacttacatacaaatgctcatagcagcattactcacaataagcaaaaaagcagaaataacccacatgtcctccaaataagtagactgacaaaatgtcgtatcttcataagatggactattattcagcaataaaaaagagcatagtattaacacttgctactccttttttttttttttttttttttttttgagacggagtcttgatctgacacctaggctggagtgcagtggcgccatcgcagctcactgcaacctttgcctcccaggttcaagcaattctctgcctcagcctcctgagtagctgggattacaggcgcccaccaccacacccggctaatttttttatttagtacagatggggtttcaccatcttggccaggctggtcttgaactcctgacatcgtgatccacccacatcggcttcccaaagtgctgggattacaggcgtgagccatcgcgcctggtcaacacttgctacttctttcacttatgggaagtaaaagaaatcagacacaaaaaggccacatatgtattacaggattccgttaacagaaaatgcccagaatacgcaaatccttatagacagaaagtaaatgctaagctcagtgtctgaatcttgtaatcccagcactttgggggccaatgcaagaggatcacttgagctcaggagttccagaccaggctagggaacatagtgagacttcactactacaaaaaattccaaaatttgctgggcatggtggcgcacacctgtaatcccatctacttgggagctggaggcaggaagatcgcttgaacccaggaggtcgatgctgcagtgagccatggtcgagccactgcactccagcctgggtgacagaatcaaaactcttctcaaaaaaaaaatttagattagttactggagggataaaagaaagggagaacagtgaatgactgctaatggataagaagtttcttgttgggaatttggaaatgttctggagttaaatagcagtgacagatagctagggataagtaacgtgcctgaagtctcagctactcaggaagttgagggggaaagatcacttgaccacaagagttcaaggccagcctaggtaacacagcaagacctcatctctaaaaaaacaaacaaaagaaattaacaaaaaagttttcaaaagatagtagtgatggatgcacaaacttgtgaaaatactagaaatttatgaacactttaaaaaggtgaatttggtgaggcgcggtggctcatgcctgtaatcccaacactttggtaggccaagatgggaggatcatttgagcccaggagttcaagaccagcctgggcaacacagtgagacctccacagaaaatttaaaagttagctgggcatggtgccgtgcacctctggtcccagctacctgggaggttgaagcaggatcacatgagcccactgaagatcaaggctgcagtgagctgtgattgcgccactacactcctgcctgggcaacagactgtggccatgtctcaaaaaaaataaaataaaagggtgaattttatggtatgtgaattatatctcattttttttaattaaaaaaacaagtgaaaggattgctcaactcaatgttcactgctcactgagaaggctaagatttgacaatgccttcatggtcatactcagttccaagaatcccatctaccaactaatcacagcaaaaagacttttttaaaaaaagggaggacggccaggtgcagtggctcacactttgggaggccaaggcgggcggatcacttaaggtcaggagttcagaaccatcctggccaacatggtgaaaccccattgctactaaaaacacaaaaaaaaaggccgggcgaggtgactcacacctgtaatcccagcactctgggaggccgaggcaggtggataacaaggtcaggagtttgagaccagcctggccaacatggtgaaaccccgtctctactaaaaatacaaaaattagccagacatggtggcacatgcctgtagtcccagctacttgggaggctgaggcaggagaatcgcttgaacctgggaggcagaggttgcagtgagccgagatcgtgccattgcactccaacctgggtaacgagcgaaactccgtctaaaaaaaaaaaaacaaaaaatacaaaaaaaattagccaggcgtggtggcaggtgcctgtaatcccagctacaggggagtctggggcaagagaattacttaaactcgggagacagaggctgcagtgagccgagatcacatcactgcactccagcctaggcaacagagagaggctccgtctcaaaagaaaaggagggagggcacttgtgggaggacatacatgtgcaagttgcagtaagtagaattttcccttcacacccaatccattgaaatccaatcatccccatcttcaaatatattcccaatactactatttctcctcaccaccatctctccccaggactagcttgacagccttctgactgatctccctacttccactcttgtgttcccatgatctgttcgaacccatgatgtgttcactacccagcagtcaaacatttttgaaaatgtttatcacatcacttcactcaacacccttcaaagggttcctaacacattcagattttactcaagtccttaccatgtcctataaggccctacaattgtactggccctttgtgaccctctctgacctcctctcctaccactccagccctgatggccttaatgttccttaaatgtatcacactcaaacatgccaagcacactccatctcagggtatttgcacttgttttctgcagggaatgctcctcccccagaaacctgaatggctcactctatcacttgtttcacagcacacttaaatgtcatctcgaaaaggccctccattatcacctaatctaaagtaacccaccctctgtcactctaacctcttattctgattccgtatcatttctcttcaaagcacttagcattattttttttcttaacgtgtgtccaccatagtagaaagtaaactccacgagggtaagaactcttgttctattcactgctgcatcctcaaaacccagaacaatgtccggtacaaggaaagtacacaatgtgttcaatgactgaattcactggctgacttggcaaaaacattcttcagtgacataggtactcacctagtattttttttaattacaataaacaaagatttagcaatttggacagaaaacatgttagtattttacaagattacctattcatctaaaggaccacaaatttatagcacaaaatttgccatgttatggatcttaaatcccttcaaatatcatagatatgaggttaacattcacaccagattaaccaagcctctgacttcatcctacctacttactcttacatcttaactagcaggtccaatgacagcatgcttcaaatgacagtaacatctatctaatttcctaagaaaaaaacctccatcttcttcctaccccaggatgagttactaggtcctgaattctacttcttttaagacagactcttgctctgtcgcccaggctggagtgcagtggcgtgatctcggctcactgcaagctccgcctcccaggttcgcaccattctcctgcctcagcgtcctacaggcgcccgctaccaagcctggctaatttctattttttgtatttttttagtagagacggggtttcactgtgttagccaggatggtctcaatctcctgacctcatgatccacccacctcagcctcccaaagtgctgggattacaggtgtgagccactgtgcccggccctgaattctacttcaaaaaggctcagatctatcctctctgctccacttccaatgcattagttcaggcccttattcattttccacttggacttcttacctggaatttccatccttacattcagctctccccttgtttttgcagtggcctgatctcagctcaccgcaacctccagctcctgggttcaagcaattctcaacaactttcaatggttccatgtagttttcaagaaaaaatttttttttttttgagacagagtattgctcttgtcacccaggctggagtgcaatggcatgatctcggctcactgtaacctccacctcccgtgttcaagctattcttctgcctcagcctccctaatagctggcattacaggctcacaccaccatgccctgctaattttgtatttttagtagaaacagggtttcaccatgttggccaggctggtatagaactcaggtgatccacctgcctcaacctcccaaagtgctgggattacaggtgtgagacaccatgcctggccaagaaaattttcgactccctcactcagcttcatctcccaccactgcccttttattcctacccaaacatatcatgctttaagttaattcagtcacaccaaattacttacagtttccagatacttcaccttgtttcgttcattttccagtacgttatcctctatctgaaaaacttttcttcccttctttgcctagcaaaagccttcgcactcagcttagatgtcaactccaccagaaaactttccatagctctctgatttagctgtcctcttctgtcctctcatagcatttcctacaattattttatgttggaatactcataaatagatatgctaggagttttgctttatttatctgcatcttctgctacactgtgggctccctgaaagcaggtcagatgcctcacccaccttcattctatattacctgatatatgaaacgggttgttgttaaatgaatgacttatgaaaggggtgagacagaaggaagagggggaaggaaaagaacagagaggggggaacgaactgacagagtggatagggagacaaacaaaggtagaggtagggggagagagagagagaacatgtacacacacacagggcattaaaaaagggaatttgtaatcaatccattattttttcatgtggcctaagccaatcattgttgaagaaagaaaagtacatctggaaaattcaatctacgtggattctaaatataaccacctttttttttttttttttcctgaaatggggtctccctgtcacccaagctggagtgcagtggtgccatctcgactcactgcaacctccacctcctaggttcaagcgatcctacctcagtctcctgagtagctgggaatacaggcatgcgccaccatgcccagctaatttttttatacttttagtagagacggggttttcatcactttggccaggctggtcttgaactcccaacctcaagtaatccacccacctcagcctcccaaagtactgggattacaagcatgagccaccatgcccgccaaagtataatcatctaaatcattcctcctctaaagattctggtatatccagcccaaccagcccattttaattgaaaatttactgctacgtaataaaagacgttaataacatgtacaatatagatacaggaaaaaaaagtttgagtttaaaaaaagtaaaaatcggccgggcgcagtggctcacgcctgtaatcccagcactttgggaggccgaggcgggcagatcacctgaggtcaggagttcgagaccagcctgaccaatatggagaaaccttgtctctactaaaagcacaaaattagcccggcatgatggtgcatgcctataattccagttactcaggaggctgaggcaggagaactgcttgaacctgggaggcagaggttgcagtgagccgagatcgcaccactgcactccggcctgggcaacaagagcaaaagtccgtcttaaaaaaaaaaagtaaaaatcaacctgacataataaaaataagtcttggaattatttacaaactttaataatctaccacctccttataatgtggtactgctgatttttattttattttatttagtttttttttttttgagagagagagtttcacttttttcgccgaggctggagttcagtggcgcaacctcagctcactgcaacctccgcctcctgggttcaagcagttctcctgcctcagccttccgaatagctgggattacaggtgtgtgccaccatgcccagctaattttgtatttttagaagagacagggttttactacgctggccaggctggtctcaaactcccttgacctcaggtgatcctcctacctcggcctcccaaagtgctgtgattacaggcgtgagccaccatgcccagccggcaccactgatttttaaaagtctatcaagagcatgaaaaataaattcaacataacaccaacatcacgatctatgttacagcacaaattccttatgtattacgaatcatattcctcaaaaacatactgtgaaaaaagtaacatagcatatattagacagtaatgggaatgtatttgtttacataaattcttaaaggtagtacatgggaaaactgctaaaacatacaacacttcaactttaaaacaacacctaaaaagtattactacataatctaactttcaatcacctcaataaactgtcacttaataaaatttaaagatttgttgtcgttaatacaacagacaattcaaacttaaaagcttgctcccaagtacaaatatgtttggtaagatccaataaatggcataaaaccttctgtagctcaatgatcatcgtaatacagaaattacaccaggcacggtgactctcgcctgtaatcccagcactttgggaggctaaggcgggagagtcacctgagcccagaagttcgacaccagcctgggcaacacggcaaaacctcatctctacaaaaactacaaaaattagccaggtgtgcctgtagtcccagctactcaggaggctgaggtgggaggattatttgagcccaggaggcagcagttacagatcgtgccagccagggtgaaatagtgagactctatatcaaaaagaaaaataaaaaagaacgaaagaaattgggaacacacagaaaaagaaacaaaatttaggcctaatacactcaacattaaatagattctgaattgcaatttttgctaaagcaaaatacaaattacaagaagcttctcatcttttatcacataagaaataaagttgtaagaaataagctaagtttttagtactaataattactagcaaattctctgagatttgctatacttataataacaggaagtacttgtatgaagttagaaatttattttagtaactttttccttttaacgttaaaagcacctttttaaaaaatgcagtagaatgtaatgctgagcacttaaaattagtatttctaaaaagataccaaaaaatttgcatttggctagtattaccaagaaacttttaaggctaaagtttccaacatactttcatttttttaaacagactacttaaaaaaaaaaaggaaacgaaaggaagaaaaaaaacattttaatctcagactttcaacttaactacatttcttttaaccaaacatttatagagcacctaagaagtgacaagcactacaacactgggaaatgtgacacattacatttactccaaactaaaccttttatttattcggcttctgaacttattatttcttactcaaaccaaaacttttcttaagaaattctcacccaacatcaaggtacatatacgagttacctaataaatgcactttcaccactgttttacacaggtgatgagagttatagctaggatttgtgactaacaaaagggattcattcctgaaacatgtctatgcttcatgaaatgagataggaataaactgtttcaggtagtttacagcatcccaaactcaaagagaaaaccttaaaaaaattagactaaacttaattactctgtatagtagaccaagatttaagtagccacagcttttaccttctacaaccacaagtattacaaattttaatttggatgcaaaattgtcaaagcagtcttgattctgaggacaagtgaaatatttttttaaatagttcaaaggaactgtcaaaagtagacaacgttgatattctaacatgctatctgttgcatttctacacttgtgaacactctacccttttcaagcacttctgaatttgtaatggatgaaaaaatacaagctagtgtctaagttccaccagttgaatccagacttttcaaaaatctaaggttttattctagcatgtgtttaaaaaaaaaaaagacagcattcatatacatattctctcaagtaacaaaaatacctgtatttttatcgttatcatttcttccaacaattaagcaaattttttgaccctattctccactcagttaacatattgacatctaagaggaacctggccatcagttttccacacatcataatgcaacagagcctctgacttatttacagaccaaccagatcaataaagaaaaataaaccatataaccccaagtcactggaaatacaagaaacaactggtatctctgaattgtgtaaaaaatcacaaaaattctctttttaaatctttcaattaaattatttttgtgacgagtcaaagagttttctgctaaaattttacagtactgttcacacaataaataagattctctttcatcagtgtaactgatagaaccacaatacagttcagtttctagggtcagattacctgacttgctttttattttaccttttaaaacactttaattcatgccgttattcctctcattccctacaaaaagagatgttcaatatgggagaatcatcttcagttgagacatcctataactgcctccaactccacagcaaagcccgccagctgaccccggtctctctggggaagggctcggtcaccaagtcaccaaacacaccttcctctgcaaaactcggaagccccacacgacgacctcgtcgaaacctcctacttcctgaattcgataaccccagagattcgttttccgcaggcaatcttaccttcatgatgactctgggaccaaggtatcctctaaaacaccaggttcagctgcacctggaggggaaacaaaagacacccagtcaacaccacaggagcccctctgcactggcggaggcggagggaaagaagcgagcgacgtccgaaccccgaagaaagagccgcaaccaggcgccagcccccgaaccatcacacgccgactcggggctccctccggccccgccatccccgcaaacccaaccacctacacagctcggcagcttcccgtccccattgtcgagacccgacggagtttcccgtctacgacaatgacgccatttctgtcagagaagaaactcacaacaagcccggcgtccggcgcagggccggccgctctcccctagggcctcggcgcccggccgagcgaatccgcgcccccacgcgccgcgtccgagcgagaggccggccgggggccaccgaggggccaggagggcctgtgggccgcgggcaggaccggcccgccacagagcccctgcccacgtcccgttccgggctcagacccgacaagtgggagcgagatcaacatctggccccgcc

SEQ ID NO: 2060 - DNA, 15977 bp, Homo sapiens
ggcaacgacgcctgcgcagtgtgaccgggatggcgcattttcttgcaccaactaatgcggtgtcgctggcggctgaggagggcggagagttctgtggtgaaatagtgggaaggattcatgtaggcatcgggaagagcctaagtccacattataaaataggaagttgatgcggggtacagttactcccggaccggcggcgtgaaagtcgtgatatcatcgttgaactgtgagcggcagtggcggcggctggggggaacccggatgggaagaagggcgggggaggctgggaggcggggcagaggaaagaaagaaaggagagtgaggacccggatgctgaaccggattgtgtatgaattttccatcccctagctttaagcgaggagggagaggaagggttggccaagtggggcggaagggagcatctgagcgaggaggaagcagaaacctcaccgtttcttcccctccggactctgtgctagcactgtatacgtttgcagttctctgcccagccgctgtggaaaatcggcctcgaagtgattgaaattccctgtttatatcaggcggcttctttcagatccatcgtctttctcccggagtatgaatggaaggattcagtatgcgcttcacatttgtatgtctctggccattctcaaaccaggcccttccctttgaaaagtcttttgcatgggatgttcacttcttagacgcaaggttgtgtgccctggtttcatcgtctaacgcgttagaaggcgctttcatttcttcatgggtgttgagcgccgaccactggggtggcctctgccttcgtagacctgcgcctggtgagacggacagatgctgaacaaaacgatgtgaaattaccgcagtggcagtgccccagaggagagttccacggtgataggagaatgagggaatttggcttctttagggagggaaaggaagggtttctgagcaagtgaggatcgagctgagagctgaagggctagcaggagttaactaaggaaagagaaaaggaaaagacattccagacaaaaagactaacttgtcagaaagccctgtggcggaagggagcttttccaatatgaagaactgagcctggagagatgggatgagggggagtgtcgaaccttttaggctttgtaaaggagttttggttttctcctaatagcaatgggatatcttccaaggaatctcaatcaaaagggagagatggctccgattggaatgtcatccctggctgaagagtagaggaagcgaaaaaaagaagagttaaagaggcaaatgcagggaacccgacgaggaggctattgccgtagtagttcacatggtgaaaagaatggagcgtttgtattaatgattatggattcactctttgaacaaatttctggcagctttttagttttgaaagtgagaagtttcagactctcactgaggtattctgtagttttttcactctaaaaggaaactagtagagttcatgtaacacacactaatgcctctttacatttaactttagtatgtgatagctgaaatttccagctgtgataaattgggaaatcctttgatttaaaagaaaaacaaaggcgggtgagggtgagagtatatgccacggtgtgtagaatcctttagactcttaagaagacacaaggcggctgggcgtggtggctcacgcttgtaatcccagcactttgggaggccgaggcgggcggatcacgaggtcaggagatcgagaccatcctggctaacacggtgaaagcccgtctctactaaaaatacaaaaaaattagccgggcaaggtggcgggcgcctgtagtcccagctactcgggaggctgaggcaggagaatggcgtgaacccgggaggcggagtttgcagtgagacgagatcacgccactgcactccagcctgggcgacagagtgagacgctgtttcagaagaaagacacaaggcaagttggttgtcgatacctggaaaaattgaagttcttatgttttcataccactgaaaatgcttgtatgtaaatatcctctgggacaggaaattgacttaagtgagtattcttaaacatctctaagtgaggaaaggaaatattttttaaagcataattagtgttttaagttgaaaaataacatcaaccacaaagctctacgaattgaaacaaagattagctctgatttctgtgcaacagggtacacctgttacaggtcctgacacaaaagggaattctgaaagtgcatctcattgatttttaagttcggtcaaatgtgttttggaggctgtgagaaaatatacaaacgtgattcttgctcccaacttgtagttgagaaaagatagatactaacatttaaatagagaagtatatgagatccttttttaattctacttttaatgatgttcgataataatcttttagctaagccattattcttcctgttttgcatcttcttttcttacttcaatccctgataataaggtcacgtgtcagagatcaaatagtataggtaataggttacctaaataggtatttgcataataggttacctaactaaataggtttttgcctaataggtatgttgattatttcgcttacttgattctttatgagcctttttttccttgcgacgtctttggtattaattgttagtcaagatggatgtagaaattttccatatgggatgtttctctttgaattcatgttgttaaaatgatttcttttggtggagtgctgatcttttttatgattgtttcatatagataagaacagactacaaaaaaatatgcctttcaatcctgaagagtaacctgaactatacactagttttgtgctttaattttcatttgtaatctgccttcaataaagagttaagctagtggaatttatgtcttagcttgttataacacaaacacgaatatttgtctgcttggcattaaagggtaaagatattccatagctgggaatcttaatctgaggtacgtgtaaacattcagggactatatgatctctgagaatttgtatgttgtaagtctttgtggcagtgtatacatttgtgttgcaacttattaacacatacaccgggcttttttttttttttttagaagattcatagctttcatcatattctcaaaaggtttctgtgacccatgagatggtttacagtatggggaagcatcaaagcacttgcacagttgatggttatatgtgtgtgttattatttcagccacccattatcatgtgcttaccaactgcctaacagtgcatacatatgtagaagttttattcttttctcctgttgccatattatacgtctcatttcacagcagaaaaacaactgcatgacagagacaatgtggttcaaaccattttacccttgtattcattgactgctacaaaacaggaacattaaatacctgattgtcaccaaattgggtagtctcagcacttctacactcgtaattgtgctggaaaagtggaatgctagcactaataattagattttggtttggagggttttttatttgtttattcttacttgtataaatttatggggtgcaagtgtagttttatcacatgcatagattgcattgtagtgaagtcaggacttttagggggtccatcacccatgtaatcacgttgtacccattaagtaatctttcatcatccacctccttcccaccttctcaccctttggaatctccattgtctatcattccacactccatgtccatgtatacacattatctagctcccatttataattgagaagatgtactatttgtcttttatgtctgacttgttacacttaaggtaagggctatccatccattttgctgcaaatgacatgatttcattttgttttaatggctgagtaatcattcgttgtatatataccacattttctttattcagtcatctgctgatggacacttaggttgattccatatctttactattgtgaatagtgctgtaataaacacatagtgcaagattttggaaattttacttttgtggcacgttgttggtatttactcaggatctttggatttgcttggctgcatgtatatgaatcagtgtgtttatttactgaaatatgtgcaaaagtcttgtctttggtggattaatttataatataaatccacaaaagtcagattctgctcctaagtatattttacatttttaaatttaatgccagcaagaagttacagtactagaattgccttacccctgagagtatcaatgatcagatcatagtatcaggtgactgggctatagaagatgacttttattacttaacattatgaagttactagggctgatttagaaatcgaggaacactggtgaaaccccgtctctactaaaatacaaaaattagctgggcgtggtggtgggcacctgtagtcccagctactcagaaggctgagtcaggagaattgcttgagcccaggaggcagaggttgcagtgagccgagatcgtgccactgcactccagcctgggcgacagagtgagactccgtctcaaaaaaaaaaaaaaaaaaaaaaaaggaacacatcctcactgttacaataaataacagtagcccacacccccttagttgtgatgtggtgtgataccatgtaagcaacctatttccagttcccctaacattctcaagcagctgtatcagaatcatacaagatgcatatttaaattgaagatttctaagtctctggcccagacttagaaaaaaaggatcaggccgggcacagtagctaacacctgcaattccaacactttgggaggctgaggcgggtggatcgcctgaggtcaggagttttgagaccagcctggccaacatagtgaaaccccatctctactaaaaattcaaaaaattagctgggcgtggtggcaagaacctgtaatccctgctattcgggaggctgaggcaggggaatcacttgaacccgggaggtggaggttgcagtgagccaagattgcgccactgcactccagcctgggcaacgagcaaaactccgtctcaaaaaaaaaaaacaaaaggacctttgagcaatcagaataacacaaagtacatgaactgaacttcattttcttcattcaaaagaaagtggccctcactcaagcaaatatattcttgtgctttatcttctggcatactgagataactttctaaagtggtttccaattccaaaatccaatgatgtgcaactcattgaacagccctaaccacaaactgccattagatgccatattacatttagcctttttgttgtagaaaagttggttagaagtgggctcaggattctaaagactaaatcatagtcccaagaagcaaaagaaagaggataaaagtaataaacttcccaaaatgtgccaaagatgctagagcagttagattcctaatatgaggacaagtaataatagaaacagatacaaagaaataaagtagagattcaacagtacagggagaccctaggaagaccatgagtgttattctaggaaatactgaaataagacagatttcagtataaaggggaatatgtttaataaatatatgcatttgagttaatgcgtattttaaatcagaaatctctgaaatggattgattgtagagaaactactagggggacgaggagaatccctttaaattttaaatacataaaacatactcatcttagtgctcatttaaaaaaggatatgtttactaattagtgtaatcagttaaatacagaggtatctttccaattctttggatgtgttttgacatttgccgtcaacaaattaagccttttgtggttgattaaaataggaaaagcttaatataagttatgtgactaagaaaacaacttaaaaaccaagacaacactttgaccaatataatcacttgaatgaagaattttctaattgagatataatttacataccacccatttaaagtgtacatttcagcagtttttagtgtattcacagggctgtgcaaccatcacaatttaattttataacattttgatccctgcgaaaagaaaccctgtactcattagcaattagtccctgttcctaaccactaatctactttctttctctgtagattggcttattctgaacatttcgtataaatggaatcatacaatatgtagtctcttgagattggcttctttcacttaacatgttttcaaggcttcatagctgtagaatcttgctttgtttttttgagactggagtcactctttcgcccaggctggagtgcagtggtgtgatctcagctcactgcaacctctgcctcccgggttcaagcagttctcctgcctcagcctcccaagtagccagaactacaggcacacaccaccatgctcggctaatctttgtagttttagtagagatggtgtgaaggctggtctcgaactcctgacctcatgatctacccacctcagctaatttttcatatttttagtagagacaaggttttgccatgttgcccaggctggtctcgaactcctgggcttaagctatccgcccgcctcagcctcccaaagtgctgggattacaggcgtgaactaccgtgcccagcaacagaatcttctttttaaaccagactaggtgtcttttcacaaacaccctgcaatacaaattcctttgcagtttgacactgaaagatgattagtttcatgtgatctttatgtttctcctttttgacagattagctttgaagtttaaatccaatggagaagactcaagaaacagtccaaagaattcttctagaaccctataaatacttacttcagttaccaggtaatacttcacttacagtccatatagggtcattttcatgcagtagtggtcgttcaaatgttagcaaatagaaaaggttagacttgctagccgttgagattttctatttaaggtgatgcgtatgagaaaaatgataaatagaacattataattttttctttattaaaaggtaatttttgccaggtgcagtgatacatacctgttgtcccacctacttgggaggctgaggcaggaggatggcttgagcccaggagtttaaggctatagtgcacaatgatcacacctgtgaatagccactacactccagcttgggcaacatagtgagaccccgtctcttaaaaagaaacgtaatttttgaaggcaccctttaaaacatatccaattatttaacatatcttgaaaaataaaaatacttaaaacattttggtatctcattggaggttgtactctttacggatattacgcattcagattccccactgtttagatattaggggaagttacgcagatttgtttaacagtagaacactttatttaccatacatgttcaagtttaccttctatgtctgtattttccagtatctcacacatacactgcatttcatatactactggttcctttgagagccaaataataatgtatctaaaatcacagtatttggaaatatagcccactttattcctgtataagggtatgccaccttggacatggcttcctacctcacgtgtacgtgtgtgtttttgttttattttgcttctttaaaaacttgtctggaggctgggcgtggtggctcacgcctgtaatcccagcactttttgaggccaaggcgggcggatcatgaggtcaagaggttgagaccagcctggccaacatggtaaaaccccgtctctactaaaaacacaaaagttagctgggcatggtggcgcatgcctgtagtcccagctactcgggaggctgaggcaggagaatcacctgaacctggaaggcagaggttgcagtgagctgagattgcatcactgcactccagcctggcaacagaatgagactccgactcaaaaaaaaagaagaacttgtctggaaatgataataagcaaaaactcatgaatataataaacaggggttattgtaataaaaaatcatttgtattagaatattctttctcatagacataatataggccaggtgtggtggcccacacctgtattcccagcactttgggaagccaaggcaggattgcttgagaccaaaagtttgagaccaccttgggcaacataacaagtccccctctctgttttaaacattttttaaaaaagaagaaataatataaaagttggtaaattatttgacaagcataaaaacctatttagccatactgtgactaaactctaatgatgctctcaattcagtctcaatagacacttttaaatttccgtgctaaagtacacacctttctttatgagcacttctctgtggtaatatgtgcatttctgttcttcatgagcctgggaaggataaaagccaaaagaatgcttgctcctgtgctacaccttggaaaccataattagtgtcatttttattttggccgaccctaatagagactcgcctgctaatgtcaatgcatgagaagaatgagggaatgacagaaatggagaattcaaagggaaggttgcccactgtttaagaaaaagccaagagactgcttttgagtgacatttatccagcagttagtaacttatttcagtatctcccagtgagaaacatggcacagtttcactttcactctacccagctcttactgccagacatcctttagaacacgctcacaaacactagctggaactgggctggcattaatagcaagccagttatcagtgctgacaaaagtctaacaagcatcgcttgaatgtctcttactctgctacttacaaagcaaggactgcctacagttacattttaaccataatgcttacttatgctgtgaccaccttctgtgacttccttttttttaattctcattacttggaaataatgttttaagacattagataacatatttaaaattatcactaggtacctcacctttttattcaagtacgttcttgatccatgatggaatacaacctcaaaagatactactaaagaaatatgacattgcactatgcacataacacacttatttttttacagagagcttcagagttactaaagtaacttagaggtgtgccaggtcatttatactgttgtaatattactcttgctaataaataataataatgctatcagtattttctgaagtcaacctggccaacatggtgaaaccctgtatctactaaaaatacaaatattagccaagtatggtagcgcatgcctgtagtcccagctgaggcacgggagtcacaggagcctaggaggcagaggttgcagtgagccgagatcacgccactgcactccagcctgggcaacagagtgagacactgtctcaaaaaaaaaaaaggattttctgaaattagtaaagaaaattatttttatttttaaatttctcatacttgctgtcatcttatgtttatgtttgtttatttgccttagtgtggggccctagatgaggtgaagggtgggattagggagagatgaagctggcagtggaggaagaagggctccaaaaagagagacaataatgtttagatcttaaagaggaagcagtaatcttttaattttgagagatctctgtgattagcctcagtactagaaattattttggaactcagccaggcgcggtggctcacatctgtactcccagcactttgggagaccgaagtgggcagatggcttaagcccaggagttcaagaccagcctgggcaacatggcaaaaccctgtctctactaaaaatacaaaaaattagccaggcatgtgatacgcccttgtagtcccagcttacctgggggactgaggtgggatgattaccggagcctgggaggttgaggctgcagtaagccaagatcacaccactgcaccccagcctgggtgattaagggagaccccgtctcagaaaaaaaaaagggggggaaacttaaaagcatcaggctaaacactagcatgtcatcagaggggaaaaaaatattaaaactgtagtacctcaaaaataagccatatattgtactgttttctatataacattcaaaagtaaaatgaaaaatgaaatttcacattgagactctgtttttcatcttcaaaaaaatgtgtttaagtgatacaggccaagtgcagtggctgacttattatcccagcactttgggaggccaagtgggacagattgcttttgagcccaggggtttgagaccagcctgggcaacagggcgaaaccctgcctctacaaaaaataaataaataaaaataaaattagccaggcatggtggcttgttcttgtagtcccagctactcaggggacttgagcctaggaggtcaaggctgcagtaggccgtgattgtgccactgcactccagcctgggtgacagagcgagaccctgtctcaaaaataataataataggccgggcgtggtgggtcacacctgtaatcccagcacttcgagaggccaaagcatgtggacgacttgaggtcaggagttcgagaccagcctggccaacatggggaaaccctgtctctattaaaagtacaaaaaattggccgggcgcggtagctcacgcatgtaatccctacactttgggaggctgaggtgggtggatcacctgaggtcaggaattcaagaccagcctggccaacatgatgaaaccgtctctactaaaaatacaaaaaattagctggatttagtggcgcacgactgtaatcccagctactcaggaggctgaggcaggagaatcgcttgaacctaggaggtggaggttgcagtgagccaagatcgtgacactgtaccccagcctgggcaacaagagcaaaactcgatctcagaaaaaaaatacaaaaaattagctaggcgtagtgacgcacacctgtaatcccagctactcgggaggctgagacaggagaatcccttgaacccaggaggcgaaggttgtggtgagccgagccaagatcgtgccattgctttccagcctaggtgacagagcaaaacttcatctccacaaacaaacaaacaaacaaaaaaacccataatcccagcattttgggaggccaacacaggtgaattacctgaggtcaggagtttgacaccagcctggccaacatagtgaaaccctgtctctactaaaattacaaaaattagccaggtgtggtggcaggtgcctgtaatcccagctacttgggaggctgaggcaggagaatcgcttgaacccagggggcggaggttgcagtgagccgagatcacaccattgcactctagcctgggtgacaagagcgaaattccatctccaaaaaaaaaaaaagaaaacagtattttagttttaactttttatgtaaccattttcctgaaaccttatctaaaattaggatgttattaccatgcattcatttagcagaaaacttatagaacatttttactaagtgaactggccatggtttttatctatcattcctttgtatgtgactacaatgacttctagtggtaacttctatccaaagacctatcttaaattagccacgcatggtggcacatgcgtgtaatcccagctactcaggaggctgaggcaggagaatagcttgatcttgggaggcggaggttgcaagtgagccgagatcacgccgctgcaatccagcctgggcaacagaatgagactccgtctcaaaaacaaaaaacaaaaagacctatcttgagctttccgtgtaagaaaaagatgatactgttgggtgaagtgactcaacgtctgtaatttcagcaatttgggaggctgtagcggccggattgcttgagcccaggagtttgagaccagcttgggcaacatgggaacacactgtctctacaaaaacaaaaattaaccgggcgtggtcgcttgcacctatagtgccagctactcgggaggctgaggtggaggctgcagtgagctgtgaacacaccactgcactccagcctgggtgacagagtgagaccctgtctcaaaaaaaaaagcaagaagcgcagtggctcacgcctgtaatcccagcactttgggaggccgaggcgggcggatcacgaggtcaggagatcgagaccatcctggctaacacggtgaaaccccgtctctactaaaaatacaaaaaatgagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaacaagaaagaaaaaaagaagatactgaaaaatagatgtccctagtcaaaataatgagattagcttttgactaaactcaggatattaaaagggaatacttcagtgcatgatgatctcatttttgaaaggaaagaagcagagcttccccatctctaaaaccttaattcaaaggagaaatagataatttcaagaggtatttttatgaggtaatagtaaaatatattttattaacagtacctatagttatgtaaaataggtagtgccaattaactgacactaaactagcttcttggcctggcgcagtggctcacgcctgtaatccaaacactttgggaggccgatgcgggtgtatcgcttgggctcaggaattcaaggccagcctgggcaacatattaaaaccccctttctataaaatatacaaaaattagccaggcatggtgtgtgcctgtagtcccagatactcaggaggctgaggcacgagaatcatgtgaacccaggaggtggagtttgcagtgagccgagatcacgccactgcactccagcctgggcaacagagcaaaactctgtctcaaataattaataaataaactagcttccttttcaaaaaaagaaataaattaggtcctaagtcctaaaagcccatcctactttaaaattgtttattcaagttcagatgaaaagagtggactagtaggcaactgaagtgctttagagtctcccgtgcctgccctaattctagaaggttgtgcactttatgatccagatttctgagtggttgagaatgagttattgagcagtgcaaggcaagctctgcagtaggtaatggattgatgaggctggatttagcaagtctgatcaatctaaaggaagtttctgaatgtgttttttgtagttaaaatactcataattaaaacacttatcacattgtcacattttatttttaaattgcaggtaaacaagtgagaaccaaactttcacaggcatttaatcattggctgaaagttccagaggacaagctacaggtattaggcaactctaacctcattaatccccaagaaattaatagctgtcgcataaaaatattcctagttcttgattgaatttagtcctcatgcaagatattattttatattgaggttgctaaatatttattagttgtgaaaattaacacacctgagactttcataatctgttaattaaactgagtaagttttgaatagttcaaataagtgaaattttcaatttttttattagattattattgaagtgacagaaatgttgcataatgccagtttactcatcgatgatattgaagacaactcaaaactccgacgtggctttccagtggcccacagcatctatggaatcccatctgtcatcaattctgccaattacgtgtatttccttggcttggagaaagtcttaacccttgatcacccagatgcagtgaagctttttacccgccagcttttggaactccatcagggacaaggcctagatatttactggagggataattacacttgtcccactgaagaagaatataaagctatggtgctgcagaaaacaggtggactgtttggattagcagtaggtctcatgcagttgttctctgattacaaagaagatttaaaaccgctacttaatacacttgggctctttttccaaattagggatgattatgctaatctacactccaaagaatatagtgaaaacaaaagtttttgtgaagatctgacagagggaaagttctcatttcctactattcatgctatttggtcaaggcctgaaagcacccaggtgcagaatatcttgcgccagagaacagaaaacatagatataaaaaaatactgtgtacattatcttgaggatgtaggttcttttgaatacactcgtaatacccttaaagagcttgaagctaaagcctataaacagattgatgcacgtggtgggaaccctgagctagtagccttagtaaaacacttaagtaagatgttcaaagaagaaaatgaataatgttaagccattcttgattggacctcatagcttattttagttaatcttttttttgtcttttagccttaccaccttttaaaaaatttgttattctccagaaacagtaaataggtgagtaggggtggtgcaagtgaattcgttttcatttagaagcccctctgtacagataatcaaaattcaaagttgaaagaatcaaaagcagccacagttatgtaggtctgatttgaatgtcataattgcagtgacaggacattgccaccaactctatcctactaccatcaatgttgtgtttattccgtcaataaaaaagacttgcttccaggaatttttatccatacactttctaactgtactatctgggcagttccaagccagtttctattagctagctggaccaaagaccacaaatctctttttttcctaaacgctgctgtaaggaatatctcacttttccccccggaaacaccctcactgaagtcttctatgaaaaggctgataatgggctgggcgcggtggctcacgcctgtaatcccagcactttgggaggccgaggcgggcagatcacgaggtcaggagatcgagaccatcctgacacggtgaaaccctgtctctactaaaaatacaaaaaattagctgggcgtggtggtgggcgcctgtagtcccagctactcgggaggctgaggcaggagaatggtgtgaacccaggaggcggagcttgcagtgagccgagatagtgcctctgcactccagcctgggtgacagagcgagactccgtctcaaaaaaaagggctgataatgataaacagtgagcactccggtcctttttcttaggttttccttttttccttcctctccaccccacaagttttgctttttaaccaaggtgtctctgcttgatgaaattcacatgctagtctaaatctttttttctcccttgtaacatttatgtgccccaaactggttagtatatgggtacagcattccctttccaattgggaagcggaaaaagagagtatgggatattttagaagggagcctttgaaccttattatatttccccatcattgatagtgacaatcttaaaagggttgttttcttaccttaagtacaaaagcatggaaaaatgcgcttttccttcccgcccacatcaccaccccgacttgaagacagtaggtgcttgaatggaaagtgagtaggcatctttaatcgccctgattaaaggaaagtgttagcctgagagggcctgactgaaaagtaaccaaaggcttaatatcaaacactaattagctttttagtgccttaaccctgacctggttaccagttttctgtagtttctacacccaagccactgaagtcatctgtggcccaagaggtaggacaaaaaaaaaaaaaaaaaaagctgatttcaatatttgatttgttgacatcccaaaatgaaagttttatgtttcccttagaaacatgttttgcttggttctatagtatgttacttaggatctatttaccatatatttgtatgagaaatcctcacccaagcattcaacctaaatctttgaaaagttgggtgctgtctttagtaacttttaaaatagtttaaatctcccattttaatagtgataaggaaacctgttaaaatcatggctattgatgttatagtatggaaagttgaactttatgaacccatacttttaaaaagcatttttaaaaatctaacactgactatagaaacaaattaaaatgtctacctttaagtataa

SEQ ID NO: 2061 - DNA, 57250 bp, Homo sapiens
tattctaaaataaagaacatttattatcacaagttggataaaaacacacagcttttacaaaaatgatttttgatagaaaaatatgtttgaatacactgtgatatttgtaggaacaccacactattgctgtatctccagctaaagcttcaaggaaactctatttcttataatcaaaatatccactatttaccacaacccgtctttggaaagaagttcatagtgtattctgaacaaaccaaagcatttactcggaagttacattcccatgcctggcagtcacttgtgtatgtttaatacagttacacatgatgtaattacagaatggcggcgctggaagggaccttgtagatcatttagttggcaccctaattttacagagggggaactaaggccagagttgagagatgtcctcaggatacctgagtcccattccagtgttcgttcagtaattcataaggaagtcatcataaaggtttaaaaagaaaacgttaatgactcgctccctttattcttctgtgctgagagtatcattctggtttattcagattaagaaagaaatacactactgaaatggtatgaaactcactgtcaaagggcacttaggtccgttggctccgtttcccacagttccccaaatgaacaggtggtacaagactcaggctttcccctaattacttacttgggtaaagtgacttgggtaaaatgaaagatacagccaggcgctgggctcatgcttgtaatcccagcactttggggggccagggcgggcggatcacgaggtcaggagttcaagaccagcctggccaacatggtgaaaccccgtctctactaaaaatacaaaagttagctgggtgtggtgatgggcaccagctactcaggaggctgaggcaggagaattgtttgaacccgggaagcggaggttgcagtgagccgagattacaccattgcactccagcctgggcgacagagcaagacttacttaagtaagtaagtaagtcagtctcaaaaaaaaaaaaaaaaaaaagacagatacagctatcattgcaatgatactgtggtctcatcacatgagctagttttacaggtaactgtcatttgagagaacgaatggacttttcttgtcttttgataggctccatgacaattcaaaaggtgaagggattgctgtcacgtcttctcaaagttcctgtgtcagaccttctgttgtcctatgaaagtcccaaagtaagttgcccagcaaaatacaaagtcaaagtcaagcttagtcctcgtattatgacattaaactgtctctagatagcaacagtttgattctaaatggagaccatgggtctgtttgtttgattttaagggtaagctactgcctggggacggggtgggggaagagtatgtgtagcatgctttatcggatctgtcttaatcacatccttccccaccttcgttctaattttagaagccgggcagagaaatcgagctggaaaatgacctaaagtcattacagttttattctgtggaaaatggagattgtctattagtgcgatggtgacaaccaactaataaaatttaaagaccacactgcttatcgtgtctggggttcaccggaaataaatgattcactggaacaattctactgtcaaaacaaagggggtttacaacttgtcctaagtataacaagggatgtattttttgttgggaagtgaccatttctaggcttatacataatagcaataataaaggctttgaacctactaatgattttctgatcttatttcatatttatttttacagctcatcactgcatttcatgataagatttaaatattaaatagaaagaaactagctagcctaataaaatctgaacacagttaatatctgtcataagactagttttaatggaattctctattgaaactactattttaaagggttactagaaatgatttggttggtcattttgggaaatgtcccttaaacttggggagacatcctctactatgtataacaatatgctattatctgtcttctcagttgcactatttctaagagtacttaaattaatcacatgcttttccctacaattatacctaagctgagtatatcttcttctgtgataaccagctttgattgaaatgtactcatattaggtaaacattaggcaatgataggaggaaagcaaaactaattctttcaaaatgtcaacaaaatttagaaatatccttcccgatggcactaaaaccctgagaggtatttgcttttattcatactcacacaactttagcatttaaaaactatgagtactaaactgtgaccttcaggatttatgttagatggcagaaagaaaatttgggtattagtctaccatataaatgaacttctttaaaaccaaggttcagaactgagaatcatattggttcctcttcaagttagttcaagttgcccacttcagagatccacaaaatctgacattatttccagaaaccccaaactttggtataagtgaccactgctcaaatatgtgatcacatgatcacacagcattcctgtgagttcctttttgtctgataattatcctaattagctctacagagctatcctgcaatccaggttgaaattcaaactctcagttactactacagatttctgaactaggccaagttttaaccaaaaactataggtaatggtgaattactaattagccacaatgcatcaggatttagaaatattttttcttttataaaataacttggtatttttctgataatcttccaatagataaataaaaacttttcttatgctacagtacaagttgatttttaaggaaatttgtgcaaacattaagaaacaccgcattggttctgggtgaaagtgccagtctggaactctcttgaaagaccatacagtctactgctaaaccctgggactcctcagacttgcactcagattatcgtttgcctgccctgattttagactctgctaattcaagtccctgttatcttgcttgacatcgacaaggatcaccgcaccgttccttcagtttccacagttccgtcagttcccacggagaatactgaggagaagacagcattcctgtctcacaggtcttctcacacagccacagactgtcctgttgagaaacaaccaaagccgatctgagagtggtgaaactgttttaagagcatcagaaagtatgcacgtagacagcttttatgtattctaatgatgctgaaattatttcaaggataactccgtgtgtggaacaactggtgaggtttgggggtggcacctcctgatttgggaaagcaccaggtcccacagtcctgtggctgtggaatacagaaacaaggcggtgtgtggatgaagagttagtcaacaaatgccattccgtaatgaacgattttagaaaccacaagtgagtttcatgtttgctagtaaaggtgtgtctatggcagtattagtaacagctattattctgatggaatgcttacaatattgcagggactgtaccaagtgctttgtaaatatctcacttaaatctcacagtaatgctgtgaggtaggaactatttccctcttaacaattgaggaacaaacgaagagttaaaaaacttgttccaggtcacagggctggtaaatgaagaggagggattaaagactcccaagctcaagttcttaaccactagactatttcctagctacgtgaattggtttctatttccagcaatgtagcagaacacagagagaaactcattcaatgttttgacaacacaaaaatgttggataaaattaaaaacctttataaagcatggctcaactccgtgatcaaagaagaaacagggtaggagaaagcgctgagtcagcctgtgccttgaaggcagctgctgatccttgggtttggaaggccaagcccagggtcaggagactaatgggagactgacacagagctaggatctctgaggggccacagcctcaggggtgataaaacaaaacacactcagcttgtctgtctcagtcttgcccctcagtgggatggaaaggagtctctctcccctcagtgcctacccacagcttgcacttaggtaggtctggggctggtagtcagtctgtgtaagcccaacagttccaagccaaaaatctgaagtattcatagatggtagtattcctagatgcatggcagaaaaaaatgtaaatatgtaaatcctctctgtaggaatgcattttaaatagaggactcagtttccaaagacatgagatggtcacaaaaaaaaaaaaaaaaaaagaccgcatcagaaaacaagcgccatgaacaacagttgtagaaacaacaaactgcaaaatcagacccagcaaagactacagatcccagaattaccagatacaaaaaagaattatattcaaagatgagacaaagtacagcaaaggaatcagactatcaaagtggaccatgtagatgtgggttgatttcttgtcctggactgagagctgctctgggaccccagctctatgcagggcttctaactgacagacactgcatgtgccttctgtcccctgcaccttcgatggccaaagtggaagctgcaagaatccagaacagaaatctctgaagctaaagccagctttgtgcttgatttcttcccagggctctagtttccattttggtctctgcagattcatttttttttctggttcagcaatactgtgttttaaatgatgtcttatatttcatgcagtgtcttatttttatcggtcagaagggttgaaggatccttagactgccacactcaatcagtggattctgtcgttcagttttttttttgagacggagtctcgctctgtcgcccaggctggagtacagtggtgtgatcttggctcactgcaagctctgccccccgggttcatgccattctcctgcctcagccttctgagtagctgggaccacaggcgcccgccactatgcctggctaattttttttgtatttttagtagagatggggtttcaccgtgttagccaggatggtctccatctcctgacctcatgatctgcccgcctcggccttctgttgttaagttttaaagctgcaaataatttctgatcaaatctatggaaactgagtttttttgtaggcaggggaacgttgatttataaccttttgctttaaactcagaaaaatactgtatgagaaataacctagtggattattgtgaattaaagcaacagcataactattatggtagaagatcctcattctttctgcccatggtgtgataaacattacaggttgagcattccaaatctgaaaatttgaaatccaaaatgctccaaaatccaaaacttttttttttttttgagacagggtctctctcactctgttgcccaggtgggagtgcagtggtgcattcacagctccctgcaccctcgacctcccaggctcaagttgatcctcctaccttagcctcctgagtagctgggaccacaggcaggcgctgccatgcccagctaatttttttgtagtttttgtagagacggggggtttcaccatgttgcccaggctggtcttgaactcctgggctcaagtgatacacccaccttggcctcccaaagtgttgggattacaggcatgtgccactatgcccagcccaaaactttttgagagccaacatgacactcaaaggaaatgctcactgaagcatttcagattttcagatttggaatgtgcaacttctaagtataatgcaattattctaaaatccaaaaaaatctgaaatcctaaatacttctggtcccaggcattttggataaagaacactcaacctgtatatagaaatccacctcctcaactcttaagaaccctgaggccatccccaaagacttacctggtatcttttaggtcctatggcagccatccagatgcccatgcttacatcttcaccctatacatggcccataaagtttaaatgtaaaaattttaatgctattttatttgtaaagacaaaaccatagccactcccatcataaaccacctttctacttttttgctctgttattattctaatatgaaatagcaaaaatgggttcacatgaagtcaaagctagtggtctttaatatgaagcacccctgccacaaggtaataagatgaaaccgcgagcagacgacccatccttctcatgtaccttaagcttccaggaagcacttagggcttcctccttaggaataaaaatctttctattcctccagggactatactttttttttttttgagacagagtgtccctctgtcgcccaggctggcatgcagtggcgcaatctcagctcactgcaaactccgcctccgggttcacatgattctcctcctcagcctcccaagtagttgggaatataggtgtgcgcccagctaattttttgtatttttagtagagatagggttctgccatgttggccaggctggttttgaactcctaacctcacgtgatctgcctgccttggcgtccgaaagtgctacaattacaggcatgagccacagtgcccagcctccagggatgacacctgtaaatactagctgaaaacataataagtaggctcaaaaaagatttaggaatagaatttaaaggcaagatttgagggatgtaggggtgcatccttaacctttgagaggtgattcctatacagagaataacgtgcttttccccaaggtaagtgggttctgctttccatgatgggatgccgagtgagatgaaacttggtgtgatgagtgtatacgtaggtgggaaatccttaattttttgtttttattttattttttattatagagatggggtcttgctatgttacccaggctggtcttgaattcctgggctcaagtgatctacccgccttagcctcccaaagtgttgtgattactggcaagagccaccacgccaagctaagaaattcttaattacctgataggtctttaacctccccgagttgcttgccagccacttgacgatgtccttggagatcacatatcctgacccacatgcaaaggcagggtaagcggggctcgggtactccaactcctgccactttccggttcggtcaactgcccaattcagtctgaaactgagatgaaaaataatgtggcctcttgtgttagtctgacacatatcctgccactattaaaacttgactcctttatcatcactacaaaggaataagcttgtagaagtgaggaaagaaaataagaaaatttctttttttttgagatggagttttgctcttgttgctcaggctggagtgtagtggtgccatctcggctcactgcaacctctgcctcctgggttcaagcaattctcctgcctcagcctcccgagtagctgggattacaggcgcacaccatcatgaccagctaattttttatatttttagtagagacagggttttgccatgttgtccaggctggtcttgaactcctgactttgggtgatccaccctcctcagcctcccaaagtgctgggattacaggcgtgagccactgcccttccagaaaaaaattttcttaatctaaggaaaggaattatcatttatccagtgttgttttagataaaagattggttatgttaaattttctcaaagttgcatttgtagagtttctgaatgaaaagcactagaagatcaccctgtgttttagtatatatgaaaacaaaaaaccaaatcactaatccatattgtattcctgaggaagcacagaaaatggtttcagagacgtgtcacaaacgtactctaacaaaatatacagtagcttctaatgtgaataccatttatttctttggcataagaataaaagccatattgttttccctcctttactacattagcctgaggcttttcatttaaaaaataatttcctccaattgtacagtaatataaaatttattattattattaagacagggtctccctctgttgcccaggctggagtgcagttgcaaaatcatagctcactgcagcctccaactcctgggctcaagcagtctccctgcctcagcctctcaagtagctaagggctacaggctcacatcacctttttaattttttgtagggacagggtcttgcaacgttgcccaggctagttttgaactcttggcctcaaaggatcctcccacctcagccttcccaaaactctgggatgacagatgtgagccagcatgactgacctagagtaatgaaatatatataaacccaggagtctagtacgaaattgtatatctcaaccacattttcaaaaaaaaaagatattttatgctttattaattacatttgatcaggtacacgaatgccaatgggctaagaatggttaacttactttccccaccaaaaattaggcccatccagattcttttggacaatcctattaaatacagcttcgaggtctatgtaacagtcatcatctgtcttcagcaacaaattgaagctcgttgtttccacagtcctgttgacacaaaagggataagaaagtcagtgcgaccaaacaaacaaacaccaatgcagtggcgtcactaacactttcattcaaaactgtacctgtcattatctaaatttcttattcctcaaatgttgagaacatttgctctaacaaaattttgctgctatcaactaaggccatcacttggtctttactaaatggcataacacagagaagtactaacctgattttaaaaggcaaagaaagagcatattgaaggaaaatatctggcttaaatggaacatatgttcaaacaaatgcttcttaggcatcattcaactcctgctgccaaatctattaaacgcctgaaccttgccccgtgtgttcttaataacaaaggcccagcataatgaattaggtgttacatctgggcctctcacacagaacgctattgtacaagatgcatccgatgctatttatattacactcaaaatattttatggcttaaaaaaacctgacttattacattgaaacatattttcccttggaaacaacttctagcaattaaaccattataaatgaccttctggaaggcaaaggatagtgacttcattatctagacgtaaaatatataatcatgactaaagacaaaattgactccttcatttcacattgacagtccctgtacatctgtttaaaaatgcagttttgctagggtgccagtcatatgtcagaaatctcaataaaataaatttagaatttcattaggtccaagaatggtgaatttaacaataatgggtccacaccaaatagcatcaccccatgtttctaaagtttatttccaattaacagcagaaggcatacataatatttgctaattagaaatttcatgataaagaatatttaggtcactgataactgaaataatgaggaagaaataatgaaactcatttgtagtgtggagatgggtgatgccagctatggggacgcaggtcccagatcagagtcctgttgaaggttactgcagcgatccagggagagaaggtggcagccaacaatagcggcagcggagactaagggagaggctaagatacttccacgcctaggaaatatcttgctctaaagagtatccggggctgactcttagccctgacttcccacccttgggacttccatgcccattcctcatctcagcctcacctacaattgcaactctcatttgcggccccaaattaaaaggaggttctttttcttactacagctgcctaaacttaacctagtattcgacacacccagatttccaaccctcatttacctctgctctctactcacaggatgagtcccaaattatattaatttgccccagcaggccaggtgtggtggctcacgcctataatcccagcactttgggaggccaaggcaggaagactgcttgagacctcatttctattaaaaaataaataaataaataaataaataatttgccccagctaagaaacattaccttccataaaccaattagaccatctacccctcaggaccagggaactgtatccgtaaagtactgttcttggtaacttcccactctgcctagggcaacagagaagaaaagaaagagacagaccctgggcctcacaccaaggaacagaagaaggtttttaaaaataaaagtgaaaaaaataaaaagtgaataccctttataggtttggcctaatcagagataggtttgaaagttttggctccatggtcaggacagacagtaccaggaaactcaacataaaattttgagatcctagagtaactaataattctaataactatacgttaagattatatagatatataatatgtatgttactattattatatattgttgctgttattcttgttataaaagtaggaattaaaagtaagttccaagaaacactggagggtctgggaaattataaatatgatagattctgggagttgtggaattttagtaagccagccacgtaagagttttagaatcagggaggtagtttttaaacggatggagtagagactggaagtataaagtggatattcagtagaagagaatgcctatcagtaacctaaatgtgagtgactataactggggaatctgggtaggtgggtataaatacaactaaaaatggaccattcccaaactcactgatttttatctaatgctggcttgagacaaccgaggcaagcagaaatgactcaaaatgaatcaactttttttttttttttctttttttttgagacggagtctcactctgctgcccaggctggagtgcagtggtgtgatcttggctcactgcaacctccgccttctgggttcaagtgattttcatgcctcagcccccctgagtggctggcattataggcgctcgccaccacacttggctaatttttgtatttttagtagaaacagggtttcaccatgttggccaggctggtctcagactccagatctcaagtgatctgcctgccttggcttcccaaagtgctgccggcaggcataagccaccagccaatttttgccgtgtttttgataggttaatatcacattgtggatctttatcaaaataaagtggcagcatcttagaagctcagttttcgcaaggaactgggatacaataggtcatatcccaggtgctcagtgtccttaggtttgtttttatttgctgaaatctcagtggtttgaagttgataaattgtctcgatagcaaaagaacaataaggcacagtgtcatgtgcctgtaatcttacctactcaggaggctaaggcaggaggtttgcctgcactcaggagttcaagaccagcctaggaaacccctagtaaggggtttccttacagcctagtaagaccccatctcaaaaaaaaaaaaactaacaataaaacaagttctagctacccaacatttttacaacctaccatctatagaagttcaataattttgcaggaacattacgataagtgtcgacaacatccacaaaaacaatatcatcatagatgctgctttcctccttcagtaaggcatcttcctcatggagattccttatatgatcaataagtctttgagggcgagaatgaaggttgtgtaagagagcatcaccttctataaaggaaaagttgagagttggagaaaaatgctgttgtaaagttaccattcagaactgatgatgtacactaaagttcttttcccaaggtaacccagcagaaacacatgcagttgtttggaactttaggtagaaaaatgggaactctcatacactgccagtaggattaagtggatgctcccactctggaaagcaatttggcaatatctatttaggctgaaaatgtgtacaccttatggttcagttgaggccacttgtagatatatccctactaacattatttcacatgaggatattaattacagcattgtttgtaattgtggaagaaaaatgggaccaacctaaatgtccactgagagaaaaaaaaaaaacagccaagttgtggtatattcacataatgaaatatagcagttaaaaaaattaccctgatcttgcatgttaaaaggattgggatgaaaaaataaagttgagtgaaaattgccaagtgataaatacaatatgacaccacagatatcaattataaaacactcaaaactatgttatttaaagacatggtcaggcgtggtggcttatgcctgtaatcccagcactccgtgaagccgagggaggagaatcgcttaagcccaggagtttgagatcactctaggttatatagggagaccccatctctaaataaaatttaaaaattagccaggcatagtggtgcatgcctctggtcccagcttcttgggaggccaaggcaggaggatccctggagcccaggagttcaaggctgcagtgagctatgattacaccactgaactccatccagcctaggcaacacagcgagaccctgtctcaaataaataaataaataaagagacgtaaatatgttcaaagtagaaaaataagaatgggaagggtacacatgaattttagggaagtggcaccccctttgaggagagggaagaggaatacatctagggagaaccacaaggaaaaggtttcaactgtacctacaatgttttcttttttttctttttttgagacagagtctcactctgttgcccaggctggagtgcaatggcatgatcttggctcactgcaacctccacctcccagattcaagtgattctcctgcctcagcctcccgagtagctgggattacaggtgttagctaccacgcccggctaatttttgtatttttagtagagacggagtttcaccatgttggccagctggtctcgaactcctgacctcaaatgatccacctgcctcagcctcccaaagtgctgggattacaggcgtgagccactgcaccaggcatataatgttttctttctttcctctctttttcttttttgtttttgagacacagtctcactctgttgcacagactggagtacaatggcacgatctcagctcactgtaatctccacctcccgggttcaagcattctcctgtctcagcctccctcatgagtagctgggattacaggcgcctgccactgtgcccagctaattgtttgtatttttacaaacaattgtaaaaattgtttgtaacaagaggcagggttttgccatgttggccaggctggtctcgaactcctaacctcaggtgatccacctgcctcagcctcccaaagtgctaagattacaggcatgagcgactgtgcctggccatgttttatttaaaaaaaaaaaaaaaaaattagaaatgaataagaaaaaatgtaaataaaaaattgttaattctgagcactgggtacctggctgtttctgtactatttctggtgtatttatgattatttcctttgtttttttttttttgagacagggtcttgttctatcacccgggctagaatgcagtggtgtaattatagcttactgcagcctcaacttcctgggctcaagtgatcctcccacctcagcttcccaagtagctggtactcccggcacctgtcaccatacccaggaaattttcaagttttttgtagagatggggtctcgctatgttgtccaggctggtctctaaatcctgggctcaagagatcctcttgcctcccaagtttctgggagcctcccaaagttctgggactacaggcgagagccactatgcctggccatgatatttcataataaaaatgattactaatgtgcttaaaagacaatttatttgccacttcacaagttaatgagtcacttgtcacgtgtgcagggactgtccccagatcctactgatttaaggcaattctttcgctgtggcaggagacgtcaggatttcctaaaaatgtctcaatcaaattaaagaaaaattttgaaaaatacaaagaaaatgagctgctgagggtggcaaaggaaatgaaatacaatttagcactgcactctttgtcactgcaaatggaaaggatgaggtgggaagctgaaggcctatatctgacttctgcctctcatgacttgtgagatactggacaagttctgttgtctctagaccacagcagtctcacctgtagaaaatggtgctggattcaatcagtgattcttgggaatgcttgctgaaatgcagattcctgggccccaagcctaaagattcagtaggtctggggtggagcccaggaatctattttttttccttctgcacctgctcccaggaatctatatttttaatggccactgctgcgaccctgatgcaggtaggcagaacacagaccagcctttgagaaacacaggggtagatgacctcctgtttttttttttttttttttttttttttttgagatggagtctcactctgtcacccaggctggagtgcagtagcgctatctcggctcactgcaacctctgcctcccaggttcaagcgattctcctacctgagcctctcgagtagctaggattacaggcgtgcgccaccatgcctagctaatttttgtatttttagtatagatggggtttcaccatgttggtctggctggtctcgaactcctgacctcgtgatccacctgccttggcctcccaaagtgctgggattacaggcattgagctactgcacctggcctgacctcctgtttagacttacaatttttggactttacgataatgtaaaaacaatatgtgttcaccagaaaccatgctttgagtacatatgcaaccattctgtttctcatgtgactacagtcttgtgagatgttcaacctttattatggaataggctttgtgttagattattttgcccaactgtgggctaatgtaagtgtcctgagcaagtttaaggtaggtgaggctaagctataacattcggcaggctaagtgtatgaaatgcattttcaacatacatttttaacttaacatgggttcaacaggatgtaacattgtaagtcaaggagcatctgtataatttaacacttgatggaaagtgaaagtgttataaaattgtaacaggaaaatggcttgtaacaacaggagtgcagaaattaaatacaagccttttagactagtaacacattttgtttcactgcatgtatctgaaaaatatgagcataaattaatatgtcaggaaaatgaaaggatgtctgcttttgccacttctattcaacatacatgttctagccaggacaatcagataagaaaaaaggcatccagattgaaaaggaagaagcaaaactctctcttcttacagatgaaatgaccttgcatgtagaaaatcataaggtctaactttaaaatgattaagtaataaatacatggatctgttcagcaatgttgcagcacacagatcaatcacaaaaacaatctgtatgtctatatactcgcaatgaacaatcttaaaattaaattagaaaaacaattccacttacaacagcatcaaaaagataacataagtatttaataatttaacaaaagaagtgcaagacttttatactgaaaaatcaaacatcattgaaggaaatttaataagacatggatgttcaaagacttaatactgttaacacggcaatactccccaggttgatccacagatagaatgcaatccctgatgggaatgtgaactagtacaaccactatggaaaacagtgtggagattccttgaagaactaaaggtagatctaccatttgatccagcgatcccattaggaaagtaagtcattatatgaaaaagatacttgcacatgcatgtttatagcagcacaatttgcaactgcaaaaatatggaaccagcccaaatgcccatcaatcaatgagtaaagaaaatgtggtatatatatatataccatggagtactactcagccataaaaagaaacaaaataatggcattcacagcacctgcgtgcagctggaggccattattctaagtaaagtaactcaggaatggaaatccaaacatcgtatgttctcactcataagtgggagctaagctatgaggatgcaaaggcataagaatgatacaatggactttggggacttggtggggacagggtgggagggggtaggaataagactacacactggttacagtgtacactgcttgggtgatgggtgcaccaaaatctcagaaatcaccgctaaagaacttattcatgtaatcaaacaccacctgctcccccaaaaccgattgaaattatatatttattcatatatatgcatatatatatatgcaatcccttaaaacattccagctaggttttcttttttttttttgcacaaattaacaagctgatcataaaattcatatggaagtgcaagagacccagaatagccaatcaagcttgaaaaagaacaaggttggaggattcacatttcctaatttcttttttttttttttttttttttgagacggagtcttgctgtcacccaggatgaaatgcagtggcaatctcagctcaatgcaacctctgcctcccaggttcaagcgattcttctgcctcagcctctggagtagctgggattacaggcgcccgacaccatgcctggctaatttttttgtatttttagtagagacagggtttcaccatgttggtcaggctggtctcgaactcctgacctcgtgatccacctgcctcgggctcccaaagtgctgggattacaggagtgagccaccgtgcccagcctcccaatttcaaatcttactaaaaagctacataatcaagacagtgtagtactggttaaagacgcagacacatagatcaatggaatagaattgagagtcctcaagtaaatccttacatctacagtcactgattttcaacaaatgggtgctgggacaactggatatccacatgcaaaagaatgaagttaaacctctatttcatgccatatatgaaaatgaacatggatccaagacctacgtataagtgctaaaactataaaactcttggaactgtaaaacaaaggcacaaatctttgtgacctcacattagacaatagttccttacatatgacagcaaaaacatgtgacaaaattggacttcatcaaaatttacaacttttgtgtgttaaagggcaccatttgcaaagcatgtatctgataagggacttgtatccagcatatataaagaactcttacaattcaacaataacaaaataattttataaatgggcaaaggatctgaatagatatttctctaaagatatacaaatgactctctctcccctcctttcctcccttcttccctccacccctccctccctcaccaccttctccctctctccaccccttcctccctcacttcctccccctcctccctccctcacttcccacatctagctcatataccataataattcaccctgttaacagtgtgcagcctcagcaatatgacaaaaccctgtctctacaaaacatttaataattagctgggcatggtggcatgcacttgtagtcccagctattcgggaggctgaaatgggaagttcacttgagcccggggaggtcaaggctacagtgagctgtgatcatgccactgcactccagcctgggcaacagagtgaggcctcgtctcagaaaaaaagaaaaacaacgaaacaaaaaaggaagatatacaaatggccaataagcacatgaagaaaatgctcaacatcattagttattatggaaatacgaataaaaatcacaatgaaataacaatttacacccactaggattggtatattttaaaagacagacaatttattaagtgttgacaagaatatggagaaactagaatcctcatatactgactatggaaatgtaaagtgggctgctgctttagaaaacaacctggcagtgcctcaagtgattaaacacacaattatatgacccaggtcttctactcctagacatttaagagaaatggaaatatatgaccacacaaaaacttgtacctacatgtttactacagaattattcatattcaaaaagtagaagcaatctaaatgtccatccattaatgaatgaataaaatagggcatatcgatgcaatagaatattatatgatcataaaaaagaagtactgatacatacaaaatggacagacctggaacacatgttacagcaaagaaactgacacacagagtacgtactgtgcatttccatttatgtgaaatgttcaaaacaggcaaatccatagagaaagaaagtgcatcagtagttgttagggggtggggggttggggaggtaagaatgaggagtaactgctaatgggtgtggggtttccttttgggaggtggagccggttgtagaactctaagaatacactaaaaccactgaaccactttaaaagggtgaattttatctgaataaagttttttaaaagacaaaaaagaaaaaatccttttctctcaagtataaagattaagtgtaagacattcagtgtacttttcaagtttcaactagcaaacttaccctgaatagtatatataaaaccacctgcaactccctccacaccttccaagaattcatgaggcaatgcaccctccccagcctgaaaggaataagaatgtactcagtgattcattactaaaaatacactgatcatattttaaaatcgatttgacaaaaatcataatatgactccacttgcagcagataaatgcatgtaagatgctggtgcactggaggcttataatatcaggatgacatacggtattctactatttttgttatctaattacaatactaaagataagatatacccaacattccataaggtgttcagaattgcaacttacatagaatcatgtttatgtacttgctactctagtagtacaaaaagcaattgattttacatcccaaccccaccacttaaaaaaatatgtattacgacctttgattttttggaaactaaaaattctcatgagttcaaatacatcttggcatgctttaaagttaagagaccatgcagagaaaggctcaaaattaacagtctgttccaaatattcaaattgaactctactgtatattgattaaaaaaaaatttttttttaatttttaatttttcttttttttttttttcaaataagagacagtgtttcaccatattggtcaggctggtctcgaactcctgacctcaggtgatccgcctgcctcagcctcccacagtgctgggattacaggcgtgagccaccacacccggcctaatttcattttacagacagggtttcactctgatgctcaggctgagtgcagtggtgcaatgatatctcattctagccttgaacatacaatcttcccatctcagccttacaagcagctggcactacaggtgtgcaccaccatgcccagctaatatttataaattttttgtagagaagaggtctcactgtgctgcccaggctggtcttgaactcctgggctcaagtgatcctcccgcctcggtctcccaaagtgctgggattacaggtgtgggccactgtgcccagcctgttgatgttgttgaaggtgcttaagcctattgtgccagcagccaatgacagtcctttctacttcttagaatggagaatcttttattattaaagagttatctctcttcaaaagttacccaatggccttactcagagtgaactgttttacttctgtatacagtaaaccactatggtacatctaccagagtattgtctggctgttgtgggctagatcagacagttaagagtccatactcagtgtatttacagtattttttctacaccttcatttaatcaagagagctactgcttggctattcttaaacagatcttttcagagttgtactgtacaaagcaatgttttaaggccagtagaagaagtaatctgaggtcactgtagtaacttgtcatttaatttaaaatatgtttgtaggccaggcgcagtggctcacacctgtaatcccagcactttgggaggcggaggcgggcggatcacgaggacaagacatcaagaccatcctagctaatacggtgaaaccctgtctctactaaaaatacagaaaaattagctaggcatggtggtgtgtgcctataatcccagctactctggaggctgaggcaggagtatcacttgaacctgggagaaggagattgcagtgagccaagactgtgccactgtactccagcctgggtgacagagtgagactccatctcaaaaaaataaataaaataaaataaaataaaagttcgtagccaaatgtgaaaattactaaaggggcaggctatagattccaacgttgtagttccataaaagactgtatatgctttatttgttatttacttatttactttttttttttttttttgagacgaagtcttgctcttgtcccccaggctggagtgcgatggcgtgatttcggctcactgcaacatctgcctcgggggttcaagcgattctcttgcctcagcctctcaagtagctgacagtcgcctgccagcacacctggctaatttttgtatttttagtagagacggggtttcaccatgttggccaggctggtctcgaactcctgacctcaggtgatccgcctgtctcggcctcctaaagtgctgggattacaggtgtgagccaccgcgcccggcctacttatttagttttttgagatggagtttcactcttgtcgcccaggctggagtgcaatggcgtgatcttggctcactgcaacctctgcctcccgggttcaagtgattctcctttctcagcctcttgagtagctgggattacgggcattagccatcacgcctggctaatttttatatttttagtagagacggggtttcaccatgttggtcaggctggtctcgaactcctgacttcaggtgatctgcccaactcagcctcccaaaatgctgggattacaggcgtgagccacagcacccagcctatgctttattttttattgtatatttctatattgttttggctttagaactcaatagtaatttctgtttattaacttctctctaaaaggtcacaacttggctttttgcctttaaaatttttctgacatcacttgctggcaagggaataaagcttagtgaaaactctcagctgtacgcatttgtgatgaaaatcttaatttgtacctggggtttcttagcgtaggctttaaaaagttacctggttttgtttttgtttttttaggttaactgtatgtttaagctatctttagccctctataataatttttactcccaaaggcagatcatttgagtctttacatttgaacctagttctcaactcagaaacctaccttttttttttttttttttttgcgacggagtctcgcactgtagccaggctggagtgcagtggcgcgatcttggctcactgcaacctccacctcctgggttcaagcaattctcctgcctcagccttccgagtagctgggactacaggcacccgccaccacagccagctaatttttgtatttttagtagagacggggtttcaccatgttggccaggctggtcttgatctcttgacctcgtgatcctcccacctcagcctcccgaagtgctgggattacggcgtgagccaccgcgcccggccaatttatttcttttagtgtaaccaatattatagaattttggcatatgctgggtattttaaagtttcataaatagaaaaggaggcaagataataaggaaagatataattccataaaactttctattttcagtaaaaaatttttcataagacttaaaatgaactttagtaaacaagtggtgtgtgtgtttactaaagtaaacaccatctttattgtcctccatttactttatgaaatttacctgtcataataaatcctaaatcctaaacatgaatgaaatcctaaacatggcctacaaatctaaatgtataactacatatgaatctatgggtctatttgtttaatgtctttcttcctcactggactgtaagttccacggtgggccactagtatgtctattttaccctgccattgtttctgccttaccacaggtatgcaggaaatgttttttgaatgagtaataacgtagcatatattcatttcaactcagaaattaatccatgtaaatgaggttaatattcattcactaagcttgtgaatttaaatgccaagtacattcctaatcattggacaggagatcgaggagaataaaagattgtctatgattccaccgtacagaccgtttgtttactaaagttcattttaagtcttcatatacctgctttattgacctatatttactttgagaaattcacctgtcaaactgttttaaatttaaagcaaagccgaatgagaaatatgagagtcagaaatcccagagttgcttcagcaaaataaatgaaagtactcaatcttattttctatttttttttgttttgttttgagatggagtctcgctctgttgcccaggttggagtgcagtggcatgatcctggctcactgcaacctccacctctggggttcaagcaatcctcccacctcagcctcccaagtagctaggattacaggcatgcaccaccaggcccagctaattttttttttttttggatttttagtagaaacggggtttcaccatgttggccaggctggtcttgacctcctgacctccagtggtccacccaccttagcctcccaaagtgctcggattacaggcataagccagcacaccccgccttattttccaatatttttatctatagtagttttttttgtttgtttgttttttttgagacagagtctcactctgccacccaggctggagtgcagtggtgtgatctcagctcactggaacttctgcctcctaggttcaagcaattctcatgcctcagccacctgagtagctgggattccaggcatgcgccaccatgcctggctaagtttttgtatttttagtacagatggggtcttgctatgttgcccaggctggtgttaaactcctggcctcaagtgatccacctgcctcagcctcctaaagttctgggattattggcatgagccaccgcacctggctaattatagtattttaactgaggttttattttcaaggtgagatagtaaatactctgaatactactgagcaagtattcttaaagaatgctaacttaaaaattactgagaaataggccaggtgcagtggctcatgcctgtaatacagcactttgggaagcgtaggtgggcggatcacttgagcccagaagtttgcaaccagcctaggcaacatggtgaaaccccatctctacaaaaaacacaaaaagttagctgggtgtagtggtgcgcacctgtagccccagctacatgggaggattgtttaagccaggaggtggaggctgcagtgagctgtgatcgtgctagtgcaccccagcctgtgcaacaaagtgagaccctctcaaaaaaaaaaaaaaaaaagagaaataaaatattgcattttaaaaatgcatcaatcttaaagcaaaactgtaaactcactaatgctggagttacaggatcatatttgagtttttgcctttactatgaagacaacaacatttgctactatatatgttgtaaaacacacaagaatcattgctccatgctgcctgggctctaaggtaaattttagaacaattttatatattaaaaagaagctaaaatatgcaattaaaccttaaaaaaaaacgacttactgtaatgactctgagaactccccctccatcattcactgtcactttgtggagatttcttgacacaaggccgtggaggtcttggctctcccacacgattgtaccttcaaagctcttttgtagaaagatgaatagtgagtcaatttccttattgctgtcatttaggttttaagtatgctttcaggcaagatttttagagaaaatttttcccaaaacgtatcatttaaaattttcaccccataactctgacataccactgttagcgtttggtgtgtatccttgaccgttttttccatgcacatataaaaaaccaattacaaagagtatatacacaattttgcatactgctgtttgccatttcccattgtatcaaaagcatttccttatgttgttgcagctgtcacagccattcttcctcatgtgtgtataacatcccaatgagcagatacaccctgatttactcattttcccctactattagacatttggttgctactaaatgtctactaaaatatctactaagtatctactaaaataatgtaggcatgttttggtgtacatgtttatttactcctaacaatttgttttgtacttacattcccagagtgaaattactgggacaagaaagagatatttttatggattttggtatacaccgccaactgctttttgaaagcaacttttactaatttatagggttatcagcaatgtatgagaatgacaactgcactgtattctccctggtatgggatactagtaaacaaaagtttaacctaatatactagatttttacaaaatgattccttatttagttggatttatttttcagtttttgacacagagcctcgctctgccacccaggctggagtgcaatggtgcgatcatggctcactgcaaccttcactctccaggtttaagcgattctcttgcttcagcctcccgcgtagctgggattacaggcgctcactatcacgcccggttaatttttggatatttagtagagacagggtttcgccatgttggccaggctggtctggaactcctgacctcaagtgatctgcccaccctggcctcccaaagtgctgggattacaggcatgagccacggcgccctgcctgaatttaaaaaaaaaaaaaaaagattggcttagttggatttctgattcctagtgatgtttatgaattgcatgttctcttctgaggactgccttatcatgctgctttgccatctgccctctgagttttctatttttcttgttcatctatgcaagcttttaataaagtaattatcttaatcctgtgcacattttatatgctaaaatagtttttcatttgctacttaatgctatttttgaaattcagaagtccataaatttcaccttggcaaatctgacaaacttttcctttgtgattattactattaaattctgagctgagagagctatgcccccctgtcccaaggtctgatatatattgaaatcttaatgtcttctaatttctccatgatcccatttttaattctgtgcacagctggctccttagtcctgctcaggtctcagctccactaccttctcctccgagaggctttctccagatgtcctccagaaggctccaactcccaacttctatcacatcaacctgttttatcttattaataccatttatcactctgatatttcttattttattttattattaaactaactgcctctactagaagacaaacaccttgagaacaggaaggagcttgcctgatcaaccactgcatccccagcatcgagcctggcctgacatgactgacaactcaaaatgtttgctgaataaataatgttgaactaaaaatcaaccagaattgactatagtatagaggattaaatgaaagatatacctctaatactctaaaaactttcatgttaaaatgaagggataaagtactttacaataatgtctcattttagccagcagtatagggaaaccatacaaaattcaatttgataagctaggtcagtggtttataaacatttttttccctctgcacagagtgatataaactttttctttttttttatttttatttttttgagacggagtctcactctgtagcccaggctggagtgcagtggcatgatctctgctcactgcaaaccccacctcccaggtcctggttcaagtgattctcctgcctcagcctcccaagtagctgggattacaggaatgtgccaccatgcctagctaatttttgtattttcagtagagatggggtttcaccatgttggccaggctggtcttgaactcctgacctagtgatctgcctgcctcagcctcccaaagtgctaggattacgggcgtgagccaccgcccaacctttcccttcctttctttccttttttaaaataaataatatttttttcctcctccaaaacagataaaaatattccaagagtccggattcctcaggcagtttatcgctctgtattcagctaatgtattttcttctaaaactttaatagtgatagagtttggaaggattgatagcatatatacttaggataaggaactgataggacttggtgagtacctggacatgagagtgacgataactctcatgattctggtttaggtgacttgaggaaaaggagatggttacccaagattaaaaatacaggcgatgagaacagatgggatggagacaatgttaccattagaatgcccatgggacattcaagtggagaagttcaggaggcaactcaaagcatgtctggagttcacaagagatgctggggctgtaattatagatttaacagccttcagcatacaggcagtaatgaatgaaattgcctgggaagaatgagtaaaataaaacagaaggctaggtagcaaatcctaatgattaatatttaagaggaaagcaaaaaggaaataatgaatcataccaaaagtaaaaactatagtgaccagataaaaatcctcaccttgaaactacaaatctagaaaagatgatgataaaacgagtaattctctgtactgtccattcaattgacatgacatgtgacatgctatttcacagtgggtccttcctggcacccaactccattttgtctgtgactaggctatgatacaacaaacaaattcaatgaataattgaatgtgttaccagaaaaattccctagtcctcccaaatcatcttgacttactcatggaacttaaataacccatcagctgttttgttactaagcaaggaagaagctttatcttccacctgtctcctaaacctgtttctgctccacaacacagtttaatttctattcctcacctctgctctcatacacctactttttattctgatgtaaggcaattatgaagccaggtatctcttaagatccaaaacaacttgtttatggcaattcccttactaagatcataaaaaccaaaataaaagttgggaaaaaatagcatgatacaggttggaaaaatgagatatcatatctatctctcccataacataagcaagctgtctgtaactcctttcacgcatcaactcttttccataaagcttctaatttctcatccaaacaacagagtagcttaaatatatacagtacttctgtgcctataaacattaacaacttcttgtggattggagaaatgactatatataaagaatttcaaccttcacaaaaaataaggatataggctgggcacggtggctcacacctgtaatcccagcactttgggaggccgaggtgggtggatcacctgaggtcaggagttcaaaaccagcctggccaacatggtgaaaccctgtctctattaaaaataaaaaaaattagccaggtgtggtggcaggcactcgtaatcccagctattcaggaggctgaggcaggagaatcatttgaacctgggaggtggaggttgcagtgagccaagattgagccattgcactccagcctgggcaacaggagtgaaattctgtctaaggatgtaagcgtccataatgctaacaataacgtcgctagtgacttaggtgaacaaaaatagtctgctttttactgaaattagttacaggttccaactgtaccattaaggacaacataaaattagagacatatatatatatatatatatatatatatatatatatatatatttttttttttttttttttttgagacggagtctcgctctgtctctgtcactcaggctggagtgcagtggtatgatcttggctcactacaacctctgcctcccaggttcaagtgattctcctgcctcagccttctggtagctgggactacaggcatgcgccaccacacctggctaattttttgtatttttagtagagatggggtttcaccatgttagccaggatggtctggatttcctgacctcatgatccacccgcctcggcctcccaaagtgctgggattacagatgtgagccaccacgcccagccaaaacataaatattttaagagaaacacacagtagtcttcacttgtgaagaatcacttgtgatgcccactgagatttatgcttcagtgagctacacaatgaaaaccttacaggcgacctgcttactggacaagctatactgccgacgtgtgactccaggcaatcaccaagtgtggagggaatacgatgatgaacttcctctcgcaaatggaatacactacctacttctcttctgttactctttgctgatgatatgccagcaaacaatcactatcattcttccgagcaaacaaacccaatcagccttgatgcagtaaaaaaaaggatttaaaattaaacatattttcaacacaaatagaattttgtacaacaggagagaatttttttaattgctaaaagtttattttttctttctattatataaagctaatatatgtttattatggaacatttagaagatagatatacaaaaagaagaaaattaaaatcatccataatcttagctccccaccaggtatagccactattaaataattgcttgctttttgtgtgtgtggttatttttgttgtttgaatagggactgggtttcatcaagttgcccaggctggtcgtctcaaactcatgggctcaatgatctgcccgcctcggcctcccaaagtgctgggaggataagcctgagacaccacacgtggcctgcttgttttttaaaagaaaaaatattatacaaaattaataaaggtaataaaatcaagtctatttagcctaaagcctgaagggagataaaaagcacaaggctatagtcattaaaactcttaataactagacctggtggccaggcgcagtggctcatgcctgtaatcccagcactttgggaggccaaggcaggcgggcggatcatgagatcaggagatcaagaccatcctggctaacacggtgaaaccccgtctgtactaaaaatacaaaaaattagccaggcgtgatggcacacgcctatagtaccagctactcaggaggctgaggcaggagaattgcttgaacccaagaggcagaggttgcagtgagcggagatcatgccactgcactcccgcctgggtgacagagcgagactccgtttctaaacaaacaaacaaacaaacaaactagacctggtgtggtggctcaagcctgtaatcctagacctttgggaggtgagaggattgcttgaggccagaagttcaagaccagcctgccaacatagcgacacacccatctgtacaagaaataaaaaatttaggccaggcgtggtggctcatgtctgtaatctcagcactttgggaggccaaggtaggtggatcacctggggtcaggagttcgagaccagcctggccaacatggtaaaatcttgtctctactaaaaaatacaaaaattagccggtgtggtggcatgtgcctgtaatcccagctacttgagaggctggggcaggagaatcacttgaacgtgggaggcagaggttgcagtgagccagaatcatgccagtgcactccagcctgggtgacagagcaaaatgctgtctcaaaaaaaaaaaaaagatataaaaaatttagttgggtctggtggcaggtgcctgtagtcccagctactcatgaggttgaggtaggagaatcatttgagcccatatggttgaggctgcgatgagctatgatcatgccactggactcctgcctgggcagcagagccagagcctgtctcaaaaaaaaaaaaaataagtaaataaaaattaggggaaaaaaaagtcttaataactacaaaggtaactcactattttggctgagtacttcccatcattagtacccactgccagatataccatcctgaacacaagcaaggaaggttaacccctctcccccaacccaatttttattttgaaaagcttcaaacctatagaaaagttcaaatcaccattcaaatcacctagactcaccaactgttcacattttgccacatttgcctttttgctctctctccacacacacttttctgttgttggatcacttaaaaatacagatatcatgaatttttaactttaagtatttcagcatgtatttcctaagaacaaggacattctaagcgaaaataatattttttatgaactaatcaaaatttgcaattctttctataaggctgaccaagataatggaacagactccataaaactgcgattagcttgaagcattaaagttcattttcttcctctttgctgcaccccatgtgactttcttttggaatacagtttctcaacctcagcaccaatgacattttgggccagataattatttgctggggcgggggtggggtggtgtcctgtggctgcaggatgtttagcagaatccctgtccctttacccactagatgccagtatcaccctacatccagttttaacaactgaaagtgtctctatacactgctctgtgcgcggagggcaaattgcccctggtgaagaaacactgctcttaaagaataggaccccctcaatccagatgaggagtataatgataatgacaacatctattgatctactgaatgcgtggcatatggcagcatgttctaagcagtctacgtgtgttaaatcatttagcccccagaataaccatctgaaatgggtggtgtagcaccttcatcttagaggaggaaatagacacagtgagattaagcacctcatgtgaatgaacaaaccaaagaatggcttcctgcaaaaactgagatccaacactatgtatctgaaccactattcttttttttgagatggcgtctctctgtggcccaggctggagtgcagtgttgcaatcttggctcactgcaacctgtcccccgggttcaagcgatactcctgcctcagcctcccgagtaactgggattacaggagcctaccaccgcacccagctaatttttgtatttttagtagagacggggttttgccatcttggccaggctggtcttgaactcctcaccttgtgatccacccgccttggcctcccaaagtgctgagattacaggtgtgagccactgagcccgacctgaaccaccattcctgaagtaaaaggtaactttgatggtacatactgcacttaaaaaggaaaaaagttcatatgtgaagttaataaaaggatgtaggaaaacaggcactctcatatattgctaatgattgttcacactgatacaaattgctaaactcccctccaggaaggaatcatctgacttaaaaatgtgtatacccttcgacccaacaattcatcctaagaaaataaccagttatacacataaaacagaggtgcagtgatatttactacagtcttttccataacaccgaaaaattgaaactctatcaacacccaaatacagagttaaatgacaatactttcatacaatgtaattctatatagccattacaaataatagagcacatcaaaagatgttcgtgatatgttaaagtaagtaaattataaagtagaatgaacggcataatcctagcaactataacacatagaagcaaaaatgttaaatgtgattatctccaaatatgagattctagtagtgttgttttcctttagcatatctgcattttcctttttttccacccctgttttagtttggcttttatttaaaagtcgttttgttttttttaatttattttttgactgcttttgcggagcaggctatcctataagcagtatgctgagagtagcgtattcagaagtttttaaaatggaagttcagatacaaatgaaaaggagatccctttgacactgacagaattaacatatagtttcaactacttgtactcaattccaaagacccatagtatgttacaaaaatgtgtggttcctattgctgaacacattgtgaatggcacaccacagaatgggtaggaaaaagtttcttggttagtcaccagggccggtcagttgtctagcctccacaccttaacccagctgagatgctgcgggatgaactctacaggtgatctaaagtgaatcccagagatgtctaggaaactgaccccgattgtggttccagagcactgagttcaggaatgtactcggcctagactaaaacagcctagaaaggctgaagctgatgaatgaataatttgttatgtctgatcctgattctgtcacactctgcgaccatactgtgtggcttaactccaggactaatgagggcacctggcaggcgaggcattctttagtgcatatctagttatgactggacctagagggacccagaaggtgacaggtacattttcaggctatcatccacaactgttcaccctttggagaaattttatttaacttggaaacatggcccatctctatcattaacctgtctgcactgacttttttttcttttcattctttagataagcaaattatttaatttttacccaaatggtatctctgtctggtctttccatcaatccacacccaacatcatcctttgtcattaaaacagttgtgtagttctctactccactaaataaactacggaaacatgcaatgtttttcaaaaagtggttttggaacctctgaggcctcatgaagtcctcaggaggtttgaatacagagtgctatgttttagcccatccacagttggtaccttcatctatcactctggagtgctgccctggtacaagaaaatatcaagtgcctgcccctgaaagcacacgcccactcctatgaaggactgcattggtactacagtcttttcctgccatcctgtacctctggtaagatgaattgttccacgggcttgtaccacagcttgttcacctgcacaccacagcttggaggactgaagcgagcaatgaagagggcctcctacaaattgggagaaaaagacaagaaaaaatacttcatgttatacattgcatatgcaaaaagttttcaaacaccttacttcttggtcagctaaatccacaatggccctaaccacggtcactaacatggttctactgtggttttggcatcactgggttttctagtgcagtcatggttattaaataacgatatttaaggtaatcaaagttgtcacgaaattctcaaatgctaaacataatccacataaccttaaaaaaaaaacccaccttgaaagaaaaaatattcagggaagtgagcagtgttgttaaattaagccaacacattatagtgtcaacactcccccaaagggttaaaactaaactgaaagacacagatttttactgggaacaaaagcactcaggaaactccgttcaaaaagaatcttcagaagaaaatataaacaaaacaaaaaagggaatataaaagaggactggagccaggtgcagtggctcacgcttgtaatcccaccactttgggaggctgaggcaggcagatcacttgaggtcaggagttccagaccagcctggccaacatgtgaaactccaaatttctactaaaaatacaaaaattagctgggtgtggtggcaggcacctgtagtcccagctacttaggaggctgaagcaggagaatcgcttgaacccaggaggtggaggctgcagtgagccaagactgcaccactgcactcccgcctggaccgcagagccagactctgtctcaaaaaaaaaaaaaaaaaaaaaaaaaaaaaaaaaaaaaaaaccggactgattttcactatgtctatcgttttcttgggtcctcccatttcttccaggcaacatttcctcattctcatgcctattcttatataccaacttaaccataggggaaacttctgttaagctcttaaaaccatgcaggggttcaaaattaagcacatttcaatggattatgtctatttctttcatgaacaccagttcttagcaatgcagtataagaatagtttttgcatcgtgactacccatgaacccattagcatccatcttagactagtccttccttgaggacaaagattaactcctccctggttaaaaatatggcaactagaagttatatcgacatgatcaaaatattgtatgtctgaaccaaactacttgattgataactcgcacactataaatagttttgttttttgagacagtctcactctgtcacctaggctggagtgagtggtgcaatcacggctcactgtaatgcagcctcgacctcctgggctcaagtgatcctcccacctcaacctaccaagtagctgggactgtaagcaaatgctaccatgcctgcctattttcttaattttttgtagagatggggtctcactgtattgcctaggctggtctctaactcctgggctgaagcaatccatctgccttgccctcccaaaatgctgggattacaggcgtgagccattgcgcctggctgatagttttttttttaaactatatatactaagataaacaagtgtatcaaaaaaattcaagattaattctaatttctagataacagtgatactcagagtactgctatttcaattacctatttgatcttcagtatcaatgaaactgttaactacaatcatatatggactcctatagttgagtatacaaagctcttctcactaatcattatagctggcatcatcagtagaaatcctactcttccctctgtcttatatttatgtctataaacacatcaacaaacgagacagattatttagaggaagaacagggcaaattccaaaaaagaaatttaatctcaaatttatttgtgtatttattgatgagtctctaacattatattcattgctaataatcaacattaataatacaaacacattttaaaaaactgaacagagttctgctgccagtaatatcagaccaattctcctatagatagtaactatgaactctggatgaaacataaaaaacaatgatttgaaggcactggaattcaaacaaacaggcagaaactagagaagaatcagtacttggaagaaggaaaaggctccaaatatgcatctcctccctaccccacttcttgactctttgtctgaggatacaactctagggtaactagaaatttgaatgaaaatctgtagtctttctgcttgaaaattaagaggacagagttggggcaaacacatcaattaataaaaggcattagggggaacctcccagaaaggaaaggatcacagagagagagaaccacaaattcttcatataaactctacccaaatctgtggctgactcatgaaatacacatacaaggcagaacccaagtagcccatccaaggccagagaaactgaatagagattttagctgtttctcactgcaagtgagacaatgtttagtctgtgtccagccaatttagctgcctgctaaaacaaaaaaaaaaaatcaatactctgaggaatataataggatccagagttcctacaatgaattatttacaatatctaggatacaatgcatgagtagcatgtagtcccagctactcaagaggctgagatgggcggatagcttgagcccaggagtttaaggctgcagtgaaccacgactgtgccactgcactccagctcaggtaaaagagcgagaccctgtcaaacaacaacaaaaaaaccaaaacccaaaccaaaaaaccccccaaaatactagacataaaacagaaaaatgttacccatattttagaggaaagataataatcaataaagacagacgctgagatgactcagaataagcgtacacagattttaaagctgctgttataactatggtcaaagctgtagagaaaaatattctcaaacaatgaacacataggaaattttagagaaatagaaacagtaaaaaagaactaaatggaaactgaagcactaaaaagtataatatttaaaataaatctaaaataaaaaattcattggataggcttaacttcagatttgagatgacagaagagtcactaaacttgaatacagatgaacagaagttatctacattagaaaagagaaaaaacactgaaaaaaatgaacagtcttgtgatctgcaggacaataccaaaagatctaacatacatgtaattggaatcccaggaggaatagagagagcgagcgaagtcagaaaaggttctgaagacattaatagttgaaaatcccccaaatttggtaaaatacatacatttacagattgaagaaacatgtagcacgccctgaataaaacagacaaagaaaaagcacaccaggcctggtgcggtgcctcacgcctgtaatcccagcactttgggaggctacttgggaggctgaggcagcactctgggaggccgagaagggcagatcacttgaggtcaggagtttgacaccagcctagcccacatggcaaaatcccatctttactaaaaatacaaaaattagccaggtgtggtggcatgcacctagaatcccagctacttaggagtaataaaccaaatacaggaaaacgttaattgttgtagaatgtagttagtggctatagggtttaccgaataattccttcaagttttcttcatgtttaaaactaaaaaacagatccttcaaatacatttccatgctgctacttcacatgcactctgtgaacaaatcagatttccctacatatcgggaatagagaaacctcactggttttctgttttctgtaaaagaataacttttattccctctatatccttattacaaaaaagatttgaagcagttattagccttgtattacagacttctacagttggaagtaagaggcaataatactcacttatcctaagaatcctaaactttttttatatccattaccaacttttgaaattccctaggttttagggaattttaggttggagatttctaatctagtcaactccttctcttctagatatagcacatttattcacagataatctatccccaaaccagtcttatatcacactacagtgtatttagtcaataggggaagaaaggtgaaagtctctcaaccagagagaattatatagtcttccaatctacttactgtatgtcacaaggaaaagttgatgtttttgaaaaagaaaaaagagaaaaaacctgtacagagcagggcatacctcttgttctgcctgataaagtttgacagtgatgttcctctggaaacccacatcattggcatcgtagaacactccaagactggtaataacgatggggtagagaactcggaaactcacgctgacaactcgatcctcaggcagccccgatgaagtgtcttcggacagactgaacgcttcaatttcctgattcaaaactaagtaatgagaacaggtttatataactgaacaaatgtaatcctttgttttactagtaagaagtagtgaagtgggcttaatgccaaaacctaggtaatcatttgctatataattcacaaatggcaggaatttttaaaaaatgcttgagaaaaatggctgcttctatataaacatttttgaaatttaagaatacagttttcagccacatctaagtaagttaattatcagaactgctttaatagctttttgcataaatgtgtgcatatatatgtataaacgccacaggagatattaaatttaagtcaactggaaggcatctatttggaagggttggataaatagaaataagaaaaacagtactgactgtagtcataaataatcagtaaatttggtcttactgtgcaaattccaaaaatcctacttcttgttaggcaatttaaaatacttgtgatacatcaggcaattattacggtataaataagcaactgaagtcacttcaaataacactgaaaaactcttgctgtacagcactgataaaagataagcatatcaaacacagttttgaaccatcttctatgtaccatttcccatcacatttatatcttcactactacccttgtggttgtggcattatctccagtttacatattaagaaactgaggcccaaaattaagcaattcacctaaggtcatagaaagtggcagatccaggaatcaagtcccatttagtgattccaaagtcagtcccctttccactccctcacagctgtctaatcagtgccaaaacagttcaaataatttttcttttatttcttcttttgagacagtcacccagtcacccaggctgcagtgcagtggcatgaacatggcttattgcagtctcaacctcctttgctcaagggatcctcctgcctcagcctcctgagtagctgggaccgcaggcacacaccaccaggccttgctaattttttgtagagatgggggtctcatcatgttacccaggctggtcttgaactgcaatcctcccgcctcagcctcccaaagtgctgggattacaggcatgagccactgtgcccagccttcaaataaattttctaattaccataaatgaatcagaatacattaaataaagcagttcataggcagggaatatcagtgctactttaataatataaaaccctattttaaaagattatatcaaagttctttgtatcttttagagctgtggttttcaaattttgctgactacacaacaccatcagttaaaaatatttgtacacacacctatttacttacaaaatatatgcatatattgtggtgagtctatatattcagtattaataaagattgtattttcttattttcagataaatagaaattctaagcctgggcaacatggtgaaactctgtctctacgatacaaaaattagctgggcgtggtggcacacacctgtaatcccacctacttgggaggctgaggcacgagaattgcttgagcctgggaggaagaggctgcagtgacctgagattgtgccactgcagtgcagcctgggcaacagagcaagaccctgtctcaaaaaaaagaaattacattttcttcctatactctaggtcatttggttgcccacgtcagacttcctagaagctctttacactcagtagatattcaataaaatgggattaaagggaagtgatgactcctacctaattatagacatgaacaggagggaaaaaagggagaatacagttttttgtcatgggctgggcaagcactaactggagagtctagactacaacataatggacaacaatacaattttttctctttaagatattcagtaaataatagatatccatagtagaaacctctttattaaaagcaataagtcaattataatatagcatttttagatattttcttatctaaaagaattgtgccttgagcttcaagttacgtggacacaggaaatcccgttgcattacagtgctattaaaccttctaccacagccacagtatcacgatgattaatgcttaccatgaccttcaggtactgaaataaccataactgcctttggatcatcgaaaagataagattaggttcaatattaacttagttatatacacatttaaaaattcataacctaggtattacatatatgaaaatgttcttttaacataaagttctacttctttacttttaataaataacagcacttaagataataaaaatatggttaatttaaaagtgaagggcttctttttgttttggtttggttttcaattgtaatttgttggaggatacatcagtggataccacatcagtgacataacattctatggggtttatgatccctttaagactccagtgaggccaggcgtggtggctcacgcctataatcccagcactttgggaggctgaggggggtggatcacgtgaggtcaggagtttgagactagcctggccaatgtggtgaaaccccatctctactaaaaataagtcaggcgtggtggcgggcacctgtaattctagctactcgggagactaaggcaggagaatcgcttgaacctgggaggtggaggttacagtgagccgagatcgcgccattgcactccagtctgggtgacaagagcgaaactctgtctccaaaaaaaaaaaaaagacaagactccagtgaaagccaaaggactttctccccagcacacaattcatacataaaatttgcttacaatgttaactgaattcacagacatcctaagtaagaaacctctattttgtaatacagacctgaatatattgtccaatttatttaaaaagctgtttgaaacccagctttataaaatagcaggctctttaaaataatgttcagtaccttccaccttctaggaactattattctaaatacatcatatgtatcaacttatttcatccttatgtcaatccccatgagggagattcttttatcccaagtttacagatgataaaactgaggcagaggaggtcacacagctagaaaatggcaaagcttggattgagagccatggagactgcttataaaagtgaggtgttacttaattatacagttttaacaaaccttaaaataccagaagtcctaatcagcatatttaagacttggaagtataacctcccttagaaacacagctgaacataatgggaattgctaataaacacagacagttaaaaacttatcaacttcctaaaattggttccctggtgacacagagaacctagttaggatcagctttctttcgttgtctttgtttttgagacagggtctcgctctgtcacccaggctggagtgcagtagcggaagcagatcatagcttactgcagcctcgaactgctggacccaagcagtcctcctacctcagcctcccaagcagctggaactacaggcatgagccacaatacttggctaatgttttttttttcagacatgggagctcactatgttgcccaggctggttttgtgctcctcctcccaccgtggtgtcccaaagtgctggagcagctttctttatcctcaccagaatttttacaaacttttaattttaaggcataaataatgttacttgtgtcttacattttttactattttttcttttacagaaataaattagacaataattctaagagaaagttgattcataatatttgtttcttcaagattattataaattaactggtaaaatcagcagttttccaaaacttcaaaatttggtaattcaggatttatctaagcataaggaacttccaaacgcgtatgaatcacactgaaaaataaagtctcctggatcctaaagttccaattctgtaaagaatctctacagataccccaaggcaatctgtcaaaaatgatgaaataggctgggtatggtggctcatgcctgtaatctcagcactttgggaggctgaggcaggtggatcacaaggtcaggagttcgaggccagcctgaccaacacagtgaaaccccatctctactaaaaatacacaaattagccaggcgcagtggtggtagcctgtaatcccatctacttaagagaggctgaggcaggagaatttcttgaacctaggaggcggaggttgcagtgagctgagatagcaccactgcactccagcctggacaacagagcaagactccatctccaaaaaaaaaaaaaaaaaaaaaaaaaaagatgagacataaatttggatgacagacattttagtctattaaaaacagactccagggcatggtggctcatgcctgcaatcccagtgctttgggatgctgaggctggtggatcccttgagggtaagaattcaagatcagcccagacaagacagcgagacctcaactctacaaaaaatttaaaaaattagccagttttcgtggcatgtgcctgtagtcctagcagggtggtgaggtaggaggatcgcttgagccccggagtttgaggttatagtgagccatgactatgccactgcacgccagcctaggcgacagagcaagaccctgtctctaaaacacataataaaataaaataataaaaaataaaaacagactccatactattaagcttagcaacttttactcaacatcaagcttgtgtatggcagtcaagggaaaagatgacttacctggatttgtgatgttgagtagtttacaggaataaggatcttccctgtcttccacaggcacttcacagccatgagcacctattatgaacttcacaagcacactgagagatgtgttggcattaacatcagttactgatcttcacctcgcacatgcacgtttcctcatgcccatttcagagcttttactttgagacacaagtgtttatgaggattaattctctacctttattcttctagtcagacaaaatgggggaacaagtaaactgaaagttgctaactaccaagttacttatgcatgagtcctttattgcaatgctatattaaagcaagtatgaatatgtctggcctcgctacaagcaaatgttcatatcatttaaaagcaaactatagtaaagtcagttctcatgcccatacctaaaaacatatctatatctaaaattttcctttgctgccttcttctatttcagaaagtgttccttttgctcaagattaggtctttccatccaagaggaaatccccttctctcctagaccttgcttcactggttacccccgtaactagtgactccttccctccacattacaaacatgataaagtcctgactctaattattctcttcaccttccatccttccttgccaccacactttacactgaggtcctacaaagaaattaaaactgcagcctgtttcttacttcccactcattttataaaacaagagttttagctttaatatcaccacctccactgagattccactaatgtaaccaatgagctgctgctaaatcaatagacactcttgaactcttaccttcctggtttctctacggcttaatactgcccagctccctaaaatgctctcttcccttccttctgtggcctgctcagtcatcttcactgcctcttgttccccagcttgtccactgagagtggtattagtctagggctctgcctttgggtcttttctcaatctactcattttttttacttcctctccctaaacaatattatttattctcatggcttcaaatagcatgggaatgattcctgaattagtaactccagttgttttctttttttttgagacagagtctcgctctgtcacccaggctggaatgcaacagtgtaatcttggctctttgcagtctccacctttcaggttcaagtgattctcctgcctcagcctcctaagtggctgggattacaggcgtgtgccaccacgcctggctaatttttgtatttttagtagagacgggatttcaccatgttggccaggctggtctcgaactcttggcgtcaagtgatctgcctgccttggcctcccaaagtgctgggattacaggtgtgagccactgtgtccggacctgaattagtaactctagtttagacccatgtaaaggacctgtaaattcactggacatcttcacccagataacccacagacagctgtgtgctaaagcctgctactactggcttctgggagccaactgtcaacttttcagaaattttgtgagacggttattaaacatagcctttatttaaaattaaattatataatcttataatatatattaaaatcaaaggaaatactcaaattaatcacttaatgttttactacattttactattatgttcttgagatcatttatatttattacatctacatggtggaaatagtatatatggcatgctactgcttatctttcccccactctgtgttcagtgatgtcacattagtcacttgaattggccatagtggaaatattcacaccctagaaactggcaaataatacaaataagggtttggtttattgttttgttgactgtctagacttaagaaagtatagagaaaatgttgataatgcaaattaagcttaatgtgatgtgtctatctatagccactacagagtgaatagttaaaaaaaaaaaaaaaaagtcaaggaagatacgattccagtgttccaaaactattacctgatacagcatagaagtcactgactttattaagtgtaaagctgacatatcttagttgtcactttagtcctcacctcactgtttaacttaaaagaaagacttttgtcacaactacactcttttgttaactgcaaccataagttggtcatagataggagagtctgacaaacaacaaaagcgttctatgagaatcaactggtttcatggaatttacgataaacagtattgtataggttattatctgtcaattacaggctgtatatactttatgtcaataaaatttataataaacatgtatgtacatataagcatcatttttcccagagagccagttagtaaacctttatcagtacactactgcctgtaggaacctcaaggtcaacatatacacaactgagtttctttcccatgaaacctgctcttctcttttagtatttttgttttgattgatgattccactattctccaagtcagaacactagcaatcttcctagcctcctcctccattttctacattcaatgaccttattctctcacaaggtcacccctctgatctctgtagatcagcccctcagcagtccttgccacaacaggtctcgtccttccactcaaccctccacatgcctgttacatgtgatctgctcactgtctgcctctcacagtcatatgcttcccccctcttttctttatatacacctctctactctcctacctctcctggctgtttctctcacactgtgccacaacccttcccccaccaccacaagccctgtgctcaagttatatagaagtgttaggagtttctcaaacaccccgggctattttatatctatttatatcacagcacatacaacattttattatacgattacacctatttccttctactaaatgtcaagcccctcctaacactctatttatctctgtattctaccacacatactacattatttgcttacagaagtacttagtgttgagtttgggtcctttggtgaaatgcaagaatggaaaatatgccataaccacagaaatgcagtttctgttactaattaccaattaaggcagaatacctttcatagataactagcatttggaataaaagtataaacagaaatgaataaatgtgctaactaaattattgcaagtatgtaccaaatttggttttttagccatcttactaggtactcttactagatccacaaaattactgtgtcccaggaaggtgtttctgcctaatatctatttttatacagatagctgatcattctcataacacaaatcaagcacgctaaatttaaagcaagactgttatgatggcaaataaattagtggtgaaatgtctgaatataaactatattcattacatttggttctgagtcattcattcaatagttgttgagtgccttagtctgcaccaagctaggttttaggtattgggaatacaccagtgaaaaaacctgaagccccaatgctcatgaaacctacattcaagtggagaaagacaaacaattttacaactaaatacaatacagatgccagctggtgataagtgttaccaaaaaaaaattaaagccaactaagggaagacacaaacaagataggggtgggctgctatttactatggggctgtctgctagagtgacatctaatcagagacctgaaggaagtgagtcctgaggacattagtgagagaggacgtaggaaatgcaaaggccctgaggtaggggcacttttagtgtatgaaagtacagtaaggcagccagtgtaggggaagtagatgtagataaggtcaaataccacaacaaagacttggagtttcactctgagcaagaaaggaggtcaatggaggggtatgaatagagaattgacataatttgactaattttaaaaggatcactctggctgctgtatggaaaataaaatgtagggggtcaaaggtagaagcagtaagttcagagaaggggacttctgcaataatccaggtgagacataatggcagcctagatcagatggcagtggtaaaggtggtgagaagtcagattctgggtatggtctaagcagcatctggaaggtatgctgatggattggatgtggcaggtgaaaggaaaaatcagggtaacaccaagggttttggtctgagcaactggtggaggagtcattattttctaacagggaaatactacaggaagtacagcttttggaggtggttctaatagtagtgatgattctgaggtctttcatttgctgtgtaataggctctattatcattgcaaccatgaactaaagaaacctgtcttgaaaaggaatgaaagctactatgagtaagcactactagtgacaagaaaattcacaactaggccgggcttggtggctcacgcttgtaatcccagcactttgggaggccgaggcaagcagatcacctgaggtcaggagttcgagaccagcctggccaacatggtgaaaccctgtccttactaaaaatacaaaaattagccgggcatggtggcaagtgcctgtaatcccagctacttgggaggctgaggcaggagaatcgcttgaacccaggaattggaggttgcagtgagccaagatcgtgccactgcactttagcttgagcgacagcaaaactccatctcaaaaaaaaaaaaaattcacaactgcaatttgcttgtatagctactcagtcacaaatgtgccagtgcaattcaatcctgaaagggccttctctgcttatcacctgagtcttcacatacatagaagtcaacttctatgcgtttcttcccctagtccctcactacacaatcttcagaggttgatctcattgagaacagactaaggctttgggcccctaactaataactgagagctatctaatgtcagcatgaaatggattaccaaagctcagttccagaagggtagtcaggaaaaagagcatggcatattacacatactgcagattacacaactaaaaaatactacaaaactgaaaaaaattaaatttatctctgtgaagttagtgaaaagtatatttagacatgcacatgtgtctaaggagagaactgctctagaacagaaccttttaagaattgctattctaaatcaaagcaaaaaacaaacaaaccacactgggtatctaaatactacacatgttaaccagtgaatatactctcttccaattatcatttggcttaaaatgttggttaaatttactttttggcccaaactatatggaagaaaagcaaatgaaacagccatttctcccaggaagagcccacatatctgaatgaacatttctattcaaagtaaggtttttcagaacttttttttttttttaaattaggcagggactcattcccatcatgcaggctagaatgcagtggtgcaatcatggctcactgcagcctcaattttccaagctcaagcaatccttccacctcagcctccccggtagctgggacgacgggcacacaccaccacgcctggctaggtttttcagaactcttatttcaataaaccaggcaaggcaacaactcagaaaacctaccgttgacttaatgtgggatgctgtagcaaatgtctcatccaggtgcttcttatcacgtttcgaagttcatggttattgcgagctgacaacacgccaactaccacatcatagtgagtagatttccactgaggaaataaggccaactgatctagaaataagaacaatacatgagaaataagtcatgtatcaattactatgaagttcaatatgtatcataagtttattacaaaataagcttatgtttgtaggaaattcagataaacacaaagaaaagaatttttaaatcacatatgaacccactatccagagacaaccactaataacattttggtttagagtatttttgtctttcacgtatatatgtatgtattcatgctcacgtaagtatactaattcttcaaaacaaacaagatgtggtaagaatctgtttcaaaaggcaacgtagcataaaaaaatagtaggcattaagagtcaattaggccacagttagaatccaggctctatcatatattaactataagttatttagcttcttgagcctcagtttcctcaactacaaaatgggtataataatacttctcataaagctgttgtaaaaattaaatgagataacatgtataaagctcttggtttggtattaggcatatatgaggcattcaatggcaactaaaaaaaatgtgctttgaaaagtgaggtcctacattaatgttagttattaagtttggcggatgacgctgaaggacttccataccggaaagtaatgcaacccttatttatatcaatgaattctatagccagtaaacctttcactacctacaaaatattctgaagaatgacgggaaagcaacacttttagtaaaaaaaaaaaataataataataaagtaagtcattctgaacggctcattttttactgtcagaaggtctaatgggcagggttacatttccatgtaaaacttgtccttagaagacagaagagaaagatatactttgtccttgtttttcatcaccagttttaaggcttgagagctacaagcttatatatagctctgatgaggtatccatttcatctctttctccagtggtgggaactgatccaaaacgtttccaaaaataaattattgaagcccagactctttactatattaaatgcaatgtttttatataccatgggatctaggtattcagtctaaaagacaacaaaaccaggttgatattttcttcaaaggcccaattaaaataataaaaacagatctttctactaggatagttttaaggatataatacagaaatttttgtgtagataccttattttccacaatagatatatttcttaaaatgtttcattctgggccaggcacggtggctcatgcctgtaatcccagcactttggaaggccgaggtgggcggatcacctgaggtcgggagttcaagaccagcctgaccaacatggagaaaccctgtctctactaaaaatacaaaattagccgggtgtggtggtgcttgcctgttatcccagctacttgggaggctgaggcaggagaatctcttgaacccgggaggtggaggttggggtgagccgagaccgcgccattgcactccagcctgggcaacaagagtgagactccacctgaaaaaaaaaaaaaagttccattccaaatggaatagaggtatttattatttcactctacaatgagtcatgtactaaaacgaattcttttataaagacaatttatttttaaataaattcaaattttcatggattaagcttattaataggccatatttattgaacagttaatctgtgaaaagcactacatatagagtatcatttaatgttcacaaccctatgaggtaggtacttgtttctttttttttttttttttgacggagtcccactctgtggcccagtctggagtgcagtggcggcgctctcggctcactgcaacctctgccgcccgggttcaagtgattctcctgcctcagcctcctgagtagctgggattataggcgcctgtcactgtgcctggctaatttttgtagttttagtagagatggagtttcaccatcttggccaggctggtgttgaactcttgaccttgtgatccaccgcctcggcctcccaaagtgctgggattacaggcgtgatccaccgtgcctggcccagtacttgttgaacaaatgaaacacccaaagaattcagtaacttaagtcaaacagcttggaaatggctgggctaagatttaatcccaggcaatctaacaccattctttatcactgttctattctaaagctatacagcttaatatagcttatctgagtctaaattctgatcttttaatccacaataccagttcaactgaattagcaataagcggatcattgaatacgctgggtaacacatcaattttttttaactcatagctcagaacattttttctcagatacataactatatgatggaagttgtacctagtgctggaactcactctaaatgagtgtctgaattcagagactaatttaaatgactatgtaaaactgacaatatgcctccccacctttttcacagagaaatatgtacattctagtgtcaggaaggaggcaaaacaaaggtagtgaccagccagttctgacattgattccacagccaagattttgcattacgttagtaagaaattatttaaatccctgtgcttcaacttcttaattagagaaaactgatacaaaaaaaattttggatattctatttcatttgtttcaaagtctcatctcaaaagattaaaagctgtagggcaaaaatcacatttaatctaaatgcctcatttatctgacatcatcagaaaataaggatgctgcacaaaagcaaactttcaaaatatttgaaacatcacttttaattccaataatttactaccttatttttgatggctaatcaaagcaaatcttttagaaatagattacatagaacataatttaatcttttcttgatgtctcaaaatcttcatgaaaatttctcaaatctatccctttcttgtcattaattctagctgctgctcagttcggtctgttttttcacctggaccagtacgagggcatcctaactggtttttacctgacttctccatataattgtcaaacaagatttttctaaaaataataaagaaatacaaagataaccatgtgacatgtgaaaatcccatggattatggatggaaacctctttttgatcttattccacctctctgccactctcaatcccccctgcttctaatccatgtctaagctgcttctgttcaactgctttactttacatgcatttctctttttcttgcagagggaaagtaacacggcatatcgtggtcttttagagaactacttcaagatatattgaagtcaaatgtcagaaaaataggttttttaaccacataccattaatgtaaattagtccaatagactcctgagtactgtgttacacagtacaaaacccaaagcagatgcataataaaatacctatgtaagaatgttgctcaaatttctagctccctttaccaatctagctctaaactcttatcaccttttatgttacaagaacagggtacctagttgactccagtgtctagaaacagagggaaaaaaagaaagtggtaagaagtaaacatgatacagaaggacataaagataattcagaaaagaaaaaaggcaaatagcaagcctatgaaaacatgttcaacttcaataagaatcaagtttgaattagagcaatgagacaccagttttctcctacattcaaactgacaaatgtcttcttaaatgattgtaactaaatgatggtacttcaaggaaatgttgttagtgatttcaacaaagtggctactctccgccgggcacggtggctcatgcctataatcccagcttcaattttgggaggccgaggagggcagatcacaaggtcagaagttcgagaccagcctggccaatatggtgaaacctcatctctattaaaaatacaacaaaaattagctaggtgtggtggtgcatgcctgtaatcccagctactcgggaggctgagtcaggagacttgcttgaacctgggaggcagaggttgcagtcagccaagatcccgccactgctctccagtctgggtgacagagctagactccttctcaaaaaaaaaaaaaaaaaaaaaaggctactctttttcattgcgggaaggaatgtaatttggtacagtcttctgcagggcaatttggcaatgtgtcaaataatttagaatggtgtaactttgtccagcaattctaagaactcattctaaagaaataatcagtgatacactcagaagatctttattaatcatagtgtcacctattaatagcgaaaaactgcaagctacataaacacataaaggactcattaaataaattatggtgtagctatatgacagaatactatgcagccattaaaattacatgttaatcatatcattaaacattattctattaatacatcatattaagataaacaggcgataggaactatgtagatactagacggttctgtttatataaagtacaaaagtagccaaatttctgccactggttactatccctggtagtgacaaaacagagcatgaagggaacttctgaagcactgatagttttctttttttaaatctgggtggtgattagttgggtgtgttcaatttgtgaaaatacatcaaactgcgccagttttattctcttgatttattcactcaaatgacagagcatctcctatgctcattgttctagatggcacagatacagcagtaaacaaaatcttcataatgtcaggactaaatcacaatcccaagcaagctccctgagggcaacgtaagggccaagggaaagttttccctctgaaggttcggtgaaaatcactgacaagagatggacaggagaaaaggcatataaatttatttgatcagtaaagatacaggagaaagtgcccatttctgtgcttaggtttaacaaagtatagatagctatgtggaattaagattggacagaaagggtaggatctaatgttaacagatggagttggaaaacccagcaaggcctgtctagattcttcttgtcctctctgagtatacattctttcctactgggtatgggataggaccctctctggtatgaggttcttatgacctgtaataaaagaaggtaagttaggtaatttttatatagaaaggtggtggtgggggctagttagagtaatatgtttaggttttatggctggctttggggaagagggattttagtttctacagctagcctcaggtgagaatgcaaggccagagagaggacagcagcagcaggtcagagacagctgcttctgaggccttattttggggtattgttttcttctgagaccctacagtaagaactatttcttttcttaatatgtaatatatcctgagagtctggcaacctgctcaaccctgcactgtgagtggacatccaaaggtatattaaagtctaagggagggcctggcgcagtggctcatgcctgtaatcctagcactttgggaggccgaggtgaatgaatcgcttgaggtcaggagttcgagaccagcctggccaacatggcaaaacgcagtctctactaataatacaaaaattagctgggcgtggtggcacacacatgtaacagaggctgaggcaggagaatggcttcaacccggaggcagaggttgcagttagtcaagatggtgccactgcactccagcctgggcgacagagtgaaactgtgcctcaaaataataatcaaaaaagtctaaagaaggttgacatcaaaattgattgctcaaaataagcccaagagtcttaaaaatcagaccaaaattccactctgatatgcatgctcttggaagagtcacaaatagatacaaatcttgaaaatgaagaaaacatgtgagcctgtcacagatctaatgataaagacaatcatcatacacactaccaaagacacctcccaaaacaccacactagcacaggcatcagcggccaccagactaccactcctctctcaaactcatggagtgtttactatgaaacaggcactgttgcgggtgtttcattaattgaatcttcacaataagtctatgagatcatcatcttataaataaggaaactgaagcacagagacacaattagcatatagggataattttggaagaactcaccccaggcaaaattacaaagcaagctcaatttgttttctgaccttctacttgctctacatctgtttccattagatactgtgagcaccttgggagaagggactaggcatccagcacagaatctaacactcaagtacttgttgagtgaatatgctcctttgttttggtttctttctttccagataccctagaaagcgaagccttcttttgtcacatcatttttctaaattaaccgttaaataattcctacttaaggcattacccaaaacgagcattttgtaatcaagatatcctatgtttagattccttagtccgatggttatctccacctgcattttcctctgtcaccctcaggtgtactggatttcacttcctctttaccagttgctttccctgactggtttaagggaacctatcacattaaaaaagttgctgattctggtactaaggtgactcacttacttcattctggtccctgctcaactgttacctcttcagaatggaatggacttccctgacctatttaaaaccatctctttaatctcttaacactgctttatcttttttccctatacttatcactaccgctgtgatatttataattatttcctgatgctctgtcttcccttctaaattgtaaactacatgagggcaggaagtttagcttgattactgctgtaattccacacctacgataggagctggcacagagtaggctctcaaatatttgctgaatcaactgcgagccaaagaaccttttttaatattcagggaaggtaaatcgctctttcaaaaaaaacaaagaaactgccattacttaatgagactgaagacagacaaagcagcagaagaggaaaaaaaatacatttaaaaatgttaattcaagaaaagaatacttagcaaaatcttgggtttttttttctcctgttaggcttaaagtacaagggttaaaatgtaaaaacacccaactattttagtttcaacatggtgacagcacaatggtaaaggaattatgggaaattttagcatttaagatgcttccactgcttttagctttgaaagtaccaaaaggaaaaaaggaaaggtaggagtcagtcttgtttaattaattaattaattattttgagatggactttcgctcttgtcacccaggctggagtgcagtggcgcaatctcgtctcactgcaacctccgcctccgaggttcaagtgattctcctgcctcagcctccttagtagctgggattacaggcatgcaccactatgcccggctaatttttgtatttttagtagagacggggtttcgccatgttggccaggctggtcttgaactcctgacctcaggtgatccacccaccacggcctcccaaagtgttgggattacaggcgtgaggcaccgcgccgggccagtcatgtttaacttagattattaaaatatcgatggttgacagctgcagcaaaccaccatggcacacgtttacctatgtaacaaacttgcacgtcctgcacacgtatcccggaacttaaaaaaaaatcccatttattatctgaccagatatacagtactcattcaaagccaaagttaattaacataactagtattgatcttcttacctacgttattaccctgttcctttctatggtctacttcttcatttccttaatctagcctggtctaactactggatggcagataaaggcatcatccttcaagtgcagtaagggagtaggaaaaacttgtctcaaactagaaaactgcctagcaagtctactaagatttcagtttgaagtctactaacatttcagtttttgtttgttttactgaaccctaaacaaccattaaggccataaacagacttaatgacgctctacaaggagattccagcagggctcactcataacaaaagagagaaacctgtaacacacaagcagctgttacaaagcattttttataaatggcgttctcttcttagttcacttcacaaaaacctaaaaaacactgagcaaaaccctgaccccatcaactggttaagtgcatagcaacactgtactttcattaaatcacttaaatagtgtttaattctattcaggtcacacaaatccttttcaaagagctagtgatctaataggaaaagagattgttaccaaaataacctcaacataatttcatataactgagactgttttgaggattgccgaatactttctacttataaggcatagagtgctgaactgcaaacactcaattctaattttaagaacttttggattagaaaacagctgttttggggagagatggtaagggaaaaaagtgccagtatagttacaaaattaagtattacataatatttaaaagagctttctaggtttctttcatgttctagggcaagcccttaaagaagaagacaagagatacagggaaagctaaagtagtgttcagggtggtggaacccactaacaaaacaatccgctgggcaccgtaagtaaagcattctattaggctgtgacgcgaaacaagaacaaaggtttcattcctacgagagattaagttttagagcaaatggacacgatcgttaaagaatttgatatttccatgtaaactgcattagcaggttatgcgatccaaactcacaggaacaactccaactctcggccatgccctatttcatgtctagatttgtttaaccgacttacatcataatccaagaatacgaactacagtatattcttacagcaaagttattccttaaaagcaaaaccgagccacctttgaaaacacgcacacacattatccacggcactaaaaccccagtcttgaccgagaaagaccaacaacttgggggggaagaaaacaacttcagagccagagctcccaaagcagaaagcgctggcggctgaagggcacacgaggttccgctcccgggcgaacgggcggcgtcggacatcactaaccaggcctggggacgggcgaaggacttgcagctgcgggcgccggctctgcgggcgttaaggcaaacggggaagtgagaagcggcggggacacgaaaagagaaaagctccctcaagtttgcccgatgttaacgctccaaggatgaaaagagccgtttgtttcgtctggggaccgtcgcgtttggcccttcccccgcctccaacaattcccggcgaagccccgcggcaccaagccgggcctcccacccccccggcggccgccaacccgcccggccccaggacctcacctgcagggccggccccggaggcgcaggcgggcggcggggagcgcagccgcagccagaggtgcagcgcggccccgagcacacacgggcacagcagcaccagccagtttcgcattggccgcccccgccgcgagccgggctctcccgcgtcccggcggagagggaggggacctgcaagtgcggagactgaggggcggcggctgacgagcgaccactccgagcacgcccgccctcgcgctcggcgacgtctggagggctcctcgcagctcccggccccgctcctccggtccctcagaccgcgggtggccgcggcttagccggccgaagccccgccccctccgcct

SEQ ID NO: 2062 - DNA, 161324 bp, Homo sapiens; identical to SEQ ID NO: 2058

SEQ ID NO: 2063 - DNA, 585108 bp, Homo sapiens
tgatttgctctcgggagtgcgctatttgcatatgacttgcccatttgtgaatttggctccccaactcctcgcttcacttcacctgtgcctccctggtccgcgcacttcgcaggcgcccgcccgcctctcggccacctctgcagcctgccaggcacctcctcttgcgctctcgctgatttcgcccacccacctccctccaccccgtgccacgttggtttgggtggctgctccgcaccgggttcctcctcctctcctctttccctccagtccttcttattctcttcctctggctgcggtggctgctgctgctgctggttttcatccagttgggaaacccaggaagccggcggctgctccgtggcgctagtccagcacgcccagggttaaaagcctcgcgcccttccgcggagactcccaggaacacccgaagaactcttccacctgcagcccccttttgcctggcagttctgcattgcatctcatggaagtggaaacaggaaaataaaaatgttcaaactccttggatgttgggataaactcacctgaacccacttgggttcgggctgcctccttctcttccttcattgccacctttcctctgtgtggctcccgggagtgtgcggttaagtcatcagactcgaagtgcctagagatccggaggaagccgcgccggtcttcccctgacatgcgtggcatgccggggctccgtaggaggtttgctatacctgggaggaccctggcattctaaatttcagctccgggaaagagaaggggctttttgccttttatcttttttttttctttctttaagtagtaattttttaactgattcattgtttggaaagcgcatattgcttccctcttccccgaattctggcaactcttcctcctgctatgatgggcccttgggcatcatgaacttcattactcctcactggctggaattcaaactgcccatctgtagtggtcccgtgcgttgaccatgcacctgagaatccacgcgagacggagccctcctcgccggccggcctggacgcttgggatctggttcctgttctggggatgtatcgtcagctctgtatggagttcttctaatgtagcttcctcctcctccacctcttcctcgccggggtctcactctcagcacgagcaccatttccatggcagcaagcatcactcagtgcctatttctatctatcgttcccctgtttcccttcgaggaggacacggtaggtctctctgctctttatccttttaatggggcatagcaattcgctaacccactagccttgcaggtagtgtcaaaggtgggaagggaatttaaaaaaaatgaatttaaaatgatgaaaagcatcgtatgtccatgagggaagcaaatttctactttctcataaaggttagtgttttctgcccctagcctccgacaaccatctccacttttctctaaagggttcttttccccttagctccctcattcatagctgcacagacaccacactctctcttttgcaaccttctactctctccacccccacggagacaggcaacttatcaggtgagtcccagtgctgtacttggagaaatattcattcaccttgctttcacccttctttgctgtggtcttgcttgggagctagtgggggtggggtgggaatagctgacaacaggaatcaggttttcagcctgaagttgattgaactgttataaagtagcctgtgtggtaatggtcagggaaaagtagccgaacataagaaggcagaaaatataattaacaacctgtggccatttgtgttgaatttggcagctttatgtttgtccacatatctagtggaaaaagcagctatctctaaaactacacatctactattgctatcagaaaggaagcaatatgtaagataaggctaagttcatttataatttacccaagtgtaaatgacagtaacttggattccccgtgtatgcaaatgttatttcatctttaggtagcagagatgggcttgttcacacaatacaggtacgatgggttttactccaaacaaccctccttacatggctattgagggaagagatctatggctctgaaaatgatactcagctgttagccggctgcctctaaaagggcgatgtctgcagctaaggtaggagcttgctgtggtaaactgttctaaagaaaggagcttcttaatttgtttactatgcactccactctgatggtaaggagagtaggacacacagaaatggagactggtcttgcttgggagctagtgggggtggggtgggaatagctgacaacaggaatcaggttttcagcctgaagttgattgaactgttataaagtagcctgtgtggtaatggtcagggaaaagtagccaaatataagaaggcagaaaatataattaacaacccgtggccatttgtgttggttttggcagctttatgtttgcaggaacagccctccagggaacatgagcgtgaaccatactagggggttcctgcccttgtattttgaagactgataacatccagaccctatttggaaagttgattcttcctgctgcctcctagccctgagctttggctttatgctgtctgtagtgtaagtggaagcacattgagaaaatgccagcacatactctggctctttttgactctgtctttaaattttatttgatggagttgtcaagcagctcacagcttgtaaggttggtggagggggatggtgaaaagaagggattgcttgatcttgatctggtggctcttttctctgtgactcctgctgggtctggtgttggctcccttaaaaaagaaagaagcaaacaaacctaggagaaaaaagagccacaaccaccaaaaaagcaatttcattgacatggaaacttagctcctaagggggagagggactggggggagcgggtaagacaggaaaaaaagagggagtgggagataggggaagccagagagactgttactaatagccataattaaacacggaaatgctcagagattagctaaattttgctaattactgtaaatgatcagcagggagaggaagattatgcattacaggttatgggtggcagggtcttgatatcttttgttcgggttgtaaacagttacagcagatactagtaagtgatggaatttgcagagcagtacttccctagggtccctaagtcagagtcagtctctctctctctctctctctcataaaggggttgagccttgcacaggttaaacatgaccctttatttagtttatttcttcaacgattggttgctcagtctcctttaaatctttttgactggtccccagtctagtttctcattaacctacatctgataaggttcagtgtgatggaaaataagaagaaagtaagtaaatggctagagaccccagaaaaggccctcagactcaccagagctgtagagtacagtgaactccatccagggtctggcatggctgagataagaaaactcatgaattcagctcttcagaatcctctttcaatcctgaagtcccaactcattgatttggggcttggagagtgaatgcatctgtattaagtagactccttgcatatttaattggtgtttttgagcataaaatcaagagaagcagcaatcaacaaaatatccctacctctggcttccatcctgcacccaagctgtgaccctttgcgtctctaactaaaaggaccagaagaccccacagagctttgctaatgcacttctcattcttacttggtgtacacttgctttttcctagtccaagacaaagacctagctaacagcaattgttttaaaaaatatttttggatggaggtggtaggaggcatggcaccaagagactgatggttgttattgatgatttactgccaatcttattccagagttaaaggcagcactctctgttgtctgtgaaaaagtaaatgcccttgattttggtatgaaagaaaactagagccttgagtccaagaatcttctttggacttaagagattgttgtttttttaactacacttgctcttcccttgcccatttcctgagaagccaaagtcctcaaagctgctgttcatcagttggtgctcccaccccctttctctactatccagacctatagagagattcatgctaagacagatggaagaaacagaaatcctccaaatagctgatattttacctacacttttgcctgtgcttggttccaagctttagaaaattggttatattatagatttgcttaaagcctttatcccaggacagcctagaggatgctgggattctttgtaaattagggagactaaggccacacttacctggggtgcccccaaaaaatctcacattaggattgtgtttcaggataggattaaccttcttcttaatgggaatctagtaggctcttccccattctgttagagtcctcaccccactttcatgctctcttctgttcaccagtcagtcaatactctttgagcacatactctgtgccaggctgtgggctactgctgaagatacagaaccgaataagacattgtggtgttcagctaggaataattgcaaaagtatatatatatatgcttccatattttaaaaagtgcaaggagtgggtggagatccaaataccaagcgaaattaatacaaaatcaaaatatcctttataaaatgaaggtttacattatcctgttatttaaaatatccctccaggttccttttcatccttggctttatttccatatgtaaatatcattttttatcaaagtgcaaggtagtttagtgattacagatatataaatagtaaaatatatttgtttaccaagctttaattacataagcaacttttgtatattttttccttctttttttccctctctctcttaaaggtcattggacctttaagaaatccaatgtgtctgggcatggtggctcacacctgtaatcctagcactttgggaggccgaggtggggggatcacctgaggtcaagagtttgagacctgcctggccaacatggggaaaccccgtctctactaaaaatacatatatatatatatatatatatatatatatatatatatatatgtatctccaatgtacatctgcctaaaaaatgcttcagtatttatagtttaaatgcaggtttctctaaggattcaaggttttatatgtaccttaaatgctattctctataaaacagcagactttcctgcctctgtagacgatttgtggggactagttgaggacatggaactcttggaaagctcagttttaaaagggaacacaccacgctatatttgcaggaagaactcttgctcagaaaccagggtgtgtgaaaagggggagtataaaagtcctattcaaaccatcttagcagaagtggtggtgatgggcccccttgtgacacatgatcctggagtctttcttggactcattccttgtcccagggatccacccccaaagttttttcagccttgggggcttgttttgctttgatctattgagtgccttcttctgctcagccagctgctttctaaccactttctttatgcctgccttcttgagattcagggagttgaataattcatagtgttggttgacagatcaaatgataagatttatatatctttggccttggtgatgaattaattagattggtttctccatctttggctcctctagatgcgttgtttttcttctttaaaattcactggtgagtggtgggtctggagattaacttgttcttgagagaccaccataggatgattataatatcctagtgtcaatttcttcaggactttcaacatggatcactgggtggtgtggagtaggggcagctatatcatagagaggagagataagatcatcagaacaaaaaacaagacgcacacacacacacaaaaacttgccgatactggctgcgggatgaaattttacagtaagaacttgattgctttcacctcagattttgaatctaaaagagaaatgtatttcattttacattttagtaaatgaacttatcagcccaaagaagtttgctttactagaactctgggtgaccagggagggaagcaaatctctgaagataaatcttgaacttactcatactttcctccttgtattagtttgctagggctgccataaagtagtaaagtactatagactgggtggtttaaacaagagaaatttgtttgctcaaggctctgtagagtaaatgtctgagaccaaggtgtcagcaggtttagttctttctgacatctctctccttggcttgcagatggctgttttctcactgtgtcctcatagggtctcaccttgatctacatgcatgcatccctggtgtctttgtgtgtccaaattctcccttcttataagaacatccatcagattggattagggtcctccctaaaagcctcattttaacttaatcatctctttaaaggccctgtcctcacatacactcacattttgaggtaccaggaataaagctttgacatatgaattttgaagagacacagttcagcccctaatgctctttctcctcaccgtgcgctgccccccaccgccccccaccatcccccgcccagttattgggaaagaagtaaaactgtactgttcagtgaatacccattggactcaaactttcacagcagaaaaataaaacttcagtgacaatggttgcaatttacaaaattcataagatagtgccctaagaggtaatgttgtgtttacagatatggggaaaaaaacagctattggttcagtgaagacttgtgttttctttcttctcagtttatcttctgtgactgagtccagatctttatttgcacatagactaattctgtctgactgcagacacatgctctaatgtccacacattaaagctttctttacctagacctgctacccttctgacccagaccctccactcctgccactgactcctttatgaactacagttgtttgctctttgcctttcctgaaacacaaattaccaactactttcacatctcagcctttggtgaaaacaagagaaaaaataggttaactaagtataaatttctcgtttttcaattttcatatttctcaattgaaaaatatgttaaataggcatcagtttaattatttttctcttcaattttattttttgaaagttcatctgaaaatataaatatgaggtaaattgtctacttcatgacatggttatgaagcttggtgagatgattgagagaataatatatatatatatatatatatatagtgtatatataagttctggttgttctaaatcctaagcaaagcattccatctttggggaaagggtatacctttctttgtctgtttgtttctgtgctcaaaatgcgtgctgatgttgataatagataaataataatggcattctggtggacagtgtggtgttaggtgaggtgggaacaactatggttggaggaaatagccttcaacctcaacctttggttctaagaaactttgtctctaagaaactaagttactaagaaacattgtgaacttaagtcacaatgaataagtcacttggtttcactgagactcaatttcttcacctttaaagtgagcaataataatagttaaccatacttatatcacagaaattgtatgagagattaaacaagttgtattttgtacattctaaaccaatgtgtacaggttaaatattttatgagacatattttcatgataaggctgccctctttgaattccttgcacaaagaggagcttcaatgttgatcatttgctggttggtagatagtggttaaagaacatgcatctgctggttctcctcattttcctatctatacatacacttttttgcctcctagagattatttcatttacatagtactctgagtaaatgtagatgagaaacactttactgtattttcatgtttatggcactagaacacagcatgggacaaaagtcagcttgtgatttttggtaatggtctgcttaggtagaaagtcatgccaggcaaattttagcatggaccaacacattatagcaaatcatttagaagctcagggattcagtaaagtgaaaagagaggactccaagaaatactctgagatcattttggaaattcagaattggatcccatttgcagtaaacctgtgcagaattcaaacattcctacatggttctcagtgtccattgtaaactaagatttttaatctggtttgtgctgggaagaagcaggtgtttttagggacaactaccttcagatgtggaagtgaagtacttcttttaatgcaatttcttaggcttactagggctcaaagtttgtagagcagataggagcacaatattatgccagaactcttagaattgactttgtgaagcctgaatttgaaacagaattcttactgagagacatggtcctgatacatagattttgccccagttttctccctgaccagctctgtaactttgaattataacattatatttttaaattatattcatcttttaacttttagacattctgtgtgataccttgatttcctaacctatattcttggctttacctgtagttttctgcatggcatgtagtatgaaagctccttaataccatagctggggaaaactttccttttcatatcttcatcatttgtacaatgagagatttgagtgagatgatctctccaaatgttttccagcactggaactgcatgagtctctgatttgtatgtctttaaagacaccactgtgcatcttaaacctatctgagttccacaagtctgccagtattttataggtctattttcttgactatcataataacttatgccaaagccataagccaggttttctcttttcccctcagacagaagcagcataatgtaccagagtggcacactgtgatgttataaagcccacaatccaacttcagtgcagtcacgctgagatgggaagaatgcagctttcatttaaacacaccttaataatgctagaaaggagctctatgttatgtttaaaatattctgctgtgtttagccatatcagagcagggggcagactagcaactgggtttataaagaggaaatggtttatttctatttacagttaggattttgagagagacttgcttgagttatacaccaacacataatgtacacccactgtgtgacaggtactcttccaaatgctttacatatgtgacttcatttaatcctcactagcctttgaacctaataaagtgactattttacgattaaaaacattgagactcagagaggttaagtggcttgattaacatggtgttaaagccaggattcaaacctggttgtgaccagaaaactcttggtctttctgctgtaccacacagtctgtcaactcaggaaacagactacacaaacacatcaagctcttttgtcaggaatcaagtacacagattgatgaagcactttgattaatgcagctaacacacctttccaaagcatctacaagactttccaattcctaataagtatttgaatgttttccaatctgcctgaacccgtttcaacccaaggagatagtaaataaaaggagcagactgatgaaacactcacacttgatatgtctttttttttgaatgaatgaatcaatgaataaatgattgagtgaggttccacatgatcaaatctcttgcactaggaaaggagggatgctagtttataaaagaagcaaaggcacaggaagttatgcacccttcaaaagcacaccaatgggctcgtagaacttagagatataagagagctcaatgttccaggtaggcagggtgaggactcaactaagagcatccagttagtgtcaggactggtcaggagcacagacatcatgactctgagtccattgccttttctttcctctacttctcagtccttcaagacactttcttaaattacaaacttgttccccatctctctttcttcagagaaatctccccttatccagattatgtcctgcaggcacatattctgccagtgttggacttgccaggccttccattaaaattaattattggctgggcgcagtggctcatgcctgtaatcccaacacttgggaggccaaggtggctggatcccctgaggtcaggagtttgagaccagcctggccaacgtggtgaaaccccatctctactaaaaataaaaaaattagctgggcgtggtggcatacgcctgtaatctcagctactcaggaggctgaggcaagagaatcacttgaacctgggaggcagaggttgcagtgagccaagatcacgccattgcactccagcctgggtgatgagagagaaactctatctaaaaaaaaaaaattaatcatgagaatccttctaataggttcctggctttgtgtgccaaggtagggtttcttggtgtgttctgaaggcttcctttgtataggaaacctcagtgtgaaaaagtgctcagattcggggttctgtgaaagatgcttcctgtcctggttggatgtcacttgccagaaggcaggaaagaaatggcctgtctgttcacctgttgctgctcctcatctggaagttgtgaccaggatcttgtttgaagacctgtccccagccccagtcctgacctcttgcttaccagctattgagtggctatgaaaacataaagcccctggaaaccagcaagccacattttctgagatactgtcctgccctcccttttttattgttttgaaatattcctctcacccccccacgttaaaacataaccatgtgtattcactcctgagtgactttcccccaaactatgaatttcaactatttccgaggcagtcgttcagaatttgaatataattacactctttgggtgaaaattgtggtttttgctacataaaaaactaatggaaatgatctgcctgttcctgtagtttacagattatatgcttcagaactgacgatatatatttaggctgcttttctgtgtggcacatttaaatgaaaatgaactcggggtgagccaccatggttgctaggcaatagagcgggttgatagagcacggtattaaactgaacccacattggtgttttacttaacatctatttgcttagcacctttgtcatctgtggtgtcatagaagggaaaggaggaggagacaggcagagtctggttatctgcagagactcaaacaagtaggagaaataatcatcccaaacaccaaagtgacatgagcattttcaaaaatttgaggttgcagcacagtcaactcatttaatgaagaacatgcaagacctgaagaaatgcataagcatagcagacatattcatggatgtggtagcaagaggaactaaagagattccccaggctgggttttgctctggtggttccagaaaaaaaaaaaaaaaaaaaatagccaccacgctggttgaaaattttaaaaatgcgtctatgggtcatttaatttcctggcctaaaatcccagatttatcatgagcaagcggtgataggcagcaaaagcattgcggcttctttacaattgataactaatagaggaactccaattgctttgaaaccctggttttaataaaagctgaaagtctcttataagaaaacaactggatcacaataaagcaaaacctcgtcagactctttgggtccattctagccactttctgatacatttaaaagtttgaaaagatgattaaagggttaaaactcagctgtggggagaatttggtctcatgaataatttgggcagagagaggatcctgtgatttggatagccaaagttttattgtttattttttccaggagccaattattatatatcttttttcattgaatcaatatctctgcataatggaatggtcacctttgaatgttctcttttcttaaaacaaacttcttagataagttaaacacaagatgataggaaacctctattttcataagaatgacaataacatctactttggtttttattatagcaattgatcactttttattatgcctaacatttttgcctttcaatatgcctgacatttctataaacgttatagttcatttaattctcccatgaagtaggtggagttgttttcccattttttaagttttagttatttattttagcagagatggggtcttgcggtattgtccagaccagtctcaaactcttgggctcaagtgatcctcccaacttggtctctcaaagtgctgggattactggcatagccaccatgcccagcccattttcccactttaaagaggcagactcggaggcatggaaagtttgagtcagttgcctaaggtcttataggtaatataaggcacaatcaggttgggtatttaagcagtttgaacctgtcctgttcaaactgcttaaatacccaacctgattgtgccttatattacctataagtatatactgaaattatactgaaaacagtatactgaaaacagtacaatatttcataaatactcttaaaatttcagtatttatgaaatattacctgaatggtgggaaaaaatttcaaagtggtattcttaaatggaatactgggccatttttaaaaggacctcttagggtctacctagatacaggataaattatgaagacagaatattttctaaacaggtaaacacctacctcatatgaggtattctaacaaatactttagcttactgcatttaatctttactgaccatccttcaaggtaggcactattgttatcatgaatttacgggaacagaaactgagccccagagggttaagcaactcactctagttcttccacttactaagcagttagcctatagcatctgttgaactcttaggtcaggtaatctgtgcaaatgtagaacagttcccggatactgaaagcaactaatcagaatgcttccctagattcacaaattctattacattataggagaggcttttcaaaacagcctttggaaactcacaccagttccagaatctgctggcaatgaatagttacatctttacatcttcaatcaaggacccaagagtgagggaccccctctcctttgacagggaagcccattggtgcctcattctcctcatgtttaattcactctaagaatccgtttttttcaggaagtttcttttccagtaattacgataggctttctccccaacttatgattttaggcaagcaaccaaactttcctgattttaattctctcacctgaaagacagggaactgtgaggtggcctgccagctttgctttcaaaagtgtggcattcatctttcattaatgccaaaaggcaaaattccaatgatttctaaaatacttcctcacccttatcagatcttattagatcaccttgaatctacttttaatcttggcccttcatacatatggtagtagttctttaaatatgagggtgaaactaatgaatacgttaagaggggcagtgggtttccaacttgagtgaatatgtgtgtgtttgctttcacatgtaggtaaatgtgtgaaccaaaataaacgatgtaacagaaaaccttcatagcagcccaattagttcctagcttagaatgtaaagatcagacatgagaactaagtctgccgtgcattacagacgtagggaggtttcagtacctgcttcttactgctctggtatcatttatcagtgcagtgttgtcacaggctcatgtcaacatgtcaataataatctcaggagaggatagcttttatgtgaaataggaaggtaaacctagagtcttggccttatacagacaacccccttctttgggatgactagtgttttcatgtttcttgttttttccatgccagggagccattttatgtgtgtgtattggtaacctcatcaactgttagctattaaagactggttaaactaattattattaagaactctctttcagaaaatcctgagatagttccttttacttcccttcacaaagtaacttgatattggtccctgagaaatagatccacaacctcatcaccaagttctccaggccctgaggaatgatcatgcccctaaaataatgttctgatgaaggactttctttggactcaaaatctgctttgcatttgtggaatcatcaaatgcgaaacctgcaagaggtctttagaagcccttttcaatcaagttatttttcatgtgaaaaagctaatagaccagaagtttgtgaatagttttcccaaatcacacttttcaaattagaggcaaggcgagggcaacgtgcaagctttcagcttcgctgtttagtctctttctagtctctttctactgcatcacaatgttagcactcaggctttccaggtgtcatctgttttgctgtggactgggaaactgggattgtctccagcaccacttggataacaaatgagcacagaaggagcagagagcagcatgacaaccaagatactccaaacactcgcactgtttcctgtaattaccatccagagagcagctcccactccgtgtcaggcatgtcaccccctcacggggtctcctgctttctctctgccccagcagcctagaggggaaattcagcatgctgcatttcaatcaaactgtttgatgagagcttttgagcctaattacatggaaggttttatccagtgaaaagaaagaggaaagagaaagagagaaattaaattgaagtataaatcagtcaagagcttagatcccgcgcttgctttctttttaatcaagagtgaaatgagaggagagttttaaggatcatcacaagacaccattaactacccaaggagctcttggctgaagatggtttgtcataaaaagaaaagtgtacaatctgtccataaagaggaagtatctgagggtcgtgctgcagtttaggagcatgacactaaaaggaaggacgcttggtttttccgtgattattttatctttatttcccctagatacctagcatattttctcgcacacattaggtgttcttgttctgtattttaaatcaatgacttggtaaataacgtagtgtgttaactcaggtaattattacataggaaagggtatgttatcaactcattcaatattagatacaacacatgaaatcagtattcaaagttttggccagtttccctttgtggttgatgtagtttgggcatatccctctaatattactgttatttatagaatgctttacagtgttacagagaaaattcacggtaattatttgatccacagcacagccttgtgtggtaggaggacaggtagtatgattgttatttattccatttttttaagctgatgtaatcaaaaccaaagaagcataaatgacttgatcagagtcatccaagtattaagtgacagagcaataactgctacccagcttctattacatcaccctgtatgacctagaatcttgtacagaatttctgggttcttcagtataagaaggataggtaaacagcagagaggagtgtttgcaaaagaaatgcattggaattcatactttattattgagtacttatgatgagcaatgcaaggcactggtccatgctctgaactggaatgtgaaacatgagctttgtccccaaaggcttacagtgtggttacaattcattaaaatgatacttagatctatcctttccatctctattgcattttcaaccatatcacctaaacagttgtgacaacctcccttaacagaccttccttagcttctgtttttccctcctgtccatgtttccctcaccattggagccatccatctgaaacaccagtctgatcatgccgctcttccatgggctcttcgtgtcatttcctctgtactcagaacaaaggctggccccttatctttatgatctggcccctgtgtatccccaacttcacctcctaacatatttgactaccttggccttcatctttttctttttccttttttccccccttgaatatatcaatcttgctactaccatagtgcctttatttgatcagttccttttctctgggatgttttcatccagattgccgtatggccactccttcttcttatacgtcaggcttcaacttcaatgttatcccctcaagagcccttccttaatgacccagtctaaaaagcactcttttttagaaggatcaagattatatgaaaaaatttaaaaaaataaaaaataaaaagcactctttcaaatgtctctccagcataccaccttgttttgttttcactgtagcttgaatatctctgttacagttccttatgtgtgtattgcttccattaacccactagaatgaaagttctgagagcagagaccttgctgatcttgttcatggctggactcccagtacctaaggcagtgactggcaaagactgagttttcataaatcttgctgagtaaagggatggatgaataaatggcatagatgcttcacaaatatgggctcccacctagcattttaacctcaatactcagtaggccctttaaaaacatcagttttagtttgtacttttcccttgattgagaatctctcctatttggtagactgctactaatttttcacgttgcagctgactccataatatctggtctgcaaagttttccctatctcccactgcacagtgagtttcccagccttctgtgtttacttttttcgctatagaagttttctcattgaataacaaaaattattaaacatatattcagtcttctactgttttccaggcactgtccagggtgtcagactcttaaacatacatcagatttgggccttgcctacaagaggttcacgccttggtggaagagctcactctcattttattaaacatgtaacattgcattgctgttatttattgatggtgattgttttcctcattaggctctgcctttcttaagggtaaggaatgagtcattcatttctatattttgattggctgacatagttcttcttttacaaaaggtgcttaatggcactcattaatgaaaaaatagagtgagtgggctgaaaaggtaagaacatacagtattttaatgcacgttgtagtgtgacaaacatcatgagataagtagaaactaccgtggggatttagaggggaagatgtcacaaccaattaggtcattaaaaagtgcttcatagcagaaataaactttatatcatgttttgaagaattatttccacaggcatgcaggagatgggctgaaatatacttgggaaaaaaaaaaaaaccagatgttccagaatcagtgactccatttgctgagttatgggcttgtagagctcagttgtgagaagggctggtgaaggagtttggggctctttgatggaggacgttgagtaataactataattataatggacatctttggcatttacagtttgcagatcagtaatgtaaatactatatgacttgtccctttcaattgccctgtaattcttttatcatgatcactatttacaagagaaaaaaagggtcaaggctgagaagttgatgcttaaatcttataggatggtgctgtatcttttcaaaatgtaaaactggttttgtaaatccctggcttaaaaagataaaacaaaagcaaataaataaataaattaagcctctttcttcactgtttccagtgccctctaaatcaagataaaaatgtttaatgtggcctagcagttcctgcgtgatctggcatcactagcatagcacgtttagcctcatcactcaaaggtccttctgccttcttgattccagcgccctggccttctcccaaccattcatattcaccactacagacttgcctttgcttatcctatttaagcagaatcctcacttcttcctttgatggtcacctactcagaactaagaactcttctttagtgtagcacctcctcaaggaaatccccctgccatttctttgagaaattcaaattcccaggccataggttctcataaccttctagaactctctcctgttgctcatttcacaattcctttttatacatttggttgtgagattatttgattaatatccatttcctaagtagattccactggggttagacagggttgttagaaaataaaaatgcaagacagccaattaaatttgtattcagataaataactgactttttaaaagtacaggtatgtcccatgcaatatttggaatatacttataatttaaaaattttgttgtttatttgaaattcaaagttaactgggcatcctatattttatctggcaacctatattttatctcatcagagactatatctgtttttttcttctagcataatcactggggttgtaacaaacaggtaatcatctaatgttggatggataaataaaatgagtttaaaaaatattctggcagcgcatgtaggctgaattggaatgacaagagactgaatttggaaggactcattagcaaactttgaaaatcatcaaagggaaagttaaggacagggtggtggcattgaggctagatagatggagatgtatagaaggaacatttccaagtggggctcagaatttgcacaggtgttattgggtagcaacccagcactgcgaggaagaggccaaagggccatttcaaattattagtgatcaggattaaaaccagtaacggagagaaaaataaatataatgcctctcatttatatagtgcttcacaacttttaaagtgctgttttatgttccccattatgccccttggtaggagagtattgtttctaaaaagacagccatttaattatcacttttctttataaattcaattacatttcccagtccatgtagttcatcagttcagagatgtttgtcttcatttctgtctattttttaacaggtttcttttatttaagttcctcatttctcagtcctgaatcctttatttctgaagcaccaggtaattttgtattacgcataacaaatctgaaatttatttgtatgagcagattgattttatatccatcagattttctaaaaatgggctataactggcttataatgacatgaccagccagaggctaatttctgtggtatttcttcctgatgccagaataggtagacaagtcagaagcacccacttcagataataaagatataattccagttattcaaatttgtgttgaaagcaaatcctttcactgcttatttttcaattagtgccaagtgtggctccatggcttctagctacagaaggccaggtgatcgagcattcttaaccagatacatgaatagggagaccacggttctgcagttgacatttcttcagctgctctttcagaggtcttaacattttttctcaccagatacttgcctgtgagctgctatttgaaagataaggtgtgctgagtaaatgattaagcaagtgagacaataagaagcaacgtaatctcatcagagactacatctgtttttttcttctagcgtaatcactggggttgtaacaagcaggtaatcatctaatgttggatgaataaataaaatgagtttaaaaaatattctagaacaggggagaattctagaaggttatgagaacctatgttctgggaatttgaatttctcaaagaaatggcagggggatttccttgaggaggtgctacactaaagaagagttcttagttctgagtaggtgaccatcagaggaagaagtgaggatgctgcttaaataggatgagcaaaggcaagtctgtagtagtgaatatgagtggctgggagaaggccagggggctggaatcaagaaggcagaaggacctttgagtgatgaggctaaacgtgctatgctagtgatgccagatcacacaggaactgctaggccacattaaacatttttatcttgatttagagggcactggaaacagtgaagaaagaggcttatttatttatttatttatttgcttttgttttatctttttaagccagggatttacaaaaccagttttacattttgaaaagatacagcaccatcctataagatttaagcatcaacttctcagccttgaccctttttttctcttgtaaatagtgatcatgataaaagaatcacagccatgtagaggacgaaatgtgagcttttaactccacatacctgagtgtcactgatcactctctcagtaggtcacccagaggttagcaaacttttcctgtaaaggaagagagtaaacatttccagctttgcaagcaatatagtctctgcctcaacaactactcaacactaccactgtaatgtcaatgcaactacagacaatatgcaaacaaatgagtgtgagtatatcacagtgaaactttatttacaaaaacaagaccacctagtctgcagacccctgcccccagatttcagcttcctgttatgaaaatggccattataaaacctatatggcacagttgttgtgattaaacatttttacatacccaaaaaacttagtaaagaatcaggcatattaatgagagttcagtaaatgctaacctgtatcatgattataagttttagggctgcaaggaatcttgggtgtgacagacaattttctcctttcaaaagatacctagatggaggattcaagaagtatagggacttaaccagggttacaggatctattttcccgcaatcctatttgtataccacttccagaaaccccaagaaatatgatggcatgaagccaagctatatattgcgggatatttgagcatccattcagcatgtatgcattgaatgtcagccatgtataagacattgtgcagtatattgcaagtgacacaaagatcaataaagttcctgcgttggaaaatctaacagtttaagtcaccctagtaactataatgaggtggaaagcgacaagtatcaaaggaatgagtgacccctacgtgccaagcactatgttgaagtgcttacatgtgttgtctcatatgatcccccagcaggtggatttttagcatttcatcctcaatgacattcaaatgttaagtaatctgctctaggtcaaaagttactaagtgatagaacaaagatttaaactcgtttctctaattgcacagtgtgctttctaccagacgctggggaaatcctcatacatgaagtatggtttagttagctattgctacaaaacaaacaacactaaaaagttgtgtttaaaatgggcatgttatttgcttgtgattctgtgggtcagcagtttagacttgactcagctgggtagcttggatgatctcacatgaggtccctcatatagctccagttatctggcagatagacgggggatgatgatggtctaatatggtctcacacacatatctgccagttggttctggttattaggctgaggagcctcacgtgatatctctgtgctttgtgacctctcatttggctaatgttgactgcttcacttggtggtctcagggctgcctcccagagaggtatataacaggagcagcaactcttgagagcttggaaatcatacaagaacactttcgctgtattctgttggtcaaagcaagtctcagaatcaggctagattcaatgggcagggaaataggtgacgtgtcttagtgggaggaacagcaacatcatactacaaaagggtgagcgtgcaaggatgggagggtttcttgctgtgtttgccaacaatttaccataaagtgataactgagttggaccttcacagaaaataaagatttgggaaataaagactttgccagagcagggattataaagaagagcattacttcagattagctgagaatgaggccacacgcctatattgcattattgaggaaatttcctcttgcctttgctccacaagcacattgcttctactagttgcagggacataattaccaatttcatatatataatacttctaacttttcagaggatttttatttctcctatataacgtttaatatgctatatagttttgttgcattgttttactctgctcattcctttcctctctgtaagttggtgtcgtcattgcaacaaagcccaggttcccagctcacttcccaaaagacaatcatgtggactatctgctgtgattgactgtggctgagtgtttgccctggcagcttttttgttgctgaagatgaaagtttgatggactttaagatggaaaggaaggaagaggagaaatttgatttcatcggcagctgtcttactcatcttcattaagatgggttgtggacacttcaaggccattctgaaccagtggtcataaaactaataggtgccactcaacctgcgctgctcgtattattgcctgagacctgtcatctcggtagttattgcaaaaggagaaggaatctactgtagggaacacaatggtccttgtgtgacagaagtgaaactgaaagaaatagatttttctattagctgcaaatcaaacccttgcacatcatcccttggaggtgacagtgcctgattctctaaggcagggttcaaacaaatcatttgggcttgcagaaaataatatgagattaatatccaagtgtgtgtgtgtatgtatttgtggggtgtgtgtgtgtgtgtgcgcgcgcgtgcatatatgacaactacgtggctcctcacttgaagttttggaattagctactaatatatgtgtatgtttaagggatgcatttgtggacttgaagttgaaatagggaaactgagatgtattctgaagagggaaggagaagagggaatccagtcctgattaggggaatattgaaataagtaggtgaataatattcagtctcccaggtttgtggctatgagctcttttcttccagaagtatttgctgaagggagggaagaaaacactccttttcttctgacaatcaaacttttcaaatgtcagcatgcatgggtgtttctctctattcttgaggctcctttttgtttcagtctaacacctcacatcctgtgggttgtaataataatggtagcagttaccatttattaagcccttgtcatatgccaggtgctttacatatattacagtgtttgtaatccatacaagaattattacaagatagatatcactatgcccaggtgtgttagtccatttgtgttgctataaaggaataccggaggctgggtaatttattagaaaaagaggtttattgggctcatggttttgcagactgtacaagcatggcatcagcatctgcttggcttctggtgaggccccaggaagcttttactcatggtggaaggtaaagaaagggcaggtacgtcacatggcaagagaggaagcaagagagataggggaggagttgtcaggctctttttaacaatcagatctcatggtaactacagagtgagagctcaatatttcaaggagggcatgatatggttcgactctgtgtccccacccaaatctcatcttgaattgcaatccccatgtgcagagggagggacctagtgggaggtgattggatcatgagggcagtttcccccatcctgttctcatgatggtgagttctcaggaggtttgattgtttaaaagtgtgacccttcccctctgtctcactctcctgctgccatgtaagatatgccttggttttccctcaccttctgccatgattgtaagtttcctgaggcttcccaagacatatggaactgtgagtcaattatacctcatttctttataaattacccagtctcaggtagttctttatagcagtgtggaaacagaccacacagaccaccaagccattcatgagggatctgccctcaggatccaaacacttccctccaagccccacctccaatgttggggatcacatttcaccatgaaatttggaggggacaaacatccaaaccgtatcaacagggaactatagctcagggaggttaagtaacttacccaacaacacacagcttatatgttgcaatgtaggaatccaaacccccaaagcttgtgccctcctactgcgctaccctgcctcttccaggcttggggctttagggaatgccctttacaagcagtataaagacgcatttaggaatttttcaatcagctcttgtctagatcttctttggaaagtcttcttagttactggcaggtcaaaataccagctacttgatctaatagtgttatcagcaagaaactaaaaatcatgaagcaatgcagactttttgaatcagataggacttactaggccatcttgtgattctaatctaacatcttatctggccactttttctgccttgtgcaggaagtgaggtctggataggtcaaagggcatgactagagcattggagttaatgggaatggggaatgccttctttgcttcttgacatttctcctccacaacactgcacatcccttgtgaaataatttactattttttagacatcatgtcaaagactgaagtgaaagccaccctcttgtgatcaactgaggtcagaagttggcaaatttttttgttgggggtggggggctaaagggccagataataaatatttttggcttttcacaccagaaagatctccattgccactagtcaattctgcatttataactgagaagcaaccacagacaataagtaaagaagtgggcagcactgtatccagtataatattatttacaaaaggcaaagagggctggatttggcttcccaatctctgccttaggcctttaaagatatagcttccctggggaaatctctacactttgagatttatactccagtactaataacatagtaagagaatagtaatggtggtggtaataatagcagtagtggcatcagcagcaacaacaatggcaccttttaacatttgcttaatacgttaaggtttacaaagtctttttacaattatcatctcacataaaccttttaaattcctactcaagaactacacaagcaagggaaacgtgctagctgagcagtgtggtacaatgaaaagagaatgggatatactgcatttagtcatagagattggtggtgtgggatgaaaatgcctagagagtaggtgtgtgtctcctggccccattaggggacagttcattcagcagcagggtgagtgtcggagttcccaaatacatggctgctaatcagttccctcactctgtaggcattttgcatttaaagctgtccagaaaagagaggcttggtctaagaggttgtggtgtaagaaaatctctacatttccacccattgccttttgggatccctgtatgttagtgagcaacagtaaaaagtgacctgtgttaaaaaggtaatggaagcatggtacaattttagagttcatttgagcaaacagagattcatgaattgggcagctccaaaccagaagtggtatggggattccaatgaagaagtatgagaactaagctattataaagagaatgcagacctaatacaaataaaatatttgattgattacagttataaagctgtctttgctgggaaattcctagttatgtaattataagtgtgattggttgagcttaagttctgtttgtcattattataggcatttacaagaaatagctcaagttaagttctgctgatgtttgcaattcaagcaagtctaaggccacttatgaggcctaactggctctgtctgctcaggaattcttgcaccattgaagcattcttcaaggtctccattttaatttagtttaacacctcttaacaccacgccttcaataacatttatttaacacaggtctttgcttcgtgctaaaggcaaacatgtatatgagactctgtccctaaagcatctgtaactctccaaagacatacccctaggaacatcctgaagattctgaatcttgcagcctgccagaagcacagcagtgctgttggcatctctagaccactgtctgtgattgacttctggctctgctacttgtcagctatgtaaccttgggcaagtttctttttctagtctctttgtcatgttcttcatctgtaaaatgggtattttttaaactacccatttatgtagtctgtgatgatttaagagctaatatggtatgtgtagtggttatttatgagctaatatgtgtatattagcttaatgcctagcattcgtaaatactcagataaatgccagtcattattattatcataattgctggtgaaattaacatacaaagtcctgtgcaaaccttaattttctcactatggacttcatacattttcagaatcctagctacttggttctcagaacattcttctaacacctagagattccacagccaatgtatctttgggaacttattgactaacacagagctaaatgaagtaagcagcatttgtaccctgacattttacagatggaaggaatcatagaggtcatctcagccagaaacacattttcaagatagggaactgaggttcatagaaagtaaatgactttgccaaagtaatacactcaggacagaatgagggctagaaccccggggattagtttttttcctctggcctcaaaactcttccttctgccatttttaacttaccaatttcacctaataccttccacatatttttgtgactgtttcaaagattccactagctaccatagaagaagtaatgaactaaccttataattccatcccagtggcttcacctcacctgccctcagtttcctcacctgtccagtgaggcaaacttacattggaagatccctaaggtggttcccagttcagataagatacaatcctaacaaataaagtggggtcggagtggaatgttcttgaaatcctggtatcaatgggactgggatattactctaaatctatggaaacttcaagaacaatatatttgttttaacctgaaaagacagttgcgttccagtgtgaaatagccaccaggctggatgaaaatgtgtgatgtgattccatcattgaaatgagcatgtgttgaccgtaagttcttctctttctctctggggacatttgcagtgctgcagagcttctctgtgagctgggatgctctgtcagcttaaatcctttccagagtgataaatatacattgattttatttgatttggcccataggtgggggataaaaaacaagacatcacagccacactatactgtatattcattccccctgaagacaacgcacacatccttgttgaagtctcctcatttagacaactcttcctttttatgcttcattataatgccactttcatgtcccttcccctcaacatcgtgcaccttgttccacatccagcactctgtgtttttaaattaagggaaatgccatttaaatatggtttttctctttgtaatatactcacctataaaaagtctttaaaggtaatgctaactgctttggcagaaattcaggcatatatatagttattttaatacaaggctatttgtttgcttgactgtttttaatgactactcattaacaccatgatcttatcctcatttcctctgcacagagcttgagaggtgctgttcacagcccctgctgcctgctttctgaggtctccaagatgctagctttctacttttccactcagccctgacacctagttcatcatttgagataagccccagttgtcggcaaattgcaatctcatcaggtctgcaagatagcatcttgtttgactcttttcaacaccttccattaacactttgggactaggtctttgggaagagccaggcctcaccacatgggcgattgtggttgatgaacagattctagttttccccattattgacttcattaaacttgacagcctttttagtctccagatagggtgaaccttttttcactgacccttattaagagctgtctccttaagaagggtcattcgagaagggatagtgggggccactccttctacttccaggaaatagctgattttggtaaacaactttgatttagtttttagagttctttcacctccctaattaggacagccacaatttatcaaatgttagcaatgcaccaaagcctaagaatgatcttatttcttcctccttattcatgggttttattactactatcctaatttcctcatatggaaatgagcctcaaaaacattaaataagttactctaggtcccatatcaataaattgacagagctggaattggaatcaacttaagtctgacttcagagcttaaggttttaaccatcatattctaccaccttcataatacctttagttactttattatattttaggtttaccccttgttattggtcttcaaaatccatgagttcattctgattttatgaggtgtattggtaatctattgtttcatgaaaacttaccccaaaacttagcagattaaagcaataaacacctattatctcattcaggctttgtgggtcaaaaattcaggagcagcctagctgggctcagggtctcttatgaaattgtagtcaagatattggcccaggctgcagtcagtcacctgaagccttgactgggctggaagatgtacttccaagtttcactcacatgcctggcaagttactactcattattggtagaaggctttcgttctccagcaatgtctgatcctaattttattttaccatagattagtgcagtcttcacatgaggtttcatttcacctctctttctctctctctctctttctctctttctttattttttttctctctctctctcttttcccctggcagtcttcttttggtcaagccatttgtattagtttgctaggtttgccatatgaaagtaccagtggcttaaacaacagaaatttattacagttgtggaaactaaaagtccgagatcaaggtgtcatggagcattgttttctctgaggcctctgtctttggtttataaatggtgatcttgtctctctgtcttcacatggactttcttctgtctctgtgtcctaatcacctcttcatataaggatactagtcatgattgaggctcatgcatctgagctcattttcacttactcacctctttaaaggccctgtcttctaatacagtcacattctgaggggtgttaggacttagggggttaggacttcaacatatgaatgttgaaatgaagtaatttggctcataataccatctttgtcctttgtatgtcttgagaatttccttttacactgtcttacctattacttatgtcatttctccattcttaacctctctttgcctcaagttcccaaagctattgtgcagccaactttaagagttaactgcctgcctttctgattgctcgttacacttgaaggacttaggatgctatacctgaaggtcttagagagttagactggtcctccaagcttatgaattttctagaaactttttaacttgcatatggtattctcctgaagaagctgtggctaaagtcagatatatttttataaactattctttgatcatgtatgagtgccaaaaaaaggagtctttaattactttgagggaggggtctgtgcatctttcttaacccttttcctggctgccctgtagatattccagaaagatttgatgtcttgtggaatggtctgagaaccagatggaagctagatgaagaacaaaatcaaaagtgtctctcttgtcttgcatgatagaaactaatatcactaagaacgcaattgagagcaaattattaagaatatgcactgaatgtgtacaacagccagtgtttgttcctcatcagcacagggaagcattcttttttttttttttttttgtgagtaattttattttattttattttatttttttttattttatttatttatttatttatttattttttaattttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtggctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccattgatgatgagcatttcttcatgtgttttttggctgcataaatgtcttcttttgagaagtgtctgttcatgtccttcacccactttttgatggggttgtttgattttttcttgtaaatttgtttgagttcattgtagattctggatattagccctttgtcagatgagtaggttgtgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctaaggtttttatggttttaggtctaacgtttaaatctttaatccatcttgaattgatttttgtataaggtgtaaggaagggatccagtttcagctttctacatatggctagccagttttcccagcaccatttgttaaatagggaatcctttccccattgcttgtttttctcaggtttgtcaaagatcagatagttgtagatatgtggcattatttctgagggctctgttctgttccattgatctatatctctgttttggtatcagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagctgaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgacagagggcatccctgtcttgtaccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgatattggtctcttcagaaattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgtgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatctctgttcttttacatttgctgaggagagctttacttccaactatgtggtcaattttggaataggtgtggtgtggtgctgaaaaaaatgtatattctgttgatttggggtggtgagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgttggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttttcctggataatatcctgcagagtgttttccaacttggttccattctccacatcactttcaggtacaccaatcagatgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctggagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgccaagatggccgaataggaacagctccggtctacagctcccagcgtgagcgacgcagaagacgggtgatttctgcatttccatctgaggtaccgggttcatctcactagggagtgccagacagtgggcgcaggccagtgtgtgcgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcagagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgaggacgggcagactgcctcctcaagtgggtccctgacccctgacccccaagcagcctaactgggaggcaccccccagcaggggtacactgacacctcacacggcagggtattccaacagacctgcagctgagggtcctgtctgttagaaggaaaactaacaaccagaaaggacatctacactgaaaacccatctgtacatcaccatcatcaaagaccaaaagtagcacagggaagcattctaagcttttgccaggacgcctgcttattatatgctatggtctgtccaaatcttctgtggctgccactacagcctgatttcccttggaaacttggcagcccgtgagttacgatggaattcccaggtgataatgtatctaatttccctcattgtacttcttttatcctgtaatgtgctgttgattcccacggctgagctgtgatggagaatagccattattattgtaatggcattattcagtccattaagacttaaaacatacctggtaaaaatagtgaaagcttacaagtcttcatagcaatctcaaagactaataacttagttgttagtcttttcctcaagtaaactttgacaggtgtttgggaataattctttcctgggctgatagtatttgatttgtactatatattgttctaagtaaatgcaggaccaatgctccatcctattcgaaaaaagaaaaggggtctctgtagagaaactattaaaaaagtttaaacagcctttacagaaacgtggtttggtggcaaagaaagggaaaccaccaccccttccaaagctcaccaggagaaaagtgagaaataaaatatcaaaatgaaattgactccacacaaagatatctgatcaccagacaaaacaagtaccaaagtgcagaaaaatattacaataaataacatcagattctttattcaagccaggcaaaacttatgtagtttttcctaaccaggttaattattttcctcatcttcttttcctttaatataaaaaagggatataagaaagcaagcctgagtatattcttggttgctctgtttcttgtgttagcctagccagaacgagctacaatagaaagaagttatactttagaaaacaatctatttaatataattcaatgctacacaaagctttatttcttaatatggacaattatttgctactggaaagaaagcagagcgagatatggccctttggggagatggttaaataagaaatacatttccagatgatgtcacatgtaaatagcactccgaaatcactaggcatcaaaattaatcaggctgaatccattgctttgtaaggtgtaaatcgctagccttacttaaccttacttcagtgctgggactcccgaatcgcgaggaaggtatgattcttatttcttcacacacacacagactgagtgttctcaagacaggaacatgattgagaatgctggaaaaaacattacattaatctacattgtaagagtaccatgcaaacatttgcttgtttccaacaccttgtaaatgtatctcgttgttgactcaaaatgaacatttggtgcagatactgagaaaaaagaatgtacttagaacagggatttcattacttctcttataggtctcagctgtggagattgtttagccaacaagaaacccaatctctgttaggtatcttgtctgagatgatattaaaaatattcaacaaccagtaggaaatggaaccaatgaaaatgactcaggtcccctgctgagactggcattgacctgttagttgttgaattgtggaaagaggggaaagggaccggatgatcggtggtaagggtatgtttgaagcagtgacattcatcatctatttatgcaagtattttaacattttaataattgatacagttatctgggtgcatgccagttgacaacttgccctgcatattgataattttaccatgcagactccactcctcaggtaactcttgttctattacactggactttatcatcatgtaatctgtcctgtccctctctctctctctctctctctctctctctctctattgaattctgggggtgtagtagtccattgtttagagggaatttagaagttttcctatattaggaagtgtattcatttcctaggaatgccataacaaagaattacaaactgagaggcttacaacaatacaaagttatcatatcatggctctggaggtgaaaagtctgaaataaaagtgttggtggggctggacacggtggctcacacctgtaatcccagcactttgggaggctgaggcaggcagatcacttgaggtcaggagttcgagaccagcctggctgacgtggtgaaaccctgtctttactaaaagtacaaaaaattagctgggcgtggtggtgggtgcctgtaatcccagctactgaggaggctgaggcaggataattgcttgaacccgggaggtggaggttgcagtgagctgagatcgtgccactgcactccagcctgggtgacaagagcgaggctacttctcaaaaaagaaaaaaaaagtgttggcggggccaagatctctctggaggctctcagggaggatccttccttgcctctttctaacctcttttgatttgctgacaatctttggcattctttggtttgcagctgcagcactttgatcacggccttgttgtcacatggcattctcacctttagtgcctgtgtgtcttcccctcttcacataaggatgcaagtcatattggatgacttatcctactatcctactatgtctatcctactccaatatgaccttatcttagctgattacatctgtagtgaccctatttccaaataaggtcacactccgaggtactggggggttaggatttcatcatatcttttgggagagacacaattcaactcaggacaggaaggaaaagccccggcaaccgaattgtattgttctgctagatgatgacaagtcataatgtagagaagttgctccaaagtgggatacatacattggagggcagcatagaatgaaagttttagaacatctatttatatttattttaatcgtattcctttatatttttgttatagtctgtttcatagcacatttagtgtataaatataataatacatgtctacgtgttaaaaatgaatgaaaatacctacattgggagtgggctgaatccacagaaagttttactgatggtggttcagggaatgtaagcaaaaggatttcaaaccaatgtaagagcatgaaatattaatgacatgtttcagataaaaatctctgtgtaggtttttcatagccccaattcaagttagactgggcaagaaatgagattatttaggcaaaaaaagggaggagcactaaattcatccacaattttaaaagtatcttctttcaggaggcttttggacagtaacatttccaaaaaaatatagtgttttatgccacagagaatcaagttgcattgtgtatactaaatggtcaagcattttcaagaacatgacaaaataaaaacatacaaatttatatctcaaaaggaaagtatcttctttcatgtcagatcatcagcacagaagccctcgatgcatgcaaaggcaagcacaggctctgcagatgagatgtgaagaagcaattagggaaggaaggaagggacagtttggatgctgggtcctgacccagaaacaacacggagtagatctcggatttgctttttcttaggtccaatgctaggacgattactttatctgtggtgaggaatgttataaaaaaccattgttggaatgccaccaaaatacttctttcccttttagcatcatcaccaagattctagaacgaagtaataacagttgccaaccttgagccattctccagctgttgtcatgtttcagtcagacaggaagtgttggcgagtaatatgggatttattgggagtgttcctttacgtgagtccaggaaataagaactagagatgagcttgggtgcctctgcttcttttatttctatggaacattctttggggtcagttttgaataatcactgggcattatcggatttctatcactattttttgcatgttcttgtgattattcaccagggaacattttataatactcatattaaatttttatttcttaatttcttgcctcattactcccatttgcattggctgcagactctctaagtattactttcccttccttgtggttcataccctaatcattgaatattgatgttctatttatttctatgcactcactttgtttttgaccaagttatatagttatttggttttcaggtaatgctttcttacagttactcaagaatgtatgctagaaaatgttgcccataactgcttaaacataaaagaggatatgttttcttgttttccatctatgttacagtctgtttctgaaatatcctttattatgagtagaataaaatctactggacttggaatccacattcccttttaaattaaaagtattcccagactttcaaattttacattccttagcatgatctcttctctataaagacagaagaggggacagaaaattctgactgatcatttcttgagctagaagcagctataatattcctgttctccatcctttataattactttctcataaatactaaactacacccccctgagcatctagaagatttaaacactgatcaaaggcaggtttagctgtatcctcaggacaagctgattcaatgaagaaaagctcaggctcttggagagcttttagaaagagaaataaattaacaattagcatttaacagcagtaaaaactgcttagcggaagcagacttgatgttttaggggatttgagatattcggagtgatgagatgaataggaaaaactgtgttccaattaggaagacagagtgaaaaggtgtgagatgtggtcttctagttcattccactggtgatatagagcctttcctggacagatttttatcttttttgagtaattattatccacgttataatttcatgcctgttgcttttaggtaagctcagaattatagtcatggcttgagtaaagatctcattgcagttgagtactagcagtaccactactcttgcatgagttgcattctctcttgaccagctctgttaatgggtgtccttatgtatgaaactgattttcttactaatggcaggattctgtctggttaggatattccctgaaatgcccaagggtgtattttgcttaaaagcaaggctggccagagaggtttggtttatgtatttatttttaaatttcttttgtacctaggataataaatatattcctctagtcttggataataatataaaattacagccatactgacaaaattaaagaagacattaacaaaaaattcagattaaaatataaagttcatgtctttggcaagtacacacaggattgtggttttgcccaaggtgtctaattaattactataatttttcaattccctgtgttcaataaaaacacgtctatgaaatgctattcataaaagcagaactcactggtcattaaacatgcaaatatccacgaataaatacacaattctctcttgcaggaaatgctatcagtagactaaataagtggtggacatttttctacagtaagtatttacttttcctacagtttgatcttaaaataccacagttggccagggcctcatgtgttgctggtgcaatctccgcattgttaatgggtatatgaagctcatgatgatgtccacaagatgataccgctattggaaaacttcctcattcttcctgtctaaccagtagcataatggatatgtgaatagtgcctgttttgtacattttccctcaggtaaactgtgataggcctttgggaataattcttttcaaggcctgaagcatttaaagtgcactgtatattgttctaaatgcaagaccaatgccccattctatcagagaaaagaaaaagggtatctgtgggaaactatttaaaagattaaaggagctttgactgaaatgtggtttggtggcaaagaaagggaaaccaccatcccttggtacagtattaaggctatatctgggaaaaccaacaaaacgtgtcatatgtggatagatcatgacactgacaccattagcaaggactttttttttttttttaacagcatttcttgtgctagtttcccagtgccaagaatggcttctttatttattcttgaactccaatacctatcacagtacttggtccttacttggtactcaataaatgtttgttgaatgaatctattttttatacttttgtatcaaactatcacatctgagcgattttgtaattttattcagctgatgatattctttataccagtgcaattttccatatgctcatgtgtgttttatttctcatgatatcagtttttctttctttgaactttgtagttccctgaattgcttagtattgtttatatatgactaaaggcccaggtggataagatggtatctttctttgtttattgtttatatatgactaaaggtccagtgaaaggtaaaaaatgagtttgttagatttcaaaatcagtcaaaaggtaaaatcagtgtgaagataagataccatcttatctaactggacctttagtccagtgaaaggtgaaaaatgagtttgttagatttcaaaatcagtcctaactaaaaaccatttcccctactggatgttgtaactcacatcattacaatttatggcttaatgaaacatttatttttctgaacaacttggatttcagtgagcagatttcttaaaataaggacattctatttttcattatagtactaagaatgctggaacaaatattttttctacttacatacttgagttcagttgaattattttatcaggtatttgcaagatgacctggaatatcttggaagttattatatgtaaattatacatacacatatatgtgtatagttcctggcattgggcaactagtataaggaatgctgcaaaaaaaatccttgctaatggtttcagcatcatgatatatatatacatatatatgcatatgtgtaattacacatatctatatgtataaataactatattaatatacttatataagctactacatattaataaatgatcaacatacctatattatttatatataaactatatataaatataactatatatatacacacacacacatatatatatgtagttgtagaaagggtcttttttagtgaattaagacttcatgaaaggccagttatagtggctcatcatgcctgtaatcccagcattctgggaggctagaggatcacttgagcctagtagttcaagatcagcctgggcaacacagcaagatcccatcttaaaataaaaaagatctcatggtaactaatatttgatatgtatgatatatgactttaagcaatattacgtgacatcacctttctcacattctaggttgctgtttacattttttgttcagtaatgaaacaaactcacgaggaagtaaaccaatcaacattttatgcatggagttttctaaatccttcatgtggctttggtagcattttgattagaagcccttgaattctgtcctgagtgcttacccattatctagtgatttacagagtttacaggaggacaccgaaatcacaggcttgaccgcatttacggatggcacagataccagatccaaaaagtttttaatgatctggaaccatgaagtgaaataaacaaggagcccagatttcttgaagacctcctctatgccaggcattttatgtctctcaattctttgagagaacctatggcatgaagttattaatttttttctagatggcaaaactgaaaataaagtatattcaattaatttctcaaggtcatgggattgaaaatactgtgactgaaaaaaatattttaagtcttcctgatcctagagtctatcttcttacattaaaataaacatattaaataaataagcacaatcagtttaggaaagatttgttttgatagaaatccatgcaaagcaggtcagggaatttcagttgaccacagattcaatggggaacatcagctaatgagagaaatgtacagtgcaaattatttcattgtacttagtgctagtcaggcttaataaagggtatgatactttggcacctcattgctttcacaaacaagaaggcattctgagtaagaaaacatgaagacaaagatcctaaacctttatcttgtggatgacagctaagaatgctcaggtaagaaatgactgtagtgacggcaggggatggatgagggctataacatctgttgcaatacatacactgaatggtgactttttcttttttaaattgacacggggtctagctctgttgccctgccagagggcagtggcgcaatcatagctcactgcagccttgaactcctgggctcaggtgaccctcctgcctcagcctcccaagtagcttggactgcaggtgcatgcaaccatgccccactaatttttttatatatttatttttagtagcaacaagctctcactatgttgcccaggatggtcttgaacttctgggctcaagtaatcctcttgtcttagtcttccaaagtgctggcattacaggcatgagccaccatgcctgccctaatggtgtttttaaaggaggaattagctgtggtcagtacagatttatttggaagaaatggaatctgtgcttagaagccaaaaggcccattattattcaataaaaggaagctctttagaacactttgaacctgaaagagttaatgaagcatgagacattagggttcccatatttagtttagatctatgtggcactatttttagaaggttacattgtttttaatattttatatagtaggccgggcgtggtggctcacgcctgtaatcccagcactttgggaggccgaggcaggcagatcacaaggccaagagatcgagaccatcctggccaatgtggtgaaaccccatctctactaaaaaatacaaaacgtagccgggcgtggcggtgtgcgcctgtaatcccagctacttgggaggctgaggcaggagaatcacttgaaccaggaggcagaggttgcagtgagcctagattgcgccactgcactacagcctgggcaacagagtgagacttcatctcaaaaaaaaaaaattatatagtataattctaataatgggatgctccacttcacttgcaagtacttgcatatggaggtgtttttttccccagtatgaggagagatcaacagtaaatacctatattatttctattgctggtcaatgcagaaaatatttgttaagcacgaagagtgtggatgtgtttgatgactacagaactaaggatttctcaaagaaacaaagagagaagtctaagttcaggtgtggaagcccttgcctaatttgcttcttcacttttgcccagaaataatttggccagggattgtgttactattgttgaattaaaccagacagaatcaggcctataagaagagccgtttagtaaaggaaatgattctgtgaaaattttagatttgataactgacatgggaggtgtttaccttcttttgaaaagcagatttaaaaaattgaattaaatatacacacagacttttacactcattttcagggaagcaagaactctatcataataatcaccaaatatcaattaatcagaaggaaaaataggcttgcaggaagagaaaatcagttcctttagacaaatggtattgacatagagattccaggtatgtttagttatataccatgcattctggatcaaatagagaggcttgtgacttgtatcagtattacctggcttcacagcagcaggagcagagaaaatatgcactatgtttagagatgaattaggagagtatgtctgaaagaaccagggatgcgtgggcaggtagatttggtcaggcatatttataataatgagccattggatttgggattgggtggagggaataaagtcagaaaaccattgggtcatcttccctaataaaagagaacgtctgtggagttataaatagaattgcctaatatttcatctaatagctttattcaatcattagaacctaagctttcttgtatcaatgtaaagtatgtgtgtgtatatatgtatatatattcatatgtgtgtgtattatatgcatatgtgcatatacatgtgtgtaatgaaaaaagaaaacagccctgaagaatcctcaagaaactgtcagacgtccttgtcctttaaaagctccagttgcccttcttgtctaaacacatcagtgcagtgtgaatcctgcattattcatgaacacataaggtctgtatttgtatacatttatctcttggctatttatttctataatctctgccccaaaccctcgccatgctttgtctttctcttttcctacttttcttttttttctggtagtttgaaaaataaacattagaaatagctattttattgcttacttctttcctttaacatatggcatttgcttaacctcttggagagttgtggttttctgaccctggagttctgatgggaaagataatgagaagtgtttacttagcatctaggccagcaagctaagaaaaacattgtgccatgctagtattgacaaggtgacagagagcccacacttgcctcacatgttggccactcccgatgctacatcccactttactcttgctggaggactgacattaatgcttactgttttgaggtctggacataatcctggtagattctaaaactcctagcaaacagtggtagacaagtcaagggtctataattgcgtataaacagaaaagtaaagacttacatatttaagcaacctgctaatccccatggtcatttagttccctagtggctatttttaatttgtcttgtttttagaggcactctgaaagcatgaggcaggtgaaagcgtgtctgtgtgttgcttgcatgcacatgctttttcaagaaggtcttcttcttttcttgtcaagactgcagctgtcaactgttccccaaaggtgttgcctagaatcagcatgcagcgctgtaggcaacctgtcacttagatgagacaccttgtatatatgctgtagttcactctctgacttgcctgtgtgcacaatgccatcttgtctgttagaagacagggccatcgtgagatgcagtttctctttgagatatatagtagctcttctttcttcaaaaggaaaaaataaaaaataaaaaaaagctactcttgctggaaaggtagagagaagggtctgcgggtgccctctaccattgtggtttcaatgtctaaatcttctggagaggattgctgcagtgatgagataaaagcagctgcctttccaagtactgtctatttgcattgatatttacattctttgccaaagtgacatcattaacatttgcttagtatttgtgccacagggatatgttttacataatttaagacttggaagtgatgataatgtatttcagatgggcagtagaggccacagagtgctgaatttcatcccctttcttcttaaggaccttagtgcataaataagtccctagtccgtatccctaaatcatattaacaatactgcttactgggtgccaacaatatgtctggtactggactagatatatgtgtatatattgtttagcccccatgacaacagtatgagggtaggtaccattatctccattatatagtaaagaagcaaggctagaaaaattggtgacttgcacaggtctgaattcagagacatctcaccgcaaggacttttctccttatgctgtgtcattctatctcccatcttgtagcctacttgtttcttcagatttaagaaacagaaaccctatattttctcaggacatgacacttgaaataacaagaaagaatattgtgggactctgaccttggtccgtttctgtctctttcattctcatctttactctaggtgcccagaaactcttctttgaaataaatataaaagatctgtgtttgctttgagagaaagccacataacattgtcacaagccagattattgaactctgccagatggcccttatttaccaaatatatgttttagttttatatacgaacagaggttttaaaaagataaagacgaacaaaattgtgtttaatgtcctgtatgataccttttgccttatttacaaactggtcctctctctgactgtacctgctcctgatgccccatcctcaatgtcctccatcagcataaaaaatgtgaaacctctttttcaaaaacaaatttaaaaaaaagtgctcagtctctcatcttgagatggagaattagaagcaaatttgcccttgcttttcttcttaatcttccttcttcccaccttctttccctcgctcccttctttcttctttctttcacaccatgtgccccagaatgacagctcagggaaagtaggcattataagctgagtagccttttccttgatgtcccttgaagggctccttatgttcagagaatatatcactgcatttgcagctcccccagaaatgccgtagcttggaggagcctattactcacttgaatctctttggtgtagacctataaatagattctcgtcttttccttgtaaccccctatagattcttgattcaagggtcaaaaatggagagatgagagttcaatcttcttggaacttactgacaccctagctcccttttaagaacttgtcctccttactaacaccatctacatggccatctgggtcttctcagctcagaaacaccctgcaacaatggctggcggaaataaggggagggcccatttgaattagcacattcccccacaagcacacacatccatactgccaggcctctgtttgtccagtttcctcctcttgtgctgttcttcccacccttctcctcagtgcagttcagatatcatctgtgtcccatgaagtctactctctcccaggggaaaccctttgaatttccattgcatattattctgtgcttctttttatgattaatcccatttaccttgtattatataaatatattttggtccttattagattatatatacttggaggaggacagtatctttctttggtccattggtgtggctaccacaggctcacagcatggcatttggttgcctaaaatgatatgtcttatccgttctttgatgtacagataagaaaagcctttatttagtttggctttcattttgttcaagaacagtggcacagtttggtttttcttgatatctttcccttattcatggttgcttttctcaaacagcacatgtggggcttaatacctagatgatgggttgataggtgcagcaaaccaggtggtacagggtcctgtgtgactctaccatggtgcacatttacctgtgtaacaaacctgcacatcctgcacatgtatcctgaaacttaaaatttaacagaaaaggaaaaagaaaaagaaattattataaatgtaaagtaattaaaagtatattatttaggagggacagtagatatcacaaaggtaagcatgtttcattctcaaatgaaatacacaaatttataaaagtgaattcagcaccagtggtgaatataaaaggctgttaaggaggaggagctaaagttttgattggaacttgaagaaaaggtatgttgttataggcagaaaacttgccatgcaggtgatcatgttagaatcagtgtcagacattaacaaaacattttcagtcaagggcagagagtaaatattttaggctttttggaggctgattacataatttgcacaatgaaatagtgggtccctttttcaaaaagcaataacgaagtgccatgagaagtacttaaaacataaagctctttttcctttttccatggtttctctctctaaacttgtcatgttgttttatatttgctcttcagtgtcattctaaggaaagaaaatgttaaattattagcatgaattttgccattcatctttatattatgccatgccagtcttaaataagttctgaataagaacttctaattcatttgcagaattactgacataggaaacatttcttatttcatagctcatgcagtgcatatatgttttgttcttaccagaaaactggacacactgcacagattaactcacctgtttttatttatttcacttcttgatatacacatattcaacaaacactctcttcctttggcttcctaatgagtaagaaaagactgaaaagaaaagaaactgagttgctttttcttttcttttccttctttgacataattttcagctgaggtggttggtcaattcatggaagtaacatgagtaagaaaggctataattaggttccttagtcatttatgtttcttagaatgccatcgttttctttctgtgttcaaagcaagttttggttccaatggaaaacatgttctttaaggactgtcagcatcccagcttactcagagtagatgtgagagactttgcaatcgctttgagtctcattgagtgtgcatcctaagtctaccagaatcttctactcccggggtattgtgagagctatagggggtgaagtggcaagaaacaatgggcatgtgtatagtatatccatatgtttatgcatctctcttttgctactgcacatgcctaattgtttcattagacttcattcaaaaacacaaattcaaagataaaattattaagtgtttcaagacggagagacaggagaatattaaaccaagagcaggtggtacagggtcctgtgtgactctactggctgcatacccatgaagcttcacctgggttttgcaagccatatggtctctgtctcaagtatttagctgttgtaccatgaagtgcggctataaatgatatgtaaacaaatggacgtgactgtgttccagtaaaactttatttacaaaaaacaggtagcagccagaatctggtctgtgggccattgtttgttgatccctagttaggcaaaaacatggagatgagaatatgtgagccttgtttgagaattgcttagctagtgtgaggtaagtcagggaatttcagaagaaagccaattatgaaagcatggattggactgtttgaatattttcctctagttgataaagtgactgatggctttagctactgaattaacgtgatcaaaagagtttttttttttttttggagatggagtcttgctctgtcaccaagctggagtgcagtggcatgatcttggctcactgcaacctctgcatcctgggttcaagcaattctcctgcctcagctttccgagtagtgggaacacaccactacttccagctaatttttgtatttttagtagagatggggtttcatcatgttggccaggatgatcttgatctcttgacctcatgatctgcccgcctcggcctcccaaagtgctgggattacaggtgtgagccaccgtgcctcgcccatcaaaagagatttttagtgaattaatatggaagtgtcctatcacagagataggaaggggtggatctgttaatagacagatgaacaagggagctattgtgagagtccaggtatgagatgataacaacttggagtattaagaagggatttgcaatgatggaaatatttgattccagaggaattttaagtgaagtgtcaccaggatgtggagagtgatttgatgttggggctgagagaagaaaagatgggaaatttcaaggtcttgtgcccggaaggctgcaaaatggatagccattcattccctgaacctgtattgtgtgtatcttctgtttgctaaaataaccatgaacagaaatggctggtgggctgctgattttaggtggctgcagaattttggtctatttgagttgatgttgggttgcctaatacacatgatgcttacaaggcattcaagatgtgtcactggcatagaggagtggagtgagggatagaagtaaaggtaggtagcccatcttcacagaaaggtgaattagaccagcgacagcagataccatctcccaatggagaaagcatagagaagagaaagaaaaagaaagaggctctaataccctaatcacttacataccctagtgtagtcctctatgcttttcaaattaagtagatatttcactttcctgtttaaccttgcctggaaagattgagaggtccatgtctagtcacaatgttagaatgaaataaatgtgtgaaataaatcatgtttatagtgtagatccccttcatcttcatctttgagtcaaatgccaaagccatttgttggctcagtaacgtttcacttagaaaatgaaacttttattttggctaaacgagtatggtgtcctggtcctttcccaaaaacataccttcaattttaccctagctggctgattgactgtttcctttacagatgcagtctagggatgctaagggcaacatcctttgtgataatgaaagccttataatgtattttttccagtaacttaggatgctgtatattaagctgtatattggtaaatattttgtctatgtggagaaatgtaaatgagatttttttttcttttcatcattcttctctacaaatgtgcattgaaaagacactgaactttggtcccatgcttatgcacaaggtataaaagttgcttatattcctaacctctccacagagttgtctagattcacaggactatttggtcaaatgttctgcaattcagttccactgcttgactgtaattcacctataaacccagaaaaatactgctggagttcagaggccctgactgttattagacagagaaaacctatagcacactggaacaatcacatttaaaagatttgcctcaagctttctatggtcactattactctttaatttatgcttttaggtttcaactttgaaatgatattgaaattttcattatgggcaaccctgaatctggaaaaatccaaggcagcttttaggacagtcacctttaattacccaccaccgttaagattaggaagtaaatgctgaaattcccatgtaagtgtattttgcaagaaattttcacactatgaaataattggtctttatctctcatcctgtctgattctctatcaagacatatcaaacatgcacccctctgctcaaagtgtaaaaaaaaagtttgctttttaaagttttaattaaggcttttgctgtgtgtgtgtgtgtgtgtgtgtgtgtgtgtgaaagtactacacactttagttgtttaggtgtcattgttgagacatttagactgtatttcattcaggcagatacttttactttattacattcccaaatgaggaaatgtgctgattagatggaaaagcatgtgtgtatcttatagtgttagcaatttggcacggtttttgttttgttagctctcagcatggttgccttcaactatatttacaccacatgggtgggcatgtgttaaagatacaaaaatcctcagacctctgaattgcattcctgaaggagaccttaattctattaggttggtgcaaattaaaatgccgttacttgtaatggcaaaaaccgcaatgattttcgcaccaaccttatactgcttattgcttttgcctcttctgtaatgaaaggcttctaactggtttgcctgcctttgattttagctttttgtgtagccttggtcatatcaagtttctgctgaaaaatttggcatggcctttgatttcccagtctcatctcctacaactcaccagtatgcaccggtagttccagtccgcaatacgtcctgcgctgtcgagcttacgcacctttctgtgtgctgtttcctctgctaagaatgtctagtgaacttctactcaccgtttaagaccagatttaaatggcatcttccttacaaataagttgattgatctatcattttattgattctgtcattcagaaacattccttcaatgcatgctatgttctgggaaactttctctaaacggactcaaacatttcttcttctgggttttcccagcgctggatactctgagtcattactaatccacactgggttcttgttttctaggctgcatccctcaatagactgtgaggtctttgtgagaatacaattgcttttgtgtttagttccatattcacagcgttcattctagtgtctggaacatagggttccactacatgcactacacatttgttgactagaaaaatgattcgttttatcaagggactgtcttaggaaatactaagtggggtgcctttctgatacattgtaatgaccacccttttctctgttctctaacgttgtatcccaaagtagataaactagagttttatccttaccaaccatctttctctcatctccatcctactttcccagcactcccctgcacccccctgctgtgtgcaaagctccaatcccgggaaaataccatgcagcgctttcattctaaaggggagcaattgaaagcatttctttggtaatttaagcacacagcagctacctttgcaaaagcctggttgctaaattatcccctcaactactcattttgcaaaagggaaaagaaaaaaaaaacacactggggggatagagactctaataagaaaagagtctgtgttttctttaggttcagcctgattcctctccacctcctctcccttcagtgactgcaaggctcctggtgtggctcgttctgctacttttccttttaatgttttaaatgccacaaatgcttgtcataaaccaccttcttaattatgcagaagtggagctgaatggttagttagcagttctattgcaattactgcactttttcaggtctgctgctgttttatgtggcactgttttctaagttgctgattaagatgatgtagtgggtggagttcttcttcccaccattggagaagggccgctgaagcctgggataatgagtccttaggcaatagtttatggcctaataagagttaaggatgggagcaaggaggagatggagagttatgctcattcatttccttcttaaaaagaaaaagccctctggttttgttcaacttttgcttctcctttgtccagtgtagatgctgaaattgctagagaaatatccatgatggctcttagcagtcctaatcttatttggacctgatattctgaggcttttaggcatcttcagatatccttgtgcagtgaaagagccttgcattggagttgaaatgatgacgagaaaatttaagaactgttgagaatttgaatcaatctcttcatgttgccatctctctctctctctttttaaagccaaatatgaatactgctgtgtgccgatcttgagccctgagaagctgcacttccagtgtagttctaggtccccactgaaaataaaataatgtgaaattgaaagcagcatgctattgtaaagtagtgcaatcattcgttcattcacaggtacttactgaatgcctactatgtcctaggcactgtgtgaggcccaggggatggggctaaaaacaatataaacttcttgcctttatggaatggcattctagtcaggtatactgatattaaaccaatctggaaataaatatatactcttcaatggtgctatgaaaaaaataaagtagaatgaggtgctataaaaaaataaagtagaatgagggaatggagagtgtgctagggcatgctattttgggtggagaaggtttctttgtggcagtgacattgaaataagtgcctgaatgaggcaaagcaacaagatgtaaggatatccaagaagagcattccatgctgaggaaatagcaggtataatcaccctgaaacaggaatgcacttggcttattggagaaacagtgggaggctgatggctagaagacagtgagcccgcagggcaggacagggggtaaagtgaggtcaaagagataaccaggagcatattgtgtatggccttgtaggtgaacaaatgggctttgaatttaatataatttaatttatattttaaaatcatcttggcggctgggtgccaattataccataaagaggcaaagtagaagactggagccaccgaggaggctgctgcaggaatctaggcaaaagatatattagtgtggtagtggcaagcgtgctacattattatgatgtcctcggccttcttaagtgtttgcttcataaatcagtagagttgtgagctgtgacttggacctgataatgaatcattacttattttaaaattgatacatacaataacattcttaattttttataagctcatataaaatattgaaggaggattggtcttattttgcatctgtttattaaacattagactggagataaggttgtgaggccctagagccaaataaatattcccagccttgcctggcagacaattattgggtgtggaggttacccagcctccatgttgcctcagtgactccctttcctgtccttcactaggtaggaggcaaaaagctcagcagtgacacacaggctctgctctcctaattgctgtaaagaactgtgctgtttcttcttcaaaatgttgattgcaggcagctacagggatgtgctcttatgttacagtataaagattttttattgtaaagaaaggagatttgttggcatggtgggatgtgtgtatttgtgtgtgtgtgtgcaagtagctgtgcttgcactgggagactattttactttgcttttttcctctcccattataggaagtaatttttggaggaaaatagtatgacagtcctgatactattttatttattttcttcttcagagtaggtacaacagaaaatcctgaatttatgcttgttgtattttttctccctattatatttctgcgtgttcacacccctctattaacagagaaagtttatgctatattctgtactccttttactctttttattaagagaaagtgagaaagctgtcctagaattatacaaaatatacatatatttttccacatctgaagggtaaaggaattgtaattcatgggaatagagtgttaagggcttatacaatgatatatactatatatatatcattgtttgtatgtatgtacatatattgcacatatatacatatcactttttggctctacttttattattttcaagtttcttttatataaccccagctgctcttctgcatttagttaagtgcagtcctaccatgtctagaacccccttctattctgcctacattcacgactttcatccctcaactctggtcccatttatctgtcacttagcattaactacgttataatgccatttatcccttttgtgcatgcattatttctactcaagtgggccatttgcttttttagggcaaatatcataatatgcacctacttatatgctccacatctgcatcaattcagacagtttggttgcaagcaacagatactataggcttagactacctcaagttggtcaggaatgtattaaaagtctttggggtagcttacagaatcaaagcaaagactaaaggaagaggtttccaaaaacaatcagagaatcttgggaggtctaagtaacagggactaattaatagctattttaggctgcagctgctagaatgcataaactccaattatttccccccattcttacaacagcctgctgaagcctccaaggtattgggtcatgtgcttacccctaagagaagcagaaaaaaaaatcaccttttgacaatcctacacctctgtgaacaatgggaaggagatgtaatttcccaaaagaaaaccgggcactgagtggcccaaaacaattgtcctctataatatcaagcatactttggtgtccacagttggagctctttacagatctggtgtcagtgatggtgacgacaaggagaaggaagagttgtaaatgactttgctcttttgagtaagtgatcatcaaatgtccttgcagtcagaatggcaaacaaatggcatggcctgtcagtatctgaagttaatttgggctggctgtcctttctttttggatatttaggtttcagtaatgatttcccgaaggccacaataataaacatgtgttatgttataaaaagcgggtgctgcatacattggaagcaaggccccctaattgaatcacctgtgctatgactctttcaactcctaaggcataattgaagcactatctcagttggcatctttgtggtttccatccacacattcttactttctggtagctggattatgaacaaccccaaggtcaggcttgtgtagaacccaacatcttacatattttactattgataaaatacaccctgagtataaatgttcacataacactttctctcatctctatagttatgtttctttcttatgaccttggccacatactttaaactccttgggaaaatatgctgccgttaaaaacgcttcacctatttcttgaaaaatgaccgacaagatgtttttcgtccaattctgtcgtatatttctattccctagatttaaatttcctggacttaactgttccctatagttagcagaaacattattttaagaacaatttaagttgaacttcatgtgaaactggctactgaatctgagtcgggaccttcttctggagggaggtaattaaatattccttattgatgctattttaaatgtgttgaatgaaaggagttaattatacagcagggaacatggcagagttctgactaataatgagctcaatgtttaatgtcttcatctttgttagaatcattaaagttgtttgaaccaatcagatgtttcaagtgaatgtagactcacagctaaccagctccaaatggcaatccctcacagatgcaggagctggtatatctaatgatgacttcaggaaaaggatggcgatatattgctttcttccatgcagtataatctgtttcagttggtcttccatcgtgatggtaaagagaaaagaataagtcttatttccaaaatttcatgtgttataatggaatgatgtttgtgcctggacatataaaagaggaaatgattttgttttttccttaaagttttacgtagccaatctctttggaatctggtgcaatattgacatttctggctgccaattcctcacatgataaatgcattaacactaaatcttaggatgcccaggaatcactagaggaccaagcactgtcctaaagaatggatctcctgtaatactgttgtagagaaatgtaggctcttgaggtcaggtttttcataccgtattactggtttgttatgtgtctttaaataaattttgcaaactccccgacactcaaactacttcctcttaaatttctcctcccttctgattgcttcaccaaacagcctgtggctttgtttttatttacaggactcctaagactctgtcctgtcctgtctatgctggggaatgtaaagtacagaagattacttccttggttctccatggaagtccttttacccagctgtgaggattgtaacaatgattggcggtgacatcactctattactgaacttcacatatgggagttgggagactttgaggaatcagtagggtgaatttaccaagttctcccatgagcccaggcagccggggtgtgtgtgtgtgtgtatgtgagtgtgtgtgtgtgtgtgtgtgtgtgtgtgtgtgaaggaagagtaagtgttaggacagaacagcagccatcatgggaaagggaaatcctagttccacctaggatggttacttcgtggagagggttactttgggtagttacggcagccttcagggttttcaagaataatataacatatatgatttatatttttgaacttcgattttaccactgcgttccctccagtgtacttagtagagataggatcatgtgtatcgagagctcaggctttagaatcccacaggtctggaatgaaatctcagctctgacttttactacccatgtgactttggacaatttatgtatccactgtcagcccattagataacctttaaaatgggaataaagtagtgcttgctttgcagaattgctgtatggattaaatgagataattcaggtaaagcacatagttgagtgcaaaattaatttatcacatattattagaaatgtggttgaagattgttttgttatttagatgaatcatatttaaatctttcattttcaagtatctaagacttccaaggactaaaacttccctctgaattttaccactcatcccagctggagatctaagataactatttttgtgtttgtttgttaattatttgacatgtttcttctcaaattaagggaaaattcttatttcggagtcactgttcagaatgaaaatgtgagactaagtatttgttttgcaaagcgcaacagaatagagaagaaaagttgggcattctgtagggcgacccatttggaaaaataaatcctaccccttttgaaggggagaaattaatgagatgagtgtcagtccctccctccccacccactgacctctctctgggatcacacaccaacagcctatgatgaagtgttgctgcagtgcaatggagcaaggttaccttcacagtaacagcttttctctggccagattactttatagccaaagatgtggttattttcacctaaacgtttcatttaaatacattgtaaagtgtgacctaggaaaacgagacaaaatcattctaagctgtatagagttggattgtttgtagaaatgctggacattaaccaatgactctcaacttgaatgtacatcagaatccccaggagggcttgttaagaaacagattcctaaaaccttactccaaagtaggtgtcaggtggagcctgagaattttcatttctaacaaccttccaggtgttgctgatgctgctagccaaggaaccacacttagagaaacaccttcaaagtgcatattttcgtgtcttactattcaaagtatgctccctggaccacctgcattagcatcacctgagaccttgttggaaatgcaaattatcaggtcccacttcagatgtaatgaattagaattgtattttcatcaactccctgaagtgacttgtttgcatattaaagtttgaggaacactgatctagtgattatagccaaggtctttggagagttgagaatctgagacagtcagccctggattcaagtctcacctactgccattttctagccctgtgattttgggggtgttgtcatttttcttctttttaattcccaatttcatctgagaaattgggatgatcatacttgaaaagttgtgaagattaaatgtgataatgtaggtaaaatgcatacaattagtagtgttgttaaattatgtcttcatttctttttatgtgaaacctgtcctgtgaaaccattagaaacagctgtttgaagaaggtatttgaaattctctctgaagtgttttcctatgtcctgttttgagagaagctattttcacagtatggcattagattgtcctcactatattattttgtgtatgagtgacagctgtagagatatataatggtttgagtttgccaagtcacagccccctcgtttgacctctgaatttaagggtgtgtgtgtgtgtgtgtgtgtgtgtgtgtatgtgtgtgagagagagagagaaagagatacagatagacatttcgttggaggaggagtgtgagggaaaacctagggttttctttcttctctaataataaaatatgacataggctttcaaagataaaattcgatttgtaatatttgacaacactggttagtcagccctaacctcactgatatattatgaagatgaaggttatgccagttaataaagtgttttgagaacattgaaaggtgctaataaaattggatatttgactttttatttacgtatgtatgtatgtatgttttgagacagagttttcctcttattgcccaggctggagtgcaatggtgcgatatcagctcaccacaacctccaccttccaggttcaagggattctcctgcctcagcctcctgagtagctgggattacaggcatgcaccaccacgcccggctaattttgtatttttagcagagacaggtttctccatgtttgtcaggctggtctcgaattctcgacctcaggtgatccgcccacctcggcctcccaaagtgctgggattacaggcgtaagccaccgcgcctggcctgacattgtttaattttttaaagtacagcccttagtgataatttttccttttctgtagccagagaggattctagtattttggcagttggacgatatcttatctctctcaatgccctcatcagttgagaaataagcctctttcttttagtattttatattctcaaagctcagaacatttcagagtcatgttatgtaaaaatgaggtataatggctgcagagaaaataaattaaaatgagaattgcgctaatgcaaattaaaagggttaatgggagcattttcttctgggtctcaatgtaggtctctgtacagatgattgaggggtttttggatcctgagtgttattcagcttggaggggctcttttctgaaattgctggctcccatacaaataggcctcttaggaccagtcattatgatgcacaccttgcactataactacatttttaacatttacaggtagggcggtggagctcttcactgcttagttactacccagggtaatctccttcaactgtaacagcaagtcaccaagttcttaatgagtatctcctgttggtccatggtaatgagggtaggtgtgtgggagaggcaaactgtaagacctttcgctgcaaatcctataagcacttgccactcaaagtgcgatccacaaaaccagcagcagtagcagcacctaccagcttgttagaaatgcagagtctcaggccccacttcagacccactgaaagagaatcagcagtttaacaagatctccggaggctgtgggggagactcacaggcagcttaaagtttcaggagctctgctttaagaaacattcctttcagagagggaacttaaactgagccaagatctaaaaccatgtgaactccaaattcagagaatcaggtcagtggtcaccagaacagagggtataataattggttataaaccattctaatagttgtaggtttaaaggaacatgtaagtgtgaggtcagttattcactgtattatgaaagatatgctttatagtttgcctcaaaaaaaaggaagtctgattaaatgtcctcaatctatgtggcagatccaagtaagaccccaaaggttaaaaacaaaacaaagcaaaaagggcaatgccgtgatcaattgcaagtcagagttaagatcaaaattaaaatatgaggtttgtaaatacaatggtaatagaaatttgacgttagcatacgaggctccccattgtttggaaccctggtttaaaagctagaatcaaaagaattttgtctagacctaatgcatactctcacttaagctaagtggaaatctttgcctctgttccagtaaccaaatctgtggcagagctgggagtggaggtattggtgagggttgtgggtggggagcagtgtcatcccccaacacactttgtgacagtttttaaggaattagttgatgagactcttgtttattctatggtgcagagagattagaggaagcagtttgagagcaaaggtcagactgttgatgctgggttgaaatagtctctaagatgcagacaggtatagatgtcctgccaacaaccagcaacacagggttgtccccagacttgctctcctgatattagagtctggctattcttctgaaccaaatacattattttactttatgacaagtgctattacatttaaggactttagagacactgtgattctctctgacatcatagcaaaatttttatgtgtgtgcccaagtactactactttttttttttttcctttggcttcccaagaagaggacctacttattgtttgtatcagatttttcaaggcaccttgggatataaaattttaagtctgctgaattggagaatttctatttattttcccaggggaaccctttggagttctgtcctactcagctgcgttatcccctagatttctgtaactgtattagttaggatgctttggagtgctagaaacagcaaatctggctcaaattgctccaaccaataaaaccaagtcactgacatgtaactgtaaccgcccaatgggttcaccttgtctgctgcctagatagaaccgatttatcaagacaggggaattgcaatggggaaagggaaattcatgcagagccggctatgcaggagaccggagttttactattactcaaatcagtttccctgagcatttggggatcagagtttttcaagataatttggcgggtaggggcttgggaagtggggattggtcaggttggcaatggaatcatagggggtcgaggtgaggttttcttaatgtctgctgttcctgggtgtggtggcagaactggttggaccagattaccagtttgggtggtgtcagccgatccatcctgtgcaaggtctgcaaaatatctcaagtactgatcttaggagcagtttagggagcatcacagtcttgtagcctccagctgcatgactcctaaaccataattgctcatcttgtggctaatgtttgtcctacagaggcgatctagtctccaggcaagaaggaggtctgctttgggaaagggcttttatcgtctttgttttaaactgtaagctataaagtataaactaagtttctcccaaagttagttcagtctacccccaggaatgaacaaggacagcttggaggttagaagcaagatggagtcagttaagttaatctctttcactgtctcagtcataattttggaaaggcggttttataactgaaaagaacagcctggctcgctcttcatgagacttgatacagggtacaaaggtgtcacctagagcatttttttctttctctttatttcctgtgcctttcctgcatctgccagaagatgacctaccaaggctagatccttgtgtacctctcaaatgttggccaacaactctggggccaactgctttccctttcaatttgagttggagagaaataatttttgtcccatcaatctcaggaaaatactttcaatctcaggaaaatatttcaaatatttccttcaaattcactgaagttgggttgatatagtttacctgcacagtctggaggaaagaatcctttttcccttttttgaggagatgttgtcttgctctcttacccaggctgatctcgaactcctaggctcaagcaatcctcctgcctcggcctcccaaagtgctgggattacaggtgtgagccaccatgccctgcctgaaaaaatcacttttgccagagggatagctgatttagttagtgcatgtgctctatccctggagccagggcagtttctaaatggaagtcagtggaataaaattctgggaagagaggtaaaaaaatgtttaccagttttctcagaatgccagctctgtttgacacttctctctcaggactttgaagactccaagaggaatgtattattatctatattctactgaggcaagccctgaagtcaaaagttttaagtgaaataggtggggttgtgctactggtctgccaactccagatccttccagggctcatctgaccatgtaggagtctagtttatggtatccacccagctggtgctaggaggtgagtgagaggaagaagaggcagactctttctctctccaattagcctctgcctctctgtttggttaataagatccatatatttaatatgctcaatgtgctttaatgtgttaccaaaccatttgagtctgttgtcacataggaaatgtagaacttttcaaacactattaaattcccttaatcgattaaagatactgccaaaatggtttacatgaaagaactaacataatagattaaaatatctttttcttttacatttattcattacattaaattttatgccatggttatagatctgaaactaattaaaacaattatacattgacttttttattcctaaatgtatcatgtttttagatgtgtaaaaataagaaacagattcagatttaaaaaataagctatgactcaaaaaaaattaatgtgaaatgcatctggaaaatttctcttttgaaactgaaatattcctcttactaaaaagttgacaatataactctttgtaacacaaagtatatcaggagaatctttggcaaaatggtgaaagaaactcttacagaatatgtaagtcacctaagttccagaattcaatctgtgctaagatttttatggctcagagggaaatatcatggactctttatgttataaaaggagtgaactatgtgattatatcttattctgaatatcaactgtaagaagcagattctcacgggcttcatccaatatgctcttgtaattctttctaacatatgtcctctattcacgaagaacaagaaaacatctccagtttaactgcattttttgtttgttttattaaattctttttttgggtatttgcacgttccaactacccagaaaattactcaaaatatttgccttgtggtctctgtggcactgagcatttaaagcaaactagtgtagttttggcttggtagagattgaacaccctttcgtgtttcaaatatttttagagaagaaattcagatacaaaagccatataagatttatcatcactttgacattaagggagcagccatgggttaaattacttgctttaggtgggtaagggaaattgatattacaccgattctgtcctcagcaccagactgtgtaatgtggggtcaccagaaacctctgacacagctcctgtcctcggggtgtttatgatgaggttttgagaaaagccagactaataagaattagattcacaatgccatgtcttagcaggatgatatagtttgggtacttgtcctctccaaatctcatgttgaaatagaatccccagtgttggcgatgcagcctggcaggaggtgattgggtcatgggagcaagtctctcatgaatggtttagcaccctccctttggtaataagtgaattctccctctgagtccacatgagacttggttgtttaaaagtgtgtggcacctccctcctttgctttctttgttcctgctgtcaccttatgatacccccctttaccttctgccatgattgaaagttttctaaggcctcaccagaagctgagcaaatgttggcacatgcttcctgtacgtcctgcagatccatgaatcagttaaacctattttctttataaattatccaacctcaagtatttctttatggcaccacaaaaatggccgaacacacaagatatgtctgcttggcctccaaaataaatctcaggtctctgattctgcctctatcaacctacattaggccaccatcgtttctcacctaaaccacaactatattcccctaaatgatcttcttgcttcagtttttttccttgtactggtttatcctacctatggcaaccagagttattatttagaatgtaaaacacagcggctgggcacagtggctcacgcctataatcccagcactttgagaggcagaggagggtggattacctgaggtcaggagtcccaggtcagcctgaccaacatagtgaaaccccatctctgctaaaaatacaaaaaaattagctggatgtggtggtggcacctgtaatcccagctactcaggaggctgaggcaggagaatcacctgaacgcgggaggtggaggttgcagtgagcagagatcatgctgttgcactccagcctgggtaacaagagtgaaactctgtctcaaaaaataagataaggcaaggtaagataagataaggtgagataagacaagatatgagcacatcataaaatgatcttgccaaaaaaaagaccattcattgatgtcccagtgcacttaaaaatcctaactctttcttactgcctggaaatctttacatgatcactgctaaaatctcagatcttgtgtgctacccctctgcccctaaggtcactaccctctgatcacattaactttcctgttctttgaagatgtcttggaacttgccattgtttctgtgtgaaatgtgtttttcctgtatgcttaggtgtatcactcctcgttatccagggttcacttacatctcgcctcagtgaagagatttagcttgattgccccatccaaaaagatcttatttgttaacttatttacatggatactatgtcttccccaacttcaagttcatgaggtctgtgtttctgtcttgtttatcaccccaggctcaatgtcttaaaatagcacctcgtaggctctcaataacagaagatggcaccaaattaatacactgaaaatgccacaagattttagataaatgtaaaaacattcaggctttgattatttggtgaacattttgaggcattacgtgagttggagcaaaactcttgaggttaaataatatttgaatgggctctgagaggcaaggggagcgtggccatgcttgtccccccacccttatctgtattctgataagaaaatacagaataaatttctttgaaattaaaaaataactcaaactctctgtaattatttttctttaattttctgagagaaggtttttttttaatttggagaaatttttaaaaattaaataaaaactagaaataatacttaatgtcttgacaaagtattaacttgatctagtttcagaaagatctcattaaactgcctgataaagtgattattcagtgccactttcatagagttttcagtaattatctgaaatgatttttagaatgaggcaacgttttcctttttttttttttgaaacagagtctcgctctgtcacccaggctggagtgcagtggcgtgatctcggctcactactacctccgcctcctgggttcaagcgattctcctgcttcagcctcctgagtagctgggactataggcacgtgccaccacccctggctaattttttgtatttttagtagagatggggtttcatcatgttatccaggatggtctggatctcctgaccttgtgatccacatgccttggcctcccaaagtgctgggattacaggcgtgagccaccgcacctggccaacatttcccttttcagtagcaggtgaaaccgtcttggtattgacacagaaatgctgataggaaaaggtgatgaactcatacacactaaaaatatgacatctacctctaaaagttttagaaatatgtggaaagcattcttggcccttttctcctaagttaagactgttcgcaaatcacttttgagagcgaagtgacgatgacatttttctcactcaagtcctaactcatttctaggcatataatttgaattaaacccttatatataattttctaattagatttttcttctttcatggctttttaagctttacataacctttgtgcttcctttttccattaatccttcaaatgccagcatcctgccaagagggtatttaccgcagtatttccatcattgttaacagagccacaagtttttttccagtatattgaaattacccatccatgagaaaatgcagtcttggatttttaattatttagttgacgcttattcaactatatgatgtaagtaggccttttctccctaatgttttattaccagttaaagcacagacaggtattttactttaatttagatatagagtaggtaacagagagctgaaattttaaaaattagataaattttttggtagttagttttatagttaatcttctctctttttttttttttttgagacagagtctcgctctgtcgcccaggctggagtgcagtggcgcgatctctgcccactgcaagctccgcctcccgggttcacgccattttcctgcctcagcctcctgagtagctgggactacaggcgcccgccaccactcctggctaatttttttgtattttttagtagagacagggtttcactgtgttagccaggatggtctggatctcctgacctcgtgatccgcccacctcggcctcccaaagtgctgggattacaggcgtaagccaccgcgcccggcctaatcttcttaatttgtcacttagagtagggcagtcgccacaatatggaaatgagctgggattagtgttatcactgggaagtgattgtaacttttgggtttgtaccaagaagtatatagaattgcttaaacttctgcatgatcaattactgcagatttttgcacctagctccactacgtagtccatcacatttcatagggcgatttctccactcctttatcatagaaccttaggagagaatgttcttttataactcccttgatggagttgcttaatgctgcctttaatttaattgaaaatggttgatcaataaagtcactttttatggatttatttctactgtttgatgtggcaaatcattaattatcattacctaaattagcatggattgccatgaaagtgaaaggagtaaattgctttatggatttcctagtgcatagtacacatagaacttttctaaatatacatcctcttcagcagttagtttgtgccagatttcaattcctacgctacaagttctccagcaaactagaggtgtccatgtccaagtggacatgctaaaaaattcaaattttacagaaattttacagagaccttacttttgtaaggtctccggaatctttaaaaaaaatctatttaattattgatagaattttagtgaccaccatagaggggagtacctgtgtaagcagaaagcaggaggaaatgaacccatttccagaaaacgaactagacattaaggagaaaaaaagaagagaaagaaaagtaaaaagaaaggagagcaaatacctctaggttttttattctgaaagcccatgttatgggttgaattgtgtatctcacctccgtcctccccgggaaaaaaaaatacacacacacacacacacacacacacacacacacacacacacagacaatattatacataatatgttgatgtcctaacctctagtacctaaaaaccttaaaacctctagtacctcaaaaattgtatatagtatgttgaagtcctaacctctgttacctgtttggaaacagtcttaacagaggtaatcaagttaacatcaagtcatcagtgtgggccctaatctgataggactagtgtccttataagaggaaattttgatacagacatacatagaaagaagattatgcaaagagacacagggagaagatgccataggcaaaccaaggagagaggcctagagcagctcttagaaggaaccaattttgccaacaccttgattttggacttctggcctctagaactgggtggcaataagtttctgttgtttaaaccatagcatttgtggtagtttgttacagcatcactagcaaactaatacagcccataatttatgactagcatttcatattaaaattaaacatattatatgaaagcttccccaaacactggaatactataatctataagagttgcattaactattttcatggaacgtcagaatgtggaatccaaagaaattcagagcctaagctgggtactatcaaagcattttataatcaaacattcaagtatgctctgattgagagaattgatttccatatgtatctttaataaaggaacccaactttcatactttcattgtattaacaagaacaaggcacagactttgttaagcctgattctgaatgttaagtaagccaagggtgaggaactaaaatttgtagagaattgagtcatgtagtgtctactctactgtgggactctggtgttggaattatcaaatgacaatgtgaatgcatcatagagatttatcctggactagcttacacttggaccaaaggtgatttatcaggcttatcattttatattgaagtccataaactctctcttctgcatccctctgttcgggagtgtgtgtggcatagaacaaatcagcctttggcacacattggaggaaagggtgtgtgttttgttttcataggttttttttagtgatgacaatcaaaagcccattttcttgattcctatggatatgaagccgattaagtattgataaggagtaaggtattagagtttaaaatcggggccatctctgagctacatggttaggtcagtggcacctttctctgaatccataatcctccaagccatttcaggccttttatgcagtcctactgcaacccagaactccttctaggccttcctctccaggagcagttatgagattgagtgttaactgcttataagacaccatatgctacacaaaactttttataaatgttgtgcttatatcaactttgacattaatgctattataatcctcaatttacagaagaagaaactgaggcttgaagcggttaaatgacttccccagagacacatagcagtatatgctagaggcaggactccaacccagaactggcagaaaagctgatactttcaaactttcaactaatggtctctgcagcctccaaagtatcagatttctccgtcaaatccttcttgcctggtctgtctgaccaactaatctctgataatgtaacgaaggttataataaatcccttccagagaggatatttgcatttaactggatgtttatgaaataatgtgctggcagaaagaaatgatactcatggtgggaatttctcattctttttctggtggaatgtataatcttggacaaatcatgaccgcaggagtcttcattttatcatctataaatgccaggattgggttaactactgtctaaagatctcttccagattcaaaattctatgattctttcacattaaatgcaactccttttcaacatatgtgtatacttggccctttattgaacctttttataagctgccaattggaaatacacagtcacggtagatatgacaatgagcaagtcacttaataactatcagcctcagtttcctaatctacaaaaggaggctattaagagcacctacctcacagtgttaatattatatacacaagtagcaaaatgtctggaacagagcaagggctcactagctatagctttaataacgtgataactgatggtgtgatcagttctattatcatctccctgcagaaatcacagtttatctaaggttatagtaaaagcacccatcatgacttcttttaatcataaagcatttcatgcagagtgcatattttaactttgtattctaaaggcattggtgtctcactaaaagctgggcagtatttatatcaaacagtatatcatctatgtgttcatttatgcatgcagactttcacccccctccaagctatgagaacaataggcgctttaaaagtctgaagcaagaaggatattagctccatgaatctttattttaaattacatttctgagttagaagtgtcaaaatggtagaacaagttaagcaagattgcattccccagtagggctattgatgttggttgcaaataaattgctggagcaggtgatgatagcaaagtccatgccatcttttatttagcaaagtatttctcttgttaacagctccttctgcatgctttcctttcttctgtttcacatcaatcatatttgacacattgcccaatgtcagggtaaaaaaaaaatgcagcgtctggctaatcatccagatgtttggcctcacactgactgaaacatctggttgtgtagctaaatgttatgttctttcatccagttattttgtgttctgttagacagaactgaagaataaaccctaggatcttcttctattaggataaagcttatagaatctcgaacttgagattccagaaccaaggccttactggttctcatagttgcacagctgtcagcagaatccggatcaattgagataatgtgtgtggaagcattatatagtatgtggaggcattatatggatttgagaagctcatgttaaaagaattctactccctttacttggttatacaatggccaaagaatgtttgtcttctggaaagaagttttaaaacagaataaaaattaattggtgttagaagccaagatttcagagctagaccaataataataacagctaagatatgtctgatgctaactctgatccatgaactcttctaagtgctctgcatagatgtaaaaacaatcctttgaagtggaccctactctttttttccattttacaaatgaagtaactaaggatgagagtgcagttaacaatttaccccagttcagaagctcaaaatttggattcagacaatttgatttcagagtctacgtatttaacttgtaaacttcctctgaaatcaaaatgtttattcagcttccaacaccatcacttattaaacttggttttgtcaccttaaagtggggatagcatgacataccttaaaaggattgttgtaaaggttaattgaaaggatgcatgtaaaacatttaacaatgttgttttttggtaagtagtaagtaaaagtagctattttttctctatgttatgcaatatttggaatcaaatatttcaatactaatttaaataatatattctaataatctcactttctgaaaattcattcaatataatttttttttcttggaagaacattcctagcaggttaagcacttttgatcaactcttgatataggctgttcttaaaataattggaagtccacaaattatatgtttctggaaactattctgaatatggaaaattatattcctttttctttttaatgaacatataatgagtatgtattaaggggaagatatatgctgagcttcctcttgccttccttttctcccccttcatttctgtcaccctgcctttcctatcttcacaatggtcctgtacagtaaactttgtttgcttttgcatttgaactttaggaatcaaggtttttaaagaagctgcatcatgtatcataaataaaaacgaaaaaaatgaagtgtaatattttaaactgttttagaacatgaggctcagtgttctatccaacaggctatgaaatattgctgttactaataagtatgatgatgaaagccactgattcttggacaactactatatgcctgacatattgctgggtgctttgcatacattttctcatttaacgcttagaagttcttgtgattgacacttgggtatcatgagcaactttgctcaccattttttcctatggtccggcgtctttagtcacttgtattactgttgttcagagtgacctttatttgattcatttacctttcagaatcttctattactcatgtatgaggaccacacatttataattagggagtaaatttggtcatcaactcggataaggcaatgggcaaatctgacatgttttcaaagacttttcagtatgctaactttcagtagggctggtttctataacagctacgacatcttttgtcaacactcaggctgattaaattgcaagattataatgttttccgaccctaagtgaaagtgacacattcttgttcttttagtggcttcataaaagtcaaatgtttaatctcaggaggaaatttaaaagatggaagtaaaaccttaatgagatgcaacataaataatagaagtccctttgcgtgaaatgacttgtgatgaggtttcttcaaaggaacaaactataaaatggagtgtttcagaaacctaaaatacactagtaaacactgcgttttaaaaatatggtatcaatgatactcagcattcagtaaataaaaagagttagacaactggtgtctgtaaaaatgttaattttccaaaacactataaatgtatcaccaaaaaataaacattttttaaaaaaattaggtgactattttcatgaatttttagtccatgaaacctgaggagttacttgaccacagcaaagattctttctaatcctttatccagccttttgtgcaatagtacctcctgttccactcacatttcacatgcctgtatgcatgtacattcagatgtgcctgtctttgtctcccagtgcttgttacacagaaggtattcaagaaatggtagccattctcacaatatcattcctattaccatttaaaaatgtatgtggaaaagggtaaagtgcaaacctgggttgttaaaataccggaaggatatctataatttaacaccagttcatttttgttttcaaatcactccaaaatgccctcacttattggtttagaaataatgtaacaaaacaaattgtgttgtgtctccaaagaacattttgctaagtgccagagctgtatataacactaaagtagatgctgacatatgaggattgtgagagatgaatggtgatatttggcttttgcttcccaagtataggtcgtgtccgaggtatagataattgttgttggtttatgataattcgacttgcggagttaggtcagtcagcatagatgcatattttttggatggttttttaacaatgttgcttaaaattttaaatcagattatttgccaaaggggggtgacaagatttggttattagcaaaaaggaaaatattaatctagatttgtttggtcttagtactgattatgaataagtcatcaatagttaatgataaggaatcagtctgctgtgccatattggtagatgaaatgctgctactcctcctattcctgggcttttctgtcccccacccccttccttccctccttcctctgtccctccaactcttcttcacatctcccaactcccccaattcacttcttttccactgcatgccatgttaccctatgcctagttatgatcctaattgtaaccctagttagagtagacacaaagtaaactcaggagcagggattataaagctcaaaattgttcctcggctccgcattttgtgtttattaacctattttacccttgcagcaactccaagcaagtctgtaaattttagcattgagagttctccattttgtgagacccctctgtctggtcaaagtgggatgacagttggtcactatagcattcaataattatccactatggttatttttattcttacagcttttattgaaagtttctttttaaccatagtgccaaagacaaaataaacaataaatattaatgattttcttggcttctatttatgatattgttattttacttttaaattctttggtatcttctgccctttcatcttttctgttctgttcagtcaagacttagctgatcctatctcaacctcaaacatatcttttctatttcatctcttgactagttagaaactttcacggcagctaaaatctcccacacaaatctgagtaaagaaaccctagaggtcaaagattgtagtgtaaataaaagtattttcctttatatatgatataatttatatgtgttatataatatgaagtctcaattagaatagggaaaatgaaattcaataattattagagtattatttgcgaagtgttctgctaatatttttcctcctattaatcaaaattagttttgtattttttttccatagcaaagtagtctaacaatagagaagaatgtcttttaaaagactaaattaggtgaaatctattctttttgttaaattatcctaatgtaaaaccaggtggcctgattaaaactagccttctttgctgcctcctactgtttcaagaaaaaggtcgccttaacacttagtttctcttgctgtcttttgtttggagtatgtgtgggggtgtgttatttatgcaggcatagctcctcattatgggaactccaagagcctgattgtgactgttttttaatgccgcctgctgtgttgtccttaaactcttgcttttcctggaatgcacaactttctcccagctcctggtttagccattggtgtcatgtcttcatgctgcatccttgtgcctctgaaatcgtgttcaaaagagtgtttatgtttcaaattcatccacagtctcaccacatttaaagataattgcagaaggtaaaacactattaataggaacaaatttactagcatctcttttactatgtgtcttatgcataaagcagtttctggttgttgggttatacagtgcctattgtgatagtctattctaccttcacctcccgccccactgcctccccatttaactaaagctcctgctgatatgttcaatttacttttttttcttttttttgaaatggagtctggctctgttgcccaggctgaagtgcagtgatgcgatcttggatcactgcaacctaagcctcctggggttcaagtgattctgctgcctcagcttctggagtagctgagactacaggtgggtgccaccaggcctagctaatttttgtatttttagtagaggcagagtttcactttgtggcgaggctggtctcgaactcctcacctcaagtgatctgcccacctcgtcctcccaaagtgctgggattagagacgtgagccactgagcccagcctgatatgttcaatttgataaatgaatgtgttgaaagatataaaatgtgttaatccctaattgcatgtggctgtgatatttaatatggctgattctaatggagtttgtaacttatggggaacactatgaatgggatattataaatatttgtatgaagtaatacaagagacatttcaacagaaaaccatgtgatctatgccctccatcattattttctttctgtgtaacaaatgaccaagtaaaagtagtgaattaaaatatgagtaagtctattttcacagtattcataatttattataaacttcttttttaaaaaaataaaaaaaattaacttctattcctttaacaaagcaaagcaaaccaacattattatcagctaatgccatttgatttcggtttggtttggtcagtctcagggtggccaatcatttaagttttctgggactgttccaatttaagcactgaaagtttcacttcctgggaaaacacacactcctttgagtatttaccgttgacttccaggtgacccacttaagggcttcttccagaagggcaggcaataagactatcaagactcttcaaagcactcttccccaaagccattagatgaggtccaattttctcagcttgatatttctgagaactgctcttcctttatttccaggatttaagaaaaataaaataaactgatatatatatacatacctttagaaggattcagaaaagaagaaatggccgtttcaccccaatatgtcactatagatatgaatgccactcatagaattgacacgtcatgtttttaacttctgtgctttaggattttcctgtttgaattgtttatgtgcatgtgattttggtggaatttcttcccctttcctctgttccttgctccttcttttgctcagtcagcataggaacatagctcccacactaggaagggctggaggttagtaacatcaagcagtgggctttcaagttagtttgcaccttggtttggaagtgtttgctcaggtctcagatacacaggagactgtgtaatcactcttgtggcatctactacacacagcacgtgagttattcctaaactgagcacaggctcctgggtggtgaatcctagtctttttatctcctgcaggctaagccttggtatttccttcagattacaccaaaaccaaaataatgggcaatgttgtccctgaatgttcaaattaggttgagtacacagagccaaagactatcaaaagaaagtgtcctggccgggcatggtggctcacgcctgtaatcccagcacttcgggactttgggaggcagaggcgagccgatcacgcggtcaggagatcaagactatcctggctaacatggtgaaaccccgtctctactaaaaatacagaaacaaaatcagccaggcatggtggcgggcgcctgtagtcccagctgctccggaggctgaggcgggagaatggtgtgaacctgggaggcggagcttacagtgagcagagatcgcactactgcactccagcctgactctgtctcaaaaaaaaaaaaaaagaaagaaagagagaaagaaagaaagaaagaaagagaaagaaagaaagaaagaaagaaagaaagaaagaaagaaagaaagaaagaaagaaagaaagtgtcctaaaagaagtggtggtacctgtggggcgtgtttggtgtcagagtgtttctgctaaggttattttaattagcctcctcccaaagccctccccctattctccttgaggaactgtttgaccgtcacatccttagaaaggccaaaccactactaactctcctgaccctctgccttatcctcatacccttaaagatgtgacttaaaagagaaaaaattatgttgttaatttcatcaactagggcaaaggggaaaaatgttcatttcgatgcaggaagttaatgggagatgggaggaagctacggttacaattcccataatacattaatgtatatttaatataccaccttgatttgtggcctcaagttaaataactacatatgtttgcagcataattcttttcataattgtgtagcctcaatgggataacatttgtattagtttccataatcgaaaatgtcaaatgcctgtttccaccttccaagtattttggttttaggtagcaaagacaattctttcaatgcgtatctgttctcattaagttctgattgctttataaagaaataaagtcttttcccattgttctgctctgtggaagtcaccttcagagtaagggtgggggtgactgtccttgccaatttttaagtaactgccttgcaagggtgattccctacagagttattttctgcatagtttccctctgggtacagaatgtgggaaagtagatgcaacgcattttagagtagtcatttgctctaataattagcattatagtacagtgtatgggctggcttcctgttgaggtctagatttctacatataatgtaggtttttctattctgtcctatattaatttcattggagttactctttatcagagcaaacatccgtaacatttagtctttttttttttttttttggagacagagtcttgctctgtcgcccaggctggagtacagtggcgtgatcttggctcactgcaacctcttcctccaaggttcaagtgattctcctgcctcagcctcccaagtagctgggattaccggtgtgtgccaccacacctggctaatttttgtatttttagtagacatggggtttcaccatgttgagcagagcaataactctgtagggaatcacccttgcaagccagttacttaaaaattggcaaggacagtcacccccactattactctgaaggtgacttccacagagcagaacaatgggaaaagactttatttctttataaagcaatcagaacttaatgagaacagatacgcattgaaagaattgtctttgctacctaaaacgaaaatacttggaaggtggaaacaggcatttgacattttcgattatggaaactaatacaaatgttatcccattgaggctacacaattatgaaaagaattatgctgcaaacatatgtagttatttaacttgaggccacaaatcaaggtggtatattaaatatacattaatgtattacgggaattgtaaccgtagcttcctcccaactcccattaacttcctgcatcaaaatgaacatttttcccctttgccctagttgatgaaattaacaacataattttttctcttttaagtcacatctttaaggatatgaggataaggcagagggtcaggagagttagtagtggtcttgaactcctgacctcaggtggtccgcctaccttggcctcccaaagtgctaggattacaggcgtgagccactgtgcccagccatttgtaatatttacagagcattgctctttttcttatcatggaaagttattccaatatctattcattctatacacatttattaagcatctactatgtgccaatgttaaagaggtgaaagtgtaaccttggccctcagactgactttttgcaggttatgctgaaagatgaatgctcagtaatagctcgtgccttaagacgtggccgagcaagctttggaggtaaaatagctcatggagtttttatttatttatttattctttaaaaatggtcacaaagatttcagataaacaatctgagtatggctaaattatttttcttaggtaaacataggaggcaagaaattaaaagggtgggagaaacattaattaggctatgctcttatcaagtagtgtgaccttagcgaatttacctaatctttttgaacctcagtgtcctcatttataaaatggaggcataactttttatgaagattaagataatgtgtgaacaatctgtgcagtagtagttgctcaataaatggtagtgattttcacatgtatttggactattgtagaatatagaaaagaatatcatgcaaactctagtcctttaaatatgagtgaggaagaggaatcacctgtgtgtatgtgattaaagctgttagctatgatgaaggcagggtgatttttctctgaagggtaattcgagtacagagatattactttgaagaagtaatatgttaaatgaaatcattggggctgaaagtggtaacaacattctgggaaaggagccgtttactctcttcacctctaagataaaccataatgcatgcatgtatttaataaactgtgatagctagagctgtttcactggggcatcagtaagctatcctcaacccccttttcttttcttccagcttttcacttccaaccccctaagttttatcagaattagttaatactgagtccagctgaatacattgcttgttataaatagaatgctttctcccttcctctgcccctgaccaaacaattgattacaaagtttatctgctgagtgcggtggctcatgcctgtaattccagcactttgggaggccgaggtgggtggatcacttgaggtcaggagtttgagactagcctggccaacatggtgacaccccgtctctataaaaaatataaaaattagcccagtgtgttggtgcatgcctgtaatcacagctacttgagaggttgaggcaggagaatcacttgaacccaggaggcagaggttgcagtgagctgaaatcacgccacggcactccagtctgggtgacgggctaaatagaatgaaaaaggaatgacccatacctgaaatgtttaacataataaaatgactgatatcgattgatgacgttgagagcaatgaccagatataagggaacaatgtgtttttacttggattgtagatatcaagaatacaggagaatggaatgggagggctaacaactctagacaacatggctgcaatctatgactttgcattcttgctataatttactttcagtgcttttacaaatgtaagactctcgaggccagcagtgtatcttttacgctattcattctacttttataattattattattattattattattattattattattatttgcaacctctgcctccaggtttccaacaattcttctgcctcagcctcccgagtagctgggattacaggcgcgggccaccatgcccagctaattttttattttattttattttatttatttattttttattatactttaagttctagggtacatgtgcacaacgtgcaggattgttacatatgtatacctgtgccatgttggtgtgctgcacccattaactcgtcatttacattaggtatatctcctaatgctatccctcccctctccccccaccccaccacaggccccagtgtaagaaatacaataaacaaagtatcttttattttggctacgtagttatgttgagggtcattcatcgtcctccagtttagcctatttggaacggtactggttaatctcaataaacaaataacattgtcagtttaattgttcaattattggagggaaataaatatatattaacctaaatgttaaattctgcaggaaaaaaactgattagacatagacaatatcaacatgggtttgttaaataacttgccttccaacaggacccaaccagaaattggaacctatgtttcatagaaacatgattcttagaaatgatctttacacaattgtaaaacaaagggaagattatgtgacgcagatgccaagaaatcagacctaggcaccatgtacaagtatacaagcaatgccgagttcatcagtcccatggctgctgctaaattgggctttatccccagcaaattaacacagttccagcaggcacgataagtttactctgaccagattactgggttgaatggcatatgccgttattttagaaagatgcagaataacatttccatttagagtcctggcagaacaaagcttggatttgggcaatagataaaaacacatagagagtatttgcagatgcatgtgatagatagaaatggtgagtgaccatttagaaatttagaattggaatttttttttttttttttgagtctcgttctgtcacccaggctggagtagtgcaatggtgtgatcttggctcactgcaacctccacctcctgggttcaagcaattctcctcccccagcctcctgagtagctggaattataggcgcccacaaccgcacctggctaattttgtatttttagtagagacagggtttcgccatgttggccaggctggtctcaaactcctgacctcaggtgatccacctgcctcggcctcccaaagtgctgggattataggcgtgagccactgcacccgacaaaaattgtctcttttttgatatttcctagagcagtgtggctcatttagattgaaatatctgtcagaagctatataccagttccattgatttcaacattaaaatgtctccacatattcttccgcatccttcttccagctcatagctgtaattagtgttatgctccatggagtggcagaagaccagctgaacaaacagccatgtacgtaggaacagttccaggcagctaaaagagcttcttcctcacttgccactatcttaaatggtatctggtgtctacagttgctccttctactttcttaagaaaaaaaaaaaaaaaatccaaatggaaaagaggactctgaagacaaattagtcctttacaattataattttatttgatttcaaagcagtacttggtatagcaccagtccaaacagattggaagaatgatattttcattccagctcctgcatagaatatctttgtgcttttcaattgctttagggagcttgcaacaatagaatcctgttaaatctaacaccattttgaactcttccttgccgatattgtgataagaaatttatacctggcccaggtttatctctgttgataatgggcttcatggctatagggacatgttgatatggtgagctagcacctatcattttgacacctactctttagtagacatagagaataatgggtgcttggggtaaagtgctggagaagagtgtcagcagtcagtgtgtatgaacctagtgatggatgtctctgtgtttgtgctgtggccatatctgtatggctatcattctttcttcctcttctcatttcttttaattttccttcaacagtctttcatttgttgcttcaattcactccatttctccccagttcttcttttttctgtcttctataattctagataaaattatgacatgacttaaaatatcctccttttttgtccgtgattgctttcaatggttctaatgaccccattggaagtctggtgattaggccctgaggggccacagtaatggaaaccttgtgttcagccttcataagggtgatccaaaaatgttattacattacttacacctctttctgtaagtattttttcttcattcacttcgaagtatgggatgcttcccatgtgcaggagaattagctcattcataactcaaaggcaagtaatttcatgttttgctatttataagagaggagtctatcatgcaaggatgcaaaggagtatgaaatcagtcacaaatgtaggaaataaaaggcaataagcttccattaaaccaaacaaaagaaaaattaataattaggcagtctctttgcaagtacataataataatactctatttttcaatgaatcaattaggtaaaaatgaaacaaaataaatgcaaagagagccctcaaaaatatatcacttttacatatgtaatataagttgaacatctcattagaataatgtgacttttttaaaatttatttttgcttcctagagttcataaatcttcaggtggtaagtaggggttctttagctattcataatgcaacttgcttaggttaattagtagagaccctttcccttcacagctgaatatgagtgcccctacttactattcaaaaatccccaaaaccagcactcttctatatattggtgcttggaagagattgtatttttcattgacctgcaatattaggtattttattataaataaagtctcaaacaggctttattttatttgtcagattctcttttggtttcgtctcataaaatattagctgaatagttattatataaaaaggaaatgatcagaatatcacatttcgggtggtggtgtttagtttgtgggttccttcatgtgacaggttgaactgggtggtagagaattctgagttctgtacaacagagtgattgatttctcggtttgcatttcttggcatctggcagtgacaccactgcagaccgagagcagaaaatggacagtagggaaaaatgcaacatttctacttggtccagctgcctttgaaggatgctgatgtttcattttttatttcttaccccaaacatatttatttgctgagtcattaaatagggcaagtgttatttctttctttgtatttgccatctcaccacagaagagttttattggccgggcgcggtggctcacgcctgtaatcccagcactttgggaggccgaggcgggtggatcatgaggtcaggagatcgagaccatcctggctaacaaggtgaaaccccgtctctactaaaaatataaaaaattagccgggcgcggtggcgggcgcctgtagtcccagctactcgggaggctgaggcaggagaatggcatgaacccgggaagcggagcttgcagtgagccgagattgcgccactgcagtccgcagtccggcctgggcgacagagcgagactctgtctcaaaaaaaaaaaaaaaaaaagaaaaaaaagaagagttttattaaaccatctcgaatcgatattgttttggcacaaattgcactaataacttgaatatatagttttgtttttttaaaggtgccttcaaaatctgatacgtataatgtatgttaaaattgatatttctgtgaaagaggttaagatcagaccgctttctgattgcagagataaaattgatagttaacaagtatttattaaacatctattatgtgactagtactatgctagggcatgatgaaaatgattcaagatgaaccatgcaagcacccctctcttcagcacctctgtgtgtaaaacataaacagaatgctatgattaacactgaaagggttcagtccgggatacttgggataaaaatcggagcactgataagttacttgtcatgtacttacttttttaaaaatttaaaattttttaattatgggtacataataagtatatatgtatggtatacatgtgatattgtgatacaggcatataatgtgaaatatcacatcaagataattggagtattcattacctcaagcatttactgtttctttgtgttaggaacattccaattccacttttttaatttttaaaaatatgcaatacataattgttgactatagtcaccctgttgtgctatcaaatgctagattttattcattctatcaatgtttttgcacccgctaactgtctctacctttcccttctctccccaatacccttcccagcttctggtaactgtcattctactctctatcttcatgagttcaattgttttaattcttagctcccatataaaagtgagaacattccatgcacttctaatttagactcttctcctctttctctgtcttctttttttccatagctcactaattttgggcatctcttctcatttacagtagcttgctgctcttcattcattaattattacaatatataattctaccaagaagcccaaagaactatagtgtttttatgtcattattctcagttcagaaagaaagcatgtgtgtggcacagggaaggcatttgaatgaatgtatgcattttctggatagcattctcgaacagagatttgatgagagtcacatggataattttaacttttctagtagcaatattaaaaacacagaaatagcttctcaataactgaatcagtaatccatttttaaaatctttttcaattcattaaaattaaatagaattaaaaactcagtcccttagtcttttttttttttttttttttggagatggagtcttgctctgtcacccaggctggagtgcagtggcgcattcttggctcactgcaagctctgcctcctgggttcatgcctttctcctgcctcagcctcccaagtagctgggactacaggcgtccaccaccacgcctagcttattttttgtatttttagtagagacagggttttactgtgttagccaggatggtctcgatctcctgacctcgtgatccaccagcctcagcctccaaaagtgctgggattacaggcgtgagccaccacgccctgcccccttagtctgactgaccaaatttcatgtgtttacggattgacaaccatgtgggtagtgcaggttttggatgcatggcaggctgaagcttatgtagcacatatttgaccttcacattttattaagtctaattttttaaagttttgtctgttcatttacatgtggaaggatgatagaaatataggaagagacatgacagaaagcttgcctaggactcagatcaaggattcagatttcccaattccggcttcagggccctgttctgtaacatcacatcagggaaaggaaaatgagagaaaagaagaaagaataagaactaatgttaattcatgtcagacacagtgccaaagatctttatttgcattattgttattattttttaaaaaataaatagactagcacgtagcctagcttacacacttctcattgtatagatgaggaaactgggaatcagttaaactttataaccacaccaagatcattgagctagtaagtggcaggcttgggatttaagaaagcttgtaatgatgttacatttgatggtttaaactgtgctgtgggaagggaatccaagaagataatcccatgtttctgcttcttgtgatgtttgcaaatctgtgttctggagtaagtctttgagttgactcttggagcttctgaaacgtctattggatatactataaccaaagataaataaataaataaaaagatcagggttcctgaacgttttcatctttacattgattgcaatgattacaagtgatcatttcatcacttggagcattattacctctatggggctttacatgatactgactttgtcaataaaaggacatattaggagcaggatttctgtttgggccagaacaaggggacataccctatttttaaaattccccagtttaggaattgaagtgactgcatactaaagttggccaaatttcatgtggctatggaatgagaatatatgaaaagttggttgtaaaaacaattaagaggattggggcagactattttatggatcccttcctccttagcttctgaaatgaactaacattgattctacaaccacttattaaatacctactttttgccatggctgatgctaagtgttgaggctagaaatgcatatgaattatattttaataagcacagaataaagaaaacttgtcttcctaatttttactttaaaagacttttatctcattgtttaagtgccataattgtacaaagcatgctgttctgagttcagtgtttcttggctcattctcagtcaatactctgcatagcatctttgaattccttactcatcaaagggtaatgagttaatttgtgtactctacctctgccaccttttgagctgtgttgttgaccattccctatacatttgcatctctgtctgccagaagatgtaccaggaaaataaaagcagcagaaaatcttataacttcccacctagacatcagtcaccatcagagtttggtctggaaacagaaaagtttatttaaaacaaaattggtactctgtgaatatttcaaccatttgttccatttaatccccattagtgaatttgcttagattaatttttttgtggattccatttccaagaatgaaagcaaaataattacatcaaaaggccactgaaatcagccaaattctctggcaggaaacttattctattcagtcacattcaaactatcaggtatgaaaaatacctttcaccactggataatacaacaatggagttggaaaatcaatcgtgtggtaaataagcaaaaactacgtgcaaacagaggaaagaagagttgttctgaaaatggtatttcaataaaagttatagtgatgacgagcagtgtgatgatgtaggaagttccaaaactaggtagagggtataatcaaaggtgggtacaatggaacaagcctggaggcaaggacgggccagtcaggaacaggtgggcttatagtgaaagaaagtggaggctttagaagtagagtatttgatgaattcttccgtccattctattttggcttctatgtcaaggaggatgacagatattcattgtgtagttttataggaaaggcgattggtagtgacttcaatgttataaagaacttggccaagtccataaaatgtccatggtgtataacaaatcttttatggtgagtgatccatggaattaggtacttagaaaagtcgattgaaacatattcacagaaaggcaaaggtttgatgacctggtgcatggaatgagacagagacactgagaaattttgattgtacaagtttttcctaatatcccacttacatcctgtagcggtgtgggcccatttattcttttttatgtttggtttccctgtctcatggtaaaatcatggacagatgttacccctcaattttctctttttcaattatttctgatccttctcactttaatcagtttacttgatagtctctgcgctagtgtaatttctccagccttttgaaaaatgtagacgcttgagccagacaaaagcacttcagcaggaacatgactaatcttgaagacatagagcagggctgataatgtacgccaggaactgtcagttaagaaatagtgatactgcattgctgactcacagtcagctcatgggtcactatgctgcccccattctgttgagatttcagtacactttccgtatatggagtttctgtgttggtacacatccagaaggtttcttgggcgcattgaccttcacatattgtttggttaatttacctaacttggtattaatcagacagaaaagacaaacatgaagtaaggaaagtcggcctttgctgttctcccttgaacttggcttcacttctatccccaccatttagtaaggaagaacagccccaatttattgagttgctatgagccagacactgtgtaagcactttctacacattattgcatttaattctccaaagaatgagataactattataatctctgttttatagaacaaccagctaaagtttatcgggttttttttgtttctgtttttttgggtttttttttgttttttttttttgagatggagttttgctcttattgcccaggctggagtgaaatggcgccatcttggctcactgcaacctctgcctccggggttcaaacgattctcctgcctcagcctcccgagtagctgggattacaggcatgcgctaccatgcctggctaattttgtttttttagtagagacagggtttctccatgtcggtcaggctggtctcgaactcctgacctcaggtgatctgcctgcctcagcctcccaaagtgctgggattacaggcatgagccaccgtgcctggccaagtttatgttaaataactcgtccagaaggtgtagtgggatgtttgactccaaaatacatgcttttaccgcctcaactgactgagcttgggactacctctaactttcattagaaacacaaatctttttctaataaactttcttcttcttttcaataaaaacatttcccacaaggtgacttaaattcattcacaattaggtataaatactgataagagcagttaacttgttttaagagtctaatatgtgctaagccttatgccagatgctttacaagcattatcttaaaccttgtaacaattttgcaaaaatgttactctattttatagaaccaaaacccaagactatgaaaacctaaatatcatcctcagagtcatacagcgaagcagaaattgtatcagctaatgagacttagtgccatttctctcatattgtgtgagaaaaatggcaatgctcaataaatgttgttctaactgttccaggtatcaagcagtagaaaaagaatatggcagatcaggtggattttgctgtcagccctggaaacactcagctggtggctacataatccatcatctcctgaagctttcattgtccacattttttttctaccctttagtcatgtgtttgtaaggaataaattactaaaatacaccataccttttaaaatatagaataaaagctcacagagagttagggtgacagaacatatgattcaaccttctgccttctggcagacagtaggctatttcttttaggtgggtatctaggaatagatacttgcatataatattttttttttgaatcccagactggtcctactaacattcttgattaccacttatttaagtgaccatcaaaccagttttatatctgatatgtttaatccaaataaatgtctttttttaaaaaactgtttaaaaaatggtatttaaatccttcccagattttagctgtgtatagtctggaaggaaacccattcacatggttttatcaggtttgatatttaatagatcaaattagtaaaacagggccctcacttcacaggcacggtgaattctttgttgataagatctatcaatgatcagtatggatcattggatggcagtgaacgtatacgtttgtggggaaaattcttatgcaccttcatagtaatggtactgcccattttatttgaggataattaaaacacaaaatacccaacgatgctgtttttattgtaggtatatgttaattcctctagagatagacaagactctaaattcatggaactttaagtgggatgttccacaaaggaaactctttaaaataatatagaaaaataaataagtaaatgtcaaccaaaatggcagaacatttaaaatcagtctgccaaatatcttttctcactttacttcatttgttgaacaatttatatgctgatatagatggccattttaacagtgtatacaaagcatttatatccacacatgtacatttaatcaaacctacatgtctacatacacatacttaagacacacatagagagtgtgtgagagagaatcaactcatcataattgtaaaggtgaagaaaattgattccttaagactaaaacacaccatattaaacttggagtttatattttgaaaataagattcaggaagtcttctaaagcattcgaagattgattagaaagataaatttcggcacacagggtctctgttcttgtaactttccctgtggtagcttatccctctgtataatacattttgtcatcattctttctttcctccctgatacaataaaaataatttccaaggttagattctatcttgcaagagcttttccccaaggaggtgcatgcatcttcttaatttattatattatataataattcctcataggaaaactaaaggcaaattaaaaccacatggagataatgcctgactgtgctttagactgttgtctaccactggctctttagaaaaagatcagagatacccctctcttgattgtccattttcttgatcatgcaatgtggtattttaagttctatgctggctttgatgcttttgttagtcaaggtgcatgtgtgaatgtgtgaattggatatgtgaatgattttaatattagcttaaataaaacattactgggaagacaaattttctgaaattcccattttcctcttccacttcccctacccccaaagaaacttgacatattcgtttcaaagcatacactgcttttttactatttttatttttatcgtgcatatcacaaccccttcattagtagacatcattgagcattaactgtgacttaattctagaaaaaaatatttttgagatacccattaagatatcacccctgacaaatataaaaagagaccttgagtttacttcattttaaataaatagactgtcttcatttcctaactctgtgaatctgacgcttcttatcaacaccccaaattactgtcaacaaattcaaaaccatctactgatgaatgagatgtttaggtccaattctgatatgccatgctcattctcatacagagaaatacctacactcttttaaatatagttgttattgctgtgacttgcacctactaaacaaatgtaaaaattcttacagttcaagaaataccagtgaagtgtatattattgccctcattacacaaaatgctcatggaaaacactctatcaattccaattatgttctggggggaaaaaaaaggaaactgaataaaaagcaatcccagaatatttgactgggctggttggttatagctgctgaacaatatgtaattgtaagaagtgtggcaaaatgataaaaataaactcagtatttgttaaagaaatgaaaacgtggcaataaaagattccggaaagcgatttagttttttgcattacttcttcattacttgattattttactgtttcatttctatttacctaccaagttgattcttttgcatctggattttgcacaattctttcaataatatacggttcagtggctataattacaggattgttaaagttcacattttactattcatcttgttatctctggtaatggaaggttggaataaatgcacataattacatggttggtcttaaattatttttatattgctcttgccaggatatactcgaaaagcagtatttattctctaatatttatttttggtggtagtggttttagcaaaataaaagtaataaatacataaatggactggtcccacgagcttactatctatggtttttttcaaattaattctaacccattcatctctctgagcctgctaggggcaggaggtgcttagagtctatggaagaaaaacgtcatgtttcagagctctggtaacaggaaaatgtccctcatgaggtactcatcatttgatctattattttatctatttgtagcagagtaactcagtaacctacagatctgtggaccaacttactaaataaggtgtcaaataagtttgatttcattctaaagcaatgccatgtcatgaaagtaaagtgaatttttttgtttgtattatactggaaatagtctcattgtactatatggcactcaaaacattttataaaaatcttagcactatcaactaaaaattaactcataagctcccgtaattaactgaacagatgactccctgttggccaaagggaccccagaaaagactgaagaactgagttcgtggccattgatggaagcgaggtcagaaacgcctcattacatgccctttatgttagagtttaggcacaactgaccagcattaacattaaaatagagatcataagattaactaaagggactcattgtgacactaaaataccacattctaaataagacctaaggccatgcaaagcaagggttaaggcatgctctgcaaaccgtaaaatctttttttaaaaaattaatcctgcataatgtggcttactttccaatctgactctggtataccctcacatggcagatagcagaccccttatcttgacttaagcatccctttgtattgacctcaagtctttagacaaagcttaactctttcaatcaattgccaactaaagtatctctaaaactcacccatgacttgtaagcccatgcttcaagatgtcccaccttttcaggccaaaccaatgtatacttttcatgtactgatttataattttacctacaattcctatctccccaaaatgtataaaaccaagctgtaacctgattactttggtaccaattatgcaagacttcttgggtttgcgttttcttgggctgcaccattcatattggctcagaataaacctctttaaaacattttacagaggctgatttttccatgaacagcagcatccaaaaaatccacaggatacatgtatcaagtatttattaagtacctacgatatgccaggcattgggctatatatgaaaaacagtgttatcagacatccacctagtgctcctgattaaaaaatggatgtgagctcattttacctttacggaggtccagagatttaaattacttgactagtccctcagcgagtcaggagaagaggggttaaaacctgattcctccagttatatagtcatttaatgttcttggacttaccagtacttttgagtttttgtgttttttttttttttttccttaaacacaaaactacacccccgcctccagctcccaccccctcccacacatatacccttttttcatagaacaaaatttggaataaatggactttaaatgaatgcattgttttgactctgcagggaaatgacatagagaaaataaggaatggatcgtacatgctcatgcactgtctggggcactcctgctgaagtctcaggagtgtctttggtttgttgtctgagacctgagagttaaaaagcagagtgccttttggaggaacacgtgtctctttccgcagcgggacgtgcacttgatacacatcagtgggcatgccatcagtgcctcgcagctcatctttctctttagggtggctgtgttgttcttccgatgactggcttgccctggagaaaaatactgcttaaatattaagattagattagttttcacacagccccattttaaccactaaatttaaatccctcagcaatctacttcccaaccttccctaggcataatattcagtttaataaatggtttgtatgccattatttctcatcaatatataaaaactaaaaggaattttaaaaatccatacatcttggttgagatgaaatttgacttgatgagaagagattattcttagaaatgtttctaattcccaatcaaggcattctatttcaaaatgtaggagcatggttgaaagaataaatctttagaaaataatgtatgagcatggttgaaagaagaaatctttagaaagtaatgtatataataatatacatatatgtatatatacttatatataagtgtatatgtaagtaatatatatctctcacaaatattgttttagtcatcatcatcatcatatacacgtgaatatatgtacatatatgtattatatatggtatatggtatatatgtgtatatatgcaagatatatatgagtatatatacatgtgggtgtgtgtgtgtgtgtatgtatatatatatatatatatatatatatatatatatatatatatatatatatacacatacatatgactccaaaaacaattcctctacaaattgtgtgtcacttccttgacccattacctccccaatgtatatatcatgtgaatatcaaacaattgaatgttttgttggtacaattggattcattcacacggaaacgtggagtctatttcttccttcaaatcctcatcctccaattaattagctgaaaaactgactgcatctctgattctctaagaagcatggaagagaaagaaatgggaaaccagctagcagctcattacatgaattcaaacagttccctttgaagggaaactttttcctggcatagatgatgtcattgatgagattgcaagggtaggcattgtataaagatgagatcctttttaattctgttttcaaaactataaagctaaaatttttagaattgaaatttcagttaacatgacccatgtattagataaaatgtctctttaaagcctgggagctctccaaggtgtggtgtgtttcctatttgctaggtacatgattacgatgcatatggatagatgtttctgaagtgtttccttctaagtgcactattgccagtcagatttacacccaagtagcaaagatgttaatgccatgcaatcctattaatctaacatgttgcttttgtggattagaactactcagactctaccttttagttgtagttattttaaatctttaatactgagctatcaaattttcttttatgatacaaagctactaagtagaagatacttgaatattccattggctgactgatgtgtttattaggcacttactctgtgcccaacacaatgataaacattctcagcaatatcgtgaaagtttaacacaggattcctggcttccagaaatatgatgtttacttaagaagagataggaacatatgtgaaaaagttaagcttcatgtagtatcttaagatgctaagtttagtattctggtggtggagtttcttatcaacaatgtttcacagaagatattgagctcagcttttcattatcaaagcaattgcatgaagaagaaatttgagaaagtacaacccctggtaatgattggagcctctgaaacttttgtaatgtcaatatccatagcatgactattttttatttccggtactgatgtggcagaagttgtggagtagtgtttttgagttatccgctgtttaggatcctgtattaaaagaagtatgtcggctgtgcatagtggctcatgcctgtaatcctagcactttgggaggccgaggcaggcagatcacctgaggtcaggagttcaagaccagcctggccaacatagcgaaactctgtctctactaaaaatacaaaaaaattagtcaagcatggtgtcgtgcacctgtaatcccagctactcaggaggctgaggcaggagaatcacttgaacccaggaggcagaggttgcagtgagccaagatagtgccaccgcactccagcctgggcaacagagctagactctgtctcaaaaaaagaaatatgtctcagtagtgcagttatccttctgtaggtttgtattggtgttcagcaagtatctggtaaattaatgaattaacaagagaatagtttctatgaagcagaaatgcatagcaaagaagtggggtgttgaaaggaacagctgggatatcagttatacaggttgaaatgtggcattggtacaatgacatattagttatactcttacaagttgtccttgagtgggtgcttgatagaagttggcttgcaaaccaaaaaaggttaaacacttgtcatggcctcaggctaatgaccccttctaatatgcaattctgtttttctcattctgagagcaaaccagatgccccatgatgtgcccactgttcttttgctaatgtgttcatcctcagtgccttcattaccagtttctttcatttgacatgcaaagatcttttttcttggctcatcccagagaagtggccgggcaagtgttctcctgagaaaatgttgatgactctggcacacagaccacatacaatttgctgcttcctcacattcacactgaagttggctaaggtgcccagagagaaaccctgagccctgactgcatccaaaaccagtcattagggatgaccaccgtgggatccctcctactgggtgcctggttaaaactgagtgtcagagaagagactggtggctttgtcattgactttcttgttcagatgtaagagcatcatcactgggagaaggaaatgtgaattgtgaaaataaataatgcagatagaagagtcggaagtacagaggagtgttcctagagtgctttatatggagctctattatggtgcataccatggtgtgttgttaagttagtttacgtgtcagtttcccctttacactgtgaaatttagcaaagcagagactatgtctgattcatctttattccaagtacctcacaaaggtaatgctagcgttgaccttaataagcatttaatcatgtttattcatttattttttgaatgaatggataatgattaaaattgaggtttttatctcttgattatggagcttaactcattgtgagcccattgacatcctgaaatacttgctgaatgagagaataaatgaacagatttaaaaaaaaaaaaaaaccctgaagagctaagcttaagccactatttaggctttgaagttgatccatgtggtcttttgttttggattgattgtagggactaaagaagtacttcatacgttgtgttatctttctgctcaggtcactgtggacgatagatagcctttacttctccgctttctcaattttcagccactggtattcaactgcaggccttctttaaaaatgtacctctttctttcaaaattttctgaaaagctagaatttttttgttttttgttttttccaggaaaaaattttaacttactggagaccaatttcttttcttaaacctgtctctgagctgagtatactgtatagtccctataatgattttggtaaatccttaagcataaggtggtcattgtgtgtgacggtgttttctgtttagtgaagacaaatggtgggatgagtctcctgctaggatgtgcagaaatgtgagcattagtctcaaggtacattccgtaaagtgttggtgccaggtgagtattgaggttgatagcttctgtgaggcctggtttcctggggttgtgcccatgttcatatgacagctgcttccacaataacatagcaggtgcgtagctcaggatttgcccactttctgcaagtggacactctcgcttgtatctaaaaggcctctcccatggtgccagaatgcctctgacagcattttcagagctgtgacggcaggactgtagctttatggtgggagcttctatctttgtaaatgccactgatgtcagctctcaccattaaccattttcttttgtcaaatgggagagattcaggactcatggaagtgagagactggcatgatgaggcaaacagggggcagtttaactggctgtttggccactttcccccactctaattctccttctcctttccataaaacatgctttccaatttctgccaataaaagcctttttaaaaaagtactagtctttcatttttttttttgcataccttgttgttattccttctgaaccagtagtaacacaatatacgaagtacattctcttgggtataaggccagtgtataggtgggaatcccatagacctaaaaagaaaaacaatctaggatttctggatgtgctctgaagtggcaccttctaagctgcagtatttgttcaacagtgtttttccaacaaaaaataggatgagttcacctgtgaagcatcctgaagggaaacaccggtgcactgggcagggaacaggagacctagatatacttcttcttttttttttttttttttggtagatatatttatttatttatttatttttattttattattattatactttaagttttagggtacatgtgcacagtgtgcaggttagttacatatgtatacatgtgccatgctggtgtgctgcacccattaactcgtcatttagcattagttatatctcctaatgctatccctcccccttccccccaccccacaacagttcccagagtgtgatgttccccttcctgtgtccatgtgttctcattgttcagttcccacctatgagtgagaacatgcggtgttcggttttctgtccttgcgatagtttactgaggatgatgatttccaatttcatccatgtccctacaaaggacatgaactcatccttttttatggccgcatagtattccatggtgtatatgtgccacattttcttaatccagtctatcattgttggacatttgggttggttccaagtctttggtattgtgaatagtgccgcaataaacatacgtgtgcatgtgtctttatagcagtatgatttataatcctttgggtatatacccagtaatgggatggctgggtcaaatggtaacaacaggtgctggagaggatgtggagaaataggaacacttttacactgttggtgggactgtaaactagttcaaccattgtggaagtcagtgtggcgattcctcagggatctagaactagacctagatatacttctaacataatctgtgactgtgtgcaggtcatgctaagtatgtcagactgccattttctccttgaggctggaagtgtggggagaaggggataatgtagttgagaatccattactggccccaccttggacagagagacaggcaggtaaagggtacacatgtgcctggatggtgctgctactggactcttgtttacattaatgtgtcaacagtgtgctccaaggttctattaggtgttaacaggtgtctcaagaaaaaaatgtttcttaatgagatcagtttgtaagaattctgggtgaacacgttaattagtttattcttttaatgcgttgaatgttttttttttttttgaaaaataatagaatcccttcagaattcttaatatgatatggtgttctgtatattttcaagaggagaggtatatagtgtttctcaaatttatttgcacatgaaatgcctgtgggacataatatctctgaaggccgatgttccttgaaagactgtgtgaaatattgaactatatgatctctgaaagttcttgaattctccattatcatcagaatacctggcccttccaagcccttgaccttcgtctgtggagtattgactctagctgccttccagacattgtcatctatgcttcttttcctctgaggacgatgaaccccggctgttctctcagtacccctgaaaaatgggaaattgtatttttttcttctttgtacccaggagtctatgtataatgcataattctcagtcaaaaggaacttgcttacttaagtgctcaaaggtttttgtcctgtggtttttgtaaggtaatcccacaacatccagataaacaaataatcacaagacataaccttccagagtgttccataacattgatcacaatcaaataatgaggcacgattccatgaaacattaggaaaattataaaggcatcaggcagaaaaccagcaactagcaaatggtttctccatgatgattttgggttcacatttcacttccatatataatacaacttatgtgcccatatttcatcctctggaagcctgccacattatcctctgaatgaatattaacactccttgtactctgaagtagcctctggtattctggtatttattcaacaggttttgaacaagattagtggattataattttggcttcaccacattttaaactgtgtgccttctctgtgcctcagttttctcctctgcaaaatggaacaatagaatccttttcattgagttattctgaggattaaatgagtgaatataggtaaagcacgtaggacatccctggcatatagcagtcaatcccttgtaaaatgttagctgcagtgggtgcaactgactgcggccagttgtcaccacctgtgacatttaccaagacaattttgggtaaaaaaggcagatttattggagaaagtacaaagataccttgcaagaaagcaatgcgcaggacaatgggctgtctaccaagaggcaggagctagagggaagttttatagggtcatactggaggggctatgtccagataagttgtgcagataaggtcctgctgctagggctatgtccagaaactaggtatttgggaacatgatgttctgtcagtcggttgtctgtgataagccatctcctctctcagaacaattgttctccccaatctggggccccttcttcattcttgcttatcttattaggactccacattaactattgttgttattatcatacacagactatctctgaaaggatatataagatatagataccagccataacctctgcaaaaagatacaaagagactagggagccggaaagcaaagatagaggagtaggcttacttttccctacatatgaatttactctattgaatattttaaaatcacctgtgttttaccatcaaaaaaataaaataaaacaagcatcaatatttacaaatgaagaactgaggttccaactttacgattgactttcctaattcaattggctatttgacttccctaatagttaagttagatttgagccagggatttgaactacaaaaaccgtgttttttctagtctaccaccttatatagagagatatgacagaggggagagatgagaggtgtgtgggtgggtgggtgagggtggaggaggtggtactggatattactgaaaaacttttgatgatattgaattctttccctgagttctgtagattttggcactggtctcttgtttcttctatttctactgtgagtaaacaaccattcccaatcctccagttctaacttgaatttcagtggactaggctgagtggatgtacaagggcaaacctgcatggggtgtagggaaatataaatagattggcactgtggaagtcagcatatgtttgcttggcacccaaccctcctatgcctttcatttgctgaatattaagcatctcatttttatctgtcctctttttgatggaatggacatgcaaatttttcaaacctacacaccctcttctttctcttggacaaagggagtaattttactatgaatccatcatgtgtcccaaggaggcaaactcaaaatttgtctgcaaaaagcctttcattcatttcttttcatgtaagaaacaaaattggcaactattttttcatagcttgtaaattccaagaaacttagtatcttttcttttcacttgctctgcagccaaaagcatattgttcagcattgcgaattcacaatactcactgctcctcagtcctggctacaacataattttgaaaagtttatgcagggaccatccgagtaataaatcacagaggaggactgctttaactgttcaccccttagctactgcctgaatgagctccatgctttatcatctcagaaggaagctgtctcaaatgcatgcttcattttattatccaattgtaacccatctagataaatttaacttcctatagatttgctgcctcttagtattcatatcttctccagacttttcattaatattatgatacttggataggagtattcccctccctttcctttataatgtaacagctttaaattgacatttggtgaatgtatcatcattgctattcaaattaggtcagtgtttttatttcattatgctggaagtcctcttagctgcgaaatcaagtttgaatgtctgttacctgaagcaatgcttctggcaaatgtttcttagaggtttttgcaagccagaaattgtcaggcacctcccccactcccacttcttatttctatgtggtttggttcatataaccatttaacatatttttataaagcggtagttgaatagagtataaaataggaaaaaattaatcatctgccctttaagaggtttctgtccactgtgtgggtgttggagagggaggtgggggaagagaggggaagggaggcagatatgcaaacaaaaatcatactatgccatggttttggtacagtcagttaatgtctaggatataatggaaacgtgggaaaaggagcctcttgacgtttactaagacttgagaatgagtttttttcttaataatctataaattgaaatccactctttctaaatgtgcctttggcactgttcttttgaattaggaaatacagaaaaacagttaaatttggttgaacgatacaggaagtactcagaaaaggcaaccatcttaccccaggagagatcaaaagacattcacagattatgttaacccaaagttttggcctcatttctcaaggaaggggctacatcttttagaccacaggcatttttccccagttttgaaactgtgaaggtgtttaggacctgagagattattaataacaggtttcaatgcctgacactcttggacttaaatgttcacctacactcaatctgatcatggacaaactacttaatctcactgagcccatgtcctcatccataaaatgagggtaataatagttccacgttttagtattgttaggatgattaaataaaataatgcatgtaagtaaaataacccagctattggaacaatcgctgctgtataataaaccatcaataattcttagcttttgctatcattcttgctactgttaattagttagtggttctcacttttttctagaaattgctctacctctgtttctcaactgagatattatagtttaagactttgattatgataactagatgataatttagatggtgtctttttttttattatactttaagttttagggtacatgtgcacattgtgcaggttagttacatatgtatacatgtgccatgctggtgtgctgcacccactaactcgtcatctagcattaggtatatctcccaatgctatccttccccccgcccccaccccaccacagtccccagagtgtgatattccccttcctgtgtccatgtgatctcattgttcaattcccacctatgagtgagaatatgtggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgtagatggtgtcttgatcagcaatctatgctttgagtgttttttgttaagtggctaatgcagtttgcatatttgtcccactaaatctcaagttaaatgtaatcctcagtgttggaggtggggcctggtgggaggtgttagagtcatgggctgagcactcagacttgggcaccatccttgtgacagtgagtgagttctcacaaggtttggctgtttaaaagtgtgtggccatttacctatataacaaacctgcacatagtgtacatgtacccctgaacttaaaataaaagttggatatttttcaagtgggcttcatccctgggatgcaaggctggttaaacatacgcgaatcaataaatgtaacccagcatataaacagaaccaaagacaaaaaccacatgattatctcaatagatgcagaaaaggcgtttgacaaaattcaacagcccttcatgctaaaaactcaataaattaggtattgatgggacgtacctcaaaatcataagagctatctatggcaaacccacagccaatatcatactgaatgggcaaaaactggaagcattccctttgaaaactggcacaagacaaggatgtcctctctcaccactcctattcaacatggtgttggaaattctggccagggcaatcaggcaggagaaggaaataaagggtattcaattaggaaaagaggaagtcaaattgtccctgtttgcagatgacatgactgtatatctagaaagccccatcatctcagcccaaaatctccttacgctgagaggcaacttcagcaaagtctcaggatacaaaatcaatgtgcaaaaatcacaagcattcttatataccaataacagacaaacagagagccaaatcatgactgaaccactcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatctcatccccatcaagctaccaatgactttcttcacagagttggaaaaaactactttaaagttcatatggaaccaaaaaggagcccacattgccaagtccatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcttatctacaaccatctgatctttgacaaacctgagaaaaacaagcaatggggaaaggattccctatttaataaatggtgctgggaaaactggctagccatatgtagaaagctgacactggaccacttccttacaccttatacaaaaattaattcaagatggattaaagacttaaatgttagacctaaaaccataaaaactctagaagaaaacctaggcaataccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctatagaatgggagaaaatttttgcaatctactcatctgacaaagggctaatatccagaatctacaatgaactcaaacaaatttacaagaaaaaaacaaacaaccccatcaaaaagtgggcaaaggatatgaacagacacttctcaaaagaagacatttatgcagccaaaagaaacatgaaaaaatgctcatcatcactggccatcagagaaatgcaaatcaaaaccacaatgagataccatctcacaccagttagaatggcgatcattaaaaagttaggaaacaacagatgctagagaggatgtggagaaataggaacacttttacactgttggtgggactgtaaactagttcaaccattgtagaagtcagtgtggcgattcctcagggatctagaactagaaataccatttgacccaaccatcccattactgggtatatacctaaaggattataaatcatgttgctataaagacacatgcacatgtatattttattgcagcactattcacaagagcaaagacttggaaccaagccaaatgtccaacaatgatagactggattaagaaaatgtggcacatatacaccatggaatactatgcagccataaaaaaggatgagttcatgtcctttgtagcgacatggatgaagctggaaaccatcattctcagcaaactctcacaaagacaaaaaccaaacaccgcatgttctcactcataggtgggaattgaacaatgagaacacttggacacaggaaggggaacatcacacactggggcctgttgtggggtggggggaggggggagggatagcattaggagatatagctaatgtaaatgacgagttaatgggtgcagcacaccaacatggcacatgtatacatatgtaacaaacctgcacgttgtgcacatgtaccctaaaacttaaagtataataaaaaaaaaagtaggatattttttaaaaagtgtgtggcgtcttcccccttattctctcttgctcctcctcttgtcatgaaatgcaccagctcccccttcaccttctgccatgagtaaaagatccctgaggcctctccaaaacctgagcagatgccagcatcatgtttattcagcctgcagaaccaactacacatctttaaaaaaaataaattacccagtctcaggtattcctttatagcaatgcaagaatggcctaacacagtggctttttttttcttttaagtatattttatatttagatgctactattagcagatgatttgtgcgtatgtcttgccctgttcagctttgaggagtccaggcccttatgggactccttctgagagtggggttcctattttccttaggaacccaagacagttctttcagaggatttcattgatctgttgccccatggtgctttgtggcacataatgacaaagcatgacaggcaggctcacagccctcgactcatgctagatctcggttcattctgtatccagggactccagttcatcatatcccttacccaggcctctctcctagctatgtctgtgtggctcacagatactctagagggagaggcaattaatttctttttggcggtgagatggtttgcctgggtccccactccaatcttatcttgaattgtagctcccataatgcccgaatgttgtaggagggacccagtgggaggtaattgaatcatggagatgggaattcatgttctgttgtcatgatagtaagtctcacgagatctggcggttttataaatgagagttcccttgcacatgctctcttgcctgcaaccacgtaggttatgcctttcttctccttagccttctgccatgattgtgaggcctctccagctatgtggaactgtgagtcaattaaacctctttttctttataaattacctagtctcaggtatgtctttattagcagcatgagaactgactaatgcagggggttatttcatgtcagacattgtcgtaagttgtgtcttccttggtgtcttagttttttctgtgctgctataacagaatacctgagactgggtaatttgtaaagaacagagatttatttcttatagttctagaggctgagaagtccagatcagttgggtggcatctggcaaaggctttcttgctgttttgttctatgatgaaaggtggaaaacaagagagagaacaaaaggtgtctaaatttggttttatagcagatccattccttgataaccaacaaactcccaggatgataatattaatccattcatgacggcagagcccttgtgacctagtcaccacttaatgctcccacctctcaccactgttgcattggggattaggtttccaatacatacctttatggaacacattcaaaccatagcatttggcaaataacccaaacccttctttcctcatctgataattgggaaaataatagcaactaccttgtggatactttgtgagaatcccatgcttcatgcaataaggacttaataattgtaagttgttaaattgtcatacatgctccttttagttatgaaaacctgtggcttttgtctaagagttgaatatgagaaggttcaaggactagggcttttatccttggatctctgtagcatgctgaattaatgaaaggtctgtctctctctctctgattaatcaaaaactctgactagtactagtgaaagtcaggtttgaacaattctgtgaagaatggatttggaaggaaaatatgaggcaagaattttaaaaagttgtttctgagttgaatttgatttacatttgctaactggaaaaagatcagggtataatcagtccataatattgaaagcagtttggaaataccattgcagatacaggtaatttaaaaaatctacatgaattaggtccaggagcggtggctcacgcctgtaatcccagcgctttgggaggccgaggctggtggatcacgaggtcaggagatccagaccatcctggctaacacagtgaaaccccgtctctactaagaatacaaaaaattaggcgggcgcggtggcgggcacctgtagtcccagctactcgggaggctgaggcaggagaatggcatgaacccaggaggtggaacttgcagtgagtagagatcgcgccactgcactccagcctgggcagcagagcgagactctgtctcaaaaaaaaaaaaaaaaacctacatgaattattcttcctgtgacatatttgtcattcttcatctctcctttaacattcctatcttcatccttcaggccatcctctgcctacctctttctgctgctacagtgtaagttgaatcatactttccaaaatatgtaaatgaaagtcagaagtaaggcaactcatagtgtttcagtgactttgatttcaatctcactcaagactgggagattctcctaaattctagcaaacttgtgcctctttcccagccttataagaaactgtccttctatctaaatactggaatgccactatgtgaagcttcaaatcagggtggttattctgagacaatggcagcttcttgggatgtggtgtaacatgtactaaatcattatgtgcacatacatttatttttaatcaacctgcgtttacctgagtgctgtggtttgaatgtgtcccctaaagttcatatattggagacttaatcctcaaggcaacagtgttggtgtatggggcctgataagaggtgattaggtcatgagggctctgccttcatgattgaattaatgtcattatcacaggagtgggttagttagcacgagagtggcttgttctaaaaggaagttcagccccctcttcctctcttgccctttgcctttggtcatgggatgaggcagcaaggagtcccttgccagttgtaggcccttcgaccttggacttcccaggctccagaatttcgaagaagtaaggctctgttctttgtaaattatccaggctcagatattctgttatagcagcactaatggacttagtcaccaactaaatgtaatggacaagaatggcctacattaaaaaaaaaatgtgattagaggatcttaatatcttattctgtagtgaactttagaatattttagacactggagattttctatcagatgtatcctgtggattcaataggattcattttgagaggcagctttctgaagtggaaataattctgtactccaggcacagtaattgggttcaagccccagctctgccatttactgggatggggagaaactcttggacagcctgttaggcctttttggcttccacttttcttgtctttaaaataaagttaataattttcattctgcttcactcatggcatagatgtgaggctcaaataaaaaaatattttggaaactaccctgaaaactgtagaacattctacaaatattatctaacaaaatatatgaatgcataattagtgtcttcaagggatgtcataaatatcgtaaaactaaagggtgagctgtatcaaaacttggaagggattgggatgaaaatcaaactgtctaaaatagaatggccaaatacattgggacttggctccagaaagaattaatgagaattacacagattcatatcttctccattattccattggtcacgtctaataacttgccatgaaattgcattgatttctacaaagtgattgcatatgctgttgcctcttttcaactgcacatgtcataattcatccatccagatcagtattttacttttaggaaaagagagatgctaactttttctcagaggagagtgtttagaagtctatgttctatagtccctcctagagaggggggatttcttcagtactcagcagctaatcttttttttcttctctctctttttccttttttattatactttaagttctgagatacatgtgcagaatgtgcaggtttgttatgtaggtatacatgtgccatggtggtttgctgcacccatcaacccatcatctacatgaggaatttctcctaatgctctccctcccctaacccccacactccccaacaggtcctggtgtgtgatgttcccctccctgtgtccatgttttctcattgttcaactcccacttatgagtgagaacatgtggtatttggttttctgttcttgtgttagtttgctgagaatgatgatttccagcttcatccatgtccctgcgaagtacacgaactcatccttttttatggctgcaaaatattccatggtgtatataccacattttctttatccagtctgtcatcagtaggcatttgggtttgttccaagtctttgctattgtgaacagtgctgcaataaacatacatgtgcttgtgtctttatagtaggatgatttataatcctttgggtatatacccagtaatgggactgctgggtcaaatgttatttctggttctagatccttgaagaatcgccacactgccaacaaacatatgaaaaaagctcatcatcattggtcgttagagaaatgcaaatcaaaaccacaatgagataccatctcatgccagttaggatggggatcattaaaaagtcaggaaatggccaggtgtggtggctcatgcctgtaatcccagcattttgggaggccgaggcaggcagatcatgaggtcaggagatcgagaccagcctggctaacatgatgaaaccctgtctttactaaaaatacaaaaattagctgggtgtggtggcatgcacctgtagtcccagctacttgggagtctgaggcaggagaattgcttgaacccaagaggcagaggttgcagtgagccaagatcctgccactgcactctaggctgggtgacagagtgaggctccatctcaaaaaaaaaaaaaaaaaaaaaaattcaggaaacaacaggtgctggagaggatgtggagaaataggaacgcttttatactgttggtgggagtgtaaattagtgaaaccattgtggaagtcagcaggtaatctttttacggtctgagtaatgaggaacctggctaatagttgccattctagatagcattaagggtgaagtctttgctcacagaagttggtgtatccagacagacattgtaattacagcagagcaaattaccatactctgaaagagaagaacacagaaagcaacaaacacatttaaagaagactgtcccagaaataaggagaagggcaagaaatctaagcagaatattccacttgccatttacagcatagacaaggacagcaaaatggaaagtcacttatataactgcaggataaagagatgggtgagatgaaatatactttctccgaatgaagttcactgtatgtgtagtggattaaatgagattgactatttttaaaaagcctgttacaaagaagaacaaatttaatagactattaagaggtaaagaggaacttttaaaagcacatattgattaaaacaaaagttatacactttgggaggccgaggcgggcggatcatgaggtcagaagatcgagaccatcctggctaacacggtgaaaccctggctctactaaaaatacaaaaaaattaaccgggcgtggtggcgggcgcctatagtcccagctactcgggaggctgaggcaggagaatggcgtgaacccaggaggcagagcttgcagtgagcccagattgctgccactgcactccagcctgggtgacagggcgagactgtctcaaaaaaacaaaaacaaaaacaaaagttatagttcagaatatttattgcatacaactcagcaaacaaagttgacctagatacaagagtattattggaatttgttagtgaatacattgacaaaattctgttatttttgtttaattatcactaggtccagtagggtggaagtcagaaattttgacttaaaatatcagctaattgaattagttatttcaaatcaatgtctagtttggataagaatattttataaaaaaacaaatcatagtattaggcatagtttatgcttggtggcatgtagagaaatataaaaataaaagatagtgaaatctttttaaaaattgtgttgaaaggtataatcatttgtgttaatgtattattcaaccaggatgtaggaagaacacacatgtcactgagctttgttctggggctggaaggaagtgcaaataacaatgatgataataataacagcagtagctaatatttatcagatatagagcttgttaccaccacagtaagcaatttgcatggagtatctcagttctcgtgattagtcaggtacacttcttacattggtttttcggattgagatattaaagtccttagaattgaaagaacttgctccaaatcatacagctaggaatggtagactagcgtttttactcaggcagtctcaagataacatttgttgagggtctattaacaaccaggcattgagatggtgtttacacatattagttatctcagtggttcttaacctgggatgcatgttaaacttaccaaggaagcattttaaaaccctgatgcttaggacctacaccaggtgaattaaatcagaaccttttgagacaggggcaggacttggcatcagtatttcttaaatataaacattgtatatgtaaatattatatcaataccagtatttttaaaagtatcccaggggagtcagccttttgaattactgtccatttaatattcaaagcaaagtctatacatttgtattattcctattttatttatgaggactctgagattcagtgacgataactgacttgctcgatcaaggtcacttacctggtaaattgctgagctgggatgtaaatgcagttctgtctagctaaagagcccgcattcttcttgatgcctcagtgtctagccattttacccagagcaataaattcacttgttcctgttatttagtgtttatcatagaatttagctttagcctcaatttcattttattgtcttcactattgagtactcacaaagggagccagttaacaacatctttggaacaaccatcctgtgtggagcattgtgctaattgctgtgggaaagaacaggggaagatatgaaatattccctttacaaagatatctactgttctgccagggttcataactttgggcctgtgacttgacatctgggtggcaaaagaagtctcatgaattgtttgggaagtattcatagttttcatcagattgtaacagagccatgagccaaaatatttatgaacttctgccttgcttggtatgtaaggcatttgattccagaagcagtggcatattatcttgaattttcttcataaaggcaaaacagtgccttttcaagagattttgagtttgatatactgtcaaaaactgtttacagctaagcctagtaaaagatgttgcatatgtggagtgtgtgtgtgtataaaaaaaatgcaggctgtgaggccgggcgtggtggctcacgcctgtaatcccagcactttgggaggccgagatgggcagatcatgaggtcaggagatcaaggccatcctggctaacatggtgaaaccccatctctactaaaaatacaaaaaaattagccaggcgtggtggtgggcgcctgtagtcccagctactccggaggctgagtcaggagaatggcgtgaacccgggaggcagagcttgcagtgagtggagatcatgccactgcactccccgctgggtgacagagctagactccatctcaaaaaaaaaaaaaaatgcaggctgtgaatataaaacaatgaaataaatttcattagtggctcagaaactagatctgagaacaaggatttggttgtttctggcaataaaacattattaagaaatgtgatatcatgaggtaaatatcttaaagaattgtattcatttacacacatatatgtacaaataaatttgcacacatatatacatgctatgcacatatatactatatatacacatgtatgtattatatgcatgcaccaatacatgctggcatgttttatgcaaattgatttttattccatagctatttttcctatataatccattatttttaaatgtattaataattttaatatcaccataaactgaaatgagtaaagaggcctgtaatgtgaatattcatatatggaacataatacgggggttgcgtaattataggtccatatatgtattgtatttcctgatatatttatatatgaaattgctagtatgtgtgaaagatatctacatatattttactaataagagatatattcatatatatatatacaaatatatgctttatagagcctaagtttggggtggaacaaatgttctcacccttgtttgattatgagaaccacttgcagagctttttaaaaacctgagtcccttttacccttgattcaaattcagtacatccagagcgggtcctggtgctgtttttaaaacattccttgaatggttgtgttgctttgcttgagaagcagccctgtagtttgtgtacaggtaggaatgaggaaggaagggtaccagacaacagacaggtaagacagtcaaggggaagaggccaggaaaatttctaccaggagggtggcagtttattgatttgcttatgttaaaatagttgagtccgcgctgtatctttttacttgattaatttaatttacacaaaccaaaggtcaatatcaatgattaatgtcagagggaagggtattattattatttttaaccctacttctttttcaactactacatatctgaccttgcagaggaaatcttggagagaaaatagccactttcatacgactatcccttggtcaatgcgctacttattaaactttattttcccactgaagaaagaaaatcctaccttcagggaataaaatagagattcattttctgacctcctagtataatgctaaaggaaaagcatacaatctctttggggagggagctgttaggaaggccagaggcagctgtcttggaaacatacagaaaggtgctattgggacagagcataatttaaagtaggtgagattggaaaatagggatttttccttctcttttacatttttttttcctttcttgaacatatacagttcttcagttaagtgttagcctgagattaaatataacatttatgaagctcctttcaaaactcatccctgcatgtgaatggaccatttcctcctttataccactgcactgacttctaattacatgcatctttcatgaaaatgtttgtcagactgtctgatgttaaattgcaagataattgataacaagacccatgtcttaatcatctttgttggtgctaaatacgtgtttattgaatgaatgaacaaacacttggatgaataaatagactgtaattgttagtaactccatgagacctgcacatttctttgttattggcactttgcctccctgtttctcttgagcttcatggttctatatctacatcacaggtagtctagtgtaaggttgaataacaacactcaaattaaaaagtaaaaatcttaagatgcttttggtacctaagcataatcataaaacaatggtcttgtttaatttgaggaggagataagtgatcaaacccaagaatccataaatttggcctaagtattggtatttatttccagagatgggcaaggaaagagtgttggaagaaaatacaaggtaagttttacaacctgtgagtactcagaacctggactttcatgtcttttagaaagacacattgacaataggcagaaaatccttagctacaactcactggctgaaagcttggtcagttaaattgtgaatttacatggaatccaaatgaagtgttcagacatttcaaacatctcttgcttaatgaggttctgtgcctggctagcaggtcagcagtctgatttcagtttacagatgcagtcttaaaaaaggaccctgagatcatctataacacttccctgtcttcctttgctccagctgcattcatcagcttccatcagggttcacagcaatgaaattaattgacaagaagctcaatcttaagagcactctgaactgtatactcttgccatccacccgctaactccaatcctacatgaatgaatgcaagtgtagttttttgagaaggggccatggctcaagcagtgccatatatgtgccttctatacaactggcttggtatctggtaaaatttccattgcccagttacaaactagccagtcccttgcagacctaggatcctcttagaatgccctatcaggaagttctttgcaagatgttttaactgagcaatgaatttatagaggaggacttgaataaattgtttcaaaaatgaaaccatttgaacacaaatcatgtctttcactaagacccagacaaactaactcatatgtactccacacatctcagtgtagtaagcagatggaaaatattcattgttttttttttttaccaatgagacactagtaacaaagagaaagtgtagaaattcttcaagatccctagaggctgggcaatcatatttctagcaaaactcttgactttcttcctgttctcaacctctgccattaaaataaggaaatagtgctatcaaagtaaaagagaagcatctgttggaggggttcaagggggttgagtctttaggcatcaaagctaggagttggctgggcgtggttgttcatgcctgtaatcccagcactttggaaggccaagtcaggcagatcacctgaggtcaggagttcaagaccagcctggccaaaatggtgaaaccctgtctctactaaaaatacaaaaattagtcaggcatggtggtacatgcctgtagtcccagctactcggtacactgaggcaggagaatcacttgaacctgggaagtggagttgcagtgagccaagattgtgccactgcactccagcctgggctactgagtgagactccatctcaaaaaaaaaaaaaaaaaaagaagaagaaaaaaaaaaagctgggagtttcattattcctcaaagaaggcacctcagaccaggttccatagggcacgcccctaaagagcccaaccttctcagggttctaaaatgtatcttaagcccaagcaaaatccttgactttccatttagatgccaatatgccatcctcataatattcattctcatggaattttgagttcccacactcttacatagctcccaaagccaacttattttactgctgaaaaatacttcagtacacttttattgctgacactggtttctctatacttcccccagagatattcatgttataagtaaatctttttccaaggtgtgcttcatctcctggctggaagcaagaaaaaaaatgttcaaagtattgtagcactttttacagagtgtgtatcatgaaatcaataatcatttattgagtactgactattcactgtggggccagatattgagaatattggagagcaattagatgtggtctctgactccaggggtctacaaacggcatggtggggaacaagctcattagatgaggagaaaaaataataatataagtgagtataaactcaagaactataattatgcattgattaatgaaacaaatactgaagatttactttttaaaaagcgttgtgctcaaggctatggcagatgtaagtttataatatgaccacttacattaatttgctaggtttgccctgacaaattgtgaaaaactgtggctgaaaacattggaaaatcagtttctcccagttcgggagaatagaaggccaaaatcaaggtgctgacagtgctatgctacctctgaaggctctaggggagaattcttccttgccttttcctagcttctggtggcggccatcaattctgggctttccttggcttttagcagcgtcactccagtccctgtttctgtggttgcaaggccttcttccctgtgcatatgtgtgtgtgagtgcatgtgtgcatgtgcacctgtgtgtgctcctgtctttacgtgacctgatacgaacactagtcttttatttggaacccaccctaatccaatatgacctcatttaaactaattgtatctacaacgattctatttgcaagtaatatcacattctgaggttccagggggacattgttcaacccagcacaacccttaaatatcctattgtcttgttggaggttattttatgggattcatttttggtgttccatggcttttcagaggaggctcagtgtccactgatagtctctgggaagactacgtaggcataggtccgaccattgctatattttcttatatctatgaaatcctaagttaacattttaaactacagtctactgtgtgtcaagtgttgtcctaggctcttatttacttaattcaatcttatcctcacaacagcctttgcagtatgattttttccattgtatagatgggaaactagttcagaaagtttacttacttacatgagacttataagctaggcgctgggatgctaaacaaattagttccaaagtctactattcaggctgaacttatgcatttctggtggtgaaagcacagcctacataaccattagtttgtgatttagaccttagcccaaacattcgtcattatcatatttgaagccaggatggacccattgttccagatctatatactgtatatcagttagccatatcaattaataatcttttgatacttgtcaaagagcagagaaccgcagaaattaagagtttattctcttcattaaaccattaaagattggaggtggctattgtgaattgggcatgaattatagcataagcctatatatgttgcatatagccccccgtaacaagcctccttgttgtcttttgtgttcctaacttatgagcagggcagagattatcactgaacacattgcagggtaaatgtaggactctgagtcacccattggatttttacaggctgaaacatttacagtgtcctgcttacaattctcaagcatcagttaggtgcaggaacacacaggcagagtcagtagctgcccagggaactagtgtccagtctaatctcttcacaaactttgtgcgtgattcaggaaggattattacaggccaaattttacccatggacctgttttgtttagtaaaatattttcaaaaataaattttggatttgaatgactttagggaaggcaggaatgatctaggctctcacaagccttagtcattacccctggcctgaattacatatttatgtgagccctctagtccctggaagcagttctgtttgtcaccctgtacttagaaaagtggaaattaatgtatggttcctggacaggcagcaccagcatcaccagggaactttttagaagtgcaaatcctctagtcccacaccagacttactgactcagaaactctgacgtggggcctgtaatctgtgttttaacaagccttctggttgattctgatgtgcattgtcctaggagaaccactgacttagagataagttaagaaactcttcctttcttgaagaatagcgtcttctgctttctaataatgaacttttctgtaatgcctcaagatctacaaagatgtcttattttgcttccagagtcacgtgagaaaacagtaacaatttgagggaggtgttgctctttcagctttatccagagatgtgcggtggcttgttccaggtgttatatgacaggacaatggacctcaaactcaagattctttttcctctacacttcactactttaactctcctgattattttgtggactgatgaataagtacgtgtaaactgattttagttttcctggtaatgaaaaaaaaaaaaaacaatgagtattgttactcttgtaataatcacatcattttttgtctttctttctttttctcattttatttttagacagggtcttgctctgtcacccaggctggagtgcagtggcatgatcacagctcactgaagcttcgaattcccgggtttaagcagtcctcccacctcagcttaccaaggagctaggactacaggcatgtgctgcaacacctggctattttaattttttattttatttttttttatttttgtagagacagggtctccctgtgttgctcaggctggcctagaactccctgggctcaagtgatcctcccaccttggcctcccaaagtgctgggattacaggcgtgagccacttcacccagcctttttttctgtgtctaaaattcagttactctctcattcacttaacagtttagaaaatactaactatacaacatgtactacgctagatgattttttaacttaaaaatgtgcaatgcacatgcatattcataataaaaatccatctttctaactcctgagaggtaagcaaaaacttattttactgctgtaaaaatcacataattggggacaaaaacttgcatgtaatatattttctatgagactgtattgactttgagagtggttagagttaatggtttgaattagcataagtaaaattaatgatattgtaggtcttaaatgtaaatgcaattttacaccaggcccagaagaaattcccctcacctaccttaattggtcagatgaaaatatttggaagaaatacctcattcaattttttaaaagcatattggctacttgccaccattgaagaattagatctcaaactaaagggattgtcgggatgggcttaaacagccttttgatttgttcattaattcatcaattcaacctctcacaaaacaattgtatgttgaatgactgctaggtgctgtgtgctatgctaggtgctgctgatacagttatgagcaagacagactcagaatcttataaatctttttgtacaaaagacaaacaattatttcagtgagttgattaaatttaatattaatatttaataaagcagaagtaattatacctgcaaaggaaaaataaagtgtgtttttagcacctataatttgaggactgtgggatggtagggttatctgaaaagagataaataatttgttgtatatttgtttcttttggggggtgaatgccatgtgccatgatgtgggaattaattggaaaaccataggctatgggagtcagaagagacattagaggctctaatatctgtcccacttttctctaatttagaaatctggaggctgggacccagaaaaggtaaaatgaattaccccaaagccacacttagtgaatgaaagatgtgtgaacggacatatgcatgggcctccttaatcctatgctagggatgaggacatgcctttcccaaaaataggtgaaattaccatatgataaagaacatttttagatattgggagtagggtagggtacaaggctttggaacagcaaagttaatcagctcagtagggggaaggaaaaaggaagagagaaagagcaggacctccagtggaacaagagtctgtggactctgtcaccctgttactccctcttaatcactcagatgatttgctttttctgcttctatttcaaaataagctgctaaaactgagatgcagtgcagtgaaagcacatcatgatctatgttctcatttttgcatggagggagtgagtaaagacctcctacttaggtagtcatcttgctgtccctgcatgtagactaaggctgtgagagagaacttggtgctttataaggcattccctgtgctggtataaatttgacccttgcatgtgagtgatggtgagggacatctctgagaattgttcctggtacaacatgtgtggatttcaacatgggtactgcatgctggagagatcttgatatgacccaaaagcaagaccagaggcaagcttgacacgatggagcaaagggtggaaaggtagaaaatagaatgaaaaatttttctttgctgtcacctcctcgattttattcaaatcttaacccaaacaactagattgcattactgggctcttaaaagttttgttggaaaagtgctgctaaagaataggaagacaatctaggcaatgccattcaggccataggcacggacaaagagttcatgaggcagacaccaaaagcgattacaacagcagcaaacactgacaaatgagatctaattaaactaaagagcttttgcacagcaaaagaaactatcaacagagtaaagagacaacctacacaacgggagagaatgtttgcacactgagcatccaacaaacgtctaacacccagcctctataaggaacttcaacaaatttacaagagtaggatctcataggtttatttacaataataattcaaatgtttcagatttgtaattgtcctttgaaaccattgctttcctttaattccagctataccaaagactctttggaatgggtaaattatttctacttgatagactaggaaagtgagtcacaaaaaggctcgcccagagctactggttattagttgtgtgtttttctctcctattccacactcgagaaaaccccgaagaatagggggtggttaatggtaaaaagaaatctagaagaagagttctggaaatgaaagacagctaggttttgagtttctctaagaaaaggtagggggcaatggatttaaactaggggcatacactgcgattaaatatcgaaagaaacacactgagatttaaaaatgtataaagggcttatgggaacgaagaactaaaaagaaaatatgaggcaagaacatagggtggcgacagaacaaggctgtgagacgtgtgcttggtttgtttaggctttaaaacttgtcaaagtttaccgttttctctttcaagagggatgaaagaaaggatggtgcttcccttagtttgtttgctttcttctttcatgtatctgccctggcagatatgcatacatgtgcaggcccgtgtgttcgtgcacacatatgcacacagataaagtgggaacagagagaagccagtgggtggtggtgagagatgggggcagaattgatgcatcagggggcctaaatccatgcaatgatcaagttcatagcaatttccccaggagactgtatcatattccagtgaaggggagtacggcaggaggttgccatggcaacaaaaggcctgaaatattaactctgactagcaacaggccagtgaaacagcctagctaggatttatggcacattatagtgtgaaaagcaggagaaaattactgtaaaggcaggaattatagcacaacagaacatataaactcccaaatccgtcttcctaattaaaacagcatgctcggaggtagagcacatagtaaggccattagcttaaatggggatgtgctatcatcgctttgttatcaagtttaatgtccttaagactaactgtgtgcactgggagagtgagagcaagggtaagatagtctggagacagatggaagcaagactcttgggcacttgaattcttctcaaactcattcttggtgacataaggtttcttcagatactagtctctgatcccacaggagattctagaagatgccttgatccttctatttgtaaataaatcatcacttctcaggcatgaaggctgagagactgataccacagtcaatccctctggaacccaccaggaagagaggagcaactaatcaatgaggtttattgttgaggaaaaaggatcttggatctcccgactccctagaggggaaaataactcccttgttgtcacagacccaaactttcttttatgtcttagtcaacagcctgcccctaagtgtttgaatttgcaatgcctggaggaagtcttccatgtaattcatactttatgagggaacctttgtcttcttgtgattcttattagaaactcccaatttctcgaactctaatccaggaccttagtactcagtctggagatgggtcagggaaaatgagaaaaccattattttacaagggttcattgttcatcctttattctgccagccattcaacaagtatttaatgaataccttctacattctagtaaatgctgggaacatgtccatgaacattaaacaaacgcacaaataattacttaataaacagttaaatatacaaaagaaagtacagaatgttttgaaaattatgaaaattcttcccatagcactatctttatttccctatcaccatagttgccaaagtgcccccacctgacattcttttaggtttgccagatgaccaagccctacattcccacagctatgtcagcaacatactcaagatcatcctttagacattgcattcccctcccctcccctcccatcctctcccctcctctcccctcttctcccctcctctcctctcctctcctcctctctttcttgagacagggtcttgctctgtcacccaggctgcagtacagtgattcaatcctggctcactccaacttctgcctcctgggctcagatccttccacctcagcctcctgagtagctgggatcacagttgcatgccacagtgcctggctaatttttttttctcttttgtagagatggggtttcaccatgttgcccagctggtctagatctcctaggctcaagcaattcaccctcctcggcctcttaaagtgctgggattacaggcatcagccactacttctggcctgtgtttttcttttttaaagataagacctaaagaggattttgactattttgaaaatatattcatatctgtgtatttttggttattcacttccaggtcctaaagttgcaattaaggagaaaaaaatcattgattattcttagtagttttgatgaggtaatgcaaggtttttctgtagcaaagtcagcatgcgtcgtgaatatggttaagctatgtatgattaaaggattatttatgttttatttataagtatttgctatcaataacagctcccaaaagtaagattcaccagtattactacagcatatgggacttttgctgtagattaataatgccatgatattttctttaatgaaggtggaaatgattgctttattttaacaaagggacctctatggtccccctgagtttgagccttgaatgtagacgatcagggatgctatatcacagctgtctccctgctgataatgactctccttggggtttcataatttctgcctgaaatcctttggtttcctctcaggaggcatggagtgaatttatagggagattcttcaatccagacacaaaaaaaggttttaaaattttttgtgtgtctccatatttgactttctgtctcccattctcatttcctttactttcatgtgtgtgttttcttcttactgtgccaaacacataataaatgctcagtatttgagattaatagatataatcattattattttgtgttattctttctactcctcccttataaaaaaagggattcctcccttcatcatgcttcccatgccttcatatacttcttattggtttgcagaacaggcatagttatgatggagaaagtaaagaataatgattaaaaagaataataacaaaccacataactaactgtttgggtttaaatgacagaactctcaaatccatcttcctaattaaaacagcatgctcagggatagagcacatagtaaggcttttagcttaaatggggatgtgctatcagtgctttgatatcaagtttaatgtccttaagattagctgtatgtgccttgggagagtgagatcaagggtaagatagtctggagacagatggaagcaagattcttgggcagttgaatccttctcaaactcattcttggtgagtactgtcactttctaggtgtgccttaggcaagttatttaactgcttcgtgccccagagagtggtgggggaatcaagggtaggacacatgtgagtcactcagaacagtgcctagtctttagtgaatggaacttcgggtgttcattattgttgatattgcaggtgtaaagaatttgattcacacactcctatcatggattggagggaagttgaatattggttcatatcttgttttaggttctggtttacttgctgcctgaactaggaatataattcgggatttgcagctagtaagttgaaattaagaagaactcaggcctttagattaatcaagtacatatacagtattgaaattatgtctttttatcagtatctttccagaggcccagttaggggagctcctggcatgtgcccggcatgtaaggagtgtccacaagtgtttgcagacctgcactgaacactatttctcttttgatatgatgcagtttaacatactcaaaagagttgagccttatcccctttgctcctcaaaaccaaacacagccagttttggattaacttttattcagtcatgttttatgctgtagggtccaacctaaattttctaggacgcagcccaactaactgaattctttatgtcacttgaaggataacgtcactacagttaattttgataataacatggtttgaaggattcctaactgcttgcaatttatgtaatattctcagtgctctgtgaatttgtagtctgatgaaaacactgaaaagggaggtaatgtttactatttctgattattattctgtatccctcatgcagacctaacctcaagcatttgcagccacccaatgactttttttgaaggaatttttactagtgggttcatctggggcagatgaaaatgtttgcattttagacactccaaatacagatataaaaactttatgtctcctcctccagctctaccttcaactttcttttcactttctttcctactaagagcacatatttccaggctcattcttcatccctaaactctgtccctctccttactcctttgttccgtcttttgtcctctccctggaatttctggtcatttgcattaactacacttataagtcaaactttctttgttcctttgtgggtgtactcagaacatcattacattcaagtaaattcatgtgttttttttctttttttgcccttttatttaaaagcactcctactggccattagaatagttaccagaaatctcctttggtctatggataagaaattctgcagaacttttcaaccaagtaattagatcatattatgtctaaactggtgcctttttctcaactgaatccaagtaggagtatagactgttaacaccttcaactgagtaaactgcaatctttgcaaagtgaattaatatatgaatgcttgctaaggcaagataacacatttttcaattaacaaagtaacaggagctcagggtagcatgtgatatatatatatattctgctacatacatatgcaggtatatttttcaatcaacaaaacaggagctcagggtagcagactacagatatacatgtgtgtatatgtgtatatatatatgtagcatactacatatgtatacatgtgcacatgtacatatttatctgtgtatatgtatacattatgtatatacatatataggtatatgtatacatatatgcatatgtaggtatatgtatacatatacatatataggaatcctatatatgtagtctgctacacatatatattcacatatatatacatgtatatatgtagtctgttgtcctgagctcctgttgtttgtcaattgaaaaatgtgttaccctgtcttagcaagtgtgtgtgtgtgtgtgtgtctatatatatatatatatatatatatatcctcaaaattttacctagagtaaaaaaatgaaatgcctacattacataaagacccatatgacaatattaattctgtgagctgagacatattcatgccaattctccataccttctcccccattgcccattctccagccctttgttgttcactggtcctaactctgctttcttactacaatggcccacttactgcatccttagtttttgacattttgaaatcacaaggttctcatattaagcatggacattttctttacttttttattaattacaaccacagaacttctctcgtcccactccttcttgttttgtctttgggtaaaaggaataaattatatatttatcataaattttaactctacaaaatggccatatttatactttcttcagatttctctcagttctagttaaggtttttttttggcttccatttgccccttatttgattattatactccaagtggctgaagaaaaaatacattcaatataatctgtctgtaattttcatgtcttcctcattaccgtaaaatataatgcttatttgagacacacacacacgcacacacacacgtgcatactcttggcctagatcaaccacacagattcatttattttaccttctcattaattagaccctcaagcctcttaatgttgttttaacactaatttgttgagttctttctggcaccaaactaccccaaactccatgaagaactgaatcatcaatgtattatttataggggcttctttcgtgtgttcgtttaaaatgtagttatctaattaatttattaatttatattgtcaataactattcccagaaggttttttttttttcagatctactagagaacttaaagctttttcttttccaggaatggccaaaatatccagaaggacaatatcaagtaataattaaagttataagctcttggtttgaattcttgctccactagttatgtgaccttgagcaaattacttaacttctctgtgccttacttttgccatttgtgaagtggaaactaaatagcctttatgtcccagtaacaatgcaaagtttattcattgccgattagaaggggcacactgttcaagatgctcattaattcattcactcattttatgtaatgactcatttatcaatcctttgttgagtctcaaccactgtcctaggtaatgctgatacaatcttatgttttgaagctcgccacaaaatttgatcaccactagagccaagatttaacacattatttcatttaatagctattttgagtcttcagggtacaatttacagttttgggggggaagatgtagggaaatatgactcgtcagactcaattaagtgcatttactcagggctacccatctattaagtggcatggttctctaaccccatagttcattctctttttctgtgcaccactagtaggttttgcataaggtaattttgtccaagtggttactgtgtgggtcctgttcacaatcttgatcatgattgtattccaacttctatgtcagagtttgcaagcatgtggcttataaactcaagatggctggtacaatgttgttcaatatttaatggaggggtattaccaagatctagttttctaggttttcttgagaaattagaaaatctggcaacactaagtttgtaataataccagggacaactagccaaactgccctattttgttgaatcatgtgctgtctaagtcctcacagtccttgccacccccaaccctgcaatcatcctacatgtagtgtttctatttatcattgtatttttgcttttatatctcttacatcttgtcacattgtatagcctgtctagcatttgaatttttgactcctgttttaagctagagatatgcttgtcactgaacacgacttgaataaggaaatgagtaataattatgactctacatgccctttatagtacacaaagaactttttaaacaaccatgttatactgctactttgattttacagtagtttgctccaaatgagtcaaatggtatgtagtagagtcataattagaatccagaacaattggtgtaagtctagtgcttttctcatttatctgtcattcattcatttattgacatatttattcaacaagtaaacaattataagtaaatgtcaaatatattctagaccgtatagtggatgctagagatatagatgtgactaagatacagtcccaggctttaagaagctcatagtctatttaggaatgacagataaacggatttttctgagtgcattgtgatgtgaactgagaaatacacagggtatgtacaaggtgccatgttaacatcaaatggcatgtgattgattttatctgtgactcagacatacctctgccactgtagggagtagtataattgacatgggatcctggccagtctccttatggtgatggtggttaatctacatgtccctgagtatcatggtctttacagaagcaggagagtgaaatgtaaaaagtgctggaatggaaatcagggcaccaagtatatatggtcctggctctgacatttgcttgctccttgacgttagaaaaatcgttgaatttatgtgtgcctaaatatcttcaccaaaaaataaggaggcataagaggggagataccagatcttacaaaataagtaggttttatttacaaatacttatggattagtgggggccctttcactaggctacaaagaatttgaggctctatctatgcttagttttaaagaatgctatggtcaaagaagctatgtttgtcataggcactagaggaagggatagaaagattctgagatctaggggcaaaagggattttgagagtgcaagtgaattaaaaagctaggatcagctggctcagtggctcacgcctgtaatcccagcactttgggaggctgaggtgggtggatcatttgagttcaggagtttgagaccagcctggccaacatgatgaaaccccatctactaaaaaaaaaatacaaaaaagtagccaggggtggtgacctgtaatcccaatcccagctactagggaggctaaggcaatagaatcgcttgaacccaggtggcggaggttgtaatgagccgagatcacaccactgcactccagcctgggtgacagagcaagactctgtctcaaaaaaaaaaaaaaaaaaaaaaaaaggctgagatcaagtttctgctgcaaggacattttcattagttaaaataagaaggggctaataccaataaaatgcatagcaagttgactattcaaaccaaaaggcctccagttgaagttgtgttttaatttaagcactagtagggcccagcaaatcaaatattgaaagatgctaaaattagtctgattactttgtgagtcatcaaattgatttgactgtccttgcccttcatataatgtcccaatagacacttaacctgactctacttccttgaatttggcaaagtaagcacgatcattggagttactgcttttgggattatttatttatcacatcacctctgccatcattacttcccactcgtctttgtttggcttactttctactgtgcttctctctatcaaatctttgcacctccttaggaagatctggaagtcacctctctgtaaatctgagaagttattttcattgttgttggatgataatgcttaagccagtgttggaggctgcacaagtaaattacatggttttagaagcacctcctccttccatctgtgctgtttggttgtattctttattggatctgggatgatatgacttctttgcctggggctgttgctgccattacgcagttttggattcactgttgcttcataccaatgttggtgctgtaaatgtacatgataagagttccacagtgagatggactacaagacttctggacccagagccccctaaaactagatccaagaccagattatgcactgctactgaggttggcctgctatggtacagactgctcctccttccccaaggatacaggcacttttacatagagggtacaacagatcttgacctgcaggtgttcaaaaatcgactcataacttccctcctcttatatctatcttatcagtaaacaaatattaataagtcataggaatgaaacatgcgactctttttggttttgttggagtgatcatgccagaactgggactttctaatcttgaattcaaatcatgagagttaagcctgtcatgaactgtgagtgcaagctgacccaggaaccatgtggttctcaaaaaaaaaaaaaaaaaaaaaagcttatggctctttttgtgccacaatggcagaattgagtcattgctacaggcagtgcatggcctgcaaaacctgtgatattattctctgctctgatattaacatagctggaatgtgccccaaatgtatttcaatcaagagctttcatgtattttttgaaataacctggataagaaaatccagattttagactcaccattctgcgggggagtgggggcggcagggggtcattgatcctgtttgttttctctcttgcatgctgtccttggagatcagaggattgatgtttgagtaagaaatgcagaataggaccatatgttaggcagggttatagacagtaaagcaggtcagcatcctataacttgatgactcaatcatcctaacattatgccatctgggcgctgatactgttcagctctcccttttcttatgaaaagtttgactcaggtcaaatagggtgtctttttttgtttccttagaattttgttttctcttccttttagggattagttcttttagtcccacctttgagataaattttataatttcaaattttgaattctgatctaaaccctcaactgttctttctcccacagtaaagaagttaaagcaatcgtagcaaaaaatgtagagagtatttctttccccatccccaactttactgagatataattgacgaataatatcatatgtattcagggagtacaacataatgtttgatgtatatatacattgtaaaatgattaccacaatcaagctaattaacatatccatcacctcacatagctaccgtgtgtgtgtgtttgtgtgtgttaagaatatttcaggttcactcttagcacattttaagtatacaatacattatcattaactgtagtctccatactctatattaggtctccagaatgtattcatcttataacctaagtttgtactatttgacccacacctccccatttcccctatttcctgacccctggtaaccacacttctactctctgtttctatacattcaacttttttagattcaatatataagtgagatcatgcagtatttgtatttctgtttctagattattttactctgcataatgtcctctaggtttatccatgtttttgcaaatatcagaatacccttctttgtcacaggatgaataatatttctatatatatgtgtgtttatacatgcatacatatctctctcacacattttctttgtccattcatctgcacggacactcaggttgatataatgtcttggcttttgtgaataatgctgcaatgaatgtaagagtgcagatatctattcaaggtactgatttcacattttttggatacataattggtcctccatatccatggattttacatttatgaattcaaccaactgtggatcaaaaatatttgaaaaaaatgtgtctgtactaaacatgtacagtttttttcttgtcattattccctaaacgatacagtgtaacaactatttacttagcatttacattgtattaggaacttaagtatcttaaagatgatttaaagtatatggaaagatatgcttaggttttatgcaaatctgatgtcatttcatgggagggtcttgaacatctgaagatttttgtgtctgtgggaggtcctgaaaccaacccctgtggatactgaaggataactgttactcaaaagagggattgctggatcatataaagttattttcttaatgcattcatgtatgcactagtgtgtgtatgcctctatacacccatgcctgtcactctatgacctgttgtcatatctgtacattcatgtaacaatcgccatgtttaagaaatgtagcattgagcctatgtcttaactgatgtatcctgtttcaatctatcttgaagtggccaatcaccctatccccaaagatactgctactcaaagcatggtccctgaaccatctaggaacttattacaaatgcagaaccagagaactcatgcctgatatactgaattggaatctgcatttaacagatttcttggtgactcatatacatgttaaaggttgtgaacactgttctaagaaatgtcttcacttcttattcctttggcttgcagtgattaattgggtagaggaggcagcatatcagaatcattatgaagcttaaaataaagtgtgcctgggttttagacccaagattaaatctgaagcgaaaccaaatgtctgtattttttaatgattccaaaggcaatcctgatgtacccaacacagggcaagggtatatattgcaaggagtcacagaatctttttattcttttcttttaaacctcctggcaaccttctcttttgctgcctggtcaacaaagattatctaatgtggttgatcagcttttcactgtcccgttcattcttatgacaatttgccctaactatgcacaaactgagaactctttttaagggtaaataaatgttctcattcatcctcacaattgatttaaaatattgtaacattttctaaatatgtacaaacagaaagctatctcatagttcttgtatgaccagaaagttattgaaattttacaaatcaaatgcaaacaataccatgtaaatgaagaacattaacgtggcagatgacattttcctgagaataaagctctacttgcaacataaatacaacacaattgctatattttaggttctttagaatttggcacattttactgctgtatgccttgtgatttctcagttctgttattatttgtctctgtttgaacccatgcaaaaccttcatccacacagcttagactgtcattcagccctctctttctgcaaataaatctaatatatgtctatagtcagcccacttttcttctatgcagatttcattaatgaaagtagtaattcttgtcagtgtgattgcaagcacaaactcaaagataacattacatggcagtccttggttggcaattgaatggtcagtattcagttgaaaggtcatcaaccagaaatatggttagccattttttagaagaaaacaaattagaaaaaagtatggataacaactttggacaccaaagaatatttctataatatttcctgctcagtctgtagtggaaggcagtagagaatagaacttacaaacatagccttggagtgagaaagatctggaaactatttatgatagttctacttactagatgcatctcttggaacaagattcttcgcttctctgtaacttggtttcctcgtgtgtatgatggagatgattattatctatttcataggccaggaataggtatgatatgcaagaagcacctgtggccctatcttagcacatcataaggactaagttatcaggagctattttaactattataatgatgttatcattgttgcatctttattataaatgtgaacattaagtttttattaattaaacctgccacatatttcttccatttgcttcattgtactcttaagatgtttattcatttttctcacttcttgctttaagaacctggttattacagaggtgaaaaatcccatcaaaatgctagagaatttggcacaattattgcttatatttctcctattgctgcttttactgctgtagctgcctcctgaactgctgctgctgctaccatggcttctagatgcttctttgacaatttatttattttccagtggaacccatctgtgaagaagcccttcatagcagtaatatcctggggctgggcactactacaataatgatgctttcgttaatcaccccatgtaattttagtttttgctgataaatactacaataaatcgattgaaactgatgaaaatagctcaaaatttagagacatacagtatttcattttaccatcagcgtatttctatgtttatgcaatagggattgaaaaagttcaatccccatgctcaaaaacacatacttccagctctctgagatgatatgccagacagggcttttgattagaagccttatttttttgcctagttctagcttctgtatgagtggagactttattaacaaaggtaggtttggagcactcaacagaagcgtagagaatatatggaaaaaaaaaaagaagaagaaaaaagataaaagggaaccaaacaaaacaggtttacaactgttttactaataagagggaaaagtctgctcatgagttaaaccaagactaaagataaagaaagaaagaacatccaaaaccttcatgtgctttgtatttgtacatttctgacatatgcatgaagcatgagggaaatacagtaatacactgaggtatgctgccaacatcctgactattcctagtcattagatagcctagtgatgtttttcagttagaggggtgctgaccttactgttttcagtaattataagtctataattaccttttatattctttaagtgtatttttgtaatttcaggttaggtatacaagagtggaaaccgtgtttgatctgacgttttggctcttgtatgaggcagctttaaatagctgtcagatttggtttcattttagtgaagggttaagtaattttaaggcgttaaaaccatgggcaataaataaccatccacagtcatcgaaggaagttgcttcttagacaagagaatgaagctagagctgctagggacattagtctgataaaaagtcacatcagagaaggtttacctccaaatgattttggtggcaaagaagcctgtgcatcaacacctgcccttgagcacagcagtcaataaaaataaggtaacacaaagcagctctcttgaaaacaaaatcagagcctatactcttaagaagttcatagccgtcacaaaaggaccctcgtggcagtagaagctaaatggccaagaatgctggaaatggggctgcaagtcataaatggagaaagtctaaactaagagggtaaacagcaggtgacagtaaattggagcacttggccaggcaagccctgcatctgccacagtgagatcagttactggagagtcatcccaggcctatttcacactgccgtctgggaatgtgggactctaggttcttaagtgttaactatgggcaaaaaagaaacaagaagtataaagtcattgagaagattgtctgcagtagggcaggcatggatgaaaatcgaactctactttgtctgtgggtgaattatttaccttctatctgtcctgggtctgtaaaacagttataagaatagacagggttaatttgtgaaacttagatgaatatgaagtatgagtaaagtaccagacatttagaaatgctcatcaacatcttgaaagaagttctttcattgagataaaaagggtctttgtatctctttctgtaattcttctgaaaacagatggtcagggtagagagctggtgcaatagctcaaatggtaaatgacagacataagattcaaaagaagctcaataggaagaatgatcctaagacaaaatggatgaattgcaatagggttacataaaccatttccttaggtttagaaaagtcgttattccatttctaggtaggagagattccactgaaataatgtttctgtgctaaaaatgcaaaagccaatttataacttttaaaattataaattgaataagtgcaaagagtgtgatatggctgctagatattggtagaaaaccatccttctcatttgtgcccttattagatgtcatcaagagtcttgtgtgcctcctgctgccacatttaaagaggggagagagagagagaaagggaggggagagaaggatgaaagagagagagaaagacagaaagtgaggcatgtccagtatggtgaaatcagctgtaatcaattccagctcaaccactatgagtccttggacaagttacctcattgacaaaatgaggatggaagctccctccctggcttgacctaaggattggattacataatgcaagtaaacaactctgcacagtacctggctcataactgggagctctgattattcacaggaaagagtggtgagagacagctatgagataaggagctgcagaagctctcggtgatctgccaatataagagaagcttaaggcaggacatgacaactgtcatcaattatttagatacctgttatgtagagaagcaattctcattaatcagcctaactctaaaggaaagaaccaggaccagtagatagaagttatgggaagagatattttggctccataacagaagtaatgaaagcagtagtggtgtagtagtaggaactgagaatgcaaatagctcttggagtgttccagttcctgttctaaggactctgcattcttatttgatcctcagaacatctatgtgaggtaggtataattattattattttcattttacagatgaagaaactgaggtacacagtgaagtaaatttccaagaacatgtaaaatagaaatgaatgacagagctggaatttgagcccaggcattctgtctcttaacccatttatgctggaggttgtgattttttaaactgatgtatgacagaaaaatcagaccttggcaaatatcttgagcagtaggctataaataactcccacatgcttagtgttccaataatggaacactaggcataagtggctacacacattatctcaactgccccaaaaagtagctcaaatacacagggaaaggctgagtgactgtacaccatggttgctagtaaggggattcctgcactgagttaggaattggcctggataatctctacggtccctcccatgacatgtctgtcattttataaaaccaaaaagcaagcaaaaaacacatggtggcaaaagctaatacaaaacctagagtcaaacattcatgaggttttctcaatgcaaaagaagcctaaaatattcacctgtaatctatttatatcaaccttatactcagttataaaaggatggccatcttattgtcttgttcaaggcagagcagaagaaatacatttgaatctgggagtggtagtagaactaatagcagcaaggagagactcatgaatctttaggagaaaaaggaggtgttaacgcactgaacaaatattaactgagtgcctcttctgggctgagataagaaaatcattgtgaaaccaaataagaacaagcattgcaggccccagatatttagagactccagtgacgtttgggcttttcctgaactttagtgtgcaatgtcattttaaaaagtattttaggggaaatgataaattatagccagtttcataaaagaggtatacattatatttttaaaagactttatatgaactgaatcatttgactttaagtttgggtgtaaaaagggtatacttcaatttctctcaggccagcttgctccccagtaaatgacaaatatgggtctcgccgcactaagatattttaatatacttcagtgggaaaggctctgatccagaaatttgcagttgtgctattgataaaatttatgagaaactttcttctgtgggcctcagttttcacatctattaaatgtgctgatttaactaaactatctttatttcctttaggctcagacatttcctatttcttttatttctataactgtacttattttcattatgtagataccagatggcaaaatgtcctggtagtgtgtgcaggactcaaactgattctgggaaaatggggcacaagtgaattctaaggtataaggagctgaagtgagcagaagcctctagaatctatttctatttctgtcagctacagaatgtaggcccagtttaatattaggagacgttgtctagcttttaatattaggtttcagagttgcctaacaaaacccatagaggttgtttcttgcttagagtaatttaatgttataaggatcaggcaggtgcaacatggcataaaagtattacttgccccaatgccacctttaatttctctcaatctttcaaagcatcaaaagaaaaaaaagttctctctttgtctattgtttataaatataatttattctctgtgcttaggtgattttcatagataagaggacattcattgtattcagtaaaacttctagagcagtccttacactagtaacaagtttcctgggcaatactgctttgttatcagacttcaccatgtagatctcacatccttctcttttctgatcttgctcttatcatttcaaagttacatgtagagtgaggatgcaggtttcatagggtttttgtttttatctgagacagagtcttgctttgtcacccaggctggaatgcagtagtgtgagcatggctcactgtagcctcgacattctgggctcaagtgatctcctgcctcagcctcccaagtagctgggaccacagatacatgccaccacccccagcaattttttttttgtcttttttgtagagatggaggtctcaccatgttgcctaggctgggcttgaactcctgggctcaagcattcctccctcctcagcctcccaaagtgtaggattacaggcatgagccaccaggcccagcccatggtgttttctgacaaagctactccattcatttgctgtttgaagttgattagtgaaccacattttgatgttcactaccttcatttgcttttatattcaactgcattctttaagaatcttccctcagcagttagaaggccaaagataatttaaatgggattgagggatatttccctctcacattagtgctgtagagccacataagaaggtattctatggtagaaatagatttagaaaggtcaaatttgaaaaataaagtaagtccagacccgagtgataagatggatggctgtctagattgagcatgcaattctaatacttcagttccacattcttttttttttttttttttttgagacggaatcttgctctgtcacccaggctggaatgcagtggcacaatctcggctcactgcaacctccgcctcccaggttcaagcaattctcctgcctcagcctcccgagtagctgggactacaggcgccctccaccatgcccggctaatttttgtatttttagtagagacggggtttcaccatattggccaggctggtctcgaactcctgatcttgtgatccacccgccttggcctctcaaagtgctgggattacaggcatgggtcaccgcgcccggcctagtcacacattcttaaagatgtttcagcttttgatttttaaacagaatggtatggagaagggcttttgctggaggtgcttcagtcagttagcttcaactctgaatgaacaccgaagatgtcttggctttcctaaagactcaggctacagattcttgctcatggccaggggtaaaatgcccttcatccaatttaatgctctcccatgtgtagcaaacatatcaactactctgggttggcatatgggggttttagtaaaactgtgtaaagaatttgccatagaaataggaatagtctttcactttccattttgtactctgggtcttctctgattatatatctcttttggttttcctttccaagctccatctttatcccaacctattgggtatacatctgatcactgctttgctaacacgataatacttgagactaattaacaataccttagtgatactgcattctcaaataggaaaatttcaaatgactagaagaagactagttgatgcctaggaccagtactagaatggttaagttactggttggaaacttcagtgtgcttgtttctgcaggaggagaactgctttaatgtgaattgcattagaaagctcccctccacttttccttccccagtgtttgtctactgaatagcagggtgaaagcgtcggttgctctcatcgcctcacaatcaggccaattgggcataactgctttctggtagaattcatctcataataaattgcattcatggaagatgcctagtatgtggtaaacatggcatggacaggccaatactagagaaagatagaacactggctcagaggagacacaaacaaattgcctttctgctggctctgaaatattctttttcagtgtagttaaatataaagttgaaatgatgctaactacaccttgatccaaacaacctcttcattgcttggcttctgatgggaatgctgtaggtagccatttgttttaatgattgatttcactaatactgagtcacaattgcactcctcttgaagttgacataagatctccatgcacagaaaatgaattcattagaatcaaagtgattgtataagaaactcaaattatccaggtgttgaaatgcatgtctactttcttttcagacaatggaatcatttataaaacatatagttatttaaaacacagacacacatacagagactatcatatgggattgtgagagattgctaattaacacatacaaattaagacaaatattcattaaaacaaatattaattcctcaaagtttaattcttaacaaatattaattctacaaagagctaaaaggctctatgtaggtagataacggcattcagatttacctcctaatctttacagtaattggttttaagggttggagaaagaagtaaaggaggtaaaagaatgtacatagacaataataattatgaataacatttactaagcatctactatgtgttaggtactttgctaaccaagcttagcatttcacatatattatttaaaattcacattaactacctgaattacattcaattattttactcttcagggagatttgtataagttgtgtaaggtctaaaactgttaacaggaaagctgggagttgaactcaagtttctctagttcctgagccaagatcttagttgctaagttattaccacattctcagagcctctgaagcaataccactgaattcagggcttatgtttattctagcagcatctttctttacaaaggggtatgtaaaaatagtagtccttctaatttctcctccctccccccaatatttctgggattatgcaggcgatactttgcttttggaaagaatgaaatataggcaattgacagaggcagggtcctgactttcttttttaattttttttccttgatgatgagcataatcatgtgaataattaagcttcaagagctaaatgactgattggcagcaagctgactaactgttctttatttataaggatatagctttcatgggaaaatgtagggtggttggtaaaacatcagaagtctcccttgagatttcataaatgccatagcttaggggttaaactcacagacatttaagtcacatgttcttgagttcaagtccaagttgctggccctttgggacttttaactcccctatgatcgattgctataaattaaaactcagttaatagaatataatgtaagtagttatatatcggaaccaatgatagtacctacttcttagggttgtcaagagcatccagagagctaagttatacaaaggactagctcgatcactggcatgggataaatatttgataaatgtggtttgtaatattttataaaagtgacaaaaattcttatttatgtaccttttttactatgaggagaatcaggttggattcttagaaaaccttcagtgcctctgtcacagccttgcaaagactacttgggatatgtttatgttgataatttctccccttttatttttctatcagtcagatttataataagaatcagctgttctttctaaaagactattgtgcctttatattattttctttaattttcaataatcctatgaattagcaattattatcctcatttttacaaatgaggaaactagagatccgaaaagtaaacagcctcccagctaataaacagatgagctgcaataccaaccgaggtcttctgtctctcacaatccagttctaatattaaaacaaaaggctttgagaccatatgacccaaggtgcaatctgtttttcagatcagaagattgggactctaagatagaaacacggtctgtccagagtcacatagcaagttggagacagaatggacactagaccctaggcctctatttctggtctagagctctttcatcatttccaggctacttgtttgtttgcagcaatttgtatgttctgtagaggaagattgaaaagagaaatggatagaaagagagagcagagatgaggggatgagagtctggagagaaggggagagagagagagagagagagaaatagattcatatatgaaggttagatcaagggccagcatccaagggtggtctaggtagagtactgggaaccaatctcaacctggcaggagaggcataattaaccagtgtctacatctgtgatattatttgtccttgctccaaaatgacaatagtgattacagtagatgcagctgacagtagcagatgacacaacctcctttcacctcctggccagctgcagcgctaccatcaccagctatagcagctttctccctggagattcagctttttctccactgatggaaggctttccctccatcactccaatgtcagagcttggccgatttggttcctcaggagactgtagagaaattcactcccattgaagcattttcttgacattttgacattcaatcagagaaaggcaaaaggcaggctaagggcccaatcatcaggtccatgaagatcaagctatgttttctgagtacctattgatagaatgtgcaggagattattactgtttgccaaagctctattgatcttggctttgtgaagctcaaagtctgtttacagccacctataaaaaccaacagccacttcttttactgaaggttaacgtgctgtgtttatttaattgaatggaaatggccttgtgttttccaaatgtcattgttaataaattttcaagggaatctgtgactagtgtgtaggtgttgaggatgggagaagggactgtcatggggagggacggctgttggaatttgaagttgctggaagcaagagataaaagacaaacacatagatacgacattggaataatttccctgtatagaagtgctataaaatatccttactctatattagtgttgttttttaaacttgtcagtaagaattctcccctgggtgttttattctttagcctgcgtctgtttttgtttgttcttttgggtttccaaaaaatatatattttaaagtgacattgagcattttagtataattgtgagttttggggttgaatatttttcactattatttgatcagttttttccttctgtaagagatttaacagaaatggctaaaattaggagccatattagatagaggaagatattggcaatcctattgacctgctttttaagaggcgtgtttcaactaacaggaggagagatgcaaagagctttcaccaaagcaatcagaagacctgtaaacagcctcagggaactgtaaaagtctgtgagggtctctagtgtaccagatgaaaagcagaaactttaggtagccgtctgaatgtgtcaaatgggaatatcagaataactcactaaatttcctttttcaactttcctcgcaaggtttgtctttttatgtggtaaatgttggtgagttccatttttaagttttactcttcccattctacttcagtctccttagcaaacacacacacaaacacacacacacacaaacacacacaacacacacaaaattgttcttcttgaaagatacatgtaaatgaatggtgagtaaaaaattaaagtctggacgcagtggctcacgcctgtaatcccagcactttgggaggccaaggtgggtgactcacttcaggtcgggtcactcacttgagaccaggagttcgagaccagcctggccaacatggtgaaaccccatctctactaaaaatacaaaaattggtcgggagtggtggcatgtgcctgtaatcccggctactcaggaggctgaggcaggagaattgcttgaaccctggagttggaggttgaagagagctgagatcgcaccactgcactccagcctggcgacagagcgagactccatctcaaaaaaaaaaaaaaaaattaaaaacttattgtctcaaagcagccattcatttattcaaggaattgctaaacttttctaagggaccaggcactggcctgagtgctacatcgagagagagtaataagatcgaggatcccattcccacgttctgcacgtgtgtgtgtgcgtgtgtgtgtgtgtttcgatctgtgtgtgttggtgggtgaatggctatgcaaatacataacaatttaataagtcttatgatactgggagtacctgactctgattagggggcactgctttaatatctggcaatggaggatatatccatcttcattcgctccttcatgcccccatctaaccttgattaaagtctgatttcaaatagcccatttgttgaacattttatcaaggtttttcaggagcctgacagaaaatgtaaagtcgtcgtatgttttgttttgggaaatactacttctaaaacttatttgagtgtctcagctttttctttcttttattttattttttaattaaaaaaataatattatcttttatttgtctttaagagacagaaccatgtctgcctagtaccttcacttggtcaaatacctcttttggtggaaacaacacaaattatgtaggttgtatatacaggatgaactcggtttaaagataagacatgaaattcagtggaaatattctttaaattctaaacagagaaatcaaaacaaaggtatattcatactgcatgtgggtataagttttttcttacatatattatatatacatatataagtgtaacacttttaagaattttattgaccatctaaatatatagcaaaatcagctgggggtacaagagtgtaactacttccttttttcctaagttgtggaaaatgtgagaaatgagaagtaagcaagacggaggattagaatcacaaggtaggtttccctagtatgaattcagtacctgaaaatcttcttagttctgagtttgaagcagattctataaaatcctgtattaaaataaatacagtaggaattagcaaggatgggggaataggagtgggcagatatgttcttgaagagaataaatgcagaacattattctttgtcaattaatttttactttttatagattgttagactatttaacaaattcttatgagaaaagtgtgtttttaagtgatctctgggaagatgttcctgataataaattaaattaggactgtgcattgcggagcccccaccagttgtactccctctggtgaatttaataccagacgcaacctagttagaggtgacatgaaatcacagaatttgataatcttttttttcaaagttaagcaaatatagatgagctcttcttgtatatgtaagatgccagatggtgtttttgagaaatcgattcgtgtatagtaccagtccagacaaatgggtccaatccttctatagataaggcgacccacttttcctattcaaccatagggctccgttgtctggcacacattatttaacaaagtgacattgtggagtcatcagtaagaatgtggcttctggagtgaatttctttttgagtttgaatcctttgctgggtgatcctggccaaatttcttaacctgtttgaacattagtttcctcgtctctaaaatgtgagtaacaagagtttctcgtaggaactatgtaaaggtaaaaagaaactgtctagcatagtgcctggcacataatataatttcataaagtgtaactcttgttattaaactggatagctcaatagatattgctccagaaacactagtgcatgaggctgccattacgatcgccaaatgatagcagctgtgaactgccactccaagccctttgcagatgcatgtacttcttcgcaagggcttctagtcattgacttacccagatctatcgtcacctcttgaagaaacaaccagaaaacactttccctacttacagtgaaataagtgagtatccttctacagaaggacagttagttcttgaaccaagggacttcaatgccatatgagaaaaattgtcttgtatacaatatctttggagagtgaaagagttttaagcatcttgatattagaaattaaggctacaatgcattcaggttgcctataagttattcatttctgtatcttgttgtcaggaaaaaaaaaaagaatacttcaaaattaagttttttccatctaggatctcagatctcattgtataattttcatcattcaactggatttaataggtctatcagtatgtacagtaaattattttcaaaattcttcacctaatagctaaaaagtaagccctaatctggttttctgtgaaattgtcctcgacagaataaatagttcaggtgtctgaaaagaaaaattccatattcctatatctgggttgacacttaagactgcgtttgtgaagcctccttatatcttgaagacaggatgtatctatcttgctggtgagaattttgctgttctggagtctatatcaggtacctcaaacgtgatgagtgatagaggtcatgttttgttgtatcacagtttgttgaatctccctccttagagattcatttgactgaaaaattaacaggtttatttgtgcaaatggtagttgcacacccaattattgcttctgggtttcccatgtgactagccaagactcaaggtgaaagtttggcctgcagctttggcaaacaaaggagaagctaatgaatcataaaggtcacatcttcttgaattttcttctctttcttcactgttctgattacttttaaaaaatctctattccttatatattctgagtacaaaaactcattagcaagatttggttctgttgtctggagaattttctgctcactgcaataggaaggtgatccaggtaccacataactgtctccatgaagatgtttgcaatatgttatgagttttttaaagttattgtttgagaaaaggccatataaggagataatttttgcttattactaattagcttacccctcttctgctgttcttacatttatgactatttacttgtaaataaaagttattgatctttttagaagtccattggattctgctgcttttatttttgagaatcattttaacttacaaacacatattaccttttccaaaaagtgaccacatagctttgtgactcctccctcatatattttgagcacacagaaattaccatcctctcactgagtactatacatcggggcctctggctcttacctcctttctcagatccaggactgaatgcatagctgaaaagatgactttagtctttattcacaacctgtaaactaaagaaggtcattaaaaaaaattcttcgtatcttgcaaacaaaagaactgagatacctatctaagaatggcaagtctgagaagcaaatacctggctctagccctctgccataagtttgcaagcttgtgtagacctttgtctgagaattggttaggtatagaaatacacttcagcagagacttgacctatatgactttcaaatttgttatgattctacaattagtgtttgctaaaatcaaaactgtagaatatagtatagagagtatattaattgttggctctatgctgacccaaaatgaagtcttttaagagattagagtactacactgtctacatttaaccaggtgtcatataacaattaatgaaaattcaatgttttatacttagaatttttaagtaataacagatgatggatcaagattaaaactgtattgacagcctaagcaaagaaataaaatctaacaaaagaagctttaaaagaaatgaatgtaaaatcctatattttgattaaataaatcaagtttgcaagtaccaggtataggagttttggactgacagaactttacactaaacaagatgtaaaagttttagttgtacataaatttaaaatgaacctgccttactgtttcttttaaaaaaattaagaaaaaaaaactctacgcagtattaagttctattaatagacttctaatttattactaaattatgttgactcttcatctgaaatgtatctatctttttactccattaatttctcttcagtgatctagtcacagaccttattatcctttacatgacagtagcttaataatggtatccttgcttttctccctactacagtctgtcctctgcatgtagccaatgttatacttgatgacttaaatctgatcatatcattcccaagtaaataagccaacaatggtcctcaataattaccgaattaattattccctgagaaatggggcccctcagtgtaatatctcatctcaatcattttttttagttttgcagatagcacctgccatttctaaatatgtgtctttaattcatcttaaccacttcggattatgacatcctaaaattgccatatatttttatatttccatacttttgctcaggatcttctttggttaaaataatctttcctacttcacctttgaccaaccactgccagtgatccatgagattcaaatgtcttctcatttggaaggactgcctgataacctgctacctcagcttcaggagaaaccagttgctggcctctgtgctgttctcctacctctaaacagaatgtaaagtactattattttctcttcaattgacaaggcgcttctatgattgttcccatcttctgttggtattatttttaataaaaagatctcatatattgtgttaaagtactaaccttgagaagacccccagtctgaaagaagaatatttcacttctcccttccccattttcaatcacacatattattgaataattttggttaacatccttaatattctaaagtatcttgaaacagttattttttctattttcagaaataaggttttagtgataatactgaaaattctaaactgtgagcttttgtttcagggatagaaatttaaaaaatcatgaggtcttctgtcatgattttgaatgtttaatctactttgtccagtgggcttctgaatcttttgtgattggcacgtgttactgagatgcagacacatgcaattctggtgaccgagttctcaagctacagtttattatttcacactgcagtaaatgtatggactgagggtgaggggactgtcagaagatgtgtgtcttgggtgcctgaataatgcttcttttgctattcactttcatcttaatttagagtcatatatttcttgttaccttttggttttccccggcacctaacaatgtaatcttcacaaagcagtgctacattctaaatttatagtgcagtaaatgaaagaggttggatccattgtgcttcataattcagagggaagaatgtctgcagaaagaaacgtgggtattctttggaatgccatatgtgcaataattgaaacattttgaggaatttccaatttacctcttaggaggaattcaggtttttgttctttttgaaaagaagatgattgttacagacttgggaaatcctaaaagaaaaaagaaggactgttgggacatcctggttgttcttgacccccgcaagaacagctacagttctttcagatcacagcacttgaagtcagaagcctaagtgggtgtccagagaattcaatgccgaaaggttttgcccctcttaactctcctgaccactagcattctctctaccttagtgtgtgggtaggtctttgttatgtctccagactcacactagttttttaaaaaaaatacttaggtaaatagcagtgggaccccaattctctttttcttgtattccagatgaaaaagaaaaaaactcaccagtttaaagtgctcgtttcatatgttcacgatatctaatagatgttaaattttggtaccaggaagtgagagagtgatatgaaggaactagtgaaataagattttaatacctggcaacatttcatagatgataacactggtccacttgaacacttgccattttttattcattatatctggtctagatgggtctagctaaaactttattccgtgcaacacagctcttgcctatttagaagcctttaactgtgtgtttaattatcacctggagtggttcttttgcagagaaaacatagaacgtaggatccagtctttcacaatgcaaaagttgaacctctgtcacctggcatgcttgaggaaatttcagaagctttgtcctcaccttagacccactgaataaggtcactaaggaatggcacccaggaatctacattttacaacctctccatttaatacatatgcttgctagaggttaagcaacactgtgggctcacctgtagcacgtagcactaatcagacaagactcaatatctggccagacttttagatgataatcacaagaagcaataacatttttctgaaacaaaacaagtggcaaatgatactgtgaaatctctggcactggttacccaatatccacacataccccacttagctctagattagaaaataaagaatgagattcagcccagaggcagccatgcgcacaggtgcacaatttggaaaaaatgagaccaattcttaaaaaaaaaatcaagctgaagtcaaagaagcttaataaaaatgtaaatcctctttcaactggctccatgttttctgtctcttcatgaacacctgccacctggtgaataatgtcaaggcctctcagagtgggtcaggaaagcaaaaaggcccatggccggaaatgctattaggcattcaaaaatgaacaatccaggtaacaaaaactcatgtcagtggtgcaggtacgatggcgtattctcttcataagaaacactatgcaaatgaatcgcaaagcgtgagagagcagaacttttcactgctgccttctgtcaagttgggaacactgaggtgaagattgagtgcaggggatttggggtggggagggtcccctgtgaaacagtttctgaatgaaagtgagggaagcaggcatgggatagaaggataatttggtctgagatgcaagtgcggctaaagcctcagccagtcccacggtgagctctgaagttaggttgtcccttctgagatgacctaaattgcataaacggatctgagtctttgtacctcccgtgcccatccaaacatccagtcaccatatgaggccacacccattgactgaatccggttctggagagggactgaggtttggtgcaagttgtccgcagccaggacttccaacatctggaggatgagcaccctaatcttgaaggctgaattcagtagcacatccactgcaactgaatatctgattcaaggccaaaaattgtggagctcagagccacaacgggcttctgatcttccacaggctgctgaatgcccctggcagtccactgaagtgataatgttaaggaaggaaatgattagaagtaatttgctgagggatcagagttgcatttggagctatcagcaagtaatgaagcaagaatgtcaatcgacaggtgaatcaaagtcagggcaaaagaaagggaggaggaaatttgctcaaaaaaaaaaaaaagccattactttcattgaggcctgggatgaggtaagtagagaaagtttgcaactgccagagattgctaaataggaaaaaatcttttgtgcacgtgttgctggtgggattgggacatgaaagatgttgtgggacagaatctcactggaaaagtcaagaatcagagctggtttcaaaaaaactcaaccttcaaataaaggatcccctatctctatattgaacctggcaatgaatacctctttcttttccttattggttggcaaggatgtagaacactaagatacacacacacacacacacacacacacacacacacacatacattctttgtttgtttgttttgagacaggatctcgctctgtcacccaggctaagtgcagtggcatgatcatagctcactgcagtcccaatctcctgagctcaggctatcctcctgccacagcctcctgaggagctgggactataggcatggaccatcacacttggctgatttttaattttttgtagagatgaggtctccctgtgttgcccaggctggtctcaaactctcggactgaagggatcctcacacctcggcctcccaaagtgctaggattacaggcacgaaccaccacacttggcaaatatttaattaaatattaaatatatctaattgtttgataaaaagggagagaggctctccttgatggaagtaataggttctggaatgcagtgagttctgctcggaatgccctctgaccactgcctccatgtgtctaatataacctatgacattacccatagaggtgccgctttttcattgggggacactgctccaaaagtgcctggaaccaggttaaaccattgaggttataaggaataaagggcctttataataaagaccatttctgtgactgtgttctgaaactgataaaaagcacttctttctgtctttggtgtcttccttgatagttgtaataagaatagtagtagttattcttctttttcttttttcttgtttgatttgtaaaataaaaacacttttcctttcctctctggtgtttgaatgcacccagtctcatttcagcagtccacaatgacatactgaaagttgtaatagagctacagctttgctgtatagaggtccatggatatgttttctaattataatcattcttgagctgtttgtaactatttcagactgcttacccagctgtatgccactggcttgtttctatttcaggaatcatctcttcctcttctcctccttccccctccattcccaaatccccacattagtagcggccaagttattttcaagtacagtgtatatgtaagtgatcttgatctgctaagaaaagacatactgtttgtttttattgggcaggcagcatcctagggaaaaggagaattacaagtctaatttggttaggaagcatcctttttcgcaacagtgaggactgcaggtaccactaaaatcattgctgttcattactaattggattaagtcctctctgttccaccaaccctgcttttaaaatttcttctctgcttttcattcagaaactgcctcagcctgcactccgttatctacctccaggctttattgcaacacctcccactgcctctctcctggaccaccttgtccacgctgcacacagttgccaaattcaactttctgtgttgcaaaccttgttgtggctccccctgtgtaaaaaccttttagtgtttctcatctccatgaatcactaatccatggtgcttagtagcatgtcaaaggcccttccgaatctatctctagcctacctctgtggaccttatctcttggctctcccacctgcccccacccacacctctaccccttgctttttgcttttcttttccccaaattctgagctgcttatacgttctttcccttcatggtgttttatacctcagcgctttcatgcatatagttcccagtgtctggaatgatcttttggataaatagtgacacttcaagaaatatctttgtcccaacttcagaaacctaattttcattgtgatgaatagctcccacagttttttccccgggctattttgcaagtattgaggattcacatgttaatcctgaaatgtgcgttctaaaaaaaaaaaaaagctccatctgagaacccattaaacctctagtttaaatacccaggcattcttaaaaatcgaatttgcattgtctttgctgcagtgtcttctcaggtaaccaatgcagccatgtcagattgatacatcatgttgttaagacccccatctgtctctagggtagtagaaaagatgcagctacggaagagaacagaactgtgctcctgaacatggcatggctgccgaacctcacagataatcctgaagcaggcaatctctgcagacttctggggtgatttgagcatgtgtagcttttgctggcagctgagagaaatgggaagtcccctgagctgaaagttgggagcactacatcctcatcaacctaaatctgccacatacaatctctgtgatcctggggaagtcactggacctctttgagtcatgctgtcctcaaatgtaaaatgagttttacatttaaatgttctaaataagttcctttagaatgtttcaattaaaaatttatccatctgtatcagataatattggtgatctcattcaatttttttagttccctttttgattatttttgtacccccaggcctcagcgtggcttctcttgcaatagccagcatggcttgttcttaagaaagttgtcctcagtctactactctattgcctctggctggaaaaactcgggtaggtgcaaggtgtccaccagcattttctcctgggatcgggctgctgccagctctggcactttgcctgggactgtagccttgtctggactcccctttccctctgcgtgggagtgcttccttatcaatcatttgccctcgaatccatgtcttaggatctgcttatgggttggactcagcccaagatattctctatctaggtatcctggttgagtttgttaataaaagttcggtttggatttagacgagacaaaccaaacttggttagggtaaatagaggaggaaggtgccttgtttcctaaattgtgtttgataaagtgcttaataagggcggcttccaaagtggttccaggtaaagaagtactaaaaaggcctctttattaatgtatggattttctgtcactgatgtttgtctgcctatgaatagtttagactagatttttcaagtaagcactttataatatctgtaactctttctaggtgttttataaacaactaactgagtagagcagcaacaacaaagagctgtaagttttctgccagtaacttctagtttttacctcctcaaaagctattttaaacaaatatgtgtctaattaaatctcaagggaatgtgaaataaaaactggaatttgagttcagagtacctgaaagagcatttttggaaaagactttgtttatgccatttgtgcatatgtagatggaatcaaaatgtataagataataagagaaaggtgccattgagcctccaagtagaagcccgatgacttcacttatgcccggctgatcacccaagtgtacagttagtcatgatttgatatctgttgtagattaagcctgttgcacacagtttctaccctgatgtttggcatgggccatgcaccatacattgaaacaagattttgaagtaaatagaaccacattttccactttctttcatgcagttattttctctgcaagatgcattctggctccttttgtgaaacctcagatttgattctacaagctgctgagaaacacagcacctgcatgccacccaccaaagagagtgtttacatagtctgttgtacatagaaagcatgtgggtgtgagtatacgtatgtgtgatgaaatggttcaattgacattgtacttacaagataaactgcatgtatcaccaaattatttgacttctctactcagaaagcattaaattttgaggtttaagtagacattaaacatttataatttaatatacatttaataaaattaatatttatgaacacatttgccttgggaattaaaagtggaaaacagtgtcatttacttgctaatggccaccacggtgccatgcagttacagatttgatggcctgcatcccagtgacattgctccaagaccagagacaagaccattttttgtttgcatggagctaagtattattttcagaaaatcaaaaccaaaaggtatgttttgcttcctagctcagggtctctggagacctgacctgccaggtatcatttgctcattttatttaaagaaaataaaataaatattcaatggagaagttaaaagtctctttccaactcaactctatatctcaaagaattattttctcattctgtcaagccatgttaaaattttcaagtaaagtcgtaatcatttctacattttctttcctgtttgtcttgcatctcttaaaatggttttaatgttagaagctacttgacaatggatgtgaaaatagatttaactcagcaatcaatatattatcaataataatcattaatttatacataaacatcacatgggtagctttccaagtccatcctgttttttgtgggctcttatgctggttcagagatgatatatgccatttttataaggtgaagaagtggagcagtataaattgtaccaagcaagtattgagcactgcgaagttcactgttccttagagaaatgagctatgcatttactgctaaaaacaaacctttcataaaatatttttttgggcaccaacctagtgaaggagtaaggaaaagaagtggatggttttagcatttaccctatggaagcttatagcctggatggcaagatcaaattaacatgagaaggcagtttggtgtaatggttaagagcctttggattcagccaaggcagaaagtgatttgaattctaattgagcccctttttagctgtacaactttgtaaaagccctttaccttctatacctcagttttcttatctttaaaatagaaatgctaatatctacctaatagtgttgttactattgtttcttaaagattgacaacaaggcgtatgaacagcatgcctggaaaatactggatgctcctcataagtagttatttatttattaatatcactgacacaagtgaaataatccatctcttcctaccccagcacacttatcataacaaatttgtaatttgtatgtttacaatatcttttctgatgaattgatccccatagtatatttagagcagtggtgtctggatttgtataaatctctgtaactctagaacttcacccagtggccaatacataaaagattctaaataaatatttgttgttgtcattgtaataggggaagagtatgctccaaaacaaagatactgattttaaaaacgaccacactttcaaaaaaaaattttttttaattctagagaccagcatcgagagtaggagtactcagtacgattatttacggtaatatatttattgggtaaattaggcaccatctggtgtgctagcttagatggctctagttctttattaatagatatatgagactctggggtaataggttgctagatccatatgctattcaggagacaaatttagtatacggtaagcttgctacaggatcaagtcgcataagaaaatgaattgaagtcgaagaaatgcttaggttaacccaacaactctgataattgaccaatgtggcaagggccattctgttccaaaaataattaacaatatgatcagtactgaattaatgttgttacggattataggtttcaaattttcccttgttaggaaaatcaccttttaaataatctcatagggttttgaacaaagagcacagtgtttctttttttttaaatagaaacccatacttgagaaggtagcaaagagtagcaaagagacctggatctctgtagcaagttcttggcctggtcttcattttcaattctaaaaattttgagggaaataaacagctgtccaaacaaaatgctgaaagaatatccctggacaaacagaaaatctttttttttttttttttttttttttttttttgagacggagtctcgctctgttgtccaggctggagtgcagtggtgcgatcttggctcactgcaagctccgcctcccgggttcacgccattctcctgcctcagcctcccgagtagctggaactacaggcgcccgccaccgcacccggctaatttgtttgtatttttagtagagacggggtttcaccgtgttagccaggatggtctcgatctcctgacctcgtgatctgcccgccgcggcctcccaaagtgctgggattacaggcgtgagccaccacacccgaccgacaaacagaaaatcttagaggggcatcaaagcaaatcatatggatggagagtgtgaatatgaagaaaagcatattctttcttcacacacacacagtatgtgtgtgtgaagtaatcttcagccaaagcaaagactaaaatgacctgttcaataagatggaagcaaactttaaaaaacaaacaaacgacaaaaaaaaaaactgtcctccttctccgccaaattcaggatacatgttttatcagcccatgtgctattaatctatttgtgattattctatttcattttctctcccatgcttttctcatttcttctcctcattctaggtgagtataggaagcatcagggctggggccataaaaagcctgtggccaaggacattgcaataagacagagaattttagatacttcattaattatttttcctaccagttaaggattccttgtgtaatgacagaacaaggagaagacagcaaaataatactaatgctaataaaaatatgtaatacagagtacttatgatgatataagcattgttttgtttgcttagattattctgtctggtgttcttaacagcctgtatgctgggcaataaaaatagagtctcaggaaaacagaaccaagtttgctataatttggagagacaaaactaagctaagattctttaagtaatgttcatggggagtttgtgcatatgatttatcagaaagagctgcttctaccagggctcataataataatggttcccctgaactggatgctaaatttatcaactggttattttgggcttctcttgccagtaagcctatagaaaacaaaaacaaaaacttttgctataaccttgattattcagagaaaataaggtttctgctacacagcagggacaggacatggttggcaactgggaaagacactcagcaaatattacagataccagaaggaacctggagaaactctgattctttttcattttgttcttaaaaagcaggcgtctgaaatgtgcccaacttcagctaaagaaaaaaacactattgttgggtctagacacaaagcctgatttgctgattttatttttcttcatttagttattttattgttctgtaaatatggacttaccttttttgcttctttattttatcttttggtagaaccttgagcagggacaccctagacgttcaactgttccgtgtgatcagtgtctgccttaaaatgtctgaattcctgtactgcatttcccagtgaagtttagtgtttatggcaatcctcccgatggggagagaaatgagccggcgaggccaaaagcagcatctgtgacttgctaggatcagctggctctgtgtgcatgatttccacttcaaagggtacacagacaacttggtgatagtccatttattgcagcctggtcttgtcaattagtcaaagttatcttctatacagctacagtaagtaatgtaaaatcatttacaatataggtgttagaacagcagagacccttagagttcatgtatttgacttcctccttgcacagttgaggaaattatgaaatgcatgtctttagcttcttcattctacagtatttattgagatttttttatgaagaagaaggataaaaagatacaaacttgtatgaagttagggaactggagaagctaactcattttctcttttttttcctgtgtctttggcacctctattagatctggtccgtagtgggtctaaataagtatttattgaagaagtaatacatgctttataaatgatggccaaatagctgtttgaatggataaaaaagcttcataaagaaagtgatacttgtactacgtcttgcaggatgtgggagaattggaaaatgagagagaatagagaaattaaccaatattatagtccagccaacagcaaagattgaactaaaattctggtctggtctagaggtaaaccaataggctcactttccaaaagaaaatctgaagcatttaagattatttaataaggaagaatttcctctggtgtcctgaatgaggaatctttggggcaagaagggtcctgtcctatttattatccttaagaaattccttgctatttttagttctcaacatcagctacttctcattactaagtaaaagccagattacttaacttgcactcaccctaattcatcttatccactggcagcaaattccttccttagaatacttccccactggtttttgagaagtgaaaaggattaacatatatggcagtggagtgttttatgtaatagtctttttattaaccccattatccagctgttggggtgctgggtagagaaggaagggaggaggaggaaagtagttgttggcactgggggttcagagccgccccagctccttgagatgaagggatgaaaataaatcctctgtattactgaagcatgtgaatgccatgaagtagtgggacctgaatcaatacattgcatttacagcagagcaaaagaaagaatagggttttcagagtttatttatcctgcttctctgaaaaatacccgtgtgaactattgggctgagagtgttgagtccattgaatttgactctttcactgccatatctttggagagaatgccttcccaaagagtcatatccaaatgtaatgtccctcccttctcttatgagtgacttacttttggtattccactgggtggaaaaaagcttttcttacaggatatatgaactaataatagttatacgactgcttcggatttgtcgcgctccccttggataagtttaatatgattttgtacacattaattaattatcttaataacagacaaaatagaaggaagccactaccgtcctttccagtgcatcagatgaatcaaaatgaatcaaagggctgggcatggtggcccacacttgcaatcccattactttgggaggctgacaccagtaaatcacttgaggccaagagttcaaaaccagcctcagcaatatagtgagaacccatcactacaaattcctttttttaaattagctggacatggtgacccatgcctgtagtcccagctacttgggtggctgagtcaggagggttgcttgagcgcaggggttctagactgcagtgagttatgatcaccactgcagtccaacctgggtgacagagtcagaccttgtctctaaaaaaataaatttaaaaataacattaattaattaaaatggatcaaataaacacatacatattgtggagattgtgagaaataagccttgttctatgtgtctcaggtttacctgaactccaagtagccctgatgactatatggcagttatcacaataagcaacagcataaaggactttgagaaatcaacagatcttatttttaaaaatgaattttcttaaacatgtattcactcagctggcagtggtggctcatgcctgtaatcccagcaattttagaggctgaggcgggcagatcacgaggtcaagagatcaagaccatcctggccaacatggtgaaaccccgtctctactaaaaatacaaaaattacccgggtgtggtgacacacacctgtagtcccagctactcgggaggctgaggcaggagaatcacttgaacccgggagtcagaggttgcagtgagccgagatcacgccactgcactccagcctggtgacagagcaagaccccatctcaaaaaaaaaaagaaagaaagaaaaaaagaaaaaaaatgtattcactcaatatgattaagtacctactctgggctagatattaattagatcattgagagtgtaggtgtaagccaggcagccagacatcaattctcatggacttgcattctagaaggagattgaagagatgaggcaacagttgtagagaacaccttactgctcatgggatagaaaattaccactgggatgagggaaagttgctacttttgattgtggtcaagaaaagcttttcaggagatcacccttggcttgaggctcattgataagaagaggccagccatgcaaacatctgggggaagaggaaagagcaagtgcaaagatcccaaagccacagagatgtttatgtgctgggagaacagaagaaatcccagtgcttgtagtgcagtgagcaaaaggaagtatgaggccaggtaaagtaagaaaggttggcaagggtcagatcatggagggcctttggggctgttgtaaagagtttcatttcattctaaggcaattggaatccatttgagaattgtgagcgggagagtggtagggaccaatggccagtatgtgatgacaggtaatgtgatctatgctcctatttttaggggcaggcctccttaaagatccatttattgatttaacaatattaaatgaaagttcactatatgccatgctatagtgttctagggtttcagcagtgactatgacaggtctccagctttattgagcttacatcttattgaggagaggcagacaaaaacgaataagaaccgtgaagaaaatatagagtttatatgataaaaattaatgggatgaagtgctggaaatttcactggattggagaccactagggctacttcagtaattagttttgaggtctcctgttgttgtttctcagccctgatggtcaagaaattctttcctgttttgcttgtttccatttctgtctactgctttttattctgttgtcctcttaggtagtacacagccctttttctgaaagtcttatctctgatgaagaaaacactttttctcttcaaacagtaacttagtcttttgctttatttcctagagactctgatttcctaaagtttttcatatttgttctatgtattcattcttttcattatttttgttgctctccacataaaaatataaaaacttatcctgtaaagaagtattaatttagacatcatttagccagaatatagcagaagaattattttacagttcttataaggtacctactaatcctccctcctccctgccccctccctgtcttctcttttctcctttccttcctttctttttctcctatcccaaaatactagttaaatagtttctctcctttaaagtactttaaagataacttcttcataatgaactcttgtgtgcataagcatttcttttcctgttaagaagcagtggacaatttttttgttttaaagacattctagaagattttaaaaaattattgtggtaagaacacctaactgtgagatctatcttcttaatagatttctaagtgtacaatacagtattagtaactgtagacattatgttgtgcaggagatctccataacttattcatcttgcattactgaaattttatacctgttgattaaaactaaagatccttttcaaaaaatacttcttaagccatggcttcccctggttgtggactgtaacccttgatgttattgaccatcttgggattaagttccattaagaaagacagtgttagacattgtggagaaataatagcaaggaaatgtttgttctggtccaccaaaatattgagggaccaattttaacctccacatcgttccttctggggttttcaggataagaaaaaaggagctgtggcttgctgctatttcagtagtcaaataaatatttttaaattgcttgtttcattagtaggatgtttttctgaaaagacagagtatatacccctcaggatatttctgccaatgtgttaaagtatttgtaaaaaaaaataaaataaatggctttgtagaatgttcttgtttcccaaatggctactgattttcttaagaaaaaggtagcagcaatttgctgaaaaacaaaaatgaccttttattagtcaagagaaataagataactaatttagattgaatgtgtttatcctaccagggtccaaaatttctattttcatgtattctccttttcttataaaggctccctttggaactatctaggaaggacctgccaacatccttgaacagtgaccattcagtctctactatactagaacccatctgatgatgaaattttgactatatttttggagatttcattctgtcattggatagctctaggaagtgcttttacaccttttgagctctggtcttgagtccagtaatttttacgtatcagtccttgttctgccttccaaaaccgcataatcctccttcaacttgacgtcctttatgtgttttgagatggcccccatgggcttccaagtgtttctggctaaatatcctgagctcatacatgtgttcttcatacagcagcactttgaggcctctctccatgctggttaccttcctcccaagtctgagttttaatgtcctgtttaaaatgttatgaacacagctacttagaaagctgtgcagtcatctcagagtagaatcagacaaggacctccttcacacgaagtgcttcctgtgaggacctatgtaatctgctctgtcttctgctatcatttgtttcttcccttctctcctttgcatcatccactccagcgacactggtttccttgctgttcctcacacaagccaagcaccctttaacttccttttaaagccctttacccttatttcctctgccttgaactctcctccttcagaagacatggggcattctccctctctgcactcagattactattgctgtcccctcagaggggcctgcccttcccaacccattctaaacagccctcccccatcatgactaccccttgtcatgcttttattagcccttgaaattcccagacattatgttatcattccatttatttgtttattgtctgctatcattattagagtatgatctctattaagtcaaggactttgctagttcctgaatgtcttttcagtacccagaaaagggtctagcatatagaaggagcataataaatatttgtgaatgtattgactaatttactatccatgcagattatctttaggcagaggatagagaataagactttttagtacatatttaacagtgtgtgtagccatccatacagtaaagaattctgcaactcacagtcaccccaaacagcatttgagcttttagatactatagagcaacctgtgtctgtgtgtgcatagatatgtgtgtacatgtacacacttatgtatatacatacacacatacattcgtatacatgcgtgtacatttatgtatgtattatgtgtatatctctgattaaatgggtgaacatgtggtttggggacccgtgtccaagccctctagattgtagaagctggaaatgacaaaagtgaatgaagtgagggaaagtgagccagcaggactgctcactgcacatgaatttccaaggatacagttgttcttgaacaatcacagtcagtatatcaaaataagcgctttattgagtagggtaaaaggagttgctggaaagactgtaaattctctcgcagaacaaatgataactgagcccaggagcccttttgttcttgggggagggggcataaattccctgaaagtatctgtcgcagggaattgctctgcattcatcatgtccgcctcctgcatcattcatgaatgtcataagactctaaagaattggcacttcatagtgaagatgattaaatagccactatacttgtcttttctgctgcacagtgctttttaaaggaattccatttaggttgtagcatgccccttcgaatcccttcgcatttcttgcaacctgaggtctctgacatcagaggaaggcccttgcttgttgggactggacagagctggtgggctagcacttcagtttgcttattttcctttgatggagacaataggatctggaaaaaaaaatgccataaagctcaaagcaaatcattttttagggagtatagaaattgctgtttagattctgcagtgaatgagctgtaatttttttcagatattttcacttctcttatcacttccttgtggactaagaataatgaatcagaacaagacacttttatatatgatttgctattttatatattcaaatataaggcctcaagtcattttgtagccaataaagcctatgtatgcagtgtaaatactgatgtaacagagtataagatatagaatcggccaggcgcagtggctcacgcctgcaatcccagctctctgggaggccgaggcgggcggatcacctgaggtcaggagtttgagaccagcctggctaacatggtgaaaccccgtctctactaaaaactataaaaattagccgggtgtggtggcaggtgcctgtaattccagctgcttgggaggctgaggcaggagaatcacttgaacctgggaggtggaggttgcagtgagctgagattgcaccactgcactccagcctgggcaacagagggaaactccatctcaaaaaaaaaaaaaaaaaaaaaaaagatatagaatcttacttctgtcctctcccctgcatgcatttcttgtcatgtatacatattctctttctctctctccctctctccacacatactcactccctctctctctctaagtgccctagagtaattcttacttcccaaacagcatccttaagtgacagagtgcaaatgattgaattaacatttatctactcaggtatatgtagaatctaaaacagttgaactcctagaagtacatagtagaatagtggttaccagaggcctcaggttgggggttggaaggagcagatgttggtcaaagggtacaaaatttcagttaggagaaatacatttttgagatctattgcatagcatggtgactacagctaataataatggattgtaaattgcaaaattgccaagaataaatttcaaaagttctcaccacaaaaaataataagtatctgaggtgatggatgtgttaattagcttgatttacatcattccacatagtttacatatatcataacatcacattgtaccccataattatatataattatgatttgtcaattaaaaataaggccaggggcggtggctcacgtctgtaatcccagcactttggtaggccgaggtgggaggatctcttgaggtcaggagtttgagaccagcctggccaacatggcgaaaatataaaagttatctctactaaaattataaaagttagctgagcatgagggcacatgcctgtaatcccagctacttgggaggctgaggcacgagaatcacttgaacttgagagacagaggttgcagtgggccgggctcacgccactgcactccagcctgggcaacagagtgagactctgtctcaaaaaaaaaaaaattaaaattaaattaaaaatataaagttggtcaataaacaaattttcataagcacttatgttagaggcaacagaaagtatttagagagaacagcagactgtaattaggagagaggagctctgatttgtttccaccagtcatcactgtcacctcagacaaattctgtaacttcccagggcctcaggatttgcatctgcaaatgaggacacaaatggtggctccaggattctccttccactcttatgacacatggctttatgtgtcaggaggggctcagccatcaggagggaacagaaaaaaaaaaaaaaaagctcaggatatcaccactatttctgaggaactcataatttaatgatctctgcaatctctaagctctgctgggaaatgagctccagcataacacgggttctgggtctgtagtggcatcgctgactgaaagataggtcatttttaaaatagtggtatgacctttggctgtgatttcctcataataaacataatatgatttttgtgccaattttctgttaattatgggcttctcctaaaagtttatgagtttaggaagaatgttctttttaaagtagaactttggacacatgttaggagatccaattaaatagatggatcatggaaattgggtcatcactggttgttaccagtaagaggatcccttagagataatgtgttcacctgttaccatagaagtcttatgagctgtgcctgtaagttaccagtggcttcaaggcaggtagaccttttgagctttaatttgttcctagaaggaacctcttcacttctcattatccagactttccctagaagtgggagggctgatcaaaatgccagccttggccctttgcattctgctgctccagccatgtgggtctgatttgttcttactgctggtttaagagagattaaaaggagcaaagctgttctctaagtttcttgatctgcaccgtggcagccagagtcagaggaaatggagacaatgggaaagggactaaatcctagagagtgatgtgtctgggatctcgggaagcagacccagcgttcaaatgcaggcttcaaatactaggtcattgctttggagaatcttcttgcacccaaaacaacttgccacaacctatgtggcccaatgtgcagcaaaagctgagcctgagataaggacagacaggatatatggctgaataaagaactttcaatttccttttcttagtagacggacaagtatcccatcattaaaaaaaaatagccacataaaaaagcagtttccaatctaagtgcacatggggtatgccaaaatctttgcacatgattgacttaatcagaaggcccaatctaatggagagaagtactgtattaatttaaatatggcaggtgctttctaagtttattgcaagagttaaagaccaattatcttgtatttttccataaaattgcattttctaaaaagagactggtgtgtctgaatacatccatcataataaatcttcaagcttggatggaagtgactgctgtttatttgcagcatgtcatatctgtactattgaatcaatgctaaagttatcatattagaactaagatgagggcccggaaaatgagtttttatagactcacagcgtgattttgtgaataaaagcataagaccaggaccaggtgtagaaagtgccttattccagggcctgatgacctggaaggcaattttcaaatgtagggattatgcagtcacctctcacaaggtccagggtgaagaacaagtaagaaactttctattttctggggaataggcacactttcaaaggaggaagaggtattgagatgagacagagaaattgagatggaaagtgtatttgaaatatgtgtaattaggcaggagaaatgagaatcacaaaacactagcaaaagtcattgtcttgctaaaaataataaaggaagaaaaacaaagtataagctaaggctttgaaggtgataaaatattaagaaattttgcttctgtatttataggaaatcagtttttaaaagtataaactaattactaatatattacataataatgcagtgatgttgcttgtccatgataaaaggtaataaataaaaatttgtttaatgaataatgaaaaatagctttcacatttggagttgattttgattcattttgatctcttatgtggctcttggctgtagactatctttgttttaagaagagcaaacccatttgtcctaatattcctggagaattatttcattcaaaagaataaaaatatcagccaggcgtggtggctcacacctgtaatcccagaactttgggaggcagaggcaggtggaacacctgaggtcaggagtttgagaccagcctggccaacatgctgaaacagagatggtgccactgcactccagcctggacgacagaacgagactctgtctcaaaaaaataaataaataaaaataaaagtaaaaatgtcatgtatataatatagagagaggttcaaatacgctaagagaaaaagaagccaagatcatgtaagcattatgattacaaccacatgcagactatgtttttcttctggctgaaggccagagagaaaggcaagtagctgtatattcagtgggtgttatttggtcaaatcgatttacatagtcttgcaggtcttccaaatactaaatattaagtacttggaaaatagctgagcaaaatctgagtgcattctatgatgatacagtagcacagtcttgcttgggacttaaaatcatggttgtttatggtcatggagttctaaccaaacccttgaacacaaaattcagtgagctcaaaatgaaactaacactttcacattctaatctgtatttccttttctatctactattttatttgtccaaatttgaaaactctgaaccaaccccagatccttctttttttactccccaaatatcaaatagatcacaaaaggcttttattcttcatgtctttcatatctgcttcccctgatttctcatgctcactgatccaattccaattttcatctctcgtgtctggggtattgcagcagtcttcctctaaatccccatggtcacacattatcctccctccatcttctctactgcagacaaagttatttttctcaaactgtgcattttcccactgatcaatgtagtcattctccaactttttaaatactaaaatcactctttgaaaaattgatatggaactttgtttttttttttaagacagagtctcgctctgtcaccaggctggagtgcagtggcgtgatctcggctcactgcaacctctgcctcccaggttcaagcgattctgttgcctcaaccttccaagaagctgggactacaggtgcatgccaccaagcccagttaatttttgtatttttagtagagacggggtttcaccatgttggccacgatggtctcgatctcctgaccttgtgatccacctgcctaggcctcccaaagtgatgggattacaagcatgcaccaccaggcctggctacttttgtatttttagtagagacagggtttctccatgttggtcaggctggtctcgaactcccaacctcaggtgatctgcccaccttggcctcccaaagtgctgggaatacaggcatgagtcaccgtgcccagcccaatcatatattctttaacattgttgtattatttcccagcagtttgtagcttattttgttttaatgctttattttcctagtaacaaattctaaaacgatgttgaataatattgtgataatgaacatctctattttcctgattttaatggcaaaggctatataattttgccatttagtatgacaatactttgctgttgataatctctatcatatttagaacatcttaattctatcttaattaaattttagagggaatggctgctgaattttttccaatacttaaaaaaaatcctgagtaaaattatattcaaattctactttaattaggtaaagtaatgaattttgttaacagatatctttaagctgaaatacactacttttcatgtttctgaaatcatatttttcttctaatataccattgaaatgctattcaaaaaatgtttatcaatttttgtaagtgaaattaaagtgttttgtttttgtgtagcatatttattaggtattggtattaagattatgttggatttacaaatgaattggaaaatttcttagtctgtttgggccactataacaaaataccataaactgagcagttttgtaaacaacagaattttgtatttcatagttctggcggctgagaagttcaagatctaggtagattgtattggtctctggtgagaatctcttttctcttcataggcaacatcttcttctataacctcacatggtgaaaccttacatggtgatgtctgttttataagatcgtttgtccccaccatctcccaaagaccttaccctataataggaacacattgaaagttaggatttcaacataggaatttgcagggggatcataggcattgcagtccatttcatgaagatttctaaccttgcctgtagtatggtataaaatggagtaatttagaaattatctcttatcttaaaagttatgttgaaaggtagatgaaaattacctgtaaaatcacctagatctgtattttttaattattaaaacttgaatctcctttccaatggtgtctatggtcattagcctattgagtttttctactttttcttataaatctttgacaagttatactttttcctagaaatgatccattccttctgactttcaaatatattgctttaaagttgtacaaagtatgattttatatttgtaatcttttctattgtgatggttatataatttctaatgttctatttttctcctttagtttttatttctgtttttttagaggtttatatattttctttgacattttaaagagcaaactttgggatatttttaacttttatattatttcaaatattatcgggtaaatttcagcttttatttttaatcatcaaaaaccatcttatttatcttatttttgtaatagtgcattaaggtgaaagttcagtttatttatgtttattttccttattattatttgagacattttcttctgagtttctgagtaaagctttatctgaagtttatatgacttgatatataaagctgtctcttcattaatactctaattattaggttttggtcttttttactgtatattttaagattgtatgtataaagagtactgtttgttcaataacttaattatagaaatcattaaggatttctttgtcaacaagaatattatcagtttaacaaatgttccaatttgaaatatatacgaattactgaatatgcttctttggtaaaattcctgagttgcttatcacccaatcatcatggtcattctttgccaatttatttaagcacttactgtgcccctatgtgttccaggcactgtgataggtaccaggaattctttcatatccaaactcttctagttgtgaaagaacccaaatttgaactagcttagactacatgagttagctattaaaagttgtgtataagaaagacctggccaggcacagtggctcatgcttataatcccagcattttgggaggccaagacgggcggatcacttgaacccaggagtttgagaccagcctggacaacatagtgaaaccctgtctctactaaaaatacaaaaattatccgagcatagtggcgggtgcctgtaatcccagctactctggaggctgagacaggagaatctcttgaacctggaggcagaggttgctgtgagccctgatcaccccactacactccagcctgggtgacagagcgagactctgtcaaaagaaaagaaaggagaagagaggagaggagaggagaggagaggaagagaagcagaggagaggagaggataggagaggagagggacaaaggcacaacttcacaatatagattataaaaactaggtattttaaaaatgataagatttttctctctgtggccagatctaaattcaacagcttgtctttactctttcagtcaggattgattttctcatgactttctccccataagcagaaatgtggccacggcagctgtgtgtctcttatgtcacagttttatcatcagagaggcactgatggagtgtttctctggttccaggtttaaaaaaaaaaaaaaaaagttcattgaagttctctagcctagcttgggttaattgattacaccttagtccatctgctgtatataagagcagaatcttttacggacatgacaatttcagttcaaatcacatgataaatatggaggaaaataataatttctttgtgaagaggcttaatgtttcaagatagagacagaggatgtgctgcgccgatagaataatgaaagtctcctatagtcaaaaaacaaacaaataaacttgaggcagattcttcacttcaaggtgctcaccataaaatggcaatactaaactatttctagaactctatatagagtgcctgttagttattttgatcctgttacaactctttcagatgatgaggtagaagtgttgtcgccttcttaatcatggagaaactgaggctcagtgaagataaatgattgttttagaacagaagcatggactttaatagttgggatttgttcttttcatccaattctgacctgggttctatgattaagaggtatgtgtctcatagaatcaaatcatcacccttcaaaaatattagccagcttttccagaaaaatcgtgttgtatgaattaaagccacaaatacaccaaagtcatccgtttacagcccctggcctcttgtaagtatgaggatcatataaatcaggcatttaaatcaaagcactggaaataagcaactgctttttatgtgtattgtttttccagagaatattcaatacttagctaccccttcattgttcttattaaaaaaggtatttcaaggctgtgaaataaaaggaggaaaagaagacaaatgtgtatgttccaaacttctcctttcctctaatcatgtctcatgtcatcagaaggaatgcacttctgaaaaataaaatgctacagaaaaggctgctgagtaattataaaatgattacttttgtttttcctttattcatttatattttgcttatgaacaaatgtatatatggtctttgcttttagttaatgctctgtaaaatagaataacgtggctatccttaaagatgtcacgttgcttttctgttgtacatccctgttaggttaaatctgagatgcacttatctatttatttttacaaaaacaatttgcaatgtgatttagaaatggaggagtaacataaaacaatttgactaaaaatgggtgtgattttcttatctgagactgccaaaaattcaccaaagaaaaatcattcaaatgtctttgtggttaggtttcttttataaattgaaagttgtgttctatttcatcatgagagatgctgtgagctctaactgatgagcatttataaaatatttccacgttgagatgaaatgacaaaaaggcaagatgaattaatgaacattgtatattcttattcctttattcccattctactccatgcctgaatggcaacgtgaagatatgtaagcataggtaagccaggtttcattgattagttcaacagcatttatttcctgtgcattcacagtgttgagagataaataaattaaacagccctggcttccaggagctcgtagtagagaagcattctggatttccattttgtttgacaataaaacttaatatttattttcttaagcctgaatactgtgcaatttcctagaacttattttgttttgctatataagaaactagcatggttatgaaagttaagttggctgtgagttaatttctcacatagacctcattataaatttacccttcagaatttagagttgtctgagtgtggtataattaatcaggaatggactattatctgaccttactttattcactttataagaggacaacctcatgtaaaaccactgtcatttaagtaagataaaatgagtacctctatactgccagttgcattgtgaaaggattgggttttcatcttgtttgctgtttttgttttgtttttaattttggccacatattagaaagccattgtccttctttccatcatcatcaggtaaatggtgagaatattagagatacagtttgacataatgaaaagaatgtagattgttgagttagacctggattaaagtcctaattccattcgatatttggtaaaagatcttggcaagtagttttaccttattctatagcttccctcatctttaaaaccaagatagtaactgttatgagctgaattatgtcccctctacaaattcagatattaaagtcataaccctcagtatctcagaatgtgactgcatttgaagatagggttttctgaatgtggtgtaattcatcgggagtgggctatttctgaccttgctttatttttcagtttcagaggttattttggtgggccctcatccaataagactgatgctcttataagaaaaggaaattagggcatagattggtacaaagggaaaaccatgggaagatacagggagaagatgattgtctacaagccaatagagaagctgtagaaaaagccagcactgctaacactttgatcttgaaattctagcctccagaattgcaagacaatgaatttctgttgttaaagttacccagcctgtggtacattttacacagccctagcaaactaacacagcaaaaaatatttcaagtgaaaaatatagagttttgaaatattatactgtatactaagatatataataaataatatatacacatagctggtattagtattaatattgatattaacattagtctagagttagtattgccaaacagtaccaaagagtttgtgaaagaaataattgtcccaaaggaaaaacaatgagcttatgaaaattcctttaagcaagagggaatttgagtgtgtccgtggaagctttatttttaggtcaattttagcgtctacagcattgcgtattctaccactaatcatctttttccttagcggaagtatcctgaaatttgatgagtaaaaatgactttcttttatatttttgtgatataacagcttctaaagtaatgtgtttctgaaaatgtcattacccctaagacttacttacaaagggtcatgatgtgtttgtcaaaactcatcagtgtgtccagaaactatgtgcgtgtgtattttagtcaaactttctgggagttaaagtatatataaggtaacacagcaatggaacatcgcaatagttggcatcagatttgcaaatggcacaattatttgtttcctcttcactggtccttgaaaaatacataatgttcccatcaaaagttccagccaagcatatttgtaagaacagggtttgaacataacctattatatcatgaagaatggctctcttccatggtatttaccaccagaattaagtagtggtagacttttttttattcatggaaaacatttagtgaatgggtagaatgttatttgttttatatttttctctcatcagctcctttggagactttggcatcgggcagaaaaagggtctcactctgcacaccaatttgagttcccatgttatcaaacagatttaatgctaaactaaactggtgtttgttctgcttataagtctttgagttgaagccttgtttctggaatattgggacatgctctgaaatgttgcctctgtagatcctagaaagtaatgatgttttctgctttcatgcgatttagttttaattattcttccttcaacagagagaaatagattgccccacagggagggaaccctcaccttgcttgagcattgtctaagaaatggctttttctcatgatgtacttaactgttaggcaatgttgtcagtttctcagcttactgagcagcaaatctgctcatttctttgccaaggaaaaagaatgttcttaaaaatagatgaactttctctcttaatgttcagtgcattcaatgttgctttatttaaggctgctttatcatcagttctggtgtttatttcaaaaaattcaaagtagataaaacagatcattcactaaattccatctattcaataaataatttgcagagctgtttttaaaatgtgtatcatttaccctgtactccctagtggctccctctgtaatgcagaggccttgtttgcagtttttccatctgttattcacctttctcccctccttttggagctcttgatctctagggatgtttttagggagtctttatcccattagtcattgggacagctttggagaagagggcatagttaagaaagggaggatctgattctattctcaactccactacttagcaacagatcaagttgtttaatctccttgagcatcaattttcttttttattaaaatagtaaccaaaatatttgccattaatatttcagtgagtgttgagggaagaggcatcagatgagacactccaaaagaaagcaatttgaaaatcatttaattctatggcaatataaggcccagctgttataaaatagtgaacattattcactcctaaaacagccagagagatgagcggcagaggaaaaccatagaacaaactaagtaaaagaaattgagaaaatgtattctttggaaaatcagatattacgagatccttcagttaaatttatgtctctatttgctagaagagatatttatcagttccaaagcaacaagcctttcccttttggttttattagctacatggtaattgatatgaatttaaaagataggtttaatttgatagcaataactacatctactggcaggatatattttatgtcattgatagtccttttattttccaaaaggatttaccagtttatagtaaaaaaacacgaatgtggataagcttgtgaaagagtaataaaaaagaaataaagaataagaaacctgaaatgatagaggaagaccaacataccttaccattatgagattttatactaagtcctgaggcaatgatcaaagagaactagagcaggagactgacatcttgtttctcatcctagtttatctatcatgtactttgcacataattgttatacttattttattacttaatttattgttctacttgttataattgtccacaagtaaattatccagttctccttaaatttaactctcagaggccgggtgtggtggctcatgcctgtaatcccagcactttgggaggctgaggtgggtggatcacctgaggtcaggagttcgagaccagcctgaccaacatggtgaaaccccgtctctactaaaaatacaaaattagccaggtgtggtggtgcatgcctgtaatcccagctacttgggaggctgagagaggagaatcgcttgaacccaggaggcagagtttacagtgagccaagatcatgccattgcactccagcctgggtgacaagagcaaaactccatctcaaaaaaaataaataaataagtaaaataataaatttaactctcagatttcccctgggagatgcttccaaaacttgttccattttaacatcaatagaattatttgagggaaggctattttgatatatatatatacacacatatatgtatatatatatataaaaaaatacatgaatgagaaaaaattatattcctcattctcttaaagaaacgatagatcactcacttaattagctatatatatatatacacacacatacatatattcacatatatatatacacacacacacaaccaatattgtattattgtattttagtacttttattaagccattttacctgtaattatttgatggggtaaataataaatgaattctagtctattgtattttttaactgaaccttttttgtttttcacacacatgcatgcacacacacatagacaaatatatatatgcttatgtatatgtatatgtgcatacacaatgaatgtatatgtatatgtacatacacatatgtatgtatatgtatatgtacatacacatatgtatgtatatattatttgtatatctaaagtgaatcttaagacaagaattctatttctgttgatagtctcccagaaaaagtaatatgctatttggctataagactggaaatagaacccatgccataaaggcagggccagggggtttctaagtcaaaacaacaacaacaataaaataattacctaagtgatcctaaataaagaaaaagtaaattgccatcaacaattatattctaatacaataagcaataaaatgcacccaaaatttaagaaccttggagaaatatgtggatgagaaaaaattatattcctcattctcttgaagaaactataggtcacccacttaattagcttgttccgtaactttcacccaggactcctttatgatcgcatggaagactgtttgatccttttcttctgctggatcaccatcccaagcacacactcacagaacacataccaaaacactctgtcaatatcaccatcagctccatcacagtaagtagttagccaattatgaaaacaataagccaggcccattatttgcaggttgtgagttaaaaaaaaaagagtcatccttgttgactatttgaagatgagatgtatcctcttaatctttgttagtggtgactgtgtagagatttcattcctggaatactgtgttggttaaaactcagcaaagcaacctcagctgcttgcaaacttgcaaatcctgcagtgttaaatggccaaaatgctactatagcaattttttcttcagttgaattggtcagtttttgccaacaaggatgaaatttacatgattctgaatataaacataagtagtatgatcttgcatcagcatactgaacacggtgagaaaccagcaatcagaagtacgaggctcaggggagaaagcatgtaatgtggtatagcatgcctcagaaatgaaaatctttgatgaattaagaggaggttcttatagttcccaggattttcccaagaagttgatttgtaatccacattttaaagtaacacaattaacttttttatttgaatatgtaaaacaaaataattctatgtttcctgtaggactctaggcattttatattaaaattaacacgaagtatgtatttacctttaaaaaccatgcaagatggcaaagcatgaaatgtaaagagaaaaaacaataacaacatcagagtagaaagttataattgttaattaccttcctctaatgtcccacagtattggactatgggagcattcagggcctttattcactcttaccagcaaatactttaccaagaatagatattttcatatttttttcttcatagcaaagtaatcatatgccaggtactttgtatcttttatgctttcttcacctataaagttagaatcatctaacatagtgacatcataaattcagaataacaaaagcaatacaaataattttaaatcaaatttttagtctatcctatcaaatattgtcatagtgaagttttgttttttgtttatttaaagattaaagccactgtgactttctaaccatatataagaaattatatatttatgtattaaaatattcttctcctttgtattggagcactgagaattactggtaggattgtggatgaaaactacaagtaaaatgcttaaagttgttgatatggtgagatggccagacaagcttttgaaaacatgccaaatttgggggctgtgactttgttttcattctgctttagtctgataaaaagatgtgaaaagaactaagtacagacaactgtttgccccattggtgtagtttattgatacagtttattgtgtaattacattggtatgtggtgaaaaaaggctttcagaggtagaaggctcaggctggagacttgaaagtggtactatttaaatcagataattgagtctctgtttccaaatctgtaaaacagtgttaagatataaaatatcccatacaattgttgcaaagattcagcaaatgaatttgaaaatattttgcaaactgtaaagcagcatgtatatgctgctatcaattttttgacttgttatttttgtagtgacaaaattatttcctgatagagtatgaatttatctctgtagcagaatccactatatatttaggatagaaaagtaaaagatttttataaattgccatgaaatgtcacaggctgatttgcattttctggtgattctatacattaatcactgagtaaccttcagttttccaaataaagaataaagagagtggtgatgacatttgtaaccatctacagaggaattatttaaattcttcacagatggagcgatatcaagggtaaatcattatagccacatttctaattttaagaagctttgagggtgtttgtggatggtaggaagtaaacattgttttgcatatagaattaatcatagactttgcataccacaattccaaatcctccagatgagtgtagagggctttcgagacaccatcccctaaggatcgagaaattcataaaaggaaaataatgttatgctacatgtaatatacaaattgagcaaattggagcaactagaatagtgacctttcaaagaagacaaattagattctgtatgcctcagaatttaatgagtcttagtgctttaggaaggatgacatatgacacatattcttaattctagtctcacaagagttaactttattatttctcaacaagatgaataactcacttcttctttggtcaacataattctacctaatattctctgtaaactagctctggaaatacatgcggaccagtgcttgagatttttagtaaatgtaaaaggtatctgaatggttgtataatgctgctttaaaagagttttaagggttggaacatggtcactgagaaatacacaagaaaatctgttaccaaatgtgctctgaattttgagatgagtaacccgtggaagtattcgctatgggtaacaccacttgcctaaaaccacagaggcaacaaatggcatagcctttctggtcaccaaatctaaatgattttctccaactgaaattaaaaatgtgtttcttgaaatgtactttttataatttctgaattacaaatattttctttatttttattcccatttgctttgtaagtagttctaaattaatatattcttagtaactcctgagttcatatggataatagtaaaaacacaagtaaagagtaaacatactggtaaacccactaatcataattgacaactaccacttgtcatgttcaaatctcattatcctgtgatgttttttctgtttcttgtatcttcttcctaagatttagtttgaaaaaggaaaagaaaatgtatttaatgccagataaataccaccactagggaacaaaaaaaaggtccatttttaaaggactcctggaggccaggtacggtggctcacgcctgtaatctcagcactttgggtggccaaggcagtcagatcacaaggtcaggagattgagaccattctggctaacatggtgaaactccgtctctactaaaaatacaaaaaaattagccgggcgtggtggcacgtgcctgtagtcccagctactcgggaagctaaggcaggagaattgcttgaacccaggaggcaaagggtgcagtgagccgaggttgcgccactgcactccagcctgggcaacagagagagactccatctcagaaagaaaaaaaaactcctagaaatcatttttgttaccatgtttatagcaacacaatagtgaaataggcaaatgcatttagtcacataacttggttttcttgggccactgctttctttcctgtgggagtgggagaaggtacaagcaggagagacatgatgcctttggactgctctgttaccttcagttttgtaaggctcctggctccactgaccagattatgctgatagataagagataggggactagttttctaccttgtgcctgtcctggccaagatgcaaaattaagcctactgttgaggaagaccagaaagttgtttattgcaatgtacccaggctcccagacttaggatgttatttaccctccaccgttatgcagcgggaacttaagatgttaagaacgactcttaccaacatctgctttgttatgcattcattctgcctgcatctttaatttggggtgatagctgccttcagaagctttgggagccgttcctctcagtaaccaaatactgtcccatgggggacatttcctctctgcagctgttctgtgtagggtctcaacagtgtgctacagctggctgtatgcaatgtagtgccttgatgtctccctctctccttgcttttgcagctggcgctacgtacatctttgggaaaagtggtgggcttatcctctacacctggccagccaatgacaggcccagcacgcggtctgaccgccttgccgtgggcttcagcaccactgtgaaggatggcatcttggtccgcatcgacagtgctccaggacttggtgacttcctccagcttcacatagtgagtacagggccttggcctggattttcttatgttactggtggtctgagttagtgattcaggtagacgcagcagaacattctagatcaatatggcaaaggtgcacatgcttataaaaattgttttcagatgtgaaccatcatatttacagggttcctgggggaaaaaaacttaaaaactcttccttcttccccatgtatatagggaggaaaaagaaattcattctttgcaggctcccttcccaactgtgtggcttggcctgtggcagaatatttagcagacttctagggtatatttaagagatttacctggtgtggatcttacctggtgcaagcagcaaagccaagtggaatgttaacaatctcctaggctgggatttggcaaaccttctgtaaagagacgtatagtaaatattttggactttgcaggtcagatagtctctctcagagctactcagttctgcctttgtaatgtgaaggcagccacagacaatacatttttttgaaatgcatgagactgtattccaataaaaatgcatctataaaaacaagctgcaggccgtaatttagtgacccctgtcctaggcttcaagcatcactgtaagagatgtaataaatgtgtgataaaaactgagaccagagtgccagagtgggcggggcaaaagggaaacagaacagtgatcaagagttgagtaattcatgtgtattgcatactcaacattttgcttttggtcttgtacatatgcacttaatagcactgcacccttaatccctgtagatcataagaacacagcaaaggctaagaaattaaaaatgatttagaagaaaaaattcttttgttataaggatggaaaatatttttacagcaacaattaacccattttatcacctgtgcagtctgcagttaagaaagtaggctaaagagagatatgattctcatccataagtacccaaagtgcagtctccaagagcaaagagaggaattgttctcattagttagcaatgacaaggctagaaagaatggatttaatttggagcaataagaatttagtttaaatagcaggaggaaaaggcagttaagaaaaaagatcaactggggattactaccaacctccaaaaaggaggaaaaggaacattgattaggaatctctgaatcagagttttgctaatgtgcaggtgtatagagagaagcagaggatacaatttcattgctggtctctggagttggagatggctggccggaatcatgcatgacaagcccagctcccacagcagtgcgcatgtctgacacttgctcttccagcatgccttggaaatgagagcagcttaaagtcctaggcttgagctggaagtcggtctagccccagtataagccagatcagggcaagactctgcttaggagcttaaggaagaactggttagagatgatcaccttcaaaatgtggtggaggagtcttgaatagagttgtgaacttttcaattttttctcagatgcttcaggaaccatatggtgctatgagcctgagctaacacattttaaaaagctatgccaaggagcaaaaagaaaggcagccatacttactacactttatctttatttggcctctaagaaccaccataatttacaaaactctgtgagatttatgctacatataacttaatgactatttcatggcagctataactaggctgttattaccagctcacttgcatttccacagtgatttatcttctttttttgttcattgtgactgcctaagaaaaatatgatttggcacagacatgagcatctttttgagtcaaatagtgtactattgttttatccattcctgctcattcatgttttgtagaacatctccacttttaagagagaggttttcctattttctgatggtttacttgaaattagcagtgttttaataaaattgtcatgcagattgtggtaacttctaggaggaaccagaacattccagtatattttaatataccattataaagctctgtcatttctttggggtctttgaaaagtgaatactctaaacatactttgagattcaggtaacatccattgtgtgcatttattagtgtgtgtattctgtataagcatacccattagatttgacatagtataatattattttctttgtatgagcaaaattaccagacattttatatcaaaatgtaaagagccccctgggatactgtagacacttgggtgatacagccgattgcttaaacgttctgtgaaagcccagtagattttcctccaaatcttagattaggaaatgatgtcacctgaccctttcagaaaaaaggaaaaaaggatcctatgctgtggggaatctgtgtgattctagagtgaccctgacatgttcatggccctctcgagcaccaggccccttcatgggtctagtcatttgaagccatattttatttccttgcagattatctctttgtctactctgaagaaggcaggtttctcatcatacttgaaagtaaagaaatctaagtagaagactaaatggcttaattatgaaaccagctttttgttttggacatttaagtagatacatcagggaaacaaagccataaatacttattaagatacttttataacttttacaatctgtaaaaggtggttctgtttgttgaatggtttgttttcttgtactaaagaaaattactgaagagagaaagagctttggggccattaatgaaagtggaagggattgagcataaggcagaagatgctatttctccttacagtttgcctagaagagaaacctcctgggaaaaagaaaaagtgatagaagacacaagggggagatgaaggcaggtggttttctcagtttttttactgctataacagaatatttgagatttggtaatttataaggaacataaattaatttctcacagttctggaggctgggaagtctaagatcaaggtactggcaggtctggtgtcttgtgagggcccagtcttcacctctaaggcgagcactgcatcctcaggaggggaggaaccccatgttttcacatggcagaagggcagaaagagtgaacccactcttgcaagccctttttaggatagcattaggcagagccctcatgacctaagcgctttccaaaggtcatacctcccaacactgtggcatcggtgatcaagtttccagcacatggaattttgggagacatattcagagcatagcagcagaatatatttgcagcagaatatattccagggataagggaagaggacagggctctgcctaccgatgtgcttcaacaagggattacatgggggcaaagcttcattctttgaatatgagtgttctttataaaataacaacaacaataaaaacctaaagtactttggtgctacttgtgagtggtggtcaggctagtaaagttggtcaaaaacaaagtacaaactccaaaattagccagcggtgtatatgtgtgtgtgtgtgagagagagagagaaagagagagagagagtgtgtgtgtgtgtgtgtgagagagagagagagagagaaagagagagagagtgtgtgtgtgtgtgtgtgtgtgtgtgtgtgtgtgtgtgtgtgtgttggggagaaggagaagagacaaagaaagtttgtatttttttaactttcaaagaagacaattcctagaaattcctgaagtgttttgagcaacatcaacattgtcgttggaatatttcctttttacccccaagtggacttatttgaaggaagagaaaatgctcttccaagaacactagagagcctgaccctggggtaagcacccactctagaatagccccagggcaggagtggcaaataggcttcatcttgcctgaaaattctcagtgcctcactctctctcttcaagctttacaccaggaagatttatgagaacagcgggcaaatccacaggtaggagatctagcttccattagtcatgtctgccacatgtgccgatgtgaggttttgtgaacgtgcactacacattcatcacatctgctttaagctccacagtattcctccacacgtgctccaattttcccatttcttttcctttgttatcctgaaatccctatgtattaaaatttctttggaaaagcagtatcttaagctcatgttgcactgcaagtcctggaatgatttatcaattcatctgaagtagtcaatcttattgccatccttctcataccagcctaaagtcagctcctgtgacagaatttaagttttgataggagagttggacagaaaggaagaaaagtggccatggctagtttggggatgtgcaatgttgtgtgggatggtagaaatgagtgggaaaacttgggcaaaatgaaggcatttgtgtcctagattgagtaactggggcaaatgaagaaagggtcaccaagacagttgagtgctatgagcacttttcttcttttatgtatgtattttaagttcaggggtacaagtgcaggtttgtaggcttgttacataggtaaactcgtgtcatgggggtttgttgtacagattatttcatcgcccaggtattaagcttaatatccattagttatttttcttgatcctctccctcctcccaccctccaccctcccaaaggcccagtgtgtgttgttctcctctatgtgtccatgtgttctcatcatttagcttccacttataagggagaacatgcagtatttggttttctgttcctgtgttactttgctaaagatgatggcctccagctccatccatgtccctgcaaagaacatgatttcattcttttttatggctgaagagcacattttttctatttcatgatttgctcagattgtctttcattctggccaagggagcagaggctcttatttctcttgctactttcttttaaacctaaagtcttcccactcatctgggccttataaaagttaaataggttttgacaaaaagtgttgaacaacacaggcctttggtcattttaaaaaatcagagagggccaggagataaaaatgatttagaaattgcttgcttcaaattaactaacatttctttgtttttggttcacattccatgatgcaatattttctgaatgaattataaactgttatattaataaaattttgaattaagcatgtttgaaaaaggcaaagagatctttattgaagtatatgtgcatgaaatgagattctgtagagcgagggtgtcttagggtagaggaattttttaaaatctatttcaaatgttagtttccttccattgaaatcgattgttgaggaattaaagctcaattttggagaaaagctgctatcgcttgcgagtgacatctgcctattgaccccacatctaggctttaaggagcggtgtcatgttacactcaccttcatttatacaacagggaaaaaaaactgaataggactagagaagagattggcatgaagtgcttgttattactatcatgaaactcttgtcaacctctttcaccatctgcaaaatagaaggtcggggagaactgggcaataattagcttccctttatgtagttaatgctgagtgtaaaaaagacatcctattaatttctttctctctgtatgtaatttacagtaaatcctcttggattcattttttaattatgagcctttcaggaacagtgaaaatttatgtgttaagatatctgttttgtttgacaagaatctataaccttccccaactatttccttcctgacttaaaatgtagattgttacatacacgaggatgaggggcagacaaagaactgctgtccagactgacccccatttcacggtggcaaagtgttctccttccaaaaactggaactttgaaaacagattgataatattctatcagtgtcatatttggggaaactggatatttattaagtttcacttgtatattattgtttttacatagtttatagcacccaacgagagtcctgtagaataaatggaagtaaagctgaatgatgatgaatggtctgttcctcccatctattgcatttataaattgccagcctggatgcttcatttgggctgtctctatgtgggatatttacagtaaacgatcagcatctgctgggatagtccttagtaaggttaggtggctgttagcttagattcatctctgggtttggccagtgacagaattggatttgagtcaagaactgtatttggggaactttccagtggagtacagaagaatgttggtgtttttgagactggtaacgcaaataaaaaaggaacgaacaagaaaacaacagaggtatccaacagatgcaatttcgtttcccatggagtgctgtgcactgcaggttgactccgtatttccttccatcgctatttgttcttagtgaaaaagacctctttgggatttctgagcttaggagtttttccagatcattagccacttatacggagaggacctgctgggcattgtctctccagctttcagcttagccatgctatcccagcagagtcggagaagaaggtgggagaagggagtagaagtgatgattggatgaagtgactgcttatgtaacctggactagaggcagctctctgcaggggagctggtgtgtgttttctcagatctctattattcccatgatatttctatctaaatctgtttactttgattccacacatggttttgagaggcagcaagccatagtagaaagatgtgcttaatttgaaaccaaaaaaaagttggatttgagttccatttttcaatccatttctgtcagtgagctatgtgactttcagcaagtcattctactacttggagcttcagcttcctcttcttataaatgggcataaaatattatgttgcagggttttctcaaagatcaagtgaaataaaatatttagaagctgttcattatcagcaaaacactgcactaatggagaatggtggttttcctaataaaatgggtgctgtagaggtgatgactgcattagagaaacatatatagaaggaaagttttagtttaattgtttgtataagtctgcttggactttttaggcaaaattttttaatttctgtttcatctgatcaaatgtcaattttatgaattaaccagattcacaatgaagacttttggagcatctctttagcataaagtgaagaagcagttacctctgagggaatttaggtcatgaccttggttaggtcaataggataagtgaccctatagcctccttggtgtctcattatatagcgttgtgtctctatccctgttacaagatgataatgcattgcgcttctattctctttagtataagcttccaaagggctctagactcagcagtgaaattgtcgcctgccttgccctgaagtttattctttaattttatcgaccatgggaaatgggaatatgccactttgcatgaaaacagggaaagaagagaagaaggaagagagggaaagaggaggaggaaggaggaggagaataaggaaaataaaagagcaagaagaagatgacaatagccatgaccatcaccaccaccaatagaagtagtagcagtaggaaagcaaaacctttctagataggcctagtatcaaaatggttttagactctccttgggtaccagataaagtcacaaagagcttggtcgtatactcggggatagagcccccacaaaatgttgctagaaccaaagtcctaatggaggtacagccagactgtggggagctaagtaggtcttgccaccaagtacactggaaacctaaaaccagaaatataaacagaaatacttcatagatttggattccccaaaatatgaaggaaaagtgaattataaatttactatgcaaatgaaatgtacaataatgcaatcataaaaatcaagctgacaaagtgtgtggaaaataggttatggctgataggaaattatgagaaggaaaggccaaatggctatatctttctcatttatggttcatacaagagcccttagactgttagttaatgacagttatgtttcagaatcctcaatgcatacaaataagaattttgaaaaactaagatgaagagaatttagctcctgagcatcattcattttatatatatataaattgagtttttattatgtgtcaggaaaagtgctgtgtgttgagggtactgtgaccaaccttggcttgcatagcataaacaggcttgagaggccacgacaattacaaaaacaagaaattaggttttctactcattatgaggtgatgtatatacaactcttgcacaactcctggcatatagtgagctttcaatcatggatagattttgatattattggtactcaaagatttttcttcaactaactcattttaactcaaaaacttgttatattttattttcctaagcaatgaataaactttaatcaggcctctgaaatttgaaatgaagcaatataaaattctaaggagctgggatattactgatttaaagacagctgggtggcacatatactgggttattgcagttatcaagctagctgaataagttctgaatagcagaagctttttagatatatgaatctaaaatgcaacaagcaaggcaaactctaagtgccatcacgtgaatgctggggctcacaggacttaatggcaagcctcccttaacaccatcagttggatgaattatctcattgacccaccgcttacactgctccttgtcattactcctggggtattgttcagtgcaacagggcaagaaataactcattgactccctgaagctatagatgatggattttagatccctagctgtattcagaaggcataggagctcagtgtattgatgggggaattcattagccacccactccacagaatcagtttcttagatcctggtgctgtcactgctgctgttgcaacttgttagtgtttcagggacagacgtcagagggaactgtataactacattagcctcacagatagtaccgacagccagacctgtcatttcctggcctgcgatgacacctctggagcctagaatcacttaaagatatttagataggccctgttgatacgaccaagctaaccttcatcctgaaatcaattcatactcaggatgacaggaaatgagttgtcattaaggctcatattctatttttgagtccttagttaacctcttataattcagtttatttttcctcctccatttctgtaaaatggcaggtaatttaatgacatagattattacttcctacatttactcgggagcatgtgtttcagagaccatcttacattgataccattactatcactttccgctaatattgattgacaaaataccaggtaccagacactgtgcaagaactttgtttacactgtcttataatgagctcatgaccactcagtgaggtagtcactattaatatcctcattttataattggggcaactaaagtttgaagaagctaaagcattttcccaagatagcactactaataaacagctgaatgggctttcaaatgcaattctgacccttaattactattacacccctaatgaaagttttagagtagaaagcatagtggtaataattttaactcaattcatacttatgaaacagcaatttacttgggattgttggagatgtgaagaaagttaatatctagccggggggtagaggggaatgaaaatcatatgtacgaatctttttaaaaacagaatcagctatataccaaagaaggtaaaaatactgctggttgctgagatttttttttttaatgtacatagatgggatgggacagattttgactagtggaatctgaagaaagagcatacctgatgaagataccagcatgagtgtcatatcaaaggaaatacaggatgtgttctcaaattcatgaattcaattggaccgtaatgaatggcataagaaaagaggcaggtaatatggattagcacaaagaacatatgatttaggggcaattggtctctgattcaaggtctagttctgcctccaactagttctgtagcctcggatgaattatttgactactccgtaaaatgcagatggcaataatgccaatttgtagctctgtgaatatttataacctatggaaaaatgcccagtgaattatctggtacatagtggatgttccattaatgatagccatgttcttgtgttttcttcccaggtactttagggacatagtgtagaagatttgagttttataccaatgatcgattgtttctgaaagcaaaaggaagacatttaaagatttttttagaagaagatgaaatgcccagcacttaatttttagggagattattttggctctgttaaaagaatgttgttcagtgggttcaaggaaaacagcagggtcttgagtaagtgtttctagagaaacgtctttaaagacttattctatgatgatgcatataggaaggtaatgaggataaaaccaaagaacagttcagagattgaatcggcaggtgttgtcagcaggttggattaaaaaggagagaactgagaaatgtctagattgggaaggttgtgatttcattaccaaaaacaaaacaggggacagataagtaaaacagataagagtttgactttagtgatgcaaaacataaggcatccaagagccaggctattgaaatttccaattggaaatacatgatgaactcagaggagagataagggctagaggtgggggcctagagaattcacagcttggcagtgacagtggaaggtttaaggagtgctaatgtctcaagggagatgaataggaacttgggaaatatatacatatttttatatatttaaatatatattattttatatatttatacaaatatatataatgtatattaaatatatacatatacaagataaaggaggaaaggaagagaactaaaaaggaaaggctagagggtaggggataacctagatagtgaagttttacagaaatcaaaacaaatgagagacttccaaacacaagttgttccagagctgttttttctatacctgttaggcctctttcatctgaaatcagtttacagagatgtcttcttcatctttattggtatttattatggtgtaatctttgccacttcagtcctcttaccagtattctgcatttcttctctgtcacgggcatcattaactttgagccagaggacccagcatctactcctagagagctgccaccaattagcagttaccctatgtaaatggtagaggtgtagctactattctgccaccctcgtaatattgtgggaaaaatccaatgacagaatgcaagtgagcatgccgtgtcatcattgaaaagtcctacaaaataaataaagtcgtttttatatcaatattggtatacctaccactcagcacagctcttggtacctaaggagatggtgattggagacctggaaatgaagaccaaagagatgctgagatggttgtagtttccaataggaagattagcaaccaggcaagtggcagatcagagcccaaatgtgagtggctcaactgctggaccctgtaagctgttgtggttctcaaatgatgtccttatcttgttcatctctcagctcttggcacctcaccttttggagcttcagtttggaaagggcaattcggatttaaatcatactgcagtttcctaaatagaacaaatcccctgatcctagtgatcatgtgcaatgaggcatggaatctgattacccttatcattatcttagcttggatagctacaaacgttactaaatggttatgaaattatctagccctttattaagtgcaaaaggtagtacttaggttactaaacttttttgaaaataattccgctggctgacttttcatggctaaaaacccatattcttatctgtggagtgtatctttttgtaatcacatctgtgtttgctgtttttttaattgtccaggcagtatgttagccattttgtgtctatcagcccatttggtcctgacaacactgttaaactagtggcattacctctattttatgaagtaaaaaattaagcctaagaggattaagtaaccatttgttaaaggtgttaaggaaagaaaagaggacttagacttaatcattgatatgtttgttttcagtgtcatagatatagatatatactgcttttcataattttctattcaatataatataatatatatgtaatatatgttggatgtgttgaatttagcaggacctgtaatatttatttaaatccacagttaagaatgataaacaggactagagaatggaacacagaattttggctaaagcagcatacataacttaaaataagtcactttctttttggattcaaagaaactcattttacattacattttttgcttcccagtatttgtttttctcaatgacgttaaggcacctaattacccccaagccactttcttaaatactcctatgcaaaatgaaaagattggcctggagactaatctgaggttttgaatgcagtgcggtagaataagtgttttagaggtaactttagttcccaaatctcaataaaaacacttccaaatttagtgtatcaaagaaaagattattggataatgcattctcatctttcggtgtatgataaatgccatatcagaagtcctcaaatactcttgattaaaaacgctaaatgatctcaaataacacaaaaacccatttattcctactggagtcagtatttaattttctatatttgtaatttaaatccagatgtgggtgtcttcacagcgaccatggcctgtcatcccttggtctgttagcttctaatgtctagcagcagagtatagtaaatacttgaaaggtagaccttcacactgaaaatcacatttattgaagtgggagcagattccatttaaattgtcccttacctgatgcctaattcctaaggttaacaggttttcatgtttgctacttatatcagcagtactggagctggtttttttgcatggctaaacagcaaagcttaaattcaatactagagcgtgaaagaggaaaatgagttttggtgtgacgtgtgaatgacgtggttttcctaaataccatgaatgcacaatgaatgatccacaaagcacagccgcctcttaaaagaagacaaaaatctccctgaggtttagttgagaaaagatacaggagcatatagcaaaaactacaacatgatacacttacgtaagatgcaggtgggaagaatagaatttccaaattaaaattagccaggccagcagaaatgagtaacctaatgttatggcttggatccgtgtccccatccaaatgtcctgttcaattgtaatccccagtattggaggtgggccttggagggaggtggttggatcatgggagtggtttttaatggtttagcaccgtccccctagtgctgtccttgtgatagagttctcataagatctggttgtgtaaaagtgtgtagcaccttcccctctctcttcctcttgctccagacatgtaagatgtgctagcttcccctttgcctcctgccatgattgtaagtttcctgaggcctccccagccatgcttcctatataccctatggaaccatgagccaattaaaccccttttcttataaattacccactctcaggtatttctttatatcaatgccagaaaggactaatacacttactttcgtgaaaacaacttttctcttaaccacctcctactgtctgtcaagtgtagttctaagtgcttgggatccaagagtgaaaaggatagacaaactccctgtcctcatggtacttacattctagtgggggagtccttaatgggcacaagcaatcagaacttcaatttgcagaattttgtgaaaatgtgctatcatatatattttattaattaactagttaacaggcagggaggatctccttcaaacttttgttttcatctttgtatttttctttctttgccaaatttccactttaatctctttcattctaatatgctcacgagtcacttaatgaggaggatatgttctgggaaatgccctgccaggcaatcttattgttgtgtgaacatcatagagtgtacttacacaaacctagatgttatagcctactacactcctagctatatggtatagcctattgcatccaggctataaacctgcacagcgtgttcctgtgacgaatactgtaggcaattgtaatgcagtggtatgtgtgtagctaaacatgtctaaataaaaaagcacagtaaaaatgcagtattgtaattttatgggaatgtaacaacccagtgggttctgtttgtccactgcccagatggagccaatttatcaagacaggtgaattgcagtagagaaagagtttaatacatgtagagctggctaaatgggagaccaaagtttgattatcactcaaatcagtctccttgaaaatttggaggctagggtttttccaagacagctcggcaggtaggggtctgggggatgggtgctgctgattggttagggatgcaattatgggatctggaaaatggtccttatgcactgagtctgcttctgggtgggggccacaggactggttgagtcaagagttgtgggcccaggtgggggacatctgattgtcagaagtgcaaaagcctgaaatgacatctcaaaaaggccaatcttagctgctacaattagggatgttcattataggagtaagtgggaaagttgcaaatcttgtgacctccggaataatggttggtaattatttaactctgcctgcatcttagcataattcaggtgtctctcatcctcttaacctggtggctttcattagttttacaaagcagtttagtttttgtgaatggttattatcatttaaactctaaactaaatttctcccaaagttagcttggcccatgcccaggaatgaccaaggtcaaagaagtttggaggttagggcaagatggaattggttagatcaggtctctttcactgtcataattttctcactgttatatattttgcaacagcagtttcaggaccaccttcacatactcagtctatcattaaccaaaatgtcactgtgttgctcatgactgtaatcaaaaaagcacagagagctctctcgctatctggttctatttctaccaccctgacaaccactatagtttgttttcaacaccaaaagaaaataacaaaaaaatagcatcttcaccctcgattctagtttcttttttcttgaaatgactatggccatttctattatttcattttgaaattgtgcagaattccttctgaacatccatctacatttcacagacaacaaattgctaaaaacacctaaacaccactaacctgggggggagaaaaaaaaacaaccaaaaacaaccaaacaaaccaaagaaaacaaatcaaccaaatgaaaacccaccctctctggtggaaagactgcaccatttttggtaaagactttgcaatcctgcctagactggatgactgcctattgccctaacactttccttcctacccccagttatttacaagatcaccccttatggtaacagtattagtacaaatgaggtttttccctttacttaactgaatgctagaagaaacagaatggaaccacatgttccctttgattcacacccaaacactgcaaaacacagagtattcgcttcctttttcaagctgtgtgtgcacattaaacacatgcaaacattggactgaaacagacacagtaagtcagctctaggggaaaactatagaagtctttttattttgtttctctaaatctcaatcttttatttaagctaggtctttgcagagattcaaagaatgatattttgtaatggttctccaaagagcagttagatgtgtctcatccaaatttgtgtatttaccttatcatcacagatactgttctggaactgggaacttagcattagctctcttcttagaaatgactattaatttttgataaaaagaataaaaaacaccacattacataatggatataagagaacatagacggcatgataggaatattctgcctgtgtttccatgaattgcttctttgttaaaaagtgtttggtataaattaggccagtggtgtcccagcactttgggaggccaaggcaggaggattgcttgaggtgaggtgtttggtataaacagtatattaacaaagaattctcctatggtataaaccctaactctagcaggaagatcaaatttctctttgaggcatgcagtctgagctccagtgactctctgcaagagaaaagctgatattgtcacattgtgagtcatagtgactcccaaggatgtatttgtgtggatgtggttggtcagaaggctttgtgtgcactgtgacatctttatgctgcagatgccaagatcacagggtccacacagagcagttcatttcacacagtgggaaatgatgcgtgtgtgtgtgtgggtgggtgtgtgtgtgtgttttaaaaaacctaaacagagcaacactgttctgtgcactcaaactctacagctaaccgccaagggccatcttataaatttggacattgaattgctaaaatttgaaaacacagccactcctattcacactctaccatctggaaataaaccctaagtcactgtgggtgtccatatggaagtcactgttctgcttccttttatcttcatggtagttcaaggttcgatttcctcctagggagactttctgttgttcccattgagccagctctgctgtccccactggtcacgaaccggatcagtacatggagattcctgagcatatgcagggcagcggcatgagagcatctaaaatagagtcattcccattgccccagcacatccttccttcctacattcctgggagaaaagagcagaaacaaaggcttttctttcttctctcttttggatgtttggtgatttgcatacagaagttaactcacttcatctactggattccaatcattcccttcctggttcctgatcttagagtacagggtgcttcttgccttccccttgtcaatataagggctttagaaaacgtgcccagctggtattctttaaacctcctccaacgcacaaatatatttttaaatgcagatatttcatatacaagttgatatttctagtttctttttgaaaatcggaaggtttaactctactgggccagtgttattcatagcattggtcaactggagctgaggagccattgccatttttatggatattcttttaagccccccaatctccaccactccctgtcacctcactcagcttcatccatctgcctgacccctggagacatttgattttgtgcttcctctcacacagaacttgtgttcacaatttggggtcataccttcacatattatatgtaaacagcactctggaacgttttcaaagtcacagctattttaggtatttagtttagaagaggttagaagttgacttttacattagtatcttaaaggaatatatttgcctgctcagaaacatctggggcccacatattcagatctttcgtacatataatttgctatatagcataacacattgaatgattttgactcagtagctcgacttattttttgtgttcttttaaaatctttcatattaagcatagaattgtaatttattgatgaatattttattttctgagaaaagttggttattattcttaaaatacattacctataatgttcatgtttcctatgttttaatatataatattacaatattgatgtgtcgtgattttttttggttgttctctaattaggggtctttatatgaatctctgattacttagcagttctctgaagggggcagtctttcagagatgcatttaagagctctgaattctgttaagaatattaaggaacacaatttttaatctttactttttactccagggctttgggctgtctgtatcaaaatgcttcagatacttcctctagggattgctttgcctgttccatccttaagagagtaaagaatttcttctccccaccaccccccaactcctgacaatttcagctaaatttttttcttccattgctttaggccattgcttcaagttatatcaccttctgagactatgaataattctttcccttcaattatattgttaccttgaaggtatttataggctgtgatcaaggcccctggagtcactgctttggcagactttataaatttagctcttaccacttctcctcacattttttatcttccagcctttgtagcactccttttgtgtgtgtgcgtgcctatctgtgtagcttctctgatattttaatatccttcctaaactagggaggtcagaatagcacatcatattccaggtattactgtgagtatcagattttagagagtgaaatcaagggagaggattaccttgaaattgaacttaatctattttgtgactcagaaaaatagacaaaatggtagaaaaagctaacggggcactgtcaacatgttttcatatattttaacgtactgttagagcaatcctggaagcttaagggggaaatgatgatttttcttagagagaattctggcttccattagatgcttgaacgtgtcctttagagtaagattttctttacaaatccaggcttcaaatatggctatgtaataagatgggttttttccatagtacatgagctcttaaatctgtattattgttattattattattattaatattatcagacctgtctttgtggcttaaaattaagaaacatcattaaacatttaattttacaatgaagaaaacaaattgctacgtaaaccatcttgctactagctttaagctctagtccaggtcattctgcattttgtcaatatagtaaattgagtaacagcctctgagggccctgcaaagagccaaggcccaatttaactccctagtgccagggtctccaaatgtttttggttgtctatacatactagaaaaaaattaactctgcaccaattaaaaatatgtatatatgtatgtagaatacacacattgcttatattatcacacatacagaaacatcaggcattttaaaagataagattagatacatatatatcccagtattattccctgaagttcccatgaaccaaccttggcacccctgtggatgcccaccccaacttggagaccactgctgtggtgggaaaaccatggtgacaaacggagccaccaccctcagcagttcccaggaggaaccccagtatcaatggttatgtactgcagagcctataagcgaatatttagttcagacactcattttagatatgaagatatggaggtgcagtgacttacctacctatggttacagagttggatgatgagaaagctgggtgtaaaatgccagccttctaatttatcagatttcaacacatgcagaaaatacatagtgttctgttttagctggaatctcaggaaaatggggactgaggtcctgaatgaatgatgaagaaggagagggtgaatcaatttccaatcggtggtcttaaaggtgaaatattgttagcctaagtaatctctactcttttgtgtcccttctattaaactctctttacaggttctctctctctctctctctctctctctctctctctctctctctctctcccacacacacacaccccaagataaaatccaaagcttctgattcaatagccaacctcttcagcaagaagagcaaaggttctgcagccagattgcctgggttcaaatcctgatcctatcactgaatagcagactttaggcaaattatttatctatgactcagtttcctcatccgttgaaattggggataaaaaagttccataggggttgatgtgagcattaaatgacacctgtaaagcactcggctcactgcctgatcccacgctaatggccctttatatgttagctatttttattattttattctaattcttcctaaaagcttaaagcacagtccttcatatcactgcatcgcatttcattttgtaacatgttcttgtgctacatgtttcaccatgtgctacatggtgaaaggcattttcctacccgctttacaaaaacagacaccgaggcccatgtttagggccaaaatcagtgctgaatgccaggacagactcccaattcagtgtctcgtatcaaactgcatttcctttcaagatgaaaattgttactcaaaaccctatgcagctgggcgggaacacagattccatggtttcctttttcttcctgtttccccaaagcaaagcatctcctctctttgcatgggggatctatccctccagaagtctacccagcctgaggataatggcagctgcagggttacaggggtaactgtccatctgtctgaattctcagttgtgtgagagcctgtgttacaaccttagtagcttctgcacctcactagcttttcccactcccttggagtgcttccattttctccagctttcggtatcagggagtgttattaaatgataaggagctggctggctggttgtgtattgtgagaggctgagaaacaatgagtgttacaacacattagattgcatgttagctctgattttgggaactttgtatcacagagctcatcatgcaacaggactgcatctgggatactgcctcccttccccagagggttattaatgggccttcatacctgggaggacagattacaggagagatgtgataattagagatacttcactgatcataagcaggcccccgagcaccaagggctagcagctgtgttacacatatgaggcaagctccatgctccagagacaaaagtgaagtagaatttgctgcagtgaccttacctaaaagaggtcatctcaaaaatggtcacccatggacattgattggcaattggtttgaatagagaaagagtgttctgagctgaggatcagaagacctgagtttcatttctagttctgccatcatagagctatagggtcttgatgaagagtcacttaacttgtgacagtttttttatataagaaaaatgggagctacatatgtcttacttatcacaagagattgcaactcaaatacttcttcttccaaggtagtagggtggcaacaagagtgtgtgtgtgttctgacgataaaggaaatataagaatattttgaagcaaaagaaggagccagtacaaaggcagaaattgacaacgcatgggagcagaagtggataaaattaaccaagctggggcagaagaaggcagggaagggtgagagaaaaacagtagacggcttaatgtcatcaccaccacaacaaatgatggtgataacttgatgctggtgatgatttggagctcttcctatggagtaagaaagaatgcaagaattgggtcattgaccagaaactctgaggaggaaattaaagaaaattcatatctaggtgtcttaaacttctcagtaaagaaagttttaagctcatcaatcaacaggggcaggggtagatttagggacttgaagaaagtataagatttttagaatgatctctttgggggatcccaaaataagtcaacaaggcatcttttcaatgttgtcttgatctcggagtcagaacaacttgggtttcaacctagctctatcttttttcctcctagagcacccttaagcagatagatgcccataccttacccatcagtactttagggttataatctatatcttgcaggcatgttatgaaaattaaatatgatcacatatgcagtgtgcataacatcatgtttggcacatagtagcctgtcattattttggaaaagtgaccataatgaaagagaatgcatcaaatatataggattgttaaataacaatgtccaatttagaagctgagttgtgttggcctatctgcttgcaccaagattaaataatattctttacaggtgtctacacctttttctctccaaggcatgtcttcagcctcagtgctttcatggctcatattttctcctctcatgctttcctacctgctcatatgatgaaccacatagaggaggtgattctccgaggatttataatgtgtttcctgtgctcctgaattggtgccaatggcacaccaatccagtcgggtgggcctcaaggcacaccttgctcctgactgagaaggaaaaaatctttgtggagtttgcacaggtataccaagtaattgagcatttgcattagtatggaaccacctactacagacaccgggctcgtttcactcaaaggatagcctagaataagcatgaaggacctcctttcagaatcttgtttatgtaaagcccttcttggatttcctctttattatattttacataattgatcacaaatgtgaacatctatggaaatgagttggagtataggcgataattaacctggaagggaagaaaacccttcaccagaagcaaatagatacccctgcaaatatctggtaatttcggccgggcgtggtggctcacacctgtagtcccagcactttgggaggctgagatgggcggatcacgagctcaggagatcaagaccatcctggctaacacgttgaaactccacctctactaaaaatacaaaaaattagccgggcatggtggcaggcacctgtagtcccagctactcgggaggctgaggcaggagaatggcgtgaacctgggaggcagagcttgcagtgagccgagatcacgccactgcactccagcgtgggggacagagcaatactccatctcaaaaaaaaaaaaaaaaaaaaaatctggtaatttctctttcattagaaagctccaagtgaggtacaaactcaattcaaatattctatgagaataaaaacaggcttatacccaaagataggcaataacaaatgctggtgataacatggagaaaagggaaccactgaacactgttggttggaatgtaaattagtacaatcactatagagaacagtttggaggttcctcaaaaactaaaaaattgagctaccatatgatctatcaatcccactgctgggtaaatacccaaaagaaagaaaatcagtatatcaaagagatatctgcagtcctatgtttgttgcagcacttttcacaatagctaatgaatggaagcaacctaagtgtccattaacagatgaatggatagaaaaaatgtggtacatatacacaatggagtactattcagtcataaaaaaagaataagatccagtcatttgcaatcatatggctggaactagagaacattatgttaagtgaaataagccaagcacagagagacaaatatcatacgttcttacatatttgtgggatctgaaaatcaaaacaattgaactcatgggcatagagaatagaaggatggttaccagaggctgggaagggaagtgggggttgggggaggtgggggtggttaatgagtattaaaaaaaaaatagaaggaatgaataaaacttatctggtagcacaacagggtgactgtagtcgataataactcatctgtacattttaaagtaaagagtataattggattgtttgcaactcaatggataaatgtttgaggggatggatactgcattcttcatgatgtgattattgcacattgcatgcctgtatcaaaacatctcacatacttcataaatatatacacctactatgtacccacaaatttaaaaaaaatgaataaaaacatccttcaaacgaagtggctattttgttgcaaaaaataactattacttctcaagcactgactgagtgccagggtgtatatgtatgtgagtatgtgcgtgtgtgtgttttgttctgttttttctcttgtaaatccgtcaaagattgcaaaggtaggaactattatcctgatttttcaagtcagaatccaaaatttagtgaggttaagtgacttgccaccatgcttgctgctcacaagtagctgaggcaaaatttgaatccattttgcctggagcccaagcccaggttctttctcctaactgggatgtcctgatgcctacacaatctgctcagtgaattactcagcctccatgtttttctattctatggcacccctacgtcatactagccactagagtgaaaagtgataagatgaaaccaagagattgtcttatcagcttctccattcacatgtcttaaatgatttctacctttactaacaagagaaaaatccaggtacattctggggaaaccattagtgcttagttggtaaaatcttgagacttttatcttactagtagaccctcaacatttttccaaagaggcactaatgtaccctgtaaagaaatgacatttttcgtctcaaaaaaaagcaaaaacaaaaaagaaatggctacttttcaccctaaaataaaaaagtgtgtgtgtgtgtgtgagagaaagagagagagagagagagaatgaatctatctccaaatgccaatgagcatgatggactagtggcaagactttctacagaatatgtaatttggtttaggcagggcaatctcctttgtatgaagtaaatagtaaattcagttacagtatatataaacattaagaagaatcttcttctgtttaaatattgcttcttaaaatttgttttgctatttaaaaaattcattttgaagttacaagtgtctctcctaaggagacaattctctgacaaacataaccaactggcaattacaaatcataattgtgactcagaccaatattaagtgagcaccttcctgctttctcgtagatgaatgtctataagttgttagtgcacatactgaactagaaagcccacatcaggaaggtactgctctttttttgttactgttaaatttgcttggccaactcagaatgaatatccagatttctcaactcttgagttagtggatatataaactccaaaaaaattaattaaaattgaagtttaaattttaatactgagaaaaatagttgattagctagaaaaatcaccctaaacataattatatgtatcagtaagtcaaggaaaaaattaaatttgtcaataggtccctattctccagtgctgtcttttcaaagttactttgcaaggtattcagttttagtgctaacgtatcaatcttttttttttggtgggcgggggatgggggcagggtctcactctgttgcccaggctggagtgcagtggcgccatctcgccttaccacaacccctgtcacccaggttcaagtgattctcctgccttagcctcttgagtagctgggattacaggcacgtgctaccatgcccagctaacttttgtacctttagtaaagatgggttttcgccgtgttggccaggatggtctcgaactccagacctcaatgatccacctgccttgtcctcccaaagtgctgggattacaggggttagccaccatgcctggctaatgtatcattttctagaatacatttatcaatgaaattttcaaagaaccttattggtatggtgaattatgtaaagtctcagaagattacttttgactttccacggccagatactcttgactcacttctatcaatcatgcattggaaatactctgacatcgtcaattctaccgtgatctactcaagcatctcacctgtttccttccagaaagcatgttttaatgttggagattcattggctagtaaatgtatagtgtcttaaatgatgtcaaatgaagaaatgccaaaaacatgcccaacaggaacagcaaagtatttaccttcatgtgtaaaatgccagtgtgagatagcccaatgtgatattgaactggatcaatggtggggtgccagcacatgaggaatcgacattaattcaagttgggacacagaagttggcattgtgaagatttttaaattctaggactaaatggatgatccactgggaggcaatgtccagacagatcaataccacacaaaacgttaattgcttttcttggtgaatcctaagaaagtgctggggctttagggaaattgagagagatttcttttcttccccctccacaaaaggtaattaatgagtacaacagacaattcaaagcaagaaaatagaatctgaaagcttgaaagccatacattcagaatccatttagagatttacagaagggctttagcccagaacagtgcctacaggagctacagtggtgacagtgtctccttgatagatgcatcctggaatcttctactgggcaagcatccaaaaatatttgaacaaatgaggtatgccttccagcatagctgggtagttagaaaagagtcaaacatatagaaaaaaagcatagtgactgaagtcatcttaaagctagtttacaaatgtagtctgaaatacactctatcacgggatgaataggtatggattttattccaactatgatctactgtgctttctgggactgtaaaaagtgactacaccatccattaataatatataggaaggcagtttgggaatgtcaacccaaagcctcttcgtaccttgaaattcccatgcaatttggttacacagagtatatcattactcaggttaatattataagacaagtattagcattatgtttgaacaaaggttttcacaaggtctatattaactttacaaaggttctgctgtatactgaatgacaaaggctgtcacagtagcgaccaatttgttccaatttgcttacttctccagatctctctgtcagactttaagttccttgaatatagggtcctagtcttcttgcccatccttgtatacatggtaggtgttccatcaatgtttcttgaatgaatgtataaaaagtgtattttaattgaaatcttaacaagtatgcattaaatgtatagttggtgcttggtactaattctctcaccagtttattgaaatttgactatatttgagcttgaaatggtatacctacagatatagatcattaaaaccaaacaaaaccctttctttatgatatcaagagatttgcctcctaacataaaaatgaataatcactgtctaccctaatggattagactttcttcattagcctcctgtttcttctgagaaatggctacattttcagaaactctgactcctaaagggggtcagtaactctgggaagactatttctattacgtgaaaatttcaaataatctcctagaaacttgaaaactggttatacacagaaagcaaaagaggtgaaaagtgagttgcagtttcattaaacatggtcatcctccaacaccgtctttcttaccagccttgcatgaaacgtcattaagatgcatcttttatgcaagggaccaaaaagggtactacttttaaaatatagcaaaaacaggggttgcagttgcccttttattgagggtcagtttatatatgtagtctgatatatatttcatccagaaatatagttttttaaactttttatcgtgaaataattttagatttgcagaaaagttgtaaagattatatagtttctttaaacccttcactgagcttccactaacgttaaaatattatgtaaccgtgatacatggtttgaaactaagaaattaacatctgtacaatacaatttgctcagataatcccagtttttccactactgtcctttgtatgtgtcagaatccaatccaggataccacattttatgtagctgtcctgtctccttagtttcttctaatttgtgataatctacaaatactttttaattgaaagaattatctaaacgtatatttgtcagatcaataccgtcctttctatctttcctttctccactgaacttgggcgtcagtctctttcttggctactaactctaatttatgcattggatattttactactttgggctcattattttaaaaatctgcaagcagacacagtagtctaggactgttcctgaggctggagggccagggtatagcatgtgcgcaggccaccaaggccagccttgtcattgattctgctttgttaccaagcaactgagatcgctcccactaaagaaaaagaagcaccacttccacttcaaaggtaaatgtgttgaaaaaagaacagaattgacacagcttcctttatcccttaggtacaaggatgccatgcctagtcagagttctgaattcaggttctcaaagcaggaacagggagatgcagcagctgcagttgggaactcttctttctttctacattttttttttctttttgaaagtccacatctctatcaatccagaatcctaattacatatgatataaagggccctcaaaagacccattacccctgttaaagtatgtaaattcaggggcaaattatatgaataatggctaacatttattgagcgcttattacatgtcaggcactgttcttctaagcattttacatttaatccttacaacaaccctgtgatgtaggactgattattaatactattttacagataagaaaactgaaatacacaatagataggaaaattgctcaaagttgcacagctagtaattgaataatcttccaaaatcttttttatttaggtaatagtatttttgataaataatttatatattttatgaagacctttacaatgatggtgttattccatttccaccctagattaaattagcatcttgagaaaaagccataaacccagtgatcaaagtcgatggtatttattttatgtttaaaaggtgtcatctctatcgagtagtcaagtgctaaaaaaaaaaaacaaaaaacaaaaaaacaaaaaatccagtcaacagaaacttaaacacttgagggcaaacattgagcaatgttggggttttgttaccttgcactaattttgggtttaagaagggaaggaaatgatgttcgtaatccagtgttctggaaggaggagtgcttttggtagattaatttacaaagttttctgctgacaaaagaaagggaaaggaaaaaaatcagataataattccctttacaggcctaatttgaacttaattctctctctctctctctctctctcacacacacacacacacagacacacacacacacacacacgacaactgtgagctgtaaatccatggtcatctagttactagcgcagtaagagcagttgtctgatctgatcaaagagtgtcatgctccaaaaaatctgatctgtggtgaaaatagattccccctggatactatccagggattagatattttcagagaccaaaaatacagtgaagtgccctcagcaagatagaacacagtgtagtcattcttggtgaattggaaggattttgccgcagggctgtcattatgaacatcagtgatcattgtaagaatatggaaaagtgctagtgaataggagtcccaattacagaacactgggtgatacagcctttgctataattatagtgtgtttagattgatgggcctaatgagcagtgttccttaatctaaatgttgattttggagcgagttaaaattagaggtaaaactgtgatagtaagtttgtttactagattgactatgtggctccacgtagaattcagattagttcaactaacacttcctcagcaccaaacccttgtcaggccttgggctaggtcctggagacccaaaagcagatgaagtcctcagggagttacagcccagcatgggagagggcatttcaacggcattagtaatagcagtggatatgaattgagcctttgccagatgctaaacacttgttctaaaccctctgcgggtattaatccatttactcactccaccataaccccacaaagttgggactaggtgagaggggagccaacaggcctggaagactacagtaacttttccaagcttatatgtgtgataagtggcagagcagagcttaaacctggtccggaccttgggttcttaactctaaccttagtattccagagaagatttcaatatacagtagttcactgtcctgggaccaagaagaggtacaattaaccatgttgcctatgctgctggtgatgaagccagaacgtaaacagaatgatttatcctcactcctttgttcgtgaacaaaggaaccataatcccccatgaaccattctggcctctttactatcctccagacaggttgatcttgtttctacctcagagcctttgctcttgttgacctgagtgtcccatcccagataccgttgtatggcccttccactcaatcctttcccacctccctccaaatgttaccttattaatgaagacttccctagctcattctattttatctgcctttcttccttatcccacctccctgcagttccttctcccttaccctgccttactttttcccacagattttaccattagcaatactattaatttctttttacttgggtttttgttggtttgtgtgtctgcctccccacactagaacacaggctcccaggggttagtgactttttaaatattgtttgtcactgaatttccaatgcctaaaataggacctgaccacatctgagtttaatatatacttttagatttagtgaattaaaaagccagaatgaggctgggcacggtggctcacgcctgtaatcccagcactttgggaggccgaggtgggtggatcacgaggtcaggagctcgagaccagcctggccaacatagtgaaaccccgtctctactaaaatacaaaaattaactgggcatagtggtgcgcccctgtagtcccagctacttggaaggctgaggcaagagaatcacttgaacccaggatgcagaggttgtggtgagccgagatcatgccactgcactccagcctaggcaacagagcgagattctgtctcagaaaacaaacaaacaaacaaacaaaaaaaaccaggaagaacatattccaaagtgtttaaaatagttatatctgagcgtcggaattatactattttaaatacacttttaccaagtttcctataatgagcatgcgttctatgagaaaagggctaaaaatagatgaaagttaaacattagtcactaattcatctcataaacctacttactcctgggaactattaacttctgtgttattattgcacattgggtttttatacatggtagatgctattatcgaggatcccttggggaaggtttgtgtatgaaatgatcatttctttcctgcttactccagattgagattgccagccttgactcacctgagcgggagactcacatgtgagactgcccgtgtgaagagcttccactgtgatacccagtaggcatctgaaaagcatcaggtccaaaatggaattcttgatcccccaacctgctccttacagagtgatccttgtctcagtaattccaacatccatcagttgtgtgatccaaaaacttagaactcatacctccctttcctcatgcccacagtttgttcatacaaagttctatagaatctacctcccgaatacattcaaaattagaccacttctcactgcaactcaataccatgctcctcacttccatctctactactcgaagccactcgagtcatctcttacctgaattgctgcaagcactttccagctggtatgtttgtttccaatcttttatttcattattttttaagagacagggtcttgctctgtgtcccatgctggagtgcagtggcacaatcatagctcactacagcctcaaactcctagagtcaagtgatgctcctgtctcagcctcttgagtagttgggactacaggcacacaccattatgcccagttaacttttttctttctatagaaatggaggtctcactatgttgctcagggtggtcttgaattcctctttctagttttctctgacactctcactccctgccaatcttttctcctcaaagaagccagaatggtattttttaaaaaatataatcagcctttattaccaaccacccccaattaaaatcctcatgtagctttatattatattaccaatccaatctaagtgcattaccaaagctttgaagaccctgtttgatcctacctctcaataccctccagaacatcctcctcgtctaccactttcctccacatctaccacaccctgggctgtttgtcaaacatgcctggtttgttctagctttgagcttttctctgtctgggagacttcttccttcagcaccagagctgacttttccttgttttatacatagtgagatgtcagctcagatgttacctcctcaaaatgatctttttgatcatcataacttagtaagctctctccctccaccagtcacactgtcccacatctcttcattctgtccagtattagtctgtaattaccatgtgcttacatgtttaatatctgcctcacttttgaatgaaagtatcaaggggaaaaggaatgtgactgtttaaatcactgctataacttcagtatccaaaacagtgcctggctcatagtgaacccttcataaatagtcactgaatgaaggaataaaggattggagcaatgaatgtttttgtgacatctagatgaaaattagagatgataaccggtgcaattttgatcatctatctcccttcataccagccaccctaatctaggggactagaataccgaaagaaaatttgcttctacgaacaaggtaatgtcatgatatggactgactcatttatttgttcatttgttcattcattccttcatcattcttcactcatcagacatgtagtgaggactttctttatattaggccccctgtgtttggttttctgtcagttatcttagggtcgtgtgtgtgtgtgtgtgtgtgtgtgtgtgtgtgtgttaaaggacgaataaagtaaataaactaatgcaatgtaagaagtgttgtggttttttagtaaaggttataaatctagacttatgtgcgtattgttttgagaatacaaagaaaggtgcttctgtttctgtttatgggaagtcactttacagacatttatctttaagtcatgatagatgaatttctcatatgggcagttttcctaaatctgagttttagcataatgagatctggagaaaaagaaggcaaaaaaaaaaaaaaaaaaaacccataggaaatgatacagagactaatgatcatttacccaaataaaacagataccattcaaagttagacactgagcctctggtaatccctgttcttctccttcatcttgagcgagggatactgaaaaagactgggctggctactgtttaatcagggaatgatgaatacttttcattagcccaagaaaagttagtttctattccagaaatattttgtaaagaccagttaaaattattaactattatgcatcacttgtcaactataggaagcattactgcaacctctccatagatgattagaataattgctgtcctttcatctttcccatctaacaatactcacccagtacctcccactttcgtttgtgtcttagtatgctgcatgtatctgctttgctaagagaacatcaaggcttggcataattgggctatttccctgtcatactggtttgcttctaaatctgcctcctctgtgggttgcagtgaggtcaatcagatgcagtcaaatggcagagaagatattaaaagtacatatatcctagaactaaatatacaccatctgtgaacttcagttacaaagggaaacttctcttaatatgaccttaggtaaagccattggcagttttattgtatctgtcagcaatcaccaatagctttgattaacaacatgactaatacataagttatgttggtctctttttttcataaataataagagatagggtttctaccaacacaacatttctcatacttgcctgatcattagaccaactgtggcacctgagaaaaatatgccacagacctactaaatcaaaagttccaacaggcctagggatctgtatagttcataaaaactccaggggatttgattatcaggcgaagtttggggagctttgtatgaataatattcaatgaattgtttgtatgtctgtccgatgctttccagactgggttaatgcctgggtctctttctttaattaagctttgattaagatgctcccagcaaatcccacactgaacatttccattgccccctccctcccccgcttctactatgagagaccgagatccatgtgaggtattctgtgatgaagatcttgttctgtttttattattaagcgtacatcttccccttttctgatattaccactatgcatcatcagttaagctgtcaccaacctgacctctgaggcattggaatcattcacttgatgaagcttactttggcataagctaagggttaggaaaaccaacagatttctaaaatattgtgcatggaagggccactggaagtcctccatcacagcctgatagctacaaaaatgagggaacaaaggcccttgagggacttgccaaagtcaaatagtcaattacagtgagagtttggactaaatctcctggttccaattattacattcttcctatgacaccattccctgattcctacaaccaaattagcctcctctttgagctttagttttccctctaggaaaaaaaaaaaaagcatgttagacgaggtcagggactctaaaactgagaccctaggttcagttaaaatgctgggaaggctactgtgataggggtggatgtcggagaggaaggacagaggtggggcttcccctagttatatttttatctgattgggatattgaaattatattaagaatttatttggaaaagccacttctgttactttttaaaaaaagatgtagaggcacaaggctagatgttgatccttgagtgcagatctgattcttacatttggagatccttagaaaagaagtctgtgaaggcaagcatttgtccttttttgtcataaaacctgattcttgggtattcagtgaatgacactcattgaccaactgcaggtctggcatgatcatcacaaagaattggcactttgaaagtgagagaacagtgggaagagaaattcttaggaagcaagctatcttttctaatcctctttaaaaggccaaaatgttcacaactttcccctaaaacagaaaggtgacattgctccttaagcagcagtatcatgcatgctgtcctctgccttcctaagaagtgcagacagagggcagaccctccgagtgaagtacctttttttcttatttgagcctgctctgcattgagggagagtttgacacacctctttagggttctgagaatagttaacagctctaagaaagagatttttgttcataagaaaaaacaagagaaactggaagcagttctcattcatattctctctctcgccacaccccccaccccacctcctcccgcctctccctctccctcttcctctctctccctctcttcagtatctaatgtaaacccaggctttctttatgttctgtgcagttggcctgagttctcttctgttttggtcaagattcaagtggaaaagacctgagcctgtgtctgcctcctttctcctaattttggtttctaatgttttacccaagaagggactagacctttgtttccctactcctttatcatagcatgctggttctcagaccttttctgcacactgctaacatccttctcacctttctttgcttggctttttttttcactgcaagctctcccatgttcatttctcatttgccatcagatttagagtaactggcttatggcatcaaagaatgaatcagatgggagcagctaagtaaactgaatgaagctgcttcctttctcttttcccatccacaaatgataaaatagcctgcccagccaagtgacgtggcattcaggggttatggtggcttggccatttgtttaagtttgcttatttgcagtcacagttctttagtatttcagtgatttggttatcactcaacagtgcacacatttcttctataaaatttgatagttacttatctatctctgatttttccctctgtgttttattatatctagtttaatttttcccctttgttgatttctgttttgtatatcttgttgcgggatatacatggaagggagacgagtttccaaagataatatagatcccagtttgcctgtaaattgataacaccatttggaaacaaatcttaaaacctcactgacacagcataaatagaatttacagatcttcttgaagcaaatccaaatctccagactctactttctccattctcccccactcatcctaaccttcacgtacagggaccgcgttaccaagtgagccaactagactctttcacacctctctgcctctgcacatgctgttccttggccagaaatgccttttttttctgctttacctgacacatttagattagtcttttaagacctaatagaaatgtcaagtgctctgatatgccttcccagatgcccatgagcaaagtcagatgttctgccttctgttcccctatggtactttactgatgtccctgtgacagcttcctgccactccagcccactcagttgggagaacttcaagaggtgaacaaagttttattcctttttggattcccagtgtctcatagaccttctgggacatatggcacattcagtctagctgaatgaggtgatgaatcaatccacttactctctccagtgcctgaaacttctcaaggagcttgtgctctcctttgctcctctcttttcaaccaatctgaaaatgcttttaaaagataatgtctgttttccagtgcagtcttctcacttggcatgtaatttctccatttttatttcctttgtgaatatcaaggtacaatttccatagctaccagtctaacctggaatcttttcatctcagttttggagttccacaacagtgtcctggtggatctatcttctatatattcctactataatgtacactcttaccaggtaccaatcagttgtttcaaaccacatttctactaaatgacctctctgaagtgattctgaactggcttccctattagatgaagaccaaacctctactctaagcacttaagacaaatggttgcattcatctcaatgctccttactcctcaatattatccattacatttttttgagacagattgttattctctgacagattgttattccttcatcgtccaaaaggagtcctcactttgcttagactggaacacaaaattttatctattttaatgttccgtcatataattataattatattctgttatctattccaaattttcagaattttatctattgcaaattttaagtattccaagttataaacttacgtcttccaaaaagactaccaggattaaaccaaccactgaatcatcatttcattacttcatattactacaagttagatttgggacactgtaatattttagccctgattttgccctttttatagtgtccatagataatttaacttctttgtataaacttccattataaaatgaagttttttatatatatatatgtatatatatatatatatataaaacattacacatttaggacatttcatgatgaaataaaagtgtttcaaatagaaaatgatggtttatttgggtttataaatcaagaattctcaagagggtatgaaacccacttctcccttatcaactctagggattttctgtagttttgaaatttgaaaagcataaagtaaaattattatcattttgatttgcttgtagtcataatatttaattcacttagaaatatcaaataacattaaaagaaaggtgtgaaaatggctgcgctcagtggctcacacttgtaatcccagcactttgggaggcccaggtgggcagatcacctgaggtcaggagtttgagaccagcctgaacaacatggcgaaagcccatctctactaaaaatacaaaaattagccaggtgtggtggtgcatgcctgtaatcccagctactggggaggccgaggcaggagaatcgcttgaacttaggaggtgaaggttgcagtgagccaagatcatgccgttgctctccagcctgggcaacaagagtgaaactccatctcaaaaaaaaaaaaaaaaggtgtgaaaaatagggtagaccacgtgtgctgttacagtagaccccaaacataaaagatgtttatctcactcatatacacagtccaatatggttccagttggtgagggttagggttgtcattctgggagttggccagtagagatgctaccatcttcagcatgtcttccaaaagcttcctggtatcaaaatccaattgttgaaagcagagagaacatgaataagttcatatggaaggattttatggactaagactaaaagtagtccacattaattcagttcacattccactaaccacatggacacccctaacttcattggtgactaagaaatgtagtctagactattcccaggaataagaggaaatggttatactggagaactagatgtctaatatatattaccttacatagttatcaaagtcatttttagtttggacatggtctttactaatgggttgcaaatgctctttatgcagatgttttatgttttatattactttcctatgcccaacagcataaaatatagaagtctggatggattaggcacttgatgtgtgtattagcttttgattgctatgtaacaaatgaccacaatgttagtggcataaaacaacatatgtttattgtgtcacagtttctgtgggtcaggagtctaggcacagtgtgactaggtccccagcaaggctgtaatccagtcgttgatcaagactgtatttctcatctaaagactcaacaggggaagggtctgcttccaagctagctcaggttgttgtcagattttactttcttgtggcagcatgattctttgaagaatcaagaattcatggttgcttgcttcttcaaagccagcaacagagactaaatcaaatctagccagatggtcttatataatgtaagataactacaggagtgacatcccaacacctttgtaatattggttaagcaaattacaggtctcatatacattcaaggggaggggattttacaaaagaatgactaccaagaagcaggatcactggagcctgtccaccacagtaaatgactgaaaaaatctgggtattccagagaactaccactttacctgaacatagctctttacacaaaactacacagaattatgaaagatctcaagagaaaagtgttccttattgccaagagctggttattatgctagtaaaatcagcagtgctcaggaacaatatttgctaagtttcacagttatcaaccttaacccacacaatcatctttagaattggatccagaacaagatgggaccatcttaaacctggtacattctcataaggttcattctcataagaccctaaagccttcattatatggcatttttgaaactcctttgtcattttaaatttttgtctttcctagctcccttttcctctactattctatctaacttaggcagcattgaatttcatttttttttctccttagtctttctgtttgacattttcccttctagcttcatttgtcctttaagacaaccccataacctttcatctaggggaaagaaatctaaaagaaagctctagaatgagattttagttgacatattcaatttgctttagaggggcatcacccatacctcttcttccactagtgagatctcctgagaggtgaaaatatgagagaatcagagctgcttatttatatatcaactatggaaagatctttcctgcctaatctgacctcttctttgaaactccaaaagtgactttttgtggttaattcttccaggatatctatgatgcagtcccacagatattaaaggttcagggcatcaaactgaaagatataacagctctaatagacagagtcacatttctaaaaaggaaaaccaaattctgaagatattttctggctctgtgaacagctaaaaatacaaggataatcgttcctatagtcctggacttttaacacggaagctaacttggaaggaaaaatgacactgagctataggaagagaagaatagaacagacttcagtgaaatcggccgcttttcttttcaaggcacttattcctagattagctcatctatctttaagtttcatatgatttttactatttggcatgacttaaaactaccaagttggtgaaaggtacataggaactctctgtactattttgcaacttctatgtgtctaaaattattttaaaataaaaggtagcaaacatacaaacaaaacaaattattgagctgggaagtgttccccttgcaaaagtctagcaactggggtaaaattgtttctttgaatacaaatgcctagtctctgattaataaaataccaggaagaggaaaagaaggagctgaagaaagagagaaagaaatagagaaatggggatttccagttgctgtagatcttgagtaggcaggaccttagcacatggtatctaggtgcatattgcctgtcacttttcaattatctttgctggccctgcctcaatcaaagcccaaaccataccccaagggcactctgcatcgttgaatttatagatgagatctttcttttgggataaagagctattctcaacttgactattataccttggccttcattccctaaagaaaatgggcagggaggcttgcagacagaagtatatagtgtggaaaatgaaccacctcttttgactctttgcaagatttgtgatgtcctactgggatgcctgggcccaggcacattcaccttgattctacatcagagacttctgtgtcttctttctcatagtatgggttattgggttgagcaaatactttgtcatcagtgtgtcttatggagtaattgagagccttggatttgaactcatatctatttgggctctattttgggctgtgtcacttatgaactgcatgaccttgagcaaatcactgaaactctctacagtccagattcgtaatctattaaatggggctaataatacctcatgcatatggctgccaacgggagttagtgaaataatgtacatgaaatatttaacactaaacttggtgcctaatgtatcttcagtaaatgataactattgtcatagtcatcattgcttttatacttttcggcttccagtgatttccagtgactacagccctaaggccattgggggatatcttttttataactgaattttctttataaaacaataactgattttttttttttttttaagacagagtctcgctcttcttgcccaggttggagtgcagtggcacgatcttggctcactgcaaccttcatctcccgggtacaagtgattctcctgcctcagcctcccaagtaactgggattacaggtgcctgctaccacgcccggctagtttttttgtatttttagtagagatggggtttcaccatgttggccaggctggtcttgaactcctgacctcaggtgatccgcccgcctcggccttccaaagtgctgggattacaggtgtgagccaccgcgcctggcctaaaacaataactgattttttaaagaaacatactcatgactatttgtcattttagtcaaagaggatggagaaaaacagggttcagttttattttcagttcaatgtttcgaccatgacatccagtgctggcttgattacattttaggaaactgaattccttctctaaagaaatagtccaaaattaaacacatatggttactgtaatcaataataatgctaaccaagcatgctggctcatgcctataatcacagcactttgggaggcagaggcgggtggatcatttgaggatcacaggagtttgagatcagcctggccaacatggtgaaaccccgtctctactaaaaatacaaaaattagccggttctggtggcacggacctgtaatctcagctagtcagatggctgaggcacaagacttgcttgaacctgggaggcggagttggagtgagccaaaatcgtgccactgcactcaagtctgggtgacagagcaagactctgtctcaaaaataataataataataataatgctttgtgcatttcaaaattactaaaagagtgtaatcccaggacttttggaggccaaagcgagcagatcacttgagatcaggagtttgagaccagcttgccaatatggtgaaaccatgtctctactaaaaatacacacacgcaaaaatattagccaggcatcatggcgtgtgcctgtagtcccagctacttgggaggctgaggcaggagaatggcttgaactcaggaggcggaggctgcagtgagccaagatcccaccactgctctacagcctggccaatagaggaaggctctgtctcaaaaaaatatatatatattatatatatgtgtgtgtgtgtgtgcatgtatgtatatatatatgtgtgtatatatgtatatatgtgtatatatgtatatatgaaaagagcagaatttaaatgtttttaccactaaaaaagatatgtgaagtgatagatgtattaattagcttgatttaatcatttcacaatgtcaacatatataaaaaatcacatcatactccgtaaatatataaaattgtaagtcaactaaaaataaaattttaaaaagggaaacataataacttttattattttgtatttttaaaaatcaaagttaggacacatattgagtttctctgctactcaatgaactgaaggttttggaaaacaagaccaaaaaacaacaacctccaaaaaagaaataaaagaagatcatagttaaggcctttcatgcagtcagctcagggatcaagggtagatctcaacccgcctgtcactgagtatgcagtgctcacagatgtggggaatacctatgtacatcacagtcctcagggaactgtaaaaccagttgcattgaccaaaccaaaacacgtgccattagaaagcatataattgtaaaccaagagcttcttttccgtttacctaagataattgcagaggctttagtctaagagaatcaaagttaagtgatagcactgtcaaaaaggtttcttaaggaagaagatctaggggttctcgggattcgttgaatttgatgccatggctgaaaaattaagtggagatacactgtatgccattggagtcaggcactcatgtgaaagatcagcactcacatttaggaattggatacagctaacagcaggggaattgataggctcatgaaaagagcatgggtagaggatgacatagaaaattaagcacagttagggaagacttaccagccaggttacaagaagcaaacacctatcccaccgattcagaataccttgcctcactcctgcatgacaggacatgtgtgttctttacgttaactgagaaactgaggccagataggaagacagatgtggccagaagaagttgacattagtaatgagagaaataaacgaagtgattttggggctggcgttaactatctagaactacccaggagggtagatttagagacacttccatctttgaaatacccagaagtctgtttctccaatgccttgactctgcctaaagcagtctaccattaatctctgaggaatctcttcaaacagctttctgccaatgtatcactgaagccttttgagaaataagtgctgttccagcttagtcatatctcaaggcagcgtggcatgggaggtggagactacgagtaattaaaaataactcccagctcaagcagggagagggctgtccctgcctcatctgtattcccatcacaggctccccagtgagaccccagctgttgagcaagagactctgtagtgtctgatgcactcaatcttgagttgatcacaaaagaatgttaacaacgttaagggcatggagttctaggttttggaagaattcttaatgattctgttaaagaggaagaaataggaaaaagaccaaaaagacagggacaaacaggaaaaacggacccagctctactgcagtaatagccattgatcactttacctcccttggcagtctgatcagtttcactggaaagatagcaagtggaaaaagtgtgcagagatatgatgtgaaaattatattcaagctttagctccccagcacgtctctaaggaaagcactataggaacagctgctggagatataaacaaaggcccaggaacatctctgccattcatgtcaggatctgagagagccaagggaaggacaagaggggaattagctcccagacatgcttgagtctctaagctgttactccgtgatccccatgttctaggtgcagaagcattgcgtctctaagcaattcccttaccaccagctatctaatgctgtcagaggaccaactatttgctgttaacagtaatgctcatttgaagctattcagcctagattttctttgtattaggtaactgtttaataaattaattccaaacagtacctcccatctctctcagtctgaccattgagcgctcttagtcaatctttgcaaacttgtccccatttagttgttaaacctgctccatcaacccaataatgaatcaacctatatttgaggactatggtttgtgcctgctccaaatcctatgttttctctgatttcagaccccttgcctcaactggatgaacttttcaagctcagaacaaataagtgttaaaaaacattattaaacaaacatattcacctttctacaagtttggaaaataacagctaaggaaaaagcttgtaatcaatattttttgttgttgttcttgttgttgtttgagacagttttgctcttgttgcccaggctggagtgcaatggtgcgatctcagctcactgcaacctctgcctcccgggttcaagtgattctcctgtctcagcctcccaagtagctgggattacaggtgtgtgccaccatgcccggctaattttgtatttttagtagagatggggtttcaccatgttggtcaggctgatcttgaactcctgacctcaggtgatctgcctgactcggcctcccaaagggctgaaattacaggcgagagccactgtgcccggccttataataaatagatgtatcaattgtagcttaccagcaccaaaaacaatagttagtaagagtgtggagtctagaatttgactgtttagagaaattatgcctcatcttggggaaaatttcctaatgtgtccaatctcctgtttccttatccataaaatggagataattgtaggacctcctccagatgactattaggaagagatgatacatataaaactcacagcactgtgtcaggcataaaataagtaatctataaacaatgttatttaacacttttatgataaaaatatagaaatagaaaataatagtttcagtgacagatcaatgttgaagcctcaattcaaaacataataaaattgctctttatggttcttacgatgtacatttatttcaaatagtaacaatgctgttcatggtgaaacgtattgattttaagattgagaaattggacaaacaaggctagtccacaatagtgggattgcagtagaccctagaatatgtataccactttggaaggtataattaatatgtttatatgtgtcgtccccaatctttccattctttattaccaccattatacctccatttactccacagtccgtctcttctagaatgaaagctcccacaaatcagcaattgcatctgtataacctattctgtatggcataacacctatatacttttccaaaaagaggtggagagaatatttattgacttaggtatgtctgtgatgatctaatgaaatgtcatggaacaacttaaagtcatagccaaaggaagaggaatgttaatatgtaagaatttgcagatagattattaacatggaatgatgccaaaatagcacagtagaaaaactaaaataaattaaataggcctggatttgctgggtaacctggggtataaccccataaggatggtgtatgtagaagaaaagtcagtgaatcattagtaattcataaactgtgttttttctcaggtgttcaaacattggaaagctatcttttgcaacctgatgctttccctggaatatgcagtgtttcttgactcgtgcagtaatggctgatggagtaggtgttcagacattttatttgttggttttatgtatccaggtagagaactcctgtctaaaattatcaagagttggtggtgcattcaggacaggaatttagattttctgactccaaggacatttcaccacccactaaaccaccctttgccatgagctcccaggaagagcaattgttcagtctggtacagtgagggaataatctgtccctagcacaggaggctgaacacagcagtgaataaaagaagacaaaaccagttctacaatataaatgacacattccattaatacaagtggatccaaatgaactaatttcattcaatagtactttcacattctgtagctatatgggcttggatacaaattgtaatgtcagtctgtcaggagagtggatggcagtgcataattacaagttcttgttcagcacttcaggagctaatcagagcaaggatgtgaatctgtaatttgcaaatgtgcaaagacagaggttactatggcactaacgactctgctgataacattcttgccaccacatcataggactgtgagcacaaattctacaaaatcatttgacctcctgtttagtcgtttgcaagaaacagcctgctggcagtacctagggacatttataagtttaatgttgttcaaaaatctaaaatgtcactatacaataaattaatacttacattctaagggactatacacaatcgtaaagcaatatatagagcaaattaatacataaaatacagagaaatatagaaaattaatatactacatcatgcaacctgcttctaaacaagtgtttctttcataggactgaatcaggaaagattaaataaggagttgagtagaaacatatatagatatgtagagatagagatataggcaatgttttctttttttttatttttatccaccaccccctccccccgctccccaccatagcatttctgctttaaacacttattctctttctctaacaattttattcattttcgttcttggggcagtagaaaaacaaagcagcattttagagttcagtactggcctaaaattcaagcctctctctaaaagattatagaatttcgctgtcctctcagttcacagcagcaagcagaataatttctgcttgccattttcctcaacttagtcctgcaaaagtaacatcattggtctctgcttctttcctcccattattacctgatcctgctctacagcagatgcttcctcagagaaagaaatacctcgaacatctccatcaacttcttcatggtagtaacccttaaccctaaacttttcttgtgtagagatgggtgcatcatgttgaggattcattgaccattctgttaatatatgaatttaatcaattttaattttaaagaatcaggagtgattacgtgcatcacaactttcaggttaaataattttatcatgggtgctaagctagaaccatggctcacctggtcagatggctataggagagtcagcacaatagaagcttcaggcaatgtgaatcctgctgctccctaccagggatcaaaactgaggtcactgtgtggtatgtggaagtcaaatgactgcttctctttaaaaagtgttggaatgatgcgttttctctcaccgattctgtctagggggtaatgtgctagggtgcagtaagttaagtgttagtcacatatttgcagggttaaatcttagttccacagctgactcactgcacactctaggcagaattatttaactccttcagtctttgtttcctcattcaaaaaagaaagagagatactatctgtggcagagcctcagaggattgagggagttaaatgtaaaaatgacacactggtgcctgttacagggagggctccctgagaagcagacctgtgggctaagtttagcatgcaggatgtttattaaggtgtgcctttgagatcaatacctgtgaaaagtagggaaagaaagcagatgaggcatagggaaaaggtggactgccacaggcaacccagcgaacctcaccagcagctctggagctaaaatagctcttcagaattgtccagagttgggctgaggaggccagaattttatttgtgttcccacgatgatgactcagtggatggggtcatttcaggaagagagcagggcatcaaccttgagcaagaaaggtcactgcagcttagtctaaccctgaagaggctggcagctcagggcatctgttgacagtattccaaggaggcagggcgactagaactttagcaaaggaagatggcacatcacagtgatcatcacagtccccagtcataaagagtagtttcttacatgtgcataccccttagccttgttttcatttctcctcctcccgccttcctgtcttcctcttcctctcccttccttttcttctttttcttcttattttgattttgttttactttatggaattaaacctccataattctgtagtgtgccaagtatgagggggaaaaagtctctttcccccattaatagataatgacaccttgacagataagtgagcaattctgcattgattcattggggaaaactatggcaggaagtgggtagcagtgtttagcgtggcataaaatacatatgctatctaaagaggtggcttctttcccttctgggggatttatgtgcttaaatcagggcccacaaactcaaagcacgcatttgggctaaaggaagcttggctaagagtaaaaggagagccaacagggaaagggccttgtaggctgtgacctttcaagctaaactgcccctagagaaagagagacttatttgaatttacagatgccttaggactccagtgagccacagctctggctcttttcctctggggcactacaaagcttaggtctttgcagatcaattaaagtcattagcgctccatctaatgaatgttgatttccatgaggaggctgagccagctggcctgccctaaacagcgcaaaggcaagcagggtaccagagttagagcaaatggcaataagccacttgaattagaaggcccccagcttgcagcagagttaatgctgcctgttttccaggtgacctcaatcactgcctggggcagacactggactcagatgctctccagtcacaagagagtttgtaaatatgatttaaaaattgtcactggctgctcaactagcaggagtgttcagaaagctgcaaggtatgagacactggatgcacagatgtgttttcatctggggaatgttgcatttttacaattttctctcctggctattatgatgggagatttctagtttttaaattcagtgtgctttttaaatttttgaatagataataagatgattgcaaaaaaaattaatgctgcctctcatttctgttcttcatctactcaagaaaccagttattctttttgtgtgattctagagttttctgatatatgtacaagcaaaggaaagtgtatagtctcatattctcatagtcccacctactaaacaaataacaacatactgtatatataattctgcatctcgcttttcttctcttttaatatatcacagctgccttaccgtatcagaacaaagagaaattctttttttttacagctctgtcatatttcattgaatgaacatgccttatttacttaactgttcctttactgtttgcagttacaaataatactgcaggtaacctcaaatatgtttcattttttacgcatgtttgagagtatgtgttgaatacaatctcagaagtagaatgacttctaggaggtatatgcatttgtaatttcaatagatagaaggattgccaaattgtccttgagaagtattacacaaatgtacagccccccccccctcaacgaatgggagcgcttccccacacctcaccaatagagactgtggtcacacttttagaaatttgtccatctggtatgtgaaaatggaatttcagtgtagttttattttctttttcttatgatgagtgagattgtacatctgtttatatgtttaggaactttttagaaatcgtttgtatgaactttctattgatattttttgaccacttttgtagtagtttgctgcttttgtttttaattgatttctactagagagactaatctccatgatatgggatgcaaatatccttttcctcccctagttttttgtttgccttttgattttccttacagcttttgcccctgagcttttagattttataatgttgaagttatcagacttttcttttatggcatccttatttcgacacttaattagaagggaggacttcatattctagagtggtaaagtaattcttcatggttttctcttagcactaccatgttttgctttatattattcattttcataatttttaatgtattcctgtagaggacgtgaggtattgatacaaatttaatattttttttcaggtggctacccaattatttcaataactatgtttctataagtcatcatttcccatttaagcctctgttatgatattttaaattcatttctgcacttttattctgctgtattggtctgtcagtgcacatttttcaattctgaaacctgtacaatagatttcagaatctaaaagggctaattctcccttattactttttctttcagagttttcctgactttcctttttttttttttttttttttttttttgagacagtgtctcagtttgtcatccaggctggagtacagtggtgcgatctcggttcactgcaacctccacctcctgggttcaagcaattttcctgcctcagcctgctgagtagctgggattacaggcaagcgccaccacacctggctaatttttgcattttagcagagacagggtttcatcatgttggtcaggcaggtctcaaactcctgacctcatgtgatccacccgcttcagcctcccaaagtgttgggattacaggcgtgagccacggcacccagcccacttttcttttatatttttttatagaagcattagagtatataagcagtttcttttaataatttgtatatgttagcatatgtatatataaattagataatgttaatttacaaattaaggagagctataacttctatgacctatatgtgtctttctatttagtgacatgatctgtctctccttttgcttaaattttattttatataatttcatatgtctcatattttgttaggtttatctctaaaagttttttcttctctgtacctaattatgaatggttcttttctgttattacttctactaatgagctgtgtgtgtatatatacatgaagatcatgaattaaggcatactaattctgcatcctgcttccttacagaatcttcttgttaatagtaatcattttcagttgtttcttctgagaactccaggtgctcagtcatatcatctaaacataattttatcactctctttccagttttatatctccaatttctcttgtttaattgcattagataataatcctatctaataatatagtaatgatattgtggatactttagcctcgttactgactttagtaagagtgattctgatgtttccacaatcattatgagcctggcttttgcaaacatatacatccctatggtttcttaacactgaatggtctggtccttacattctcaagttaaatcccgttagcattgagtattctttataatatagaactagatccttgtaaacaatttaattattttctttttctatgccacagaacaattaacttggcattaaaattctctactctttaaaagcttggaatgatttatctgtgaccttttctgggcctcgtgctttctttttctaagggtggctcaggtgacagacaacttcctccatttcatcaatggaaatgaataggttttgaatatgtatcccctttagaattatttttaggcaattacacttttctaggatattctctatctcccaagttttcatatatatttgcacagagttagccaagactatttttgtcatttttctgtgcttattttccacttactatttttaaattttatgtatctgcaattttcttcctctttttcatgatgagataatctaatgtttaccctttttaatttttttgtaacagaaactttaaatatattaattttaccacttttgcatttcctagaatattaaattctccttttccctatatgaattggccctttatgtttttcttaaacatattttatgtttgtttaaaaattttgtattaaaaatattgaattgattttgttattttctcctgtcaatataaatatgtaagaccaaagatttcctctaagcatggcttttcctgtttcccatagattatagaatatgagtgcttttacatttttattgttctaggaaacctgcaaaatgggctgtattacattcgacccaagaattaagagagagttttaaaatttctgattggaatgggattctgtttccgatcttgttgttaacatctagttattacactgtgatcagaaaatgtgtacaatagtatttcttttttttttttttttttgaaaaagttgcagttttctttttggactgcatacagttacatttgtgattatcatgtggattcttaaaaagatttttttaattttcaatgcataagtctttaagtgtactgtttgatataccttataaattatgctatttaggtcaattatagtcttacttttgactacttcatctatcattgaataagcaagatgatttaaagtgtcttatttctgttttttggctgaatgtttcttcagataactcttaagttttctgttttttgaatgttatttttatttcatttggttcataactagttataattctgacaccttcattgcgaatttcatcttttaacattttaaacaaaaaggtcttttctcaattatttaaaacctgaataccactttctctgattttaagatccctatcgctgatttatttttgtttgcattcttccggcatgccttggttgaacctcttattttcaacgtgattaacaaatttaattgttttatttatttacttatttattttaattatactttaagttctgggatacttgtgcagaacatacaggtttgttacataggtatacacctgccatggtggtttgctgcacccatcaacctgtcatctacattaggtatttcacctaatgctgtccctcccctagccctctaccctctgacagtccccagtgtatgatgttcccctccctgttccatgtgttctcattgttcaactcccacttatgagaacatgcagtgtttagtttctgttcctgtgttagtttgctgagaatgatggtttccagcttcatccatgtccctgcaaaggacatgaactcatccttttttatgcctgcatagtattccatgttgtatatgtgccacattttctttatcactggtcattagagaaatgcaaatcaaaaccacaatgagataccatctcatgcaagttagaatgacagtcatcgaaaagtcaggaaacagcagatgctggagaggatgtggagaagtaggaatgcttttacactttggtgggagtgtaaattagttcaaccattgtggaaaacagtgtggcgattcctcaaggatctagaacaagaaataccatttgacccagcaatgccattactgggtatatacccaaaggattataaattattctactataaagacacatgcacatgtatgtttattgcagcactgtttacaatagcaaagacttggaaccaacccaaatgcccatcaatgatagactggataatgagttgttttttaaagcaagtctcttgttcatagcacaaagttggttctgctttgtgatctattgtaaaagttgaaagtctttgtcttttaataggtatattaagccagtttatatctaattatgtgatagatatatttgttcctggtcctctcctgttactttatcatatagtttctctttttcttattttgtttgtttgcttgtttgtaatgtgttctatgcatgtctatatgtatgttttgctatttaagagtttgcattttctcccttgtcatttttacagttataatgtattatatttttagtgctcaatatatttaaaccagagcttctcatccaatataccacactcagggcttttggatagaccctctggccatgaacaatcttgtcttctcctctcagtctcgacaaatatattatttgctttttgacctatcatttgaaaaatattgggaaatgtcactttaaggaatatgcactagctctttactatgagcagtgaatcatctttcttaatatttaatacagaaaaaaacatgcatgtattaaaattaattgagttgatactttatatattatcctttgactcctagcaatcagataatttacttcctactttctgtcctcttctaactatttttagttgtattacttctgtattgtcagggtttattccattttcattctggtcttcagcatattattcccattaggttagacatagttcttctttaaaaactatactctgtgcttaccttcaatttcattgtcatagttattctaattatgttttggttgatcaaagtcatttcctagtagtttcctcaatattcccagtgttcctgaaggtaaataccatttgtaaactatcattgagtatagtttggctggatataaaatgttgggtcatattttgctttttgttgggaggatgtttctataaacttattaatacagtcctggtgagtcagagaagcctttcttgaagaggcattgtctatgtttaatctctaatggatgatcgtcacagaaacatagacagaggaaatggttccaggcagaatcaatggaattgaaaaaaatcatggtacttctgtggaacaggtagttggatgactgtaatgcacaggggaaaaggtagacacaagttgacactggagaagtaggaggggatagagcaagaagaacttgacagaccgaggagtctggattgcttccaggacaataatctaaactgcagagtggtatgaagcaagaaagggatatccggttgtaactgttcatattaagaggggtgcacaggggtatatgagctttctcttccaaggagcctttgagtcctcatctctgctgttacagtacagacccagaatttcttatgtaggagagtaaatacatttatgaaataataatggaattcattttatgctagggccatatttctaactaccttccaatgtagcaggagatagcaagacttaaggatatcttagtctgactcttttaaaaaagaaaaaataaagaattacagttcttgggtatatagtcttgtacctctgtaatctgtgaactgtctttcttccaaggatcccatggaaacctttacaaatctagctgatattcactatagttctaaaacatttccttccttagctgttccatggggagttttctgtgatctcgcagtttcaagctactttttggggaccttccatacttcattcaggtgggagctgccatagttaactagtttcggagcacaactctttatcaaacactatatatgtaaaaaactgccatgttaaataccacttgttgctctttcatcttcagtcagctatatgcaaaataggtctttacaggcaaatttacattctatcacagaaacagtgactatcagataaccaactcccttctcaattcttttttttggcttgttttcttgcttacttgcttggttgctttctctctttcctagctgaatagcattacaggccacttctaaaataaactgggttgtggaatttccactgaaggctggagatgaaaaacatactcatttacactgtgtgcgaacttggtggactaacattggttaaactttgaaattaagagatttttttttcctgatttttggccatctctttaatgcaatttcaggtagccacatggttcttaaaaccccaaatgcagctatcttcagtaagtacaaaatgaaaatatgttgcatcctaacagataagaatttcttctttctcatgatgagagctgttacctaaaggagcaaagctttaatggggtctcagcttgattttgccatgtttatatacaaaagagatgaggcaagctttgttttgaagatgttaattgattctgtccaccatgctgtctaacagccaattccctgaaaatgtagtgatggaaaaaaaatctgttccaattactgtataagtaaaatgcttcccttccacctccactaaagaaaaaaatggcactcactgctcaggatctgagatcgacagctgattctgcacatgcaaagccctgctgccatttgtcatttcaggaactgctttatttttgtcaaaatggaaggaaaaaaaaggagagagacattatacagacatcagaattcaaatcatttgcaacctgatttgggtaatgaaggctcaaggcggagttgagatttagggactaaggtggttgtataagtatgtaacttcacaagaatctgttttagacccagagcagattaatagccagattacaatggcatttcctgggcttaggaatctcattatcctcttctttcatatttctttaaagtggaagacccttccactacggtggtgtcatttgaactcaagtgtcaggttcacatccttgtgccctgaagtttcaaagtgtccagttgctgtaggagctttttctattctgatattactgatactgagactggataggaagcataccctgtttagctgcacatctaaataatcggtaatgagaacatccttgacaaaactatcttgcggaggagaggtcaggtcttacctgcatgcctgcgaccttcagcaaacaaaggcagagatctaaggagaaaacaggatgtgggatgtttccagtggaccttggcagtggacttgctttgtgtttgcaatggaagaaggaactagaggggggataacctcatggttgtcttttcttctaaatttctaagacaaccagtgaagcttgaggccttttctccagaactatacaatctttgcctccagcaagctctgtttttactaataaccagattgtcaggtggaaaactttttctaagtggaccttacttctctaagtaaaaaaacaaatcccctgaggcatgaagacctccattttacacttttgttatatacttcacaggtacctgaaatggttctggacaaaggatatgatgatcgacaataaagaaatcaaagatcatattcataattataaccaacaaaaaataattctggggataatattgtcaaaatggattccactgcaaacaggcagtaggatttactttgacaatattctccccagaattattctggatatcactgtagggaccaaaggagagtttttcccttggccttccaaagattctctgaaaaatcaacttgcaaaatgcaaattgatcagagaaaaagtgtacacatttatttaatgtgtatacacaggagccttcaaaatgaagacccaaagatacaggagaaattgttcatttttatgcttaggttcaaccaagtgtggacatctgtgtagaaatatgattggacaaaaagggtatgatctaatggtaatggactgaggcagaaaacccagcgaggcctggccgtgtagactcttcttggcctctctgagcccacattcctttttttctgggtagggggcaaaactttttctgaaatgggggtcttatgacctataatcaaacaaggtagtcaggcagtttctgcgtggtcagtttttacacagaaaggcagagggaaattggagtaatatttttaggtcttatgactagctttgaggaagagggatcctagtttctatggctagcattggggaagaatgggactgagaaacaggagggcaggggaaggtcagaaaaacttttgcttctgaggccttcattttggggtattgtttactgagccccaacaccacctcgagggtttccaggtatattttttaaagaccttctaacaaatgttccttttatttatacatccatttaattattggtgctagttccaatgcaagacttaaaaaattccacttctaattccccacctgcatggagggcacaaatctccaactcatgatcagaatttcctgcaatccgtatgtcatttaatgaattccactctattcttctggaaatcgaacactctagaaacatagttttccttttagctgcaaacctattaatgctggcagccataaaataaatgcagtcacaactattccccacaaatgaatcagtcagctcagattaaaatatactctttgcatatcactgaagggctcttcctggtcagcttgtaagtgttctgttttcattgcgtggtattcattttccttttagcattgcacttgatttgtgaagtagtgttgactgctagattcccatcattaacattaagttttattgccttaaatctctgtcttatgttcactataaatgttttaagtcaacataatgctagcaagaggtgctgggttaacagactacagttggcatatgattctcatttggggcagggaattgtgcagggttattaggagctttctacctttttatttatttatttagggacagggtctcactctgttgctcaggctggagtgcagtggcacaatcatagctcactgcagcttctgacccctgggctcaagggatcctctcaactccgcctccagagtagttaggaccacaggcacatgccaccatacccacctaattttttttctttttttgagacggagttttgcttttgttgcccaggctggagtgcaatggcgtgatctcggctcactgcaacctccacctcctgggttcaagcaattctcctgcctcagcctcccgagtagctgggattacaggcatgtgccaccacgcccagctaattttgtatttttagtagagacggggtttcttcatgttggtcaggctggtctcaacctcgcaacctcaggtgatctgcctgccttggcctcccaaagtgctgcgattacaagtgtgagctgccacctggccccatatccacctaatttaaaaaaatttttttgcagagatgtgatcttgatatattgcccagcctggtctcaagctcctggcctcaagtgattctcctgtgtaggtttcccaaagcatgtggctaacattttttaatcctatacaatgttagcactggcctcatctagtcctaagaagtttgctcctaatcatgtattcattagaattgaggaggagaatatttcccatggtgaatttatatgttccgccaattcaaccaacatcaaatatttattagctgcataccgtgtgccagatacagagccagacactcaattttgcagacacagtatacctgctgtcctagagtttagactctaatgagggagagagataataaacaaggaaataagtgtatgtaacaatgtacagctagaaacgctgggaaagaaacgaacgtgagagacacttattggaatttaaatgcaagccactccactatatctactaggtgtgtgtgttacaaaatacaaaaaaagaaaagcctcctgggagggtagcaggagttaaattactcaaaattaagccacagtttaagacagcaaaacataacagaacccagagatgccccaaggcaatacaaagttaattatctaagtagtagtaacaagaataactgctggccaggcacagtggctcacgcctgtaatcccagcagtttgggaggctgaggcaggtggatcaccctgtcaaaactctcaggagttcgagaccagcctggcaaacatggtgaaaccccgtctctactaaaaatacaaaaattagccgggcatggtggcagaagcctgtaatcctagctactcgggaggctgaggcaggagaatcatttgaaccggggtggcagaggttgcagtgagctgagatggagccactgcactccagcctgggcgacagagtgagactctgtctcaaaaaaaaaaaaaaaaaaaaaaagactgctttaggatttaaggaagagtagtgtggcgggttagagatggtggttagaagaggctttctagaggatcccaaaatgatgaggagattgtggatggaaagtggtctcttaagcagaagaaaaagcatggaagaaatactagggtcagggaagataaaaaatattacgctgttatgaacaatcaattatatagggaaagtaaataatgttagaaaggtagtttaaaattttccttttttgcttatcatgttagaaagaatttaaaatagtggccaggcatggtggctcatgcctgtaatcccagcactttggggggccaaggtgggaggatcacttgagttcaggagttcaagcccagcctggccaacatggtgaaaccccgtctctactaaaaatacaaaaattagctgggcgtggtggtgcacctgtagtcccagctacttgggaggttgaggcaggagaatcgcttcaacccgggaggcagaggttgcagtgagccgagtttgtgccactgtactccagcctgggcgacagaatgagactccttcgccaaaaaaaaaaaaaaaaaaagaaagaaaaaagtaatggcagtagtagcaggagtagtagtagtaacagataaaacctatcattggcagcaacccaggcaagcatttatttctatatcttgctgatggggttgatggggttagcaattgctatagtctccctagtaggggatttaggagacagatgaaaaactgttagactatttacgtatttaaccaaaaggttccattttggggtattcatcctatggaaatagtcatgaaagtaggtaaagatttagttccagagatgtttattatagtttcttgtgaacattcttatttgaaaagaagataagtgcccaataatatcagattgattacagtacactcaagcggttagcacagatattcatcatagctgtacttgataacagttgttactattatcatgttcttgtgtgagaggtaaagggagataagattaaactttttgatgttataaacaccatcacatacttcaatctaatattttagaagaatatttaatactattttaggtttactgttgaattacatcaacagatgtttgtaaaacacagagcaaaaagtagagtaagttatacaagatcaatttagtcacatctctatgtgagtatgtttgcatcaaataaatactggaatgatatatgtgtgtgtatatatatgtatatacagtatattcaaatgtgaacagtgagtagtgagattacaggtaattttgattctttttgtttgtttgtttaacattatgttctaaaatgtgtatggtaaaaaaaaaaagtagtttttttttatttctaagactagaaaattatttagcaaacaagtggaccaaagatattacagatagcatttcctaaacatgatgtgccttttgtcatggaaaaaatggatgattttgttttcttcttcagcttaatatgcgatataataagctcagtcatcgaagagtgaagtgcagcatactgaaaaagtatgatttggtttcacacagatcttggtttaaatcccagcttcatctctcattaatgatcacatcctgaacaagttaatatgtatgtctcggtcttctctttagaaagctgacaatggggacatgtatgttaagtgactagcacagcgcttaccagaggaccattctcccgctgtagcaggacgagccgcagacgaaacctctcagacaccaaattgtaaaaggaagggctttattcagctgggagtatgggccagctactctctcaaaatccgagctctctgagtgcacaatttctgtcccttttaatggctcacaacactaaagatttcacgtgaaagggtggtgattgatttgagcaagcaggcggtacgtgacaggggctgcatgcaccggtggtcagagagaaacagaacagggcagggagtttcaaaatgttcttctatacaatgtctggaatctatgagtaacatcggtttctaagttatgagttgatttttagctactgggtttaggccaggcaggcccaggcctggtttcgggcctggcgccgggctgcctgtctttgattttacttccttgttgttttttcttaaaacaggtactgagtataaaacaatataaaacaatatgagagggtctctctcttccctcaccacatatgtgagaaaagagaaaatatggctaagtcatgtacttaactgagtattaaaacacatgtcttaccagaaatagcaatttttcaagtgtgtgaaacacattaaaaataaactttgaaactccaaaaatctttaaaatatgtaaattcatttagactttactagaaaaataaagttatctctctgaaattttgttgttaaatatttgtagaaaaggatgtaaagtggaatgaggtctagagagagaattttgatggatgtgtgtatttgagtcagttttcatcccactgaatctttagtcaaatcaaataaaaatgaaggtaatttgtcagcttgcagaatcatgccaagcaaagtcgaaaactgccagcctatgttcattctcatggtttgaacaaaccgaactccaagtaattcattgtttggttttgaattacttatattcactctgttgatcccattttgctttgaaattgtactttcatgtttattttctgtagtccagaatggaggtaggaggaggaaatatctggaaatacctaaaaacatcttgaacataccttaaaagtaacatgtttaggaggtccctgagttagttttattagcacctctgagtgttacagaaatgattgcaaatctccaaactcacagacatttgcccagagtccccacctataatcatgtgctgggagagctttagtataattattaggccagtgtaggacaagcagcagcgtgcacatagtcacatttaaagtgaggatttaaatgacaacaaaaagcaaagcaaaatgacactctatataacttgggattgtttttatttaaatcaaaatttaaaaaattttaattatacatatgtcctggggtatgagtggaggggtggctatggggatgggtacacaggcatgaatgaacacaggagactatgaaagatgcttcagatgccccccggacaaagatggagaaggaaatgttttctgtaccatctctatatgggcagttcagctttctctctgtgcttgttttctctgctctctctgtttggatttgaagaaaaagaggttttttgttttttttttttcctttttcttttgtctctatcttatttattttttaagtagactgtcaaaattttagctgtgattgaagaaaagaaataagacaaataaaattagtgggaaaccaaggagggggaaatgggattgccacttcctcttgtacagagtcagcagttttaatacctgtaaacaaaaagttctttgctggaactctttttagaatggaaaatgggatgaataggtacagcattatcaaaccatttgttgtgctccctttttcttgaattgatggaaaatatagaaataacacaaaccaaagttgacactcttgaaatgacttgtccttagaatttattgtttatctcacggaaacatgaagaaatgtcttcattaatgtttttgatctcagagccccatttccttttatctcccagcagaagtgttgcagtgtcctcacatttggattgagaatttagatagataagaattcaaccctctagtcccatttactgcaattgtatttaaataccagcttaattagctgtactcatcctccttcccaatcctctttgaagtaggaaagtcccattgcttccgtttagctaatgctatgctcataccctagtttttaagctttgtagaaagtacagatatgactgccccatgtgatctctaagaagtctagatatttgatccacagaagcattttgttccatggaggacgtggagtttgttgctttggatttgagcttcatttaaagcatttgcttatttttcatcttgcaaaattaatctaaatcaacttaatgaagggtagaacattgagatatatacctgttaatagtagaataatatgacatggcacagtatccaggtatggaaaaggtgaatagggatagtgttatgagatttttagagtacgttaattttataaagcatgcttatgggaaaagccaaacattgatgacatttcgcagaaaatgttatgttcaggtttggcaaataccaataaggtcagagaaaaagcaatatgaatcagtattaagaaaattataagatagtgtatgtctaggtcatgatctttagtatcatcaataaaaccactaaggatgcctcactatagctgtgagatgggttcggaccatgatatccagtttaatactatttgggagcagaagtaactagatatatttatcctatgatattttacacttattggacacctgttgaatctctgttggcttgagatttaatttgctaagagaaaagcaactgaagttactaaggtaatagacataacatatgatctaaaaattgagagtacgttaatcaaggggagtgagcagaaattattctcgtcaatcatccatgtgtccctctatatccttcacctttattgctgttagatttggaggaaattctgagcaatgttccgtgatcaggggtgaaaagtgtcatttctgggctgaggcagtttatagtcatttgcaccttttctataccactctctttccctgccttctcttctcaatgttctgaaaatcttgtgttctaaagggacttgaataagatggagatagagtgccaacccacattagcatttatagcatatatggagcaagaaatgaacacgtgtgtatgtctttatgtaagttacagatacttatctatgatacctatcctgactattgcaacatgttaagctttccactgataattaaatttcatatataaatagataattaattttgatatttaaaaaatgtaagttacaaaagcactatgctactctgagaggaaattgagaaatactaaagttttctttcatggagccccatagttggaccttcacaaaggcttcaaaagctagtttcctaaccagtaaaagtcagcatgagacacagtgggctgagataacaggcccctcagcctaggggtggtttgctgaagtaggaggccagagcctctggatgagtcatcttcagttgttacgacggcttactctgtggaccatgcaaataatatcattttcgatgtgttccatgatgcgaaaaagttagagaagtaccataggtctttgtatcaggcaccaatataaccacccctacactccagatcttctttccccatactcatttctccactctcctccaagtcctgcctcaaacgagttattattttcacataaaactgagaaggaactgttgaaatgactgacatcttcagcaaataaaatagttgtcaaattaataaataaatgtcacttgaggcacttctgagcttctcaatatgtcttcttttggaggactatttgttggcataggagaagatttcctagcaaccctcaaaatctttccaattaggaacctaaattctattcccaaaggttatgatataaagaggaaacttgaaaatttgtaactgaactctattgaagtatggggtatttcaattgagtaagcccaatatttacctgcatcacaaaaaaactagattttaataatttcttatcaagtgtttatgccatgtaccatatttaacatatatttactcattagtttttcaaaattcttatgaaatgatattgtttttatacccattttacagatgagaaaactgagagagaccttaaggagctttctcatgatgcatggctagttaatggcagaactcatgttaaagcaagcagtccaaccctgcctgggctcttaaacagtggagtctgctgtctccttttaataggatgaaggtgaagttctcagcttgatatttttgtttcattcagtgcaaagtgtcatcttctaccccagtgccaaaaattacttcaaagaaaacagctttttgactaccgacagttatgtacaagaggtgtgatttggggttttaagagcttactttgacacagctcagatcccttttttggtagtgaaaattatgctgttatctcctaaaaaacatcatctgctctgtccccacctctttaatttgacaggtgattccatatccatgtaagagcattttggtgtctgaaaaacaataaaaatcgtcccagtaaacccatgttctattcaaaaaattttggcatattgattgtctggggtaaggttcaaaattgcataaacttccttgccccacaaatcactttgttgcatcgacaataataatcacaattattgatagtaaaataatttggccattctatgaatagtaaggactgcacatgttaaaaagaggcaaaagaatggatagatgatcagaatccattctcagtaaccagagctaaggaaacagctcaagtaaaaacgctcagcttacttaatgctctatagtaattaatagtaattgataacaacttgtagcaattaagatctaatgcacttaatttgcaaatgtactccttaactttgaatacacttttttctctaaggcgaaagtctagaattggagactcttggattcttcttcccattcttttccttcttccttggaaaaaatcagaaacaatctcgaaatgtggcctgttggagctggaaaagagcttagagattgttctagtacagttgtgtcaaactacaggtgaaaactttgaatcttggagaagaccactggtttattccacctctctagccatcggcatgaatgtctattggtatacttggtttagctgcccaatttatggccaagactgggacatgatatggtacaaaatatggtgtttttgtataaagagctatctcttgttccttcgttgtaaggggactgagggcacaagagttctaagactgataatcccatcaacttaatatattaaaagaggttttatatctaaagcatccaacacagtgtctggcctagaggaggcactatatctatagaacaaataaacgaatgttcgaacatagcctctctaaattctatttgaatgacttaacacaaagatcagaaatttgcatagctgtttgtgttagccctttaaaacaaaactctcctaggggaacatatgtgaattctattcagagtttaaaaacagattcatgggagagccccaaaccaatcaaaaacatggcaaggtttaaaaaacaaaaaagacaaaaaacaaaccagaaaaaaaaaattatgaaaagaccctgcctgccaagagtgacttgtttgcaattgaaaacctggagatatgagtacataatagaaacgtggcaatgatcatctgggcaaaaacacaatttgtatgacaatgaatcaggaaatgtcctggaacaccagaagatgaaaaacctgggattttataaggcacattcaagttgctgcgcatgcgtcacaccatgaattttcctgtggtctgacatcctgttaaaagcattggtctctttctaaacattggtagtagaagtgtaccacaacaggcaaccttacatttaaagaaagaatgtaatagatacctgtggaaactgtcaaaagtgtcttctagagctatttttgaggtctcttttattccttcattcctgatctgaaattcattaaggctaagagtgccccttaaattacgttctgctgtatcctggaggaacacctgaagaagttaataataaaccctagagattaggcaagtggaaagaattatgaaataaaacaaagcaaagaaattgtgtaaacaaattaattaattgtctgaaagtgaaagcatgtttgtaattttgcccttgtcaaagaaaaattggagttcattatgctcgctgactgatttaaaagcttcttcccgcgtagcatcaccgggagaatgagtgtgttgtgagtgcaaagcatggatcggttgcagcatcaattaaaatagaaattcattattgaaacctccagagtaaaaggtttgtgctttctgctttgaggatgggaggaagcttttcttttcttatttttaagttttgtttattttttttctctcctctctccaattggtataggaacatttattttggatttccagtagcaggcattctacctttttgtaataaattatattaatacctgttatacattgagcacatgctatataccaggcattctatatactttatcatctttaaccctcagagcaatcatgtggtgaaaggtatccatcagtatcacttgaggaaactgaagctcacggaggtaaaattgaacagctactaagtgatgatgccaaggatttaacacaccctaggtttgtctgactaggaacttctggtctctccaggacacaacagagccttctaaggcaggtttactgtgttgagttgggtttgcccctataacaaggctatcaaagatatatgtgtgtatccaggataggcattctgtattcagttacgtgttggagtgctatcgagagcccagtgggattataggtggaataagataccttcaacacagccatctgctgcatatggtgacccttgtgctctccaaatgagcagaagctcaaccagctttgctgaaatgtgtttgatgagaggatggtgtgttttacttttgtgacatctttccccagaggtggttgcctgaagagttgaactttagagaacaaaaagaaagaaatgtaggatccatttatggtctctcctagaatcatgccatatgttggactctatatggaaagggaggaggaataaaatgaagaaagaggagtacacagagcatggaaaaccataagtacgtgtgatccatgattacatcattgcaccttgcaaaaacttgttgattttagctctggggaggatgagtgaaaatcatggagtcagagcagaatcatgaaaagagattggttttggagccaagggaactcagatttacatctggtcacaacattttttttttaatattccctttttttattaattattttttttttaatttaagttccaggatacatgtgcaggatgtgaaggtttatttcgtaggtaaatgcattccatggtggtttgcagtacctatcaacccatcacctaagtattaagccctgcatgcattaactatttatcctgatgctctctctccttctactccccagcaggccccagtgagttttgttcccctctctgtgtccatgtgttctcattgttcagctcccacttataagtgagaatatgcagtgtttggttttctattcctgcattagtttgctgaggataatggcttccagctccctccatgtccctgaaaaggacatgatcttattgcttttaatggctgcatagtattccatggtatctatataccacattgtctttgtccagtctatcattgatgggcatttaggttgattctgtgtctttgctgttgtgaatagtgctccaatgaacatatgtgtgcatgtatccttataacagaatgatttatgttcctttgggtatacatcttgtaataggattgctgggtctaatggtatttctggttctagatctttgaggaattgccacactgttttccataatgtttgaactaatttacattcccaccaacagtgtaaaagcattcctacttctccacagcctcactagcatctgttgtttcttgactttttaataatcaccattctgactgtcatgagatggagtctcattgtggttttgattttcatttctctaatgatcagtgatgttgttgagctttttttcatgtttgtcggctgcataaatgttttcttttgagaagtgtctgttcgtgtcctttgcccacttttttttttattatactttaagctttagggtacatgtgcccaacgtgcaggttagttacatatgtatacatgtgccatgttggtgtgctgcacccattaacttgtcatttaacattaggtatatctcctaatgctatccctccccctccctgcaccccacaacaggccccggtgtgtgatgttccccttcctgtgcccatgtgttctcattgttcaattcccacctatgagtgacaacatgcagtgtttggtttttttgtccttgcaatagtttgctgagaatgatggtttccagcttcatccatgtccctacaaaggacatgaactcatcattttctatggctgcatagtattccatggtgtatatgtgccacattttcttaatccagtctatcattgttggacatttgggttggttccaagtctttgctattgtgaatagtgccgcaataaacatatgtgtgcatgtgtctttatagcaccatgatttataatcctttgggtatatacccactaatgggattgctgggtcaaatggtatttctagttcaagatccctgaggaatcgccacactgacttccacaatggttgaactagtttacagtcccaccaacagtgtcaaagtgttcctatttctccacatcctctccagcacctgttgtttcctaactttttaatgattaccattctaactggtatgagatggtgtctcattgtggttttgatttgcatttctctgatggccggtgatgatgagcattttttcatgtgtctttcagctgcataaatgtcttcttttgagaagtgtctgttcatatcctttgcccactttttgatggggttgtttgtttttttcttgtaaatttgtttgagttcattgtagattctggatattagccctttgtcagatgagtagattacagaaattttctcccattttgtaggttgcttgttcactctgatggtagtttcttttgctgtgcagaagctctttagtttaattagatcccatttgttagttttggcttttgttgccattgctttttgtgttttagacatgaagtccttgcccatgcctatgtcctgaatggtattgcctaggttttcttctagggtttttatggtttcaggtctaacatttaagtctttaatccatcttgaatatcttgaattaatttttgtataaggtgtaaggaagggatccagtttcagctttctacatatggctagccagttttcccagcaccatttattaaatagggaatcgtttccccacttcttaatggggtggtttgtttttttcttgtgaatttgtttacgttccttgtagattctggatattagacctctgtcagatggatagtttgcaacatttttctcccattctctaggttgcctgttcactgtgatgatagtttagtttgccaatcgcagccacttttaacactgttactctgggtaggttatttggtctgagtgtcagtccctccttctgtaaaatggggggaattcctgaaggacagtgttaggatgaaatcacattacttataatgtcgaattcctctgtcaatgcttatatgcttctcattcattatttctaagtcaagcatttttaaagcatttaacatgcaattattcatttttgtttataaagtgaccctgtgaacttatccctattttacagttgatgaatctgagacactgagagattaaataacctacctaagatcatccagctataaagtgatcgagacaggttttgtttgttggttggttggttttgagatggagtcttgctctgtcacccagcctggagtgcagtggcacgatcttggctcactgcaacctccacctcccagtaatggtgcaattacaggcatgcaccaccacacctggctaattttttttttgtatttttagcagagactgggtttcaccacgttggccaggttggtcttgaactcctgacctcaaatcatccacccacctgggcctcccaaagtgctgggactacaggtgccccgctcaagacagattttaaacctagcattcttgctccagaattcatgctgttaatcactgctattctgcctctctgttgactctcagaacctctcttggtcaaagcaagaaggtatcgaacagacttcctgtgctgttttataagctgcctcaaatccttccaggacagggcaatgtctatataaatagatgttataaaaagtataatctaggccctatttatttttctctcagattcatgtctaattcataccagttgagccttgctatttgagtttcacttaaaagcattctgacatagctcacctcccctctttctcttatattgctacccataaggactagagaaaagatggataacataatcctgagtctatgagttgctagaaattcctcattataattgtgtgtcttctggcaaaaataaataaataactttctcttttaaagccacttataggagacaatgcacattctgtgttttttctctgtggctgtgcatggacacagactcttctgcccttctcttgcctgttccttgattcctcatgtttctgtctggtgcctacctgagatccaggtattcctctttacctcgtcgtcttgctattttttctagggacttttcttctcccaaagttatgttgaaacaggcaaaacacctagaaatgggtcatgtgggtgagtagaggggagtgagaaggagagggaaaaaattcccaaagctcatattaggcaattacagttctaatgaatagaagcagtctattcaggcttctggcaatattttatgctcacctagtgtagtctgtattcccttaaatgggtaaaagatgccttaaaaagattgctttgaaggatgaagagacttgaaacaactctctgaacaaaagaacttgtttattcattcatttattcagcttgcatttattatgtgctgggtattatgcatataaatattttcttaagttttgtttttaattaacacataatagtatatatttatggggcacagtgagatgtttgatacatgtagacattatgtaaaaatcaaaccagtgtgtttagcgtattcatcacctcatatatttacctttttcttctggtgagagcattcaaaatcttctcttctagctattttgaaatacaacaatacaatatttttatccctagtcaccctgctgtgcagtagaacaccggagcttattccctccatttaactgtaactttgtacctgttgaccaatcatggtccctattctaaaagtgtcacagcctaggtaggttgacaaacaggtaaatcaggattacaatacaaaagtaaaatagcctggatcaaggaaagcacaggttgttatggaaacacaagagaggacatgtaaataagattgagggaggttcaagaaggcttttcaggagagatgacttttgaactgagttttaaagaccactgggtagacaataggagaaaaaaacatttctggctaagaggttagtgtggatgagcaagtggctctgtatagctggaggagtgtctgaattttccaacatgaaaaggaccacaaacttggtggaatcaaacaaagattttttttttcttttgtcacagttctggaggttggaagtccaaaatcaaggtgtcagcaaggctggttccttctggaggttctgaaaatgaatcccttccatgcctctctcccagcttctggtgctggtggatgcatcactctgatctctggctgtctttacattgccttctctgtgtttctccttttctgcctgtatcttctcttcttctaaagacacttgccaggccaggagcggtggctcaaacctgtaatcccagcactttgggaggccaaggcaggcagaccacctgagtttgagaccagcctggccactgtggtgaaaccctgtctctactaaaaatacaaaaattagccgggtgtggtggcgcatgcctgtaatcccaacgattcaggaggccatggcaaaagaatcgcttgaaacccaggaggcggaggttgcagtgagccaagattgtgccattgcactccagcctgggcaacaagagcgaaactcatctcaaaaaaaaagatacttgccattggattcagagcccacctagataatccaggatgatctcatctagacagcctttactaattccatcttgcaaagactcttttttcaaataatgacacattcatacattccatatcttttggggagacactatttaacccactacaaggtataaagatgagctataggcctgatgaggtaggaaagaggcagggcaaggtctcccagacactcatgtacctgacaaggtgagtctcaagagacacaagaaaaccttggaactgtaattgtgaaattgacatctatctctggaaaatgactattactcctaatgcctctagccaaagactatcagaaacccacctgtagctgatggagttgcatttgttactcattgtttcgatgaggacacacatcatgaggaaccatcatgtctcagctagagggtgttggagaaaacctattgtaggaatttgactttggttgggtaatatgaggaagcgtccaagaaagcctagttcactttagattagatgctgtcagaaagcagaggcaattctaaaaatgtgtatcttgattaaatcttctctgtatggaacaagagtgaggataaagttgtaaatgataaagaagtagcaatcactagccaagagaggggactgtttgctattttgtgggtgaagcagtgactttgtttttctgtgcattgattaaattaagatgtagctttgttttgactcagtttatcatggtctcagagtgacttcttctgagattggtattctgtgacattgctcatgtgcaatagaagaataacaagatctagccatgagtgccaggttacgttccagatgtcacaggctgctcttttgttttgtttttctttttcaataccaagtgataagaatgagcatgcctaaaattccagcagttgtaataaaatacatcaaccaaaaggttcagactgtcctgtaagacccataataagagtctcaatgtgttcttaaaagaacattctttcttagcctacgtgaacatccttctctagacttaaattacttctgacccacatgttgggccgtatctattttaaagacaagaggagctaactgcaaagttccttgtctggtaagctgtttcatctgatagttgtaatagcattttctcccgtctcactgtagggcctaaccccacaagcatccttgtgaagaaagaccccacagtcctctttttaagctttctccctccctttcctggggtgccttatctatttaaatattagaggtgagtcaaatgtaattctctttaatgaaaaacaaacaagtgatagaaccctaaacgctcttttggcaaagatcccttcagaacaaacaatcttcttttaaaagaagtcagagctaggaaagggccacaggagagcagggatagccaactaaactatgcagcaggcttctctgaaaaaaagtgagtgacttttttggtgtggcaagaaaaaaaaaaagtaaagtttgatataactagtagtccttggaatgacaagtgacaagagaggtctcttccctccctatagtcccaaggagaaaagggctctgtaaaattaaaggcacaggtattcagttgaaaggacatatttttctcctctaacttataattagcctgcgatactggcttctgtaggctcttatgaaggcaaattgctcaggacagtgactctggcgatgtcagtcatacaggcaagcactgggatatctatcacaaacacatgccagttgtcatcttccaaggcatcacctgattgccaactcaggtcaggaagaaatcattcctctttcttcttctgtgatgttacttatctgttgcaacagaggagagggttagcacctttcatgacatattccagcatcctgttaaattgatcagaagaccaattgcacacagtgtcttctaccattgagattggaaacacagccaagggtggagatggtcagtgaggcttcccagtgtcttgcaagttccaggtcagttgtttatgcttagagtcccctgacagagagatggatgtgttagcaggttctagggcctgtggtttcccttgtggaaatgccagtggaccatgtgtgctccttgggtatcagggtgattgggcttgggttggttgtggccacagcatgaactggagagtcggctgtatttggcatgacaaggttggcacaggccagctgagaccttgaaaaatttggagctgatgcagaggtgaataaacacattgaaaacagaagctgcaacctcaaatttctacagggaccagacaggtaatatgcctgagtgaagcaggccaggtggcaaattgtacagtgcaggccccaatcaaagtgcacagtggccactcagctgccactggattataattgtgtagagatgtgagtttagagttgtcagcttttcaagagaagccaacagtctggtgtgtatgttaaatcccctgattctggcatctaattaatgcccttagcagtccaaaccaaacaatgtgtgagctgccatttttgcaaccttgagctaatggtgttaacgtccagtttctttgtttcataacatctatggaatggctttgtgaatgcaaatgttgaaacattgtgagtctcatccccaacagtgaaaataaatacaaaatttaggcaaaaaataaaaataaaaataaaaatacttcttaaatgtcacagcgcccccatggggctggctggggcaacaaattaagggacacagctgagctttcgattctgtcagtaactaagtagtaatggtgcctcagggggtctgagtcattgaacaagcgctacaggatagcacaatactaggtacacaaagtaggcgagcacaggctccctacctttgaaaagtttataagttcattaacagtattatgtttccatgcactggagcattagaggaaaaatgccacgataacatctaaacaagagtgcagtgggccctgagaagtatgatgattctgtttccttctttaaagcatctcttcttaataatgtgcagtagtagagagaatagaaaagcagcatgatggccatgtgacttgctggatggatgccatttctgttggatgagattggacatcaataggtaaaaccaataagaggttgtgtgcattttcagattctggaattctggaatctatgacatttttggaaaaatagctctcctaagacactggttctaaatatagcagtgggtttcaatagttctatgaattgaaatcaatagtactaaggagcgaagagcctagatcactctcccaagaatcattgcttagatgagtggttctcaaagtgtagtctctggccaccagcatcacctggcaacttgttacaaacgcatattgttgattctcattccacaactattgaatcagaaattctgggactgagtcctagcaatctgtgttttaaacaagccctccaagtgatttaatgcatgccaaatactaagaatcactgttatccttggaagaggggaaagctcagataacccacaattgaggtctagagatgttcatagtctcttctacaagtaagtcttaccagtgagctatagtagagataaccaagatagcatgtagctggaggagctgttgcttatttgactggattttttggtcattttttctttctcacttatgtgtttgttctccacttgttttcaagccccattgatttctgtattagctttctattgctgctatgataaattaccacacattttcatggcttaaagcaacacaaatttatgagagttctgaaggttagaagtccaatacaggtatctctggataaaatcaaggtgtcagaattagagcaaatcccttcttggggcctctcgggaacaatctacttccttgctttttccagcttctaaaggccacctgctttctttggctcatgggcccttttcttataaatgcagatgttgtttttaaaaatgaacaatgttaggctgccttcctcgaggggctgtctctcttgttctcactcttctgcctccccttccacctttaagtatcctgtgattacattgggtgcacctggatgataggcaagctccctattttaagatcaactgattagcaaatttattcccctgtgctatagaaggtaccatattcacatgcttcaagaattagaatatattgtatctttcatgggggaggtacattattctgcctaccataagagattgtattcggagggcttgtttttttttttgttgttgttgttttttcaccaggaaatggagcctggtgaaaaatgtaatatatagcctcttcctccacactactaaactacctttctgtgtcctacagagactgtgtaatattcactggtgaagacataagctttgtagtcacaaacctgagttgacgttcctactctggcacttactagattgatatggtttggctgtgtccccacccaaatctcatcttgaattcccatgtgttgtgggagggacccggtgggaggtaattgaatcatgggggtaggtatttcccagggtgttctcctgatagtgagtaagtctcatgaggtctgatggttattataagggggagcttctctgcacaagctctctttgcctgctgccatttcacgtaaggtgtgacttgctcctccttgccttctgccatgattgtgaggcctccccagccacatggaactgtaagtccaattaaacctctttcttttgtaaattgcccagtcttggatatgtctttatcagcaccatgaaaatggactaatatatagatgtaataactttttgcaagttatgcaattttgggccatagattcctttattctgaagtggagaaaatactttccttatacaattgttatgtttacataaaataaggtgccagatacatagtagaaataaaataaatgatgttactacttcctaaaatcctaaaagtttcatttcagattgctgagtaaacccagttaaagaaaccagcctctgtgttttggtgttgtcattaatgctaagttacatttccttagggtatctgcattaagcaaatgtaagatgtttgagtttcaaagatgaacaagtgacttgtaagtgtaaagtggtatggctgtttttaataaataggtaataccacccttttggcgggtagtagagaaaagaagatgagtttttagaaaaagactcagagttactcagaattaagaaaatgaatccttactgtcaatatgagtctcccaactgctagcgcaagtggtggatagattttcttttccactagatttacttcctgatatacacatttatcactcaagcatggactgttcatcaagtcattttccatctataaccccagctgaagcctgacaggttgtgtgtttattatgtactcttaaaaaactggagctcatttgcccctgctgcggggagagcagactcagacagatagagggataaggtcattcagtggaatgcccattcactgcagtcaagcctaaataatagagaggtgtaaaacaaccaggaaaagctctgattattgccagaaatcaaatattgatcagatagtcccctaacttaccaacttccctcttaatgatctgattcccatgtattcattcatcagttagttgagcccctcctatagaccaagccctgtgcatggctataaaaaacagtatgtccatgcccacttccccctctacactcaatctggagccatgagaaattaaataacctttaatttctgaagatcgggtgctcttataaaacatcagtacttataattgtatcctgcagtggaaaattgtgcaataatctttttctgaaggcatggccatgaattgtactatattactccatctatcttcttttaacactaaacaaaatgaagagaatacattgtgcatggcccctagaaatttaccttcaaatagaaacaaagctgctaactccacacacacatgatatgctgaaaactgaataaatattgaagaatctaaattcaattaattagcaagccaaatcttgcctcaaattatgttgacattatttattcctttgttgattaaatgagttgcctcttaagccaaaagagaagatcttaagctcttgtttcttcattccaggtctcttctctccaaggaatttgggaaggagcaagcacagcagaggccagttttactgcatgctggtgctcagagggaatagggttcatagagtagaagacagtgaggagagaaccagtaaggaggttggggagctggatagcatttacagcatgggttcattgattcattgggaggcttataaatttcctatgcatagaagcacctgtttttaaacagagacatgtattcaacacatgccttcgagaactaattggaaagagtctttgatggcctatcgttttgaatttgcatgaccagaactccactatccatgcaaacacagtggacttgctgcaattgtcctttgacttaggcaactttaacaatgcaggggaggaggggtgagaagaggctaggagaggaagtgtcagtgggagaagccaagaataattgaagtagtgtgttatttcttttttttttaactattaattttttttattattatactttaagttctgggatacatgtgcagaaggtgcaggtttgttacataggtatacatatgccatggtggtttgctgcactcatcaacccatcatctacattaggtatttctcctaatactatccctcccctagccctccacccacctgacaggtctcagtgtgtgatgttcccctccttgtgtccacgtattctcgttgttcaactcccacttatgagtgagaacatgcagtgtttggttttctgttcctgtgttagtttgctgagaatgatggtttccagcttcaccagtgtccctgcaaaggacatgaagtcattcttttttatggctgcataatattccatggtgtatatgtgccacattttctttatccagtctatcattgatagacatttgggtttgttccaagtctttgctattgtgaacagtgctacaataaacatacatgtgcatgtgtctttatagtagaatgatttataatcctttgggtatataccctgcaatcccattactaggtagtatggcatttctaaccaccctttccttccatgagcttaggcctgggagttgcagtgagtgggagccttaaatctaccaagccgcaaatttctgtgttcctgaggcctctcaaggcatcaacatcttgaatagaaaataagtctatccttaaagatacagtacatttaaagattaaaaaaaaaaaaaacaaaaaaaatcatgttccctaaacacaaataacttcatctgctgcccaagcaaagaaacaaagagatgtctactaaaggcaaaaatgccaatgtcgtgcttcctgagcacagacattgcactgcacagaatggaccattttggagactttcaaagacagttttgactcagtaatctcctatgctgactttattacctaactgtgtcctgtggaggattaggtgatagtggcaggttaggtccatgggagattggattccactgtgatcagcaaacagaataaccagcatgtgtgaagtgacttttgtcagaggagtgatgaggagtgctctctgaattcagtgttttccctctttaatttttgctaatcatgggtcatttatctgtgagctactgcattgtttccactgcctgctttccaaccagggataggttttatctcaaaaaacagaagacaaaacctcttaacctaaaactaagactccctctgggagattccaaagagagacggctttgatgtaatgggaagggagctgatttagggtctaataaagtcttctaccagctgtgtgatctttggcagtttctagttccctaggtactatttgcctatctatagaaatggggttaacagcacctactgctgaagttggtatggacataatgagataccatacatgtaaggaaatgaaaagtattccacaaatactccttccctgagcttgttccttcctttcaccaaaacacacatattccatctttcaactctcctgctctacacgtgtatgcttgagtttagggccctggaataagcaatcctgggtcaacatctgctctgcaaacatcaaaaagtgtgagcaggggcagcctagccttggtattgatgtgtttcccatccacagccacattcaccattagacccagtattagtcactgggtccccggggccagcatttactgttgccttcaaaaatgcagactcattactaacaaaagtggtatgtccattattatgacctatttagtggcccagcaaatccccaaattctattgagccacatctgtctaccgaggggctctgcggttgattgtctgagacggatctgcttgcaaagaggctgatttgggaaagttcaacagccccacttagttgctctgtgacatcctgacttcctacaggttacttctcatattgttgggtgtttgtttgtttgttagtttgtttgtttgacagaggtctcactctgtcaccaggctggagtgcagtggcatgatctcggctcactgcaacctcctcctcccaggttcaagggattctcctgcctcagcctcccgaatagctgggactacatgcacaccccaccacaccaagctaatttttttattttttagtagagacgaggtttcaccatattggccaggatggtcttgatctcttgacctcatgatccacccgcctcagccttccaaagtgctgggattacaggcatgagccaccatgcctggcctcaatgttgtgttttaaagttcagctggaagatacccttattcctaagaaatccactaaagaaaactgttcttccaggagttccatttcattctctgggaagggtccatcccttgttcctgttccctttcctctgaattctataggacatatcacagcaccttcttgctgcctccttgtttgtgtctttcattaaactgtaagctccacacatgcagggactgtatttattttttcagagatgtgtcttcaacactgaatgcaacagtgacacttgacaaatatttttcaaacacattgaaatgagtttgatcaccacctgggcattcacagtagtccagaggtcccctgcactgtgagtgtgactaaagctcaggaaagtcagaaaggccagccaaggaaggaagatgctggcaagactcggaaagtgcaggagtgtatgagattgaatcacctggacaggggcacccaaacaaaggcgtctgctggctacgtgactttggttaagttgctgaacttctttgtccacagtttcctcaacactaaaacaaggagtaatcattatatctactttatagggctgttctggggattaaattagttaatatttataaagcatttaaaattatacatggtatgaaatgagcacaaataagtgggatgagggagacataaacaaaagttcctaaagtggaggttaattcagagccaaagacattgcctgggcattagaagtagtcagacatgaatttgagtcccagctaaggcatttatcaactgggtcggccttgaagaagccgcttgcattctgagtcttgctttccatagctatgaaatgttctcaatcacagttatctcccaggattgttaagagaagtttcctttaaatgttcagaatagtgaatggcatttcttatgtgcctaataaatattaactcatctactgccatcccttcctttctttccctctcattctttctcttttcctggcccataactttctgctcagaactggaaacatctttgaaggagggagaaggagcatgagagtcaggggcttgtttacaaaacaaaacatggaaatagtaaaaacaacaaatctaatagtctctgaaatgattttgtctcccactaggaccagaaaaagcagcagaattttatgttaatggattcggtggaaaatacggctttaatgaaacattgactatgattactctgttgtcatttctctgaatttctggtcctctttccatctctcttttaagaagatctgaatggttatttctcaacacaccaggattatgttttcttcgtcaagagtttgaggaacctagggtgcagcttgagctgctgagctgtctgtctttattctgacaggcgtggactccagtgtttagctcaagccccagggactggcttttgaacagcagctgttctcagtgaaactgaaatgcgcagaggggaggggaatagtacaccctgggaagtacagggagcaggtaagttgttttgctaatacatccctggggaagtttctagtgtttctgggcatggctgagcgcacagctcataaaaaatgcaccagatcattgttggcatttgatgtcagaagaagctacagtaccaagagacatggactgtctggtttcctgtgacatccaggtgacacaccaggtttccactgcttttcgtcattagcccagatgttcccagttacttggacagagagccttgtagatccctgtatatggagtcttccttcccgtggttcattagaaatggcaaagccaaactggcagtattcttcaatttgttgataagagtgcttcagtgcatgtatttacaaatacacattgttgttttcaatttgtttattcagtgaatcaaaatagcaaaacacattaactataagacaagagaaggataaggaagtaacatctattgggtacctgctatgttccaggcaatgacagagctgcttgacagaaaatgtttaatgtcttcctcattgtagctacatgtggtgtttcaggtatgattactgcatgttacagtgggaagtagcccagcattcttgaaagagtatagggtcctcactatctgtgtgaatttgagtagttacttaaaccctctgagctttattttatttctgtaaaggaatttaacaaagtggctaatagggtgtgtagggatgaagggacttttaagtttgctgaaataaactggaaatagattagcaggagagaaggcgtacaaatttattaacatgcagatgtgcacaggatccacacaaaatgggaagactcaaagaaaggccagatagttgaaggttaaatacccttttcataggggagagggaaatgggggacattgccaattttagagaaagagtaaataatttttagaggagatgagtggcctggaagaacagatgatagcctgggacaaagttcctctgcactatggggcaggtgatgacaagctataggaaagtgagggacagaactgcgcttcaaacaaaggttgttttattatacagataaagtctctaaggtaatggcccttagaagaataatgggaagaacaggtgaaaactctgtctgggtgtgttgtgggtgccctggaggtagagacttcttcttatctctcctgcatcagagttaatcttctctggttagtgtagatttcagggagcggtcaaagaccattgcattccttctggataaactttcttctggtgagagaacttcagagagagcccctccctacacttaggaaaggaatgtggggggtggggaaagctgtgcaggagaaagtcagagaaagaccttggttctgaggcctttcaaccttctttgttcaaagcaatcagtatgccaaagtaccatattttggggtatcattttctgagcctcaacaattgtcatgaagattgagtatgattgtaatataaagggctaacatttttacttgacctacatgagctgatcagtactgagagctcctcttacaagaaatggaccagagagggagggaaggggaaggggaggaaagggaagggaagggacaaaaagaaagaaaataaagaattgaggttcaggaaggttgaataatttaattcgcccaaaggcttacagctgctaggacgttcagccaaaaattacacccaggtctgatttcaaagacactaaaaccactgtttacttatagctacttagtgcaccccatctcatcccacccaatgccacctaactcccacctctattgtgagataactacatgcacgcactcatttggtaagtgggatcctggtgcctatttgactgacatttgagagttagcacatacaggtggcacaggtggtatctgcacagaaggaggaaggtggtgctgacacctctggatcttacacttgggtttagaacatagctggtcactaaagccacagggtagtggcagaacatttggatacatctttaaagactcaattagtatcccctcactgagtccccatcttattcattggttagccccctagactgaactgtcaaaaatgttctaagtctccttgtgttctctttatctttgtttttacaatcacaacacaataacaggagatactttttaatgaatgggcaggaactctccactgagatgtaaacatgttatactgggaattctgctgcagggttaatttatgatgatggagtcatctatatcatagctgaaagcaaggctttggggaagtgaaacccaggaaaggtcagttgtaatgcgcattgtctatattttaatgtaaaataccaattttgttgggaaaagggtggtcgggaaagaggtttgatccaaaaggttggaagttggggaaataattcaaaaagaaaactccaaataaacaacagagttggctggtcagttagccaaaggacaccggaggattcctgaaggtctgcatgtggtgagcacaaacttggtagggaaaaggcaggaatctgggtggggagaaggtactagaattcacaaggaagactcgtaaaatggaaactacggttgctgaaacacgttgtctactctattaattttctgccaaacatttcatgtgcttttagttcttcattgagcatgacatacttcaaatactcaaacctatttccttcttgtaggaatagctaggcatttcctcccacggtccaaggtgagactgaagataagtagaatctccacacttatttgtttactttggtccagactatagagtcaggttaaaagccatctggggaaatagccagtagccaatgcttattagcgtactacttgggtaggtgggaggatgcaagagctgtcaaacagcagccatcctgatgagaaagtgaagaaagccagaagcagcgtctcttctgtggcagtcacacagggtcccttgatactcagcccccaacatgagattgcctcttaggagaattctagaggttaggctaggcttgagacattatagagaacaggttacagcaccccatttttactttattggtaactgagaaagtaagatatattcctagcctcccagtcttagtagtaagaggtacttttaaactgttaatttttatgagcaacacagtggtatggccggcccttcctcctccttcagggagttcatttgatgtagtttggttgattcccatgcatgtggaatagctatgacatcatcaaattaagtgtacactatgtgctaacaattatcggggtgtcaagagtgaaacattcaggtcctattggcagttctaataggtgaatctcatctcactgttttatgtgttcagtgaagtaaatcttcagtaagtctggagtagctggggaagccttcgccaagaggtgaggtctgagctgggccttgagcattgctgagatctgaatgggtggaaaacagaagagaggtcattccagtcaaaagcaagatgtactcaaaaaatagcaaggaaaaacagatcacctggatgagatagcatttggggaagggtaagactatagtatggttggatttattgaacaggcacagtgtcaggaatccaactggctactttatatacactacttggtgttttatcctgcaaagtaaccctaataaccagtagcatttgctgagagtgtatgtgggtagcaggcaatgtatgagatgccgggaatacagagaaggatgattcgatgtttgccctcaagacctcagaatgtaagtctaggatatagtaacaaaataagtttattctagtataataggaatatatacactttaccaaggaagcatagagagcagaaccatttgctttgcctgctagatttcaaaatgacttctcagagatggtgagttctgagctgggtggtgaaggatgtgtaggagtttgtcagataaggagatgaaacaggcattccaggaaaagggaatagcaagttcagagacttggtatagtcctaaattatgtttgtcttcatttcagctagtgctatttcattgttgctggagataacacacacttggattccgttacgtattttcaccttgccaacttgctttgtttgcagaccataatttctgagtttatctctacagcaggttttcagccaaattgctctactaaaataaccctaaaaatctatcacctctgttttctgctgctgtcactggctgtttgtgtccttacttttcagtcaacctcaatggagactggaaagagaaatacaaattgccccagaaagagaacacaggcccctctcttcagcaacagggtgtgagtggatggggaccattatcacattatctacacagacaccgttttaatccacattgccaaggaggagaggaaaatgcatggccttcacagaacatcattaggagggtgggccattgtgcagcatctattgttaatgtcaatacctacaaacatgtccagactcttccattctttagcatactcattctctgagtggtattttatgtgtattattctctgagaggtaagcacggacaagtataattccatttttatgtaagggaaagctgagtaaagaagatgcttaaagaataggtggatagaaaaatgaaatgacttcagctcataagcattttgagtacctattatgttttagtcattatggtagaaacatggcaaatggatataaacaaaaaacatataattccatgcctctgttcagattgttgtctgcccctgagattcctctttttcccactccccttgactaactcaactagccctgctttttgtttgcctgtttgttctatttattttttggaggacagggtctcactctgtcacccaggctagagtgtagtgatgcaatcacaacccactgcagcctcaccctcctgggttcaagtgatcctcctgcctcagcctcccaagtagctgggactacaggcatgcaccatcacacctggataaaaattattttttgtgtaaagatgaggtctcactatgttgcccaggttggtctcaaacttctgggctcaagcagtcctcctggcttggcctcctaaagttctgggattataggcaccagccactgcacccagtcaactagccatgtcttttggtccaacccaatgttgcacctttgcataacaaaggcaattaaagaccacttcttccctcctgccccctgcaaaaacctaatagttctcaaacacattggttcatggaactcattatatatgaaaacccatcaacatccacacaattagcaaacttaaccctctgcagggttgacattgagttggaccttaagatatattcaaggctagttggctgggcttggcttgactcccccttagctctctctataaaagcaatgattactgtattatattggttttcaaagaattctgtcccacattctgttctacttattaccttctttgcttgactgtgatagattgaggccatctttctgtctgtccctgtattaatacattcaggctgctgtagcacaataccttagcgtgagcaaaggaagttaaagaccacctcctccccctgccccctgcaaaaacctagtagttctcagactcattggttcatagaactcattatatatgaaaacccatcaacatccatgtaattagcaaacttaacacacttgaaaatgctacctttcaagtcagtattcatattaggcagactttggagatgttgtggattctgcttcataccaccacaataacgtgattattgccataaagtgagtcacacaaattttttcgtttcccagtgcatataaaatttacgttgacattctactgtagtctattaaatgtgcaatagcattatatgtaaaagtaatgtacaaaccttaattataaatatttattgctaaaataatgctaaaaaattatcagagccttcagagagtcataaccttttggctgatggagggtcttgtcttgatgttgatagctactgacagggtggcagttgctggaggttggggtggctgtggaaatttcataaaataagacaataataaagtttggtgcatcaactgactcttcctttcatgaaagttttctctgtagcatgtaatgctgtttgatagcattttctaaatttatttcaaaattggagtccatcctctcaaacccagctgctcccttatcaactaagtttatgaaatattctacatcctttgttgtcatttcaacagtgttcacgacatgtttaccaaaagtagattccattttaagaaaccacttttcctcatccataagcagaaactcctcatccattcaaggtttctcatgagattgcagcaattccatcatatcttcaggctctacttctagttaccttgttctttccatcacatctgcaattccttcccccactgaagccttgaacccctgaaactcatccgtgagggttggaatcaacttttttcaaagtcttagtaatgttgatattttgacctcccatgaatcattgatgttcttcatggcatctagaatggtgaatcctttctagaagaatatttcaatgtacttcgtccagatccattagaagaatcagtgtctatggcacctatagccttatgaaaatatttcttgcatgataagacatgaaagtcaaaattattccttgatccatgaactgcagaatggatgctatgttatcagatatgaaagcaatcataatcttcctgtatatctctttcagagctcttgggtgattaggtacattgtcaatgatcagtaaaattttgataggatgttcttttctctctctctttttttttttttttctgagcagtagctctcaacagtaggcttaaataaaccatgatgtaaacagatgtgttgtcatccagactttattgttcctttgatagaacacaggcagagtaaatttatcacaattcttaagggagccctaggattttgggaatggcaaatgagcattgacttcaacttaatcaccaactgcagtagcctaaaacaagagagtcagcccaagactacaccttcgtccagcagaagactgttttgtctgcattgaaaatctagtgcagccatctttatcaatgatcttagctagaacttctgaatagcttgctgcagcttctccattagcatgtgctacttcaccttgcacttttatgtatggaggtgacttctttccttaaacctcatgaacaaacttctgctaagcttcctacttttttttcctacagcttcctcactcttcttagccttcatagacttgaagagagctagggccttgttctgggttaggctttggcttaaggaaagattgaggctggttggatattctgtccagacaactaaaactttctcatgtcagcaatcaggctgttttgctttcttatcatttgagtcttcactagagtaggactttcacttttctttaagaactttttctttgcatccactacttggctcagtgcttggcttagcttttagtctatcctggcttttgatatgtcttcctcaccaagcttactcacttctagctttttgtttaaagtgagagacatgagactcttcctttccctgaatacttacaggccattgtagggtcattattgacctacattcaatattgttgtgtctcagagaatagggagacccaaggaaaggggaagagattagcgagtggctggtcagtggagcagtcagaaaacacacatttatcaatccagtttgggcaaggtgtgtggcaccccaaaacagttacaatagtaacctcaaagatcactgatcacaggtcaccataacagatataataataatgaaaacatttgaaatattgtgagaattaccaagatgtgacacagagatgtgaagtgagcccatgctgttgaaaaaaaatagtgtggatagatttagatttgcctaacttaaggttgctacaaactttcaatttgtaaaaagcataatatctacaaagtgcaataaagaaaagtgcaataaaatgatgtttgcttgtagttttaaagttttgtatgaaaacagtagttggataaattgtttgcctaagcctcttttgtagtcagagggctattgtatgtacttggaaaaagtgtacatgctagggacttccagggcagcttgcatccctgaggacgggactaaaaataacagagtcccctgctttgtgggacctaaagcttgtacaatttgtgtgtgtgtgtgtgtaacgtcttgagtaaaaagaattcaaaatataaaaatgatttcatttaaaatgaaaaaagataatgaaaaattacagattttaagaagttggtaaatatcaccgaaatggataaattaatttactatttgcaactaactgcttgacattcttctataacacttttttctataaaattaataatgttcgctatgaatgccttttcatgtgaaaattctgtaatattcctttctacagataggatagaaaggtaattcagtctttcctctggcctggttcgtcaaactttctaaaaaattatggatagtttttagagtttatattggtaaatttaagtgaatttttaaaaaatgttataacttctggcaaacctctatcaaagtacaaattctggtcctgggtgaccagagaggacccctaggtaagacagcactgggggtgggaggagcatttctggaagccattttgacacctggacagtagcaataacttaattctacaaggacaagattgtaagcttttttttttttttttttttttttgagatggagtctctctctgttgcccaggctggagtgcaatggcacaatctcggctcactgcaacctccgcctcttgggttgaagccattcccctccctcagcctcccaaatagctagtactacaggcatgcacctccacgcctgggattacaagcatgtgccaccaggcctggctaatttttttgtatttttagtagagacagggtttcaccatgttggccaggctggtcttgaacccctgacctcaagtgatctgcctgccttgccctcccaaagtgctgggattacaggcataagccatcacacctggccgattgtgagctacttaaagataccccaccaaagaacttaaagtgttccatctcagcaccctggccctgtgttgtcaagctgctcccccttccatcatactgtgcactgtatggtgcctctttatgaaccagacgctgcttgtgcaacagaggctgatcccactgcagagactgtatttgtcttctctttattttactggaagtctttgccaccatccggctggtaattgctccacaccacttctgaatcgattgcttttagagttgttgagcttttattactactactcattggggagagaagagagaaagaagcaggttggcctgggctctgcaagagacggatgttgtcaaattgtctttctccagctgttgaatacaactcataatgctattcaataaaaccagaaagaaaatgagagtacaagggaaagaagagatgtcagaaagagagaacaagagaacatacgagtctgccttctcttggaatagacagcaaagccatattgtgatgttgactatatcatgcagtaatggtgaacaaatgtagcaagaagtaaaagacagagctatttaaatatatctgtgggcaattgcacaaatctgccacttttgtaggtatactgatgtttcctcattcctggagctgagaaaaagggtctatgttttgctttattttatttctttcatttagtttggtaggctatgtaatttgattcaagtatgatagaatttctccttagttatacacattactgttattttgctagtaagtggctttgtatccacaatcaggacactcttatgaactgtttacatctgctattgactgatctcgttgcgtttcctcatgctttcatcaaaaggtagcagttggcagggccattcactggagaatgaggaacacgcataattagatttagtgaagaacaccctcattccaattggaatctgtctttaagaaaagaaaagaaaaaaagctccaggttaaggagcttcgaaagactgaatactgatgtaacttttgttcatgctaattactcacaacccagataatacttcgtttaatgattttatcccatttgttatcccctataacattcatctgcataaattagtttcttgtcaacctttcagaaagggtttaatgacagttcatggtgtttacttattttctaaaagtagtctaagtgagtcattataaattgaacattcaagttaaatttgtctgaaacatatataagtatcatataaatttcagattttacacagggttctcctctactaagcaggtggaatataccccccatttcagaatgccagtttaaattacttgcctggggtaaaataccaaatcagagttggacataaaacccaggtatccttattctcattctactattctaataaccagatccaatgctataatgctgcaaattataggccctatttttcgagtaggatgcatgtgaatgtcatttgtctcttaaatgcatgaatagtgtcttcccttgtggtcgctctactgcttccagcctgtcatgtcaagcagcattgcctttattattgaaatgaagacgatacttagatcattgatctcaatggcatttggcaccataagaactaccagtctgttgtatcatataaaatgatactgcctggtatgcaaatcagccagtgtgtcaacaaaaatgctggcatcagatagaatgtccaaattgctatcactctgccagttttacacctacatccctattagttcctgtctaattaccaatgataaaagtactttgaagtcccactgatttccatgtaaatatcatacaaatttggatttgctttaacattataattccatcagcttagaagttaaaatttagaaaagctgtagttcattagtttaagtcacttcaaaacttaccttgcttagttttcagatagactcccatcctatacttctaggactgtacaaataaaaaaatgaattaaaagacatttcttgatgggtttaatgttttctactaattattttgacagacagtcataatctgttctgagttcttcttttctccttccatttcaattcttcataaaacatggaaaaaactttggagactgaataagatctatggtaatccacaatagatgaggccctgaacacaacatagggaaaacatataacccacccccaataagctcaacttactgtaaactcttgaggagtaattagggacttcagcagtctctctgaaaaagccaacgcattgtaaaacccttttagtttttacatgaatattaattctttgaaagtagatgaaagactttctttaatgctaaattcttatccatagagaataatattagagcgaggatctagtgtattattcccatttcatgaataggaaacggagaagtagagaattttagggaccataaaagtgacccaagtgccatgtgtcaaagctaatatacttaactcaagcctattccagtgggttctcacccttcacttgtgccctaaggcctggcagcttatttcaggagggacacccgttgttggtgtaaagagcaagatcttttatgggtatcagttttaaggggcttatgggaataatcaatatgctatggaagtaatgaagatatttaacgtcctgaaaattctagtctaagctttgagaatgtgaccataaaattgacagggattaactttaatatttgactagttaacggtaggattttttccgttacagtgcactgtgtcaaaatttggtctcgttaaataaattcctattctatcagggatgagcttcccacaaataatgttaaaaaaaaaaaaaaaaggagaaagcatgataaaccttttttcctgtttctcttcttctaaccacagggtgcactatggcagttgcagggcttggtaattgaattcagttctgcaacctgaatacatttctactgtaagtggatctccctcctctaccagagaaagaaaatggcctcaaatgattctgactggaacacagcagccacctctcttgtaaatagctgggtcttattgacttatcttggtagggagccaaaattgctgcccagatgagtccaagcagtagccagaagagaaccagctacttatggggtctctgtctttgtgaaataagtattaagagggtccatcttaaagaaggaagagaagtatggtcaggtgagtcaggcaatgatgcttagtgaagtacaacctcagagttacggtttttaataatacgcaaaattacatgtgtaagtgtattgatatgttttataatacagcatgcccagaatctcaaaaagattaaaaaaaaaaaaagatgttcctaggttctaagtatttttctttgcatagtggtttgagggcgagtcaagtttataggtgtgctgacctttaagagagttaggaataaaagagggcattgagagaaagtggtttgggtcgcagacaccatccctcaaatagctgacaatgaaggtctataataataattggcattatctcaatttgccaggtatctttagtagaatgtgctttatctaatacccaaggtagggtttcaacaatgttgagaatctatttatgaaaaggccaagatgataatgttagctaagtgctaaatataataaaaagtagtcatgaccaccattctagacaagcttcattgtcccgcacactttatctggacctgtggtttctggatggttaagcggcttgtactcacaaagacaaattgtgcattcttggaatacattcttggaggtctgagagttttctgtgagtggtgctgaaagtgtatatttcatctcaatgacaatctcaaaaaattataatgcaagcatattctgaatgatcttgttgaccacctaataaccaggtatttttatagaattttaatgcttgtgttgagttgtgttcatggggaacaaacctgtcataccttatttggtaaggactattgagaaaagagcagagccaggttgagaacataaggaatgcatttatgtcaaggaaaaaataaaatgatgccagagtctgattttaaaaacaaagctatctcacgatttcaaatggagaaaacagggagggagaataaaatcacagcaagcttaattaggtgtgagcatcatgacctcaggagaacctgggccagagaagtcaggagtattaatgtttaccatggaactggtaatttcatttaaaccaagcagcatcagctgtcacattaaattaatattattgaaattttatagcatttatatttatttgtatttaatttataaatgggtgttggttgtgtaagtgctataagtataaatggattgtagctagttttatgtttgtgtatatatatgtgtgtgtatatatacatatatgtgtgtgtatatatacatatacacatgtgtgtgtgtatacatatacgcacacatgtgtatatacatatacacacacatgtgtgtgtatatatatatacatatgtgtgcgtatatgtatacacacacacatatgtatatatatgtaatgctaacaaaaaataatttgaatgattgccaggggtccccaagaatgagctttttcttttaaaattggcctgtactttctttgagaagccttgccacgggtagaggagctattcagtgcctattgagtcaaaatttggccttaatataaatggggaggttttcccttgccatgtttggtgcctgctaggtatagtcacttgctctaatttcagtagggtggtggaaattaccaataggcagaaaaagacagctttgctgacacctatttggttgaattttacaaaatggaaggatgaataatacctcaaaggcaatctggtagattctttgagggaaagagatgtgtctatttacagggaataaagctaagcacattgactgttcttaggttaatggaaaagaataaggctagtgtaggagccagcaaattatgtttcctccataattagagtcttataaaaatatcagcgtgaattacttgctaaatacaaattacaattgttaatgtttgttaagaaaaataattcaatttagagcaagaatgaaagaaatacaggcacccaagaacaggcacagaatacaatcactttaaccaaagcttagcatggattattttcccccacttcagcttcaagtttattctaatctttttctggggggcaggagacagtcggaggggaatgcatctgtatgtcccagctgtgtggcttctgagcctgacacccctgtgctctaacaagacccagggaagaaatccttagcaggctcttacccttatcagaacaaagctatttagttgccaccttaactccagtaattaactcagtggagcaaatttccttatttcatgtaagatgtgagccaaaactctccttgctgcacttcttctatctctgggataaagccaaacagagaagaaactcaaggaccatagaatctttccttgcttttagttttcctttgaggccctacctcccaactccctcctcacctctctccttgaccactgagtagtaccactactcagttaatactgaattttcttcttttccaagccctgcagtttactctagaatttctactgacaaagccaaatcttgctgtgatttttgcccccatggagaagcatgtattataggaacaactaaccctttataacttaggaggccctggggcttcattgcattacagagtcatacaaccataaatgcccagacatacatcaccagggttaaatcattttcagtatgaaatgatgtaatccaatttgaacactgcctcaaacccagtgcccttcatgtggtaagtattcaatacatacctaatattttaactttatttatttttacctcctccgatacaaaaaaatgtaaataaccctcaatgatctgtaaaaaatcacttagttggaacactttgttcatcctctagcaatgtctgataagttagttatcattacatcatgaatcatgatactcctcatcaggcagtaaaaatacagtaatttcgtttaattgaagggaaatacatgtttaccttggtaaaacttatatattatctttaaataaataaagggttatcttgttcaaatagcttaaacccataatcaaatgttgcttatagaggtcctgctttaaggatctcataatgatttgcatatcattagcttgtcagaataccatcctaaaccttgctgatatctgctctctttgcagttcattctttgttgcatccaagtattacagtaagttgttctctggcaatttgtttatactaatgatttgacagttattttttgacccttgaatgacataattatgttaaatacagtttaggctagcttgtgttcaaattgacatgaatttttaaattagtaatgttggtatctagtatatgacagaaatgaaaaataacgtattttgtatttatgcaagaaattatctgtaccgatcaaaactgacctccggacacaagaccagactggacttgcatatgttaatgggaaacaaaatggggaaggggctcctaattacttaagtttattaagaatcccaggatacctcttagaatggtagaggtgatgttagcccttatgtcctggacatgatccagtttaggtaattgctaattacaatctgtctacttaattcccacggcccttgcttctgaatgttattttcttcacttagcaatatttaactattatttgctcttggtgtgtgactgttggaacatctgctgattcctccttctacgttcggcatgatttgcttttcatttggttatttgataattattattttcatattatttttgttctaaatatgtctatagatagaaaacagaagccctgtaaaagttttagatattttttaactgcgtgggctggactatgctttgtcaatcgagcatacagactttctggatgtaagtttgggaacagtgggcataccactggcccatgaaacactcactataagatagtgtcaactcagaggtgaatcacagatagaccagggttttcagtgtcttcaaaactagggctgaaatcacagcacttaggggcttataagtagatccctctaaggatctatcctattctggagccattccaaaacaagagtacctctgttttgggtgctagagcatgctttatttcaatcacaattcaatggaactgaagaacagaattagaaagtgatgagtcaaaaattcttattcaccgcaaatacagggctagataaactccaggtattccacacagtttccatccctctgaaggaagcgagattactcttgtgtccgctcagctatgagcaccttgatttgggatatattgcttggagttcagatggagaagacatccaggttttatctataaactaccctccatatctctaaaagttacttagaggaaatcactgagttgaaacttcattcattccctagcattgtcagatgaactgaagcatctttttcaatagtcaatatatcctgagccttcttagtgaacacagtgcttagaactttcaatgaattcacctctctaagattatggactacatattccaaatgtgtagattttgacctaaattttacccattctacagaaaaccaacaaactccacctcagagagatgttctcactatatctacccaccagggtaccagtctaaaaggccccaatattttctcctgtgttttctgaataattgtgtttgagctagagccgggagactcctcctgtggcttttattaatggaccaaagtttggttcctgtgaggactgcaatgtgtgattcaaatgcccagtccatgattcagctagtgaggggagtaacccattttatcagttgtgctgtcttccactgctgttctctatattccatcagaggaaacaaatggcttctattgtgcataagaatgccatttagtcccaagcaccatttgaaatggaaatgaggagtaacagtaacagaagaacattggctaataattgtgctctgaatagccatttggccatgtgggcagggtaaaggtaattgtgtcctagagtaatacatcttctgagcattccctgagactataattgctatgttgatgggatgcatttttaaacatgtgattgcggctcttagacttaaaaaaaaatggctattttcagaatgatctgactttaagatgtcaggcaagattttgaagtcagaataacaacacacaaacacagatctaagatgtattattgtgtagctacttgtctaactgcatttttttttcttaagtctcaccctgtcttggtgatacacagattaatactaacctcctaccaaacaatccctgttgccactctactgaaaatacattcttgccttccacaagcagaaggctgagtgtctttgtggcttaggagagaacaaaaacacatctatgtattcattgccttgttcacttgcacaaacggagaaaactctttgaaaacatcttcctttctcctgagtgaaagaatgagcaggcgctgcctcccctgatttactgcacccatcctaatcagggtagatgattctgatcttgcattaaacaattactatgcaggctctgggcttaagttttgacttaagtttagaaattgagtagttcccacaatgccctccatttctaaatgtatgagaagaggatcaacaaagaaaaaaattaatgggcttttgaatgagcaacgtgtgtgtgtgtgtgtgtgtgtgtgtgtgagagagagagagagagagacagagagacagagagaggcatgatcttggctccctgcaacctccgtctcccgggttcaagtgattctcatgcctcagcctcctgagtagctgggattacaggtgcccgccaccacacctggctaatttttgtattttttgtagagaccgggttttgccatgttggccaggatggtcttgaactcttgagctcaagtgatccgcccacctcagcatcccaaagtgttgggcttacaggcgtgagccactgtgcctggccaacagaacatattttaatgtctgaaaaaaaagaagaatctactttaaacatcaccagaagggatacacccttcggtgtccccaggccttgctggcttgctgtgggtataaagcattaattcttgtcatttgctggttatagtcctccaccaaaactcttcagttcttggcctctaattcaagctttcttccaagtttctctccactctcactgtgtcatttctaggaggcctcagagttttccacgctagaacacagtcggtactctcatgtgtgttttcattttagcctctttgttgatgtctgctgcctgtcaatccacctgggtttgtaaagtccctgaagcaattcctgccatgagaatgttccttcatccagaatgctgccttctatgctccccaaactcaaagaccttcagggaccagtaaactcaactgcccaaagccaagcacagctgtccacagaattggggcagagattcttctccataggactctggcctggtgcataggtttggctgaggaaaagacatgcttttctccttccccttttcacttctatcccttttcaccaggactcttgaagaatattctcacaggcctcgtttcccctcaggtcagaaaatatgtgcggaacagaccctgagatgctgactgtgcaaggctgttcagacccagtcaggtcaggccctgaatccttgtgatatggaatgagatatgataaattggaaattgtctttaataaattgccattcgtgataattctagtgataattaatctgctgaggctgctataaaatatcatagactgagaggcttaaccaatgtatttccacatagttttggaggctggaagtccaggatcaagaacaaggtgctagccaattggctttctgtgagggatcacttcctggcttgcagtcagctgccttcttgctgtattctcatatcacctttcctaggcagatgcatgcagagagggcaagtgagctgagcaagctcactggagtcttttcttgtaagaacactaatcctattggatcagggccttcacttttgtgacctcatttatcctcaattccttagaggccccatctccaaattcagccatattaggggttagggcttcaacagatgatttttggggcaagtattcagtctatgacaatcctcatttaaactcatcagggaccattgataaaatgctattcattcttccctatgctggtgtggaaatttgccacccaatggatgcctgcaatatatgccagagactttaggtacgctgtggcatggcttagtgactatgagaagactgacatattagcttggactagcttttgttaagcaaatggactattttacaatccaagaaaatgaacaaaattccgttttacttactcaagataaaaatgcattgatactgcaagacatatcctcactgaaagatagggtcacttaaaatatcccatttaaatgcaaaggacactagaaagtatagcaagacaaggtaaagaaaataacaaccttgctaacatatgactaaaataggaactggcagctgggggtgatgagagaaatgaaggcagtcagctacacactgactgccggggagcatcctgcacctcagataagggagcttccgcaatgaatgcctgggcctttggctttgtttcaagtcttttgatctagcggagtccataggatcatttttcccgtgggccagacctctggagaagcaattggcattgttagtttgcactgttagttctgaagctagtttggtaacaaaaagttattgtagtaagtgcacttgtgtgtgtatgtgaggggtgtggatagatgatcatgttcaagtctgtagtagaaaatttctaattattgagtctagagaactaagaatacttataggaggtaattaatccttacccgacatgtggaaaatgtcttataacccttctgtttaatttaacaaaaatatagtctactgttcagatggttaccactcggagcaactcaaactatttccctacagattttcctgtagagaatgaatgagaaatttttttgtttgtttaaggcctgaaattttactaccaaagtcaaattttgagtattgattgttgagtcctgaggatggttatattatcatgacaaatcttgcttattgtttttaattagacaaaattttcaaataactgtgagttattacatatctcttttattatagtgttctatagattgtattttgtttcattacccacactacacacacaaaccacatatacacatgcacaacacacacacattctttctatacttcatgtgaatgctttgagacaatcctatttaacattgacaatgaacaggacagctggtctctcaataaaatctaagataccacagtagtatctgcaaataatatataaattagaaatatttggaatgtttagtttatttgctaaagctcttcagaactataaattacaatattaatgaacttatttttaattcccatcactttcatttttatagaatccagaaataatgcatgtaacttgccattcctccccattagtacacttgagtccaaaggagaggttcacagcatcgtgctcttttgtgatgtggtttagaagaaaaccagctcaggacaagtggactctgaaaatagcagactttcctttactcatcttttgagttttcagagaagagtagagattcagttcattggatattttctttgtactaggctccatgctagaaattggagaaaataataaatgagaacctatctttaattaccattctagaaagaagacatgtacattaaggataatatgtaatggatgtcataatataaatatgtacaaagacaaggtgtagcatagaaggcagatgaattgttatgttgattggagtgtggtttctgttaagggatgacattaatgaggtatcgcctttgcaacttcaagaatgaatagaagttaatcagacaagaaaagaaccatttcacaaggaacaatatgtacacataattcaagacagccagaatgtgaagtaagaggagactcaagttttgtcagcatattatataagtaagggtgagttttggctttgagagttgctttgttgtgtttttccagatagatgtttttcagatatcttctcccctgtgagaaatttctgcaggtttgattgatcctttcagatgctttttaaatatatattagtttcatcactttaccacattgagagtccatgtatctttgactcaaatgcctaggaacagaagatgtgaggaaagggagagagagagattctgtcatttaacaattattattcaagtacctaaaccaaatcgaaatgcctaaaggaatgcagtgggtgatgtaaaagaaggtgtagggcaggtgtaacaacacagaatggtagagaggtgggaggtggggggacgggagagtacgcagctcttctaaggtgggcagctgccttatagcttcagccagttgtcacacagcactggttttgtcagttttcagttctttgaaaaaattggaaatgtgaaattttatatggaactgtcaatttgtggaagttagaaaccactcgcaggccagcactgggaaggccatatccagcctgacttgctctgttttatacaccatgcactctcagtggttgcctcaagggctttagaaagaaggtcaaccctttgccttgtggcttttgtgcattgctttcttaagaggaacataaggaaactctactgttctcagctgctgttgtggttacttggccatttgtaagacttatatataataatgaagttgtcttggagggctgccatgtccgtgatgtagttgcttatctaattttgtaatcttttatcaattccctctacagcttgaaggccaggctgagggtatggtacagaatactaagtggtttcaaatcaagtccaatctctgttgcaatttttattgtgataacaagatatattattaataacaataaaagacaataataatgtattattatattgtaagcttaccatgaagtgtatgggcaacccaaaaagatattcagccatcattaaaatcttttctaatcacagccacacatttcatattatattaaggaaaaacataaaagcaatcttgatgttaagtagaattagtaaagacctaaaggagtataaccgaataaacacaaagtagaataagtaggccagaatatgattgtattctatcaacaatgttatatttgcttagaaatctcttatatttcttcctccaaatatgcgtgcatgcacccacacacacacacacacacatacatatatacatatatgtatatctgcaattgtctaaaggtagatggtatagcataaaggttaagagtgtaaatttggggttcatactactagagtttcacaactgcctatgtagccttccaaaaatatttagcatcctgagctgcagttttctcatctataaacaaggattaataatagtatttatctttgtactattagatatgattgaataagatatttcatgtaaatcatctagcgtactgccagatatattttatagtcattattaatgcaaatcattattgtatcattattattactggagttttaactctctggctgttggcaggaggcctcagttcttctacccatgggcctctccacagagctgcttgagtatcctcagacgtggtggctggctttacccagggtgagtggactggggggtttggggaacaaactaggtagaagaacacctctaccatgtctattctttagaagcgagtcacgatgtttggcccacaataaagaagaatggaaatatttgctaaagattttgcagatgtattttaaagccacaacaaggcaaagggttattattcttaatttgcagaagtaattgagactcaatgagattagataacatacccaagaaaacacagtaaattgcataacttatttactggagctcctccccaaacccctaaactatgtgacattcttgctttaaaaaaaaatggattatacagcacgtgtcaccactgcattctcttttttatgttgttcatgtgtgtctgtgaaatgtgccttctaataaaaatttgaggatcttatacttttccagaatcattttgttgaagtcatgttttggagtacatttgtatgcaatccgtctgataagggaagtatatttctcactggaattagtataggcggaaaacaccatcaatcatagtcatcacaaagcaattaagtacctaattgttcatggctctgagtttgctactgaaacagaaaacttcttaggcttgctaagaaaacttcttaggcttctaagccctcctggggcttggaatccaagaattcagtagaagacggaagcgtggtaaggagaacaagaactgaagacataaacaaatttatttgaaatatggttgcagtggagcagggagagtgaattcaggggaaagaaaaataaaatgaaataagatgctgaggttcaagaaaggataaaaggtaaagtggctgaatttaaatgacctgggtttcagtttttaacaaaacataaaaataactgaagaaaggctctatattttatttaacaataacaacaacaaaaatcaaagtgcttgtttatcattgggactcaacttttgcagagtttttgccttaatttttttctctctaaagcagaatttcccatcactttagattcctttccgtgtcaatgatggcttttaatcccaatttccatcattacccctcagtgaaatgattgcttccatgtttgagtatatatacatatgtctgagacttaggtcaattattttcatgcagaaatcggggagggtgctcctgtttttcatatgcatttgtaaatattttcaatcaatcatgcatttataatccaattgggaagatatgattcagacacaatagcccgtctgctgcaagagtctgttataaaattgatcagttggccaagttatgctatttttttaagttactttgctttctttcagggaagaagaaagacaaaaaagtccagaaaccagcagcagcaggtgctgccaaaatggtattcttcttatctgtgctgatttcaaggggtgtgcaaaagaatgtgtagttgcttttctctctggctgttgggatggcgtctgtctctctggcattatccacttatttgatctagctaagtataggagcagaaataaattaaaaatgctttttcccagaagccccaaggatgttattcacacattctcccttctactgatctctgccagtggtgtgtaaatatatatttagggggaagtggctgaagtcaaaagctctgttggatattctttccctttcagttacttaccttcttatgcacaaatagaaagagagaaatcagaatagcagagaaattaacagacatgacagcacaacaccttctttcccatgtgctgatttgaagaggctcatgtatttatgtcacaaatgtcaaaattcaagtttctaagcaaaagaaaaaaggaaaaactgctaaatgttaagtgatttgcttatttgaagagttgtattacaaagcaatggaatgggagagctctcccagcccaggaaagacaaatgggaagacgggtctattttcattttggcattggacagaaggcagccttctggcctgctgtcacttcctatctgttcagtcttcgttttgcttccccgctgaccatggatcggattctgactcatatcagagactccctcttctgatcctatttatttatctgaggattttttcttttctttttccatagactcctagaatccagaggaaactcagtggcatctctcatattatcctaagctttctcagaaatgtgacatcaatattttaaaattttcagtagttatcaatatttcttaaatctagcagtaaggatggtctttgaaatatcttttctaaattccttctgttataataaaagtcagtgctcttttatatggtttggctgtatccccacccaaatcttgccttgaattgtaatgactcccacgtcaagatggggccaggtggaggtaataggatcatgggggcagtttcccccatactgttctcatggtagtgaataagtctcatgagatctgatggttttataaatgggggttcccctgcacgagctatcttgcctgctgccatgactttgctcctcattcaccttccatcatgatagtgaggcctcccaagccttgtggaactgtgagtccattaaacctgtttttctttatcaattacccggtctcagatatgtctttattagcaccatgagaacagacaaatacactgtttatcatattcttgacagcaataaaacaattgcttactgtcagctcttaacaatctttagtataattaagatagtctatttggattctttttcagagccttctatttttcagtcttttgaatgtactcttattgctaaatttggaatatttttagttttgctgcatcattttttgaatttacctttctcccctcttttgcctattcattattcaaaaccagatcaaacactctttctgtgaagtcagtaacttactccttcagaaatgtaggtacattgaaattggtaaacattatcacactttgtacatacttttacagtgactatgtatatgtgtgtgtttgcaaaactttctgcctcattggacaataaactcctcaagtgcagagatcttgtgttatttatctatgtgtcttcagatactaaatgtggcacatagtagagctccatacatgtgtattgagtaataaattaatgaataaatatgatgctggtggcaggtaaattcttggtgtttactttgaggtccggatcaatacaggatcaggatagtgcttctcttacatctgtttgcacagcagaactgtactgcactgaccagatgtctcaaagtaatgtccatcttgcctggaagtgtctttccttacttggggtcttttaccttcagaaatccaggtgcattcacaatctgcactgttattataccaactctaggtgaaggatgcatgatccaaaggtccagagtttgaaagcttgcagtctgcaaaactgccctcacttctgatttgaattgcaagttcaggggtttctccaaatcactttcagatttgataatttgctcataggacttacaggactaactgaaagctgttggactcatcattgtgatttattgtaaggacaggatacagattaaactcatccaaggaaagggacacatggggcaaagtgagagagctccagatgtgtagcttccagttgccctctcccatggggtcaaataactcctccaggcaacagtgtgcgacaataggcacgatgttgctgacaacagagctctcctaagctttggtgtctgcggtttttggaggttgggtgggtgcttcagcacatacacatgattgcccatatatatatagctaatctcggtctccagcccctcaggagatagacctgagaccatgcgccccaagtcccacaacctaagccgcatcgttggtgtgactcacaacccccaccataagtcacattgtcagatattctggcatggcagcacccacactaaacaaagatgtggctcctactaggcatgctcctcctagggctaaaagatttcttcctagaagccaagagcaacagccagaccattccctgggcaagattaaattccttactgaaccacattttagttcttccacacaggtctcaccaaacctataatttccaagtgagagaacaggaagcctcatcttgctttcacagcttgagacaaggcaaaaggaaacgctgttttgaactttgtagtcagggtgggtgtgtttacaagggatacaatcccctcaagtcaatttaaatcaagaatctatatgtacagtggcatacccagggtatgtggctgtaagtaaatcgtgttttaactctctccctctactttcttcctctcaatgacaaaattattttcagtaataattatttaataatatagtaattctcaccatattttaaaattgctcttcagttttaaaacaatttacaagttagaagcatacatttcaattttacagctattattcaaattcagtagaaatatttcacatatgacctgaaatttgaacttaccaagcaaaagtattatataacacagacttctttttttctactttactgagtgagtggacacagatgaaaaattctaagttagaaattctaagtggtcctaaggaatgaccaaattgaataactcaagttttctttcttttgtcattacaatcagtgtgctatcactttttattttaaatgttggtttaagcaaatgtgtacgtatgtgtgagatatatatatatttcatatatatatatatatataatatatatataatttcagcattaaggagacattgtgcccacataaagtgataatgagactggaacattacaaacttactccttcaacgaatgcatgtagccaatctatgtgtgatgggactgataatataaccaggagctctccaaattatcattcatgtagaatacaatggtttttaaataatcggtaatagaagttattaatttgaggcttacatatgaatctgaaatgcaacaatgtctgtagaaattgtttagaattttgacaagatttgtttgtggatggagtttctttttaaaagattgatatataatattttacatatcagtggggtccatgtgatattttgttgcatgcataacgtgtaatgatgggtatttgggatatccatcaccttgagtatttatcacttctatgtgtaggtaacatttcaagttctctcttctagctactttgaaatatactttgttgctaactatagtcaccctactctgctatcaaacattagaacttaaaccttcttctaactgtatgtttgtaaccatttgccacatctctttatcccctcatcccacccacacacccattccagcctctggtatctatcattctactctctaccttcttcatgagataaacatttttagctctcatatgtgagtgagaacgtgtgaaatgtgtcatctgggtcttgcctatttcatttaacgtaatgacttctagtttcatccatgttgctgcaaacacatgattttatccttttttatggccaaatagtattcatatatatatcacatattttccttatccttgcatctattgatggacatttaggttggttctataactttgctgctgttgtgactagtgctgcagtaaacatgggagtccaaatgtccctttgatatattgatttcttttcctttggataaaaattcaatagtgggattgctggtggatggagtattttatcactgacattgtttagaattgtgaagggaaagcagaattaaattttctgtctctttaaactcagtcatcttttctctatagcacaaaagattatgttttttttttttttttcataactcagcatctttgtgagctatgaaacttgccctgatagccttttcttgcctagggtaggatatattctgaggaagggctgggactgcccatgcattcctgcagagcattcacgggtgctatttacagtcctaattaaatggaggattattagaaacgggaaggcagctataaatagcatggtccattttatctgtttctttggtgtgtaggaagagcattgctaagattctcccttgaagttcagttaactcagaatgtgttctgcttttgttattctgctttggcttaaaaaaaagtctcctgatgctgttcaaagtggggaaaagaaaacaaaaacaaacaggagtcactctcagtcattttagcatatggacagaaggaacacagaatgaaatagagttggggaggggtgtgcacggtataagaaaaaaaaatgtgggcctaatcctttccgataacttttttttctgaaaacaactattaataaatcttatttccaagtctgtagaatattggttctcttcatccaactgtaatgtgatcagtctgttcagggagcagaggagtgggtatgggagccttccctctccgtggtcctgttagggcaccttttccagggagtggggactctgctggcttctctttcagcacactggacggtgcagaaatcagctcaactctagaggcagtgctgggattggaatggaacttgacctggatcaaatcaccgagcctttgcaaattcctgattttccaagttaggacatatctttagacccagagcccttaatcttggctcttgggataagcttccttactgcttctctcaacactcatctccacctccagcctctgctctacaagctgccactcatctaccttacatctctgatccatccccagtattcaacagccttcagcatttcttggttacctgttttaaatttcccaagttcttaacctgtgtttataacaactcatgaacttccaaccaacacatcaactccagctccctccagtactccttctttcaaaagggttctagtcaaaggggtttgcaggcattgcttaagctcatggggtgttttcgtcaatgccccattggatttgttcatgtctttgtttctttgatatatcatccttcttctcctacttatcttaattgatctcaaagctcaagtcaaattatatttctcccagttggtaattattttccccttactttaaattctgaaaacgctaatgactgagcttttcatttagtactaactggatggttagttttctttgtgtatgtgatcgtttacgtggtcgttttgtttctcaccaacacattgtaaactcttttagaattgttatctaatagaaatataagtaacataaacctgtattatatttttggagcatctgaaagatttctctcaaatggtctcatctgatccccaaagcacccctctcaggaagtaatttttttatttttatttttggggaacagggttttactctgttactcaggctacaatgtggtggcacaatcacagctcaatcagccttggcctcccaggctcgtgattcacctgcctcagccttcccagtagctaggactataggcacctgccaccacgatgcccagctgtttttgtttgtttgtttgtttgttttttaagtagagacaaagtcttgctatgttgcacagactggtctcaaattcctgagttcaagcagtcctcccttgtcttggcctcccaaagtgctgggattacaggcatgagcaaccatgcccagctgaggaggtataatattatccatagtttcacatgtaaggtaataggagctcacaagggttaaataatttgcatcaaatcactcagctggtaacttttagatccagatttaaaaattctcaacttctgactatatcctatgttttttgtttggttttgtttatagcttgcagttgcttttataattattatttttttgagacggagtcttgctctgtcactaggctggaatgcagtggtgtgatctcagctcactgcaatctctgcctcctgggttgaagtgattctcctacctcagcctcccgagtagctgggactacaggcatgtgccaccacgcccagcaattttttttttttctagtagagatggggtttcaccatgttggccaggatggtcttgatctcttgatctcgtgatctgcccgcctcagcctcccaaagtgctgggattacatgcatgagtccccactggatttgatctttacaaattaatattagcacttgttaactaaaggaatgaagaaataagtgaaagaatgaaggaataaatacataacaacattatgtataacacagatgagtgtaatgattcagcaaaacttcattataatctcttcagggcacctcctggaaacctgagaaataaaactgttttattactggtacttgcctttctcgaaaactgatagtaaacgtcctgacaagttagtcttaggtatctttccttcagttcaatagcaaatgctgtttaaaagcaaatacacagcatttatagaatgtttttgcctcttcattatattttactacataaaaatctaaaacacacaaaaaagtaaaacacaaaaacagtctaaagtgtgacactgatttcagtacaatacatctagagggaataatttttctctaaattcccaggtggctaaaaagagggctctgtggatagatgtggaaagcgtgagacagatgcttctctgagcctcgggtttctcatcttaaaatagagataattacagtacctacctcacaaggttgtggggatttgttgggaggatctaagtaaagcccttaagacactgcctgggtataaagcagctatgtagcttctagtgtcttaacattgctaagaaaagaaacacacttgccccctttttgcagaagtaagctcctttagtgattttcatctcattttcttctatactttttttttatatttgttgtgagcacgatcttctcttttttaataaattcatatttttcaattatttttattattaaggtaagaagtgtgcttttgttggtggaggaagaaggaagcccctacatgcatagcaacgtccatgggaatgaatcactgttcccttcttttctatgaacttaagattatactcaagccactccagaaaatgaccatgcagtcactgtaagcaattcctctaaaattattaaaaactgtttatgtttggagaaaggcagcccctcttgcagtgataatgactgctatatgagaggattaagctgattacatctttggaatactgagattgtgcaaaatagagggaacgatgaactctccacataagctaaggaattcagcaaaaggatgaatcaacaggagagagagaatatgaagcctctatttggaaactgaacacgtagcctcccagataaaagtgagaaagattttgagtaatatctgaagtcatgtagctgagaagttccatctacacttgagaataaaaacaaacaaacatactctaggcgatgtctatgccagttccatgaagtcatcatagacttgcaatcaattgcttgggaaaatagattttaaagttgaatttctggctattactaggataattttttctcctggacattttatgtatttatgtatctactttggtcagggtgacaaatggtatgtggtatgcagagcttaactactactcctagcccccaggccccataatcttttagtggattcagccaagcagaaatgtatgttgaataaaaccatgtccagggggtgagcagaaagaaatgcatttgaggaaaggatattatgtcaatcccaaactcgatgaaatgttctaagagtatcccagagattggttctatgaatctagtgaaacacagaataccctactcttcacagatgggtgtttatttgcatgagtccataggcatgtgagcttttgttccttagctggaggattagagggaagaaatgacataggtgattagggatgggggagagctgggatgaatatggagaaaggttagagaatgcaggcggaagttgatggcagcaatttgacttagaaccttatgggacttgggacacacgcactgtaaccttgagacctagataacagtgttttatacagattcggagaatagattatttctcccacaacccagctactgctatgggtacagctttagtgctctgcgggctcagctgaccacctgaaggtgactggctggcttggagtgacaatagaagagcctatagcacttgtaagagcagggtcctcactgagattgtgcacagcagagggagccatgaactccctgcatgagctaaggaattcagcaaaagcatgaatcagcaggagagagagaatatgaagcctctattcgattaatgaacatgtggcctcccaaacaaaagtgggaaagattttgagtcatagctgaagtcatcatgtagctgggatattctataaacatttgagaataaaaacaagcacagcaaccaatgtcctttctgttctaattaggactaacttttgagtgctagagactagagggcaggcatagccctctatggagatgggccgttcaagttttaataaatgtgttgcatttgtcatcttagtatggcatgacaaatgatctattttatattaggagctgcccaaagatgttgggttaattttagtcaaagtgattttatgcccacaacatctggatgagtttggtcaaaggaaagaagtttagtagactcataaccagaaagatctttgtcttcacctggcctgccagacttctgagggagtaatcatgcccaatatagtaactggaaggacatgccacttgtttggaaggatagaggcatagcctgagaagataaaggtgaaatctctgaaaactttgataaagaggctgggcacggtggctcatacctgtaaacccagcactttgggaggccagggcaggcagatcactaggtcaagagattgagaccatcctggccaacatggtgaaaccccatctctactaaaaatacaaaaattagctgggtgtggtggtgtgtgcctgtagtcccagctactcaggacgctgaggcaggagaatcgcctgaacccgggaggcggaggttgcagtgagcggagattgtgccactgcactccagcctggcgacagagcgagactccatcttaaaaaaaaaacaaaaaaaaaaaaaaccaactttgataaataaaatataactctaactctagatagggaccgaatgggggtataatgtttgtttaagtttttgggagacacttgataacacaacctggatatggtggagagcattcacattccttttcagtagtagcctcttaacgatgaggtatggatgaacagcaaattgctgctgacttattaattaccatgcccacaccactgatttccctatgtcttacctgtgcacacacattggctttacagcatacgaacgccaagtttgtggcgtagcatatggtgctccctcaaataagcacaactgtctgcctctctgcttatctaatcatagcaacagaaaaattgacttttcagttttcttttccccaggccctgggagatgcatatgccaaatacttggcattctttgtaacagagtcaatcataattaggattccaaattaaagtacactgccagccagggcatgtggtattttatattatttgtttgaacaaatgtattataacttgaaaatggcaaagtaaaagaattaagtaaagctcacactttttatatgtaatcatcttgcggagttttattttatcagaatgttagatgaaatcagaaagcaaagaatgtaaaatagaaaaatgtatctgaaactttattcttttaagtaacaggtttggttttttgtttttgttttctttattttcattttgtttggtttttgaaatgctcattgtagaatgttgaatatggtcagatgttgggtgtgaagtttattagaaattaaccctgaaaaagtatggtatagtcattcagttgccttttccagtggagtctgatttggcctggcgggtgtagtgaaacattaactacacccgcctcagccacccaaagtgctgggatcacaggcgtgagccaccgcgccaggccctaaagcacatcttgattgtaggttgagggtgcagtgccaacaaattctactttcatggctcttgaaattctgtgaacatttaagagccactttgacacagccatttcttgttttttgagagagggtattattgaaattctttttaatccaagatttttgtgacaatttcattcattcctactttctttacaccagtagtagctattcatattcattcttctattttctttgcatgattaactggcatatactagttcttcacattattagcctaataatagtagttacaggctataataggctattaattcattatcatctcctgactcaagtgaatctgctggtaactgagagctcctactcttgtcaatggctttgatcccactgatgaccattttagtgctattcccttctcaccatggttgagccttttctacatattcctctcagaatggttgtgccagactttcacggggagccatttttaaagctatcctcactacagaatatggcagcatttcgttggcagtaaaatcagttaaactgcatatagaatgctttagtttcttctgaataaaatgtgttacacaaactgaagtcactgctctttttaaaaaccaaagcagaataaaccgttttgtaagataattttgccactataaatatagtttcctttggcttcttcttggaaagattttatttcagcttgcactgtgagatctttgtcgttttcaccacacatttccgtcaaggaagcccttggatgactgccatgatttgcctctgctggacgcttccttcaagggctgtcaacacctctcttaattgtctggcttaaacatcaggcgagcaatgtgttaaagttagatggcaaatatacttaagacaaatatgtaaatttttactctttcaaatatgcattcaactggtgtgtatagatttcagaacaaaagccagagagagagcaagaaagagggaggagagagaaatctatatgtataaatagaaaagccaaggtagaaatgctgtgtgtgtaaatacccaatttctggattaagacgtatcacaaatacatatgatcaatacttatgtacatgcaagtgtactgcctttccaaacaccagcaaatcttggtgagcagaaatcagtagactgtccatagtgggatctagaatttgaatggaaacggtcttcaattttaaatattcatctgttttcatttgtagatatgacactcactttaagaggtgatctgagttcaaattccctaaattatatttgcatttgacttattacacatattgttagttgtcccttgaattccagtttctctttgagtaagttcttagaagatatatgtagctaggtgacttatagtcacctcttagtcattctcaaatatgattataggctatttcagattcatttcaggaaaatgtcatgtgtcaaggtgtcaattctgagcaatttttacattttgccaattctattatagaagtggctctcacccataagtagcttgaaggagtcagtatgtaatgtgccagtctcattttcactttatgtgggcacaatgtctctctaatgctgaactgttatataacctgtggtctatctgactaccatagcttcgtagatcaaaatattgttatggtcatataaatgactataatgtgggtgttttagaattgcacttttgtttatgcataactggtcccaactcaaatctgcttcatcattttttagtcaaaggatagtttttcatgtcagtagtacctcaaactccgcttgtgaacttaacacccagctatatcctgttagtttttaatcaggagggaaaaaaaggctgctatttgaactaaactgacagcttttgttgatgagctgttaggcagattaaattctgtcttgctcttcaattgttcttgaggctctgtgggacttacagtaatagaattttatttgtgtcagtaaagttgacagccctgattcagaagaccacagggagctgagatgttgattaaggagcatcatattgaccatggcttaagtgggtaacaaatgaactgagagagaagactctggatctacttttgcctgtccatgaactcgtccaaagcaaatatgctttgagttttcatgtctgttttttaatttttgtggatacacagtaggtgtaaatatttgtggggtacatgagatgttttggtataggcaagcaatgcatactaatcacatcatggaagatagatagggtatccatcccctcaagcatttattctttgtgctaacaaacaatccaattatacccttttagttatttaaaaattctattgaggctggacacagtgacttatgcttgtaatctcagcactttgggagggcaaggcaggaggatcccttgagcccaggaattcgagactagcctgggcaacatggcgaaacccaatctctacaaaaaatataaaaattagccaggcatgctgacatgtgcctgcagtcctagctattcgggaggctgacgtaggaggattgcttgagcctgggaggttgaggctacagtgagctgtgatcatgcccctgcaccccagcctgggtgacagagcaaaactctgtctcgaaacaagcaaacaaaaaattgttaaatcattattgactagagccacccattgtgctatcagatactagcccttattcatttactctatttttttttgtactgagattttaatttctgtacttagtaatagctttcaaaattgtcatgttatcccaggaaattgttatttttatccaaggcttattccatttttttttccagttgtttggggcccacaatattgtttcttttagaaataaagttagaaatattcagaataatgaacacttaagagagaataaggagtagaatacctaaaaaaaaaaaaaaaaaaaggaatcaaataaggaagagatagatagtaaaagagaagtggatgtaagcaatttagaatatattttatcaaaaattgctttttaagtggcattttctcttgctgcagaagacattattgaacaaaaaaaaagcccaatgcaattcaatttaaatttatcactctattattttaatatatttactcagggttaacaactcattaaacaccaaattgctcactcttaatgagtctctgacgctaaaattgagctgacttaaattttactgtaaaatatcagcaccattgcataaaactgtaataaaaattaactaaaagctattgaatgactgtggagtggaaaacagatttgtgacacaaaacagaaaatgtagcacacgatatgtggctggcagaaacatgagtaatagcttttattcaccaaaacatgataagcccatttttcttttgctgtattggagtctgtgaaacatgaagtcatgttttctttttttcccccattactttgtacaacgagggccagtggtggaatgatacagtttggctgtgtccccactgaaatctcatcttgaattgtaactcccacaattcccacatgtcgtgggaggaacccagtgggaggtaattgaattatgtgggcaggtctttcccatgctgttctcataatattgaataagtctcagaaagtctgatggttttaaaaatgtgagtttccctgcacaagctctctctctttgcctgctgccatccatgtaaaatgtgctgctccaccttgccttccaccatgattgtgaggcctccccagcgatgtggaactgtaagtccattaaacctttctttcttttgttaaaaaaaaaaaaaaaaaaaaaagattatgatagtgctagtcaatactgagttgactgtcaaaaataagcacactttacattagccagttacttctgggacactgttgaagagtatgtcacatgtacccacaaattagtcaaacatctttaggcatcacatgatatctaaattagtctttttctccttctccatcccctggttgtccatgaaatattggcctcaaatcagcttgcctatggccaccatggaaaccatccatcatgaacagcacctatgcccctggtacaggagtgcatttctccccaagcctacagtcttctgtgtgtcacagcaatgctgagtttcccacagaggtggcgttgatggactctttctcaactctttgctatggagtatcacctgggctaagaagttctgcttttgcatcaaatttcaatttttttctttttattggatttgaattgttctggcacttttgccactatgctgtctctcaagccctaccatcccctccatctttctaaggtctctcagaaccttagctccaacaaaacccccttctttttctctcattataacacaaatttcctgtgaatatcaatgaagcaaacagatacagtgggagctcgtgaaagacaaaggacaccgagctagtattttcattaacaacatgggctcttgtactgtcaaccaacaagagctttgttataaatttattcacaatggcaatggctttgggcaacatttagatggaaagtatttatgaaaaatatactatttatgtttctggataggaaacatactattcatgtaacaaaatatgacatttaaaggaactcactttttcttttttgttgacagtcaccgtgtcatcaaggaaatcaacatttagaaattatgattgtcactagctcactctgagccatggctctacattttatccttgtcaataagcaatccagtgttaggattttaaaaattgtttaaaatatccgtacaaagagttattttctatcttggtccacaaatttgtcaatattttccacagcatcacaattgtcagaaaacacagtgaagcttaagttaaaacaaatctgcaaagaaaaagtcaaaaagaaaactcttccacagattttcagagagatgatttattagtccaaatttgagcattgaaactagcctatattctaagtttaagaaaactgtaattttcatgtttctttcagttcaatacaatttatatattgaatacaaaagagattttcacttattgatatggctttctaggtgtttaaattctaactcaatattttaaggattcagtaatagtagggtttccatttctacatggtaggcattctctagtttacttttcctcttctttctgtagaaattaactatttttgcttcacagtcatttcatgatagacccgatttcttacactgaaattcattttaatgtttggattgagcaatggtttgctttggtcttaacttttatttattgaggtataacttacatacaatgaaaatctcaaatcttacatctactgttcaatgagttttgacaaatgcataccattgtggactccatccacatccctataacaaagcagggaactttttcaccttttcagtaccctgtaaaagttacctcatgcccaattctccccttcctctaagcaaccactgatctgatttctatcaccatagtttactttttcatgttctagaattttataaaaatgaaatgatatattgtatccttttcttgtctggcttctttcactcagcatactgtttctgagactcagcggattgctttttaataatataattacaactgagtctcaaagatttgaaaaagtcagaatttcttataaaattggacattgtggtttgctacctgctgaatgatgaagacgaataatgtacttcagtgccctgagatagtttttgtctactgtaataaaatatttccagtcttctctgtttttgcattcttcaattattaccttgaagttttaatgttttttaaaataatgaattggcctaattgtagcctcagcacaactactaagttacacattcaataaaaagactttttctttgtaatgttatatgttaatggtcagcctcctagatactgatgaagcccatcaatttctactgatagttaagatcaattaaccaattagttacccattttcatttttcctgtatattctttgtagatcacttactaaaatgattttctaagaccttcactttcttaagtaaagaaaaacaatttgactgagacttggccatttagctaaaatctaaaagacctatttaatttaaagtataagtcaagcagagatcttatcttctgtccataaataataagaatgattgtttttcgctaagtggaaaaagtgagatgaggcaagaagttgaagaatgcctagccaggtagcatatgaagcctacaagtttccagctgtgggtctgatgaaaaataatgagacatctgatggaacttaggatcttatttgaaaaataagccatcaagtactttaactttctggtatttcaaaagtaaaaacatatactaatcacttgtttttatttcacttatttgacactacacatctgtcttagtacaaactcatgtttatgcaatgagatttattagactgatagttcatatcttagccccttttcatagagaatcattgaaaaaaaaactgttcactgtgagaaaactctctcccctcactactgatcgcttatagtaccaattcagtatatgagaagacactatttttacaattattcacatccttaagaaaataaaactctataatttaaacaatgggagtataaaggtattttagaacgtatttgtatatgttaaaacaacagcatattaaaaatttaccttgagaaggccgggtgtggtggctcacacctgtaatcccagcactttgggaggccgaggcgtgcggatcaccaggtcaggagatcgagaccatcctggctaacacggtgaagccctgtctctactaaaaatacaaaaaaattagccgggcgtggtggcgggcgcctgtagtcccaggtactcgggaggctgaggcgggagaatggcgtgaacccgggaggcagagcttgcagtgagccaagatggcgccactgcactccagcctgcactacggagcgagactccgtctcaaaaaaaaaaaaaaaaaaaaaattaccttgagaaaaacaagcaaacacatgaacctaaaaaggcaacagcagatatagtgttgattgatccactgccactccagaattatttatggtagcaaaaataataattttcaatttgatggattcttatttaagcagactcattatactttttggaaaataaaatattaacattcaatataatatgactacctcagtcactttagctccacaggtgattgggatagcgctgctggcctgaataataaaatggtaataacctcagttagaacaaataattgttttactagttcagatacacttaacattataatagatgccctcataaggtgctatgtataaatcctttttttgaaaaaaagcttgaatcatcatgtaaatgttttagggcaactcattgcttagagaaatcctttgaagttttcttttataatgcaaaaactcctactgccttatctgttttgtaaattaggttgtattcgtaccagttttgttgaaaagtgaaacatccttctaagcatgaaagttttagaaataatgtctaagtatatctaaagtagctattataggacataaatgcattgatattttagtggatctcagtctagaggtgagaagagggctaatcataataattgggactgagtgtgttagaattacacatctttcccctgctctgataaaaaatatcctgccatagagagtcactgatactaatcagagcatgtcatatctttcagatatttggggacagagaaaaaaaggtgatgaattacagtactagagatactatagcctttaaaataaatattatatacttttggttctacatacttttaaatgaagatggtccatgaagtaagttatgatcaaaactaatgcaagggcttacagcctaagaagaaagtccagaatttagagaatggtgacctgtcttttcttggcaactaatattatgaacatcaatttctcatcactttgtggcttcaagaaattctcccatcatagagatgaatcacctttcttccaggtcttcaaaaaaaaatatatatatataaaggtctgtgggagataagcttagaaacagtggctgaaaaggagaaaaattcagatttcagtcctcgggggtttgcataacaaatgatgaagtatagttttatagctcatctaagtaccttggtgcttcttttgggtacaagtccctgtttattagacaggcatggtgacttctagatacattcttccaagacatcaagataattttacttcttagttttttcacatgttaggcaattccaagattaatcgtgtataaacttgtttgacacttgaatcaatttttggttttacataaacggcattatttcatgcatacctcagctgaaaattggcagttatgtattagtgcttgattttctagaccagtattaaaattaccttccaaaaatgtttcagttgcagaaagtattggtggccaacaggtcttccatgagtcgggacacattagccagtgtcaccctttctctagccagtcagttctatgagaatggtattggaagaacagacaacctacctgcagcacttgccctgtcctgttcatattgtggacaatcatcaaaagataaaagggcatatgaaagatttatggtaaatgtcttccattttctctgccttgagtacactggagttagctttcattttcatagttgcttactatgaatgtcttagatgtagcatgagaaaatcttatattttctttttgtctagaactctgctgttcaatatagtagtcactagctattacataattaaaatatggctagtatgaataagcagataattttaattcttatttcagtataatttccatttaaatttaaaaactcaagcagtgtaaaatagttttcatcaaacacaatttttgttctaataaaactatatttcacctaaagcactgaaaatttagcattgagtttcagtgtgctgttaagtataaaaatatactagattgtaaaaacttcatatcacgatataaattatctccaacaatttttatatacattagatgttgaaataatattttgattatattgggctacacaaaatacattattacaattaatttaacatttctttgtacagtttttaaatgtgaatccttggaaattcgtaattgcatatgtggttcacattatgtttctcttggacagtgctgagctagtacattctgaaatatgtagcaattatttctctatggcttcataaagaaaatgtcaatccaaggctgaggatttatttatgaaaatctaaagacagccggttttcctgatggttcatgccgtgggggaacgggtctctttcccaatatataagaggacaaatcttgggatgggttttttttttttttggtcttttatgacattctttaatgatttctcctgtgcttgccattctgccttgtacgtaatacaccctttctagcaatgggtttaaaggtttttccttcctctcctttttgagctgtaaaatatgcattatggggagaggtgagctgatagttgagaaaggtcattaagggttcagcctggcttagtcggaaagatgtgaattcaaattgttattctcccagatatatactaacatgaccttggggaaattgcttaacttttctaaattttagtttgcttcatctgaaaaaggtacctaatagggaagttttagatattaaaatcaatgaaatttaaaagaatcaagaaatatgataatgcctagtatataacaggccctcaaatgtgttctgaaccaagagatccctgtaagagttaaagaaacaggaaagaaacacgaaaagcggctcaacagtcaaagacaggttaattttgcagaataaacctgagaggggcttctggccaatttttggacaggagcactctctcttacagactaagagtatttattggttttagggcgagagagctttatcacaggcttggaatgtttctgtgtgggggagaaatttatggtggggttggaatgtctctgtttggaagggaagttatcctggggctgacctgtctctggtcggggaggggtttatcttatggttggaatgtttctggactgggatgttatttgtggtttatggtcatgctgacgttagccattaagctgatgccctttggatttaggcagtttttgatcaaggggaactttagaatggtggtgcttgtccaagatagccatgctcccgctgtgtcaatccccaagttttaaatgtgtatctttacttagtgacttatggagtcgtaactattaggacacatacagcagtaagtctaaggcatataccagcttatcagatggatcccctacctggcaaagggaagatcctctttctctactaccttagtccttctttttatactctgtgcagcttttcagttcttccacttgcattaaaattagattacctcttagattagatcaaaagattgtccctggttgtgagaagaaagaatactttaatctagcactaatcccttaatacaccattatatttgggtacattttttttcctagcagaaaaattatttttcagccttctcagaagtactaaaagtcctttgccaacatcagcccagtgcaagttaacctgttatgagatttgttttgtgctttggaaatgcttgtcagacaagctttcaacattgagatgtgtgatttaaattagtttgcataagaaaatgtaatgccagggacaaatttctctctttatcccttcttatactacaaaacagacaaagagggttaggtggttgctttttagtatgcgagtaatcacttgggattcacagaaatattagatgcagtgttattagtgaaaccttagttccctttatagatatgtcttatgtcccatttgtaatattattattgttgttaccatacgcaaactttatttcttagtttggatgcttggtctcaaccagacccattacctccttatcttcctatctcttagggtcacttcatgcttagaggcaacttgttgaaagtggaggtcagcgtgatcctttttcttagaagacatagccctttcatggaacttacgtagctgattcatagcctgagtcagtctcttggatctgtgaaaaaaaggaaaaatgaaccagacatggtgtttgcagtcagtcttctttgaatataaaatatataggcagaggaaaaaattaaaccaggcagattaacctcaaggcataaagacaaatgctaaaatgtactctaacgtgaagggttaagcattccaagatgcccgttggaaggttctttatccaacacttctctacccattccaaccccagtgtaaacattaaataattcttttaaaatttgaatactcaaacaagaaagtaaagcatggaagataatttttaaatcattatgtagtgattagaggaagaggaataaagggtaatgtgagattttagaaataggtgctttgaatagataaagagatattgcaaggatagatgaactcactatcgtctttgcagtatagtatcgttggtgcagaggatttgggatagaaatccagtctgggggccgagatgtgatcattatgtgcaatatcatcttcaaaaagtcaggtcatggttatcagtttgctacaaagaacatcttagtctcatttcctgtccaaggcaggaattttcccctgaacattcctgacagaagataacctgttttgtgctctaatcacccagtcttctaccagaggttgaagtgacattttggctccattttctcgtattttatgcaagaagctgggaattccagcatcttactctgctcatcagggatcctgagggagctggtaatatgcagaaaggatgtcaaagggccatgttactaatagctgtggaagctccgctatccacaaagcagagattatgaaacagtctatactttggctagaagcctaagcagaatctcttctacttccctcaaaatctatttcttagcaccagcaagactgggtctgtccagtgggttgtgggtttggggagaagcagaggaaagattgacatcatgtggaatctggaagagacagaacacatctcttggtgcttttgaaggtacagtgactccatctagtagtaaaaggtgttcaaatgaatggcttcaaatttgaccagattatcaaatgctgcttccctgataaacagctcagacatgggttagaagaggtggccctgggatgggaagcagtgcagactctcatgtatgaatagctccaattctcaaaaaattcttttagttaactgctgtctgtcttcttctacattgcactcaagcttaactctgcacttttaaaatcaacatataaattataactttctctcctatgataacttttcaaatgttttttgacatctattcagtaccgagctcccttttgaaaactgggccatcatttcccaacctccaatttctgactgtatttccataatttatttaaagactcctaacaatggagccacaatcataactacaggtcccctttatatctcaggatgacattcatttggttctaatccttgaactcatttgaagattctaattgctcttgtattctctcctcttctatctggaacttatctccctgataagcatctgtgttgtgattcttctagagtggagattatttctcttgtaaggaaaaaaattaaaactaccttgttctactttctctgttgcatcacaccttctctcttaagtaatagtcctaaaccttctctgttcttctccagacagatcataaatgttacaccccaacctaaaacaaaacaaaacaaaaccttccttcatgaattattattggccttgtatgcaagactgagttgatcccagtctcaatttacctgataccatctatttcaacaataacaataataacaacaataatgaatatttatttagagctttctctgttccaagcactgttctgaccactttatgtatatttacttggttgactctaacaataattactgaggtgggccaggcacagtggctcatgcctgtaatcccagcactttgggaggctgaggcgggcagatcacctgaggtcaggagttcaagaccggcctggccaacatggcgaaaccctgtctctaccaaaaatacaaaaattagccgggtgtggtggtacacgcctgtaatcccagctgtccagaaggctgaggcaggggaatctcttgaacccaggaggcggaggttgcagtgagctgagattgcatcactgcactccagcctaggcaacagagtgagaatctgtctcaaaaaattaaataaataagtaaataaaaataaataattactgaggtggctattactaatttctctattttggtgatttggaaactgaacttagaagttaaagggcttgagcaaatacattggactaaaaggtggaggagctgaggtttgaagtttcaatgcaggcatctggctccagggttcatggtcttttaccatgatgccatgctgctatgtctacttataggagtatgcacgcttttatgttctttcctgtttttgtgagccttattctagcttttatatatttttaaactctgagctccttagagagtttccaatggccagtcaaatttatttaggtcctctgaatagtctctgaatggaagaaagtgtttttcatccctaaagcccacatgtatacttcagatgcacaaggttcaaggtcagggcctgaaggagaaagtatcacagcacaagtaacaatgttaaacttcaaaggaagataaaacctcaaaataagatattaaggtcaaatactagaatctgcagggacactgtcctggttaagaggcaatagaaaggaagtagcataaggtgattcagcaggggagagatgtgagaccaacagcgttagatcagtggggctgtaagagagactctccaaattcatttatggaggagaatgccagaagagtggggagagagtgagctagagattcccaagtcccctggcaacgcgaaataccaggggtactagcacccaggtctttgcttctaatgccattctctaatgaaagggacaaggcatccttggaaaaatggctaattctagcacagagcagggaatagacaagatgagcccggagaatctggtagtgacagaaaggaagaaaatgcagaaagaaaaaggaaggaagacaagggaagggaagggatggtatgaaaggaaggaagaaagggaaggaaggaaggaagtccaatgaatgggattggggtctatttctatctgtgttcttaacaatcttcttcatcagggattagattcttgtttttttctttgttgccttttttttttttttttttttttgagatggagtctcactctgtcaccacgctggagtgcagtggcgcaatcttggctcactgcaacctccgactccgtggttcaagcgattctcctgcctcagcctcctgaaagctgagatcacaggtacacgccaccacgcccaactaatttttgtatttttagtagagacggggtttcaccatgttggccagaatggtctccatctcctggcctcgtgatctgcctacctaggcttcccaaagtgctgggattacaggcaggagccaccgtgcccagcctgttgccttgtttctgatgggagtccaagaatctccaagctatctatatgagaaagacaaaactactctttctatcctgtactgtaatcctacctgacaaatatatccttcatgctccttgtcattttgagcaaatagcctgagcttacctcactttcatttgaacttcctccctctttattgccaaggtactacgttcctttatctctgtgcctgaacaagccccccttgctataatcttcatgctgacccctcattctctagagtatatgctgttttctgcagcagactacacggccagtgcccttgcttggagcagatctagacatcatatcgccacggtcttcattctgaagtaaccttagaagtcactttcagttcataacattaaagcacaggttacaactcatatgactacatgggccatataaaataaatgagtcaatgtgccgaagatcaggaaagtgatagctcaggcaagactgacactaattcttggcctctctgtctaagagacagaagagagtgctagagactatggcacccaggagaacccagaccgaagagggcagccactgctcagctgctgccagtcatcacagcacaggagcaatggaccaatattatgaatttatcttcttttgaaagacaatccagaagtcgagacttttataaaaagtctgaattcattacctgtattaaattttctttgatttaaaacactgatcaggctaaatacaacatacctgtaagatattacatacctactgcaagaaccctgcctctgcatataaaggagaaagataagcacagttgattctcttcacaagccctgtgtcatgcaaacaggattaatagcccagttctaggctaacaatttcatagcaaccatgtggttattatgtgttgtatatatgaaattatgccataatgagctgtctcctaacaagattgtgcaggctataaagctgttttatagctccaagagagttgctcctgagttcattgacagtgcttattgtttctttccatctcagttacttttgaattaaaaagtgctcaccctactctttcttctcggctacaagttttgccatagtgcacagtgtttcttcatcttactttctttaaagaacctttcccatctcttcagttatttctacctgttccaacctccctcctgatagcaccccagtagtgggatggaatgtgctggaggggtttggccagttcttgggggagtttcacagtcacctgtctacagtttcagtgagatgggaatttatcaagctgaaattagcaaaagacaaaactgacattgtttaaacacatacttaacaaaagatctaaccagttcctcctagaactagaagatatttgaaaattagagaggagcttttttttttttcctatcgctttctttaaaacacacttttccatagataatcttatctttttggcatcaacaattatttataattctggaatgatttccaaatctaacttgtaaccatatttccaactacctgccaagtgtctgtgctggaattacctaatggcatttgatcgtggctcaaatgtgctcactcaactttattccgtgggctgctcacctcccctgtgtggagcctgggagcctctgaaggcaaatcttgactcatctctcacctctcaactgatcaaccagtagccacacctgacttaaatgccatctggaatccagttctctttcagctcttccatttcttacaggaacttttacagtaacttctgaactgttactcttgcctctgaactgcctcctttccaatttattattcacaagttccctggagttattttctttaaaacaaaatgacagctttgtttcgttaaaagactgtcaggttactccattccattggccagagggaaagggacaaagcaagtacgtgcccacacaatctctttactgtggtatttggtagctaatacatctttcaagcctcatctacttcatcgcctcctgcaccccaagctggaattacatgtgtcttattgccctgtccctgcatatcttctggccttatagacctctgtgcctttatctatgtcgttccttctacctcaacaggtttctgtcctaccatggattgtctaatgccttctgcacatgttctttatcctaggaagcaaaatatttattccttttcctgcattctttaatacctagtttatgcatgtctcattgcacttattctaatcggagcttgttcttgtcattttttttcatatttttttccttttgtgggggagtttaggacccaagtctttgtcctcttttggtttaactagtaccttgcacagaaaaggtagtcaataaatgtttgaaaaaaaaaatcccagtttgataattagttgaaaatttcttcagttaatgaaaacttggtacaaccaaaggaaaatgaattatcagagtttactatgctccatgagattcttttcatacaagtatgctgcagaggaatggaagagtgggaatataaataaatatgaaaaattcttagaacaatcttcttattatttgagacagagtccagctctgtcacccaggctggaatgcagtggcatgctgttggctcactgcaaactccacctcccaggttcaagcgattctcctgcctcagcctcccgagtggctggaattacaggtccccaccaccacgcccagataaatttttttttgtatttttagtagagacggggtttcactgtgttggccaggctggtcttaaactcctgacttcatgatctgcccgcctcggcctcccaaggtgctgggattacaagtgtgagccaccgcgccctgccagaacaatcctattttctaattggggtttttctttgttttttgtttctttgtttgtttgtttgagatggagtttcactctgtcaccgaggctggagtgcagtggtgtgatctcagctcactacaaactctgcctcctgggttcaagcaattctcatgccttagcctcccgagtagctggggctacaggcgcctgccaccatgcccagctaatttttgtatttttagtagggacgaggtttcaccatgttggccaggctggtcttgaactcctgacctcaggtgatccacccgccttggcctccaaaagcggtaggattacaggcatgagccactgctcccggactttttttttttttaatccttctactttactcatactctccaaagttaattcacacacaacctccccaataaaatggaagtgaggtttaaaatcagaccataatttaaccagctgaccaaatgccattttgtataagaagataaaaagctaccattgttgttatatctcagagcagaagctctttcttcattttattctttaaaaacatcattcagggttgggtgtggcggctcatgcctataatcccagcactttgggaggctgaggcgggcggatcacttgaggtcaggagtttgagaccagcctggccaacatggtgaaaatctgtctccactaaaaatataaaaattagctgggcatggtggtgggtacatgtaatcccagctactcaagaggctgaggcaggagaatcgcttgaacccaggaggtggaggctgcagtgagccgagatcaagccactacactctagcctgggcgacagagtgagactccatctcaaaaaaattttaaaaataataagtaaaaaataaaaacaccattcaatttatagttagcatgaagctacaccatcaatctttcctcgtgttcatgatcatggctcagcatttttctgaagtgtcattaataagccatgttagcaggaatgacctacacatatgcatgtcaggagggcttcaggccactgctgtctgtgtgtcaccttgacgtcagccttgataattgtccagggcctccaacttcacagcagtacctgggcctatgtcaggttgagttctatgatcacacactattttcatcagaaattttaataaaattatttttttctcagatgacttcccgcatactactaagtgatctgggagaaggagtcttagggtgtggatgggattctgccttgggcatattttgctctactgggccctggagtctttgcagatgctgtcaagatactgcacttttttttcttttttgagacagagtcttgctctgtcacccaggctggaatgcagtggcatgatgtcagctcactgcaacctccgcctcccaggttcaagcaattctcctgcctcagcctcccgagtagctgggactacaggtgtgcgccaccacgcccagctaatttttttgtatttttagtagagacagggtttcaccatgttggcccggctgctcttgaactcctgacctcaggtgatctgcctacctcggcctcccaaagtgctgggattataggcatgaaccactgcgcctggccgatactgcagttttgatggccatcactggtacaacaccctgcgtatgccaagactgtcatgccttgtcagctataataaaaagcaggagacaaatggccttttgttacctgaaatgatggatcagtatgtatgtgcaaggatgcacgctgtcaagttcttgtgggttaatcatgccaggctgatggaggggctccacgagttccaaagtagaaggagcttgaactccaggctgtggctttgaagcagttgttttctctggaattagctaatgaggctctctttgtttgaggattggaaagcctccaaaaacccactcaggagggaaattaacaaatgtctgttttgttacctccggataaatcttcatgatgaaatgtgcagccggtccacctcttcaatcttctctcttcttcttcctcagtggaagctcaattaccatgaaggccaaaataaataaataaataaacaacaaaccaaccaaataaataaataaagcagataaaccgtggttctttgcttaaaaaaagttgcagcaaagaaaagctttagagtaatttctagttagaagtggctgtgagattcactgtcttctggtgatatttgaaatatactatattcatgcaaatgtttctgattatttaaacacattatctgtatctataattatcagtagctgctggcattatgtgagcatgcaaaagtgggaacagcagcagtaacctgactcatttcaaccaggatggaccatctcagagggtcacagttactaatctctgcatgaactagattttataaggtattatgattctttcatagcttgtaacttttcattgatcatcaactttactgatttttgttaatactggaaattttaataaatgggttgtgcacaggtacttattgagcatctattacgtgccatagaatattctgattattaaggatgtcaaggtatataatccagagtcacggttttcaaggaactcagtcaataattacaagctaatacatgggtaccactgttctaggcacagcgtggcagaaaagaatagcgtggacacacattcaggggatttaactaggagaaaacagtaaggaaggggatcttagcagaggtagtatattaacagatgtatatgacaacttacactgctgtaagtcatcctgtttggctggcaagttttgctttagaaactgggtaaatattgttcatgaaacttctgtgtaagtttcacgtgaatgttttcctatgtgtatgtgtgcatgcttatttgcatttgtgtgcacttgtgggtatgtgtatttgtcctgtgtcacaataaaaggtatctatttctggactttgcagtcaaaaacattggaaaactgtctatgtaggtaatggacacaatagaatttagaaagcaacttttacaaacattgcagatttgtaattttctaatatcattgatatataaagctgagtataccagacacttgtaaagaaatgatcttttccaatgaaaacacaggtgttaaacagaacctttcttctggcctacaaatcactcttctaacacttggaaaaaattaaagaaatattcagcaatgtgtagaatttcaatcccagagagacaggaagagactgtatagctgcagatgcaatatgcttgttattttggcaaaagcgtaacataagaagccaccaactctcacagaggaagcagagaaattcagtatttgcttgtaacttagatatttctttctttgttttccccctaagaagaacatatcttttctggtgggaaaagggaatttagataattaaagcagagggaataaacattttcaggaccaaagagaaaatagccgtttgagccacatatttaaatgttaatctacaatttttttttttttttttgagacaggatttcactgtgttgcccaggctggagtgcagtggtgcagtcttggctcactgtaacctcccttctcccctcttgggctcaagccaacctcccaccttagcctcctgagtagctggaactacaggcatgtgccaccatgcccggctaattttttgtcaagacggggtctcactatgttgcccaggctggtctagaactcctagactgaagtgatccaccagcctcagtctcccaaaagtgctgggattacagatgtgagccaccaccgtgcctggccatcaaatgtttttcatagtggactagggctttatgatcccataaaaattatttccctcatggaaccactccatttatgtattataaagctgtcaacatctggttttattgataaatatccctggggtttttgagctttttcttttcaacatagtgcctgtgttttatcttgacctttgctttaaaattactgctagatgtaatgaggattctggaaagagcatggttcaagattttgtacaattgatataatgattctgaagcaaataatgggaaaggggagagtttcagaatttggtggccttagggtaagcttatgatttgttttatctttcctcatatctacctaatgctgtgaaattttgggattagatttggattggggacaaatgaggagtggaaatagtggagggagaaagggttaggaaagttacagaacttggcaaggctcttggaggtggtggattgatttctctggtgttgtgaagtgtcatcttctttcttcagttaaactgaagtacaggcaagcttctcctgctgcccctcagtttcactgtgtcaccatttttagtagggataagcagagacttgttgttggtaaggacaggaaggaaggtgatgctgatgaatttttgctggtgctaggttagctgccagccggcctggcaatggctgtggtccagccagcctggggcgcttctagtattctctgtcatggggcaatatgttaacgaattaaaatgccaaatagaaatgagacagaattccaaagacatgtaaactgaaaaacacctgtccccatttgttgattttttttttcctgcatatacttaaaaaaccccaaacctttatgtaagagtctcaggagtgcagtgaaaaaaaagtgtttattgacgagccatttccaatttaggccttaaacttcaagacccatttctaagacccatatgcttcaaaacgttctatataattcagctcaaaaggatcttcctctcctctagatctataatgtttattgactacatccctcaaagagcagtaatgcatcatggtgaaataaaaattgaactgcaaatccgaagacttgaattctagttcctgatcgtttttcatagtgtatttaatcacacagtttaacccctaggtctccttcactgtgactcattatggtgagttcgcgtgagaaagtgtccaccataggacactaaattcaaaagagtgaccagtaatgattgttgtcccaaggatgtccaaatgggaaaaccattatcagtctacactctaaaccagaagggacttattccaccaaaagaggttaagggctccttaccacagtcacaaaaccagaatatatattctttcagagaaaacccggatacagggcatgagattagaaccctagaatggcatatcaaaaacttctggagtctgttgagtagaagtttggagaataaacaaattgatagattgatatttgaatccccggcagagtaagaggaataataagattttgaatcaagaagaggaattctgccacatgcaactaggaagaaaaaagcaaattaactgtgataacactcattagggattatcattatatctttaatgaggaggtaataaagactgattatttactaggcatcccttattgatccctatttatcactacgtagagtaaaatgtacaatttttcctttcacttgtggatttcattaatttatacagtcatcacatattgattgtacatatactgtataccagacactttattagctttaagaataccaaaacgaatatgccagatatagtatctaacttcatggagtttgtagagagattttttgaactgaatttctcagcaaactaacacaagaacagaaaaccaaacaccatgtggtctcactcataagtgggagttgaacaatgagaaaacatggacacagagaggggaacatcacacactggggcctgtctgggggtaggaggttgggggagggatagcattaggagaaattcctaatgtagattacgggttgatgggtgcagcaaaccaccatggtacttgtatacctaggtaacaaacctgcacgttctgtacatgtatcccagaacttaaagtataaaaatgagaaaaaaagatgcacaaatagtgtcacatatagtataataatgatatggatatggcctaattcatagagtcaacattctgatactaagaggaaggaaaaatcaaaacaaaataaagaaaaaacaaagcagacagtagcctttaaccgtttccttttaaagaaacattgttatctgggttcattacttgttagaaagtaatgtgaagcacttaataaacttcaggtggtggtattaggtaattaacatgtgaaattcctcatatggttatttaaatttcatggtagtatttaacagttttcatgtttatggccttttcctgcaactaagttgtaaaatccttaagggaaaggatgaggaaaggaagacaagagagaaactagcatttgttgactggctactacgtgccagccacagcactagctactaaacctgtgtcactttatttaaatatgaaggtcagaaagcatttctcatgttcctggtatctcctgcactgcctagtataatatttcatacttacaggtgcttcatcaatatttgtgttggttgacttagcaatttaaactgcttctaaatagagttacgtgagtttttccccaaagactcatgcccttttttaggaggcaaactagccctttccatgtcaccttccttaagaagcagggcaaagaggtgacagtttttatactgaaatcagttgtttaattgttcacccatttatcaaagcctctgtagagttaaagacaagtacagtgcccatgtaccctttatgctgcaagttctggacagatagctgtcaatgcctgaaaatagtgtaaattcactgggtgaagagagcaacttgccagggggatgtgatgtagccccttctagagtatggggttttctacttgggcatagtcagctgctagtttgttggattgctgctgctggggaaagaccaggccacttcatgatggaatgcgtcaacttttggaaagtcaaattcaggatgcagtttcaactagtagtaactatatttttctatcttttaaaaagtgaaggagcaacagaccagtctagacacatggacgggctttagggctcagttgctaaagagatagaagtaaaatattatagaaaatgcttatagtacatgttaagtgagaaaggtaaggtaaaaatggtttatgacctataactgtgtgaaaactaaccaaagagacacgtatcatttaaaaagatttaatgttgtgcctgtaatcccagcactttgggaggccaaggcgggcggatcacaaggtcaggagatcaagaccatcctggctaacacggtgaaaccccgtctccactaaaaatacaaaaaattagccgggcatggttggggggtgcctgtagtcccagctacctgggagactgaggcaggagaatggcatgaacctgggaggcggagcttgcagtgagctgagatcatgccactgcactccagcctgggcgacagagcgagactccgtgtcaaaaatgaaagatttaatgttggtcaaattatacacaacgattcaacagtactggaagttgaggaggacgagcaagccagatagcaccaatgatcatgaataaattccttatctttcagaaagcattattgttcagtggtttcaagttttggatgtgcactcacattgcctgtatggaatcctggctccacaagtagttgtgtgagattgggaaagttgcacttgtttaatctgtaaaatggaaaatatctgaggattaaattaaaatatagctggatcatgcatagcataatacttggaatatactaagtcatgaataaatagtactgttgtcatttctttgacattaattattaaggcaattaggaaattttccatctagttaacatatagcaaatcaaactaagctgtgaaaaatatataatatgctatggtaataagacactgaactgtgatgctattattggggtctgtctaaatccacagaagcatcagaaattcacataaatcaatgctaatgtcaatgcctagtaaattatagtctcagaaacatgaagattctagatgttttccccttctttgcacactttgtttatatttcaccctattactattatcacctatatttatggtttttcaatcatttgtgagtgcttggaggaaattcattggttcagcagttgaaccagggtattgaatagtacatgaggactctcagactctgaagagctggtcgggtgtctctggctaacacatttccagtggataaagagctgctccagggacatctccttcctctgcagtacagtgatctttttgctggtgactagaaagtccaggggaaaggacagccagccaaagggtggcaaactgatggaaagtgggggcaagctttctgtaaccatgtaaaagaaactgccaattcccatgaaaatccattgtctctttttcttattaacaaatccccaacaagccaccatggctcaagcctgtaatcacagcattttaggaggctgaagcaagagaattgcttggggccgggagtttgagaccatcctgggcaacacagtgaggcatgcatctctacataaaaattttacaattagtctagtgtggtggcacatgcctgtagtcccagctactcaggaggctgaggtggatcgcttgagccaggagttcaaggctgcagtgaactaggatcaagccactgcactgcagcctaactgacagagcaaaatcctgtctctaaaataataataattttaaaataaaaataaaatgctaaaatgaaccaaatctccaattttatttgaaataacactgccttagttttttaagaaagaaaataaaacatttctcaccttttctaacagtcaagctggtatgttgctttaagtttggtgagtgtcaggtatgcaaaagtgttgagtggcagatacagaaagactgcttaaaggcatctgactcagttgcaaaggacatcctttgtccttcttgctgcctgtactatgaatgtagtggttggatcttcagaagcctatttaatcataaggtaatcttaaagatggaagttatgattaagaatgccagaacacaaagataaaaaatatagaagtctcagatgaaatttctgaatcagccttaaactataatgcttaaactgtttaaatgtgaagggataaaatttggggcatttatgccactattttatgttatcgttgttacagtgagtacaatttttaattggtatgtgtgtaagatttgctcagatctcaatcaatggttctaagaggaaaaagcttaattccaagctgcctctctcctgtctatgatatcccaagcatcacaaagtacacttccagctcctcagaccctgtccttgttttgcattgtttagccaaaccacttcttaacttcaagtagcaaatagataactcacattagcattaggttctcttattacaagtaattgacaagaattgtaccagtgattaggtgttgcccaaagatcttttaaaattccatgtgacccaaatactaccaaatcctaaaagatttaactaactggctcactaaccaatgcacacacatacttacttatttcacccagtatgtgttgactaccttttgcccaccaggagctaggcaggttcacagtgcctagctcccaggcacaaagataaatcagaaaccattctgtctaagtcaacctttcattttagcttagcaggaaacacactaaaccacggctgaaatatgccaggaagttggtagctggtgatgcctctaccacaccgcagtgcggttaatccagcattcgacttagtcgaaatcacttttttcttccaatactggcatttttatggatggatggatggatagatgaatatcagtatcaaaaggtccatgctttattttctaataacaattcatgtccaattatctgactgccagcacagttatctgctatggttgttagaaactttagaaagaagtaaatcctccaaaattgtcactcttaaaatctgagagaaaacagaatgaatagataagagatgcttcaaggcagttcagctctgtgatggttccgttgagatagaacacacatatacaaagtgtttgaagtaagaatttccttcgaggagaagcacaaagggaatagaagacccagcatttgttactggccttagataagcttactgttcacttatttatcaatgtaaaaacgcccagttagtttttagctcaaggaagagaggacatggccaaagatggccttcatgaacttttttttttcctgtgtgaagtatggaaactcattttcagtattggattttgactggattgtcttctacccagaagctggctctgcagaagttatgatcagatctttggaagtaacatttgatctaccgccgaatatagatccccttccttccctcttctactccctccttgcttttccttcttattacactgatttcatgcaaaattaattatcagtcctgtcacatcttgcactgctaacagtggtcagtattgaattatggggaacgtgaacagaattttcagcagcctaattgcttctcctgtgcccagcaaaatgttacgttaaatactcacagcaagtagactagactgtattctatttccataacaaactggcgggatttcattaccagaatccctagcatctactcacatgactctttcctaactgccctatcagactggtcttggataaagtaaattcctttccaaagctgcagctgcctagttaggtattgaaatattgtatccacttgcaggtcaaaaaggaaaaaataacaacaacagcaagtggtccatgagagtgaagtggaggtattaaaactaggctgggtcttctcttggaagatgacagactgagtcccacagtgcctcactccattcaaagcaattaggagtgtaggattgcagtgacaacggatctccagggctatcatagtgctttacctaaagataacaagagattagcccttagtgacagatgactaatatattctgtggacactgactgagagtttgggagtttctactgtccctctcaaggagcttagagaatatgtacacgggaagacaaaaattaaagaaataaatgtaatgcactgtataatgcataatgataaatgcatcttcaaggtacctaagtaatttagaagatattgcagtgggagaagagtactgagatattcaccaaattcctaccagaaaaaataacacttgagttggctgatgaaggttgactaggagttcattagacatagtagagaaagtcattttagaaaaaatgataataaccagctttgattgagagctcaattttgcttgtcctttttggaagtgtactgtatgtatgtattagtccattttcacattgctataaaaaactgtccaagactgggtaatttataaaggaaagaggtttaattgacccacagttctacatggctgggaaggcctcaggaaacttacaatcatggtggaaggggaaacaaacacatccttcttcacatggcagcaggagagggaagtgcagagtgaaggggggaaaagccccgtatagaaccatcagctctcatgagaactcattcactatcaaaagaactgcttggggaaccgtccccatgatccagtcacatcccactggttccctcctacaatacgtggggattatgggaactatagttcaagatgagatttgggtggggacacagccaaatcatatcaatgtattaaaacagttaatctttatagtgatagtgattctttgaggtattattcccatcttaagaatgaggaaactgaggcactgagaggttaactcacagctagtaagtaagagagcaagaattcatacccagcagtatgaagaagtgaaggatgagttgggaatacagaacttgatcattgagagtcatactagtcacaccaaggaagttagagttaatcaattgacaacggggagctcttgaaaagaactgacaaggtcagatttgcattttagaaatattgttgtggaaacagaaggattgattagaaggaagccagaactggagcctggaaagttggctacatggctttcacagtaatccaggaaggggatgatggaagagaggctgcagcatgggagcaacagctggagtgaagaagagaggatatgtgtgggaaatctttaaggggtacatttggcacaactaggtgatagacagaagtgatgggtggggagtagaattggtgaatctactcttctaactgcctttccctatctccagtctcaccaagtatcttgaattaggaagcaaggaaaaggggtcaattaagaaaaagggagagcaaggttaatggagaacaggctcaagaaggaagaatttaaaaatggaataaggcaagagaggataaagaaactacctatggagtgctatgcttgttacctgggtagcaaaataatctgtacaccaaatccccatgacatgtgatttacctgtataccaaacctgcacatgtatccctgaacctgaaataaaagtttaaaaaaatagaatgagttaagagatttggtaatcttgagaaatgtctgtaaagtgtccatgtattccatgggttcaatggggatctgccattgaaattcatagacctgaatatcagagaagggtagaagattagagaatttgctgtttggatagtcgaactccttctttcatagatgaggaaagtaaagtctagagaaattggagagacttgtgttatatcacttagtttgttacagagctgaattcataccacccatttccatgtgccctcaaatagtagccgacctcttccttcctgggagagaatccttaaccaccaagtcctgatctcataggcctgatagtcaatccttggaagggatactgtggtgcattgcttagatccgtcccacttaaccctgggacccacatactcactcaccaacctgctgggagtgctggtcactgacctgtctcaactaggttgactccaggaattgctctctgctaaaggattttttctgtttcagggatataccaaaatgaaaaaataaaaattttatataaagagcgtttgttgcctgggttgtatgcctgtagaatacattcagaggtagaattactgtttcaatagtattaataaatttttacccaatggcttttcaaaagtgtgcatccccaatggcttttcaaaagtgggcatcaatacacacttagaaatatgcagtaggatcaatttcaccaattatctcaccatctttttagaagctaattcattttgcattcttaaattccactaaatttcaagagagcagttaaagaataatacaaaactttgaagcactaaatgtatatatttaagatattatgtcttctgtagtcaatggcaaatatcaagaatagagaagatgcacaaaactgaccagtagcagaaacagagatccacattctaatctcacgtctttctactttggttaaaggcaataattcctatttcactcactgatgagtctttccctaacgagaatgtgactaaaaccagttgagtttgcgaaagggatgtagaaagagacaattaggtaaaggtgaaaaatgagactgacgaagtgacgttggtcaatctcctgtttactgagtgcaggttaggaaataacatcaactaggttttctggaatttgagaactgagtattataaaaacactgactccgttattattattattgtcatttttaattttggattcagagataggagctgaatagcagcaaaaaaaaaaaaaaacatgcttatgaagagctgcctagtgaaaatgacactcctttggcttaggaagagaaagaaaatgaaagccttacttctttcttctactgattgaagtttttactttctgctgtttacttgggtttttaatattgaagacttctttgtagtctctgatgagttttgaagattaattttgcagaagtaagataatattcctgtttaccagaaatatttctgaccataagactcattatttatttattatggatggtcattttatatatttttaatgcttatttaagactccggagtacatgtgcaggcttgttacatggatagattgtgtgccactgaaatttggtgtaagaatgatcccctcatcattcttagcatagtagtcaatagtcaggttttcaagcctcaacccttccctccccctctagtaatccccagtgtctattgttgacatatttatgttcatgagtactcatagtttagcttgcaattacaagtgagaatatgtggtatttggttttctgttcctacatcaattcacttagggtaattgcctccaggtgcatccatgttactgaaaagaacatgatttcattcatttttcttttctgtggctgtgtagtattccatggtgtacatgtaccatattgtttttatccaatccaccattgataggcacctaggttgattctatgtctttgctattgtgaatagtgctgcagtgaacatacaagtgcatgtatcttttttggtaaaataatttgtattcctttgggtataaacctagtaatggaattgctgagttgaatggtaataccattttaagttcttttggaaatctccaaactgctttcaacagtgtctgaactaatgtacattctcaccaacagtgtagctttccctttcctctgcaacctttccaacatctgtttttttgtttgtttgtttttcactttttagtaatagccgttctgactggtgtgagatgatatctcattgcagttttggtttgcatttctctaactagtgatattgatcactttttcatgtaattgttggctgcatgtatgtcttcttttgagaagtgtccgttcatattctttgcctatttttaatggagttatttgatttttgtgttgaattgtttaagtttcttacggattctagatattaggtgtattttaaatgcatagtttacaaatattttctcccattctctaggttatctgcttactctattgatagtttcttttgctgtgcaaaaagtctttagtttaattaggtcccacttagcaatttttgtttttgtggtaattgcttttggagatttagttgtgcattctttgccaaggccaacgttctaaatggtatttcctaggtttccttctaggatttttatgatttttaggtctcacatttaagttttcaatctatcttaaataatatttgtatatggtgagaggtgtaggggtccagtttcaatcttctgcatatggctagctagttatcccagcaatatttgttgaatagtagcgagtcctttccccattgcttgtgaccatgagattttatgtgatgttgaaacccaaaactacccaaaggaattaactactgctggttaattgtacctatattaaacactttctttatagtattttccttatttgggggccatctcaaagtcctaacaatcagaatttgtgtcttctcatatgatttttactcagaattacacagaatacagtattcataaaaatgaaccaaccataaaatatttattcttctactgtgtcaggtagtcttgtaggttcctaagagataccaaatacaggttcataattcttgtcctcgaagatctcccaatctactgataaagcaagtaccatatgcatgaaaagataaatgtctttataaagtttcttaatcatgagtgcccatttgagtggtctgtgggtttttagaagttattcacagaaacgaggctccttagttctgacatggggaccatttgtttttattttcaaaaagctctatgaagtgatttggatgtaaacctctgaaaagaagttattgtcttaaatattcatgggaggctaggcctacttgcatctggagttggctccagaagtctttacaaagttagcttggcattggctgggtttcaaagaataaatagaaggggataaaccaagaagaaatgtggatatatatggggcacgattgaataatttccagaaagaaatcagatagtacaaggagtgtccagagaatgatgtatatggctgaaatggaagtgttatagaatggtagttagtaataaagctttaatatcacaagcatattgaaacaaattgcatgtaaaacactgatgtaataaaaagatttagattgttggagtattttgatgtcaagtacttgtcttcctggtgatgtgaaaccatgcatatgtgttttaagtagaaatgtgactccatgggaaaacatgtaagaacatgagcaaagatggatgagaatagggtgagtgtgaagggaaaacttattaggatgctagttctctgaggttataaagaccataaggtagtggcattggagtacaataaaaagatgacgacattttaaaggaagaacctccctggcagcatggctgaatagacctgggaagaaagagaatttatgcctgaatgaatggaaaactgatgattttgtatctcaaagtggataatttatttagaggcaactggctttggaggaaagagaaaatgaggggttttctaatgtttgagatgatagagaaacaggcaagcatagatactttggaggcagttggatatgtagcattggagtcaaaggccaagtaagaggtagagaaagagattttggagaacttctcatggaggaaatacttgaagtctggagaatggatgagacctgaagggaataagatatgtagatagagacaaaagttgaagggtaacactcagactttgggggagatctacatttaggaagtaggaggagaaaagtaaaggcacagtaagaaaaagaaagattcaactaaagaaaaggccaaaaaaagtgtaacccacagagaaaagagcatttctggggctaaggagtgatcaacactatcaaaatactacaggtaaactagtaaaacaagtaatgtcagcattagtttccttgtctgcataacaataatagttattatgaggtatttttgtgaataaactgaaatgatgactattaagcatttagcccaaggctaggtaaaagaaaaggctagccaaaagcatctgttattataaatataataattactaatcagcacccaactatgccgggcacttttgtagttacacatttgaataagatgcaaccctcaatttcaaagaggtaagtgtcaatacaaagataaagatgtgaagaatagatagataccattttgtggtattgtttctacaagaaagatgtaaatacaatggaaaaggtgccagtggagaaaagtgataactttatgagtcctttgccagacataagtgatagggttttctgtacatattacatgttattcttagacttgtgcaatttgctaagccagtttatagactcttgaatctgtgtaattgctatgttcttgactcaaacctgaagggacagactcttgggagggaatagccaggttcagccttttatctttcttctgtgcacagaactcttgcttactttctccaccatgggtaaatcagaatggctttgaacaatgagcattttctgcagcctgagcagcagttgctctttagacccaatttacaaattaggaaaaacaaataaattatttatagcatgacaaaaataggatttggcttaatccaacagctttctcagttacaatgcttgctgctcaagtaatggatcaattcacagttggctaaatccaggtgtttttgaacctttctatttaaagtatggttctctgaccagcagcatggagatcccttggatatttgtttcaaatgtagaatctcaagccccactccaaacttaactggataagaatctgcgttctgtcaacaactttagaggcactgtatgcagattgagaggcactgggctagaatactgaattagggctgaggaacatcatcacattctccacgctgtcccagtatactgttggatgatgtcagagcaacgtgaaaggattttgggttatggtttagctcatagtccatgcagaagaggccataattagcacagggtaccatggcacttctcatctgagacatgtgacatggatttgcacagatgagtacttctgacctattaatgttagtagtagaagtgatccttttgtcagtggaaaaagctgccagactcagaagcaagtaaaacctgaagaatcttttagaactgttagtcaagaacttcataggtggtttatataaaatttattgtcacttgctaactgcatggctttcggcatttcttaacctttctaaacttcaatcttttcattcatggaacgtagataattattgtacctgtatgacagggtcaatgaaaggttaaatgagtgaagatacataaagtagttagcacaggatctgggatttagtgagggcccagatactacttgtctgttattatttagtttatttagtttatttttatttatttatttatttgagacagagtctcactctgtcacccaggctggagtgtaatggcgcaatctcggctcactgcaacctccgcctcccaggttcaagggattctcctgcctcagcctcctgagtagctgggactacaggcatgtgacaccacgcccggctaactttttgtatttttagtagagatggggtttcaccgtgttagccaggatggtctcgatttcctgacctcgtgatccacctgcctcggcctcccaaagtgctgggattacaggcgtgagccaccgcacccggcctattacttagtttattattatttcattattattgagtatctattatttgatcttttatgtaataatagtgaaataatagacttctgaatatttgcagagaaatccaataattttaagtgatattggcaaatactatgatattagaaatctaggtggtacttaggaatctattttcttagtctctattctgtggccagggaaactctttattccttttgtccctgctatatttgagacaaagatcttgaatgcatccactcttccctaaggaaatgccatcaactcatcatccccataccatgcaaatgccttttacagctgcagagcaggtgtgggcagatgcatacagcagcatatgaacacatgtttaccctccttggccacactttgtcttactctatgttttctaggaacacattttggggtggaaatgcctttattccatttatatttagtcaattatctggtttagcttccattcttacaacctaattaaattcagcccatcaactcagtttaaggcatagcagctgtagacacttcgtttatctacttggagagaaaaaagataagttggtacaggggttccccatcttgtgaatgcaattcccattcaactacatgcaattgaatatgagcatgggatggtattctggacctaatgttaaattctgctactaagctatcatagttgaaataatatactcaactgcaactttacatattttccagggaaatgcaaatgattgcttttaaaggaatgacaactcatttgcctgcagatttcattcaggatatttaattctgaactactagcctatcacccattaactgccatttctaatatcttttgactccctcaaagagggaaactcataatttgtttcacttagaatttacatttttttaatattctagaaaccatgaaagaaatcactgagtccttagctcctgttttttttttttttttttttggttgttgttaaattgtagaatattagaatgtttcagttttactgattgtatttgttaatcattcttcttccactaccgttgtcttttcccatcctcttggaagggtgttagagaagactctatatctcacctacagatgatttcacctagaagcttagcctcccttcatgactactgttaaagataaagactgcctttggttgacaccataacccacaagaaatgattgcattcctcctggatggggagcaggtgacattgcagatgttacacttcccacatggctaagccactgatcgagattaaaaattcaaaagacaccaaagagccacgttattgtcccctcacagggagctctagaaatacatgacctaaattgtttcttctaagcatattatcagttccattttcaaggtatcaacatgatatctttccattggttcacaggaagaccaaagagtgacaagagaaaaatgtttccatttgtagtttttctacagactcatggtataggtcagcttttttattgtaaatatttaagatgtacatttaaggtgtctccatatatgtatatatatatatatgtatacatagtgaaattactagtagagtcaagaaaattaacatatccatcatctcagttacctttgttgtcataacggcacataaaaatctactctcttagcaaatttccatgatacaatacagtagtagtaactatagttatcatgctgtaccttaagtctctagatattcgttctacataattgtaactttgtaccctttaacctatatctccccatctcctcttccactgcatctggtaaccaactttctactctgtgttactatgtatttgactgtttattagtgtcgacttaggagtgagatcaaactctttcactctctctttctttcccgtttttttttttgtttgtttttgtttttttttaaacaagatctcacactgttgcccaggctggagtacagtcacatgattccagctcactgcagcctcaacttcccaggctccagggattctgtcacatcagtgtccttagtagctgagactacaggcatccaccaccacacctggctaattgtttgttgtagagatgaggtctcactatgtttcccaggttggtctccaactcctgagctcaagtgattctcccacctcagcctcccaaagtgctggaattatggtgcgagccactgctcctggcctctacagtatttttcttgctgtgtctggcttatttcacttagcataatttcttctgggtccaatcatgttgttgcaaatggcaagatctccttctttttaagactaaataatatgccatttaatatgtacatctaccacaatgtctttattcctttagcatgaggagaatattgaacattactttgagaactagaaaaaaatgaacatgtgggttattttagtggttaaaaaaaataggaaaataactataaagacatgaaccaactatcaggggatgtttgggttgtttccatatcttagctattgtaaaaaatacaagaaagaacagacatctctatggggtgcttatttcatttcctctgggtatacccagaagaacaattgctagataatatggtagttctagttctaattgtttgaggagcagccattctgatgttataatggctgcacctatttatattcccactaacagtgtacaggcattccctgaacttcactctatattttatttcccaaatgagatggaagtacatggaataaagtagtattcaagccagtttagtcttcacattctaaatcacccctctatgaaacctctccagattaccttttctccccatgtggatctgaatatgctcctttattcccagttgtcctgtatgtatccagttttacagacatagcatctgtaaaggacactgttgtcttacaccgaagtgtagcagttaagaactcagggtttgcacctttccagctctgtagacttgggccggcaactgagcctctttcacccatagtttctttatctagaaaacaggagtgatgcatgtctcataggaccggtgtaaggattaaatgaattgtaactagaaaattgttgggaaataccaaatataattatataatgactagcctctgtaggtataaacagtttaattacttataagtttacatgtctgcttatattaaagagggaaagacttagactgtagttcattttcatgtctctgtaacacagcactctgtttagtagttacataaatagtgattgaatgaatgtacaagtgagtgaataatcatctcaagtctatcctttgtcaaggaaaatttccagatagagttctttctcctttagggggtctttaagatggtcccagtgccagcccaagaagagccagagctagatcttcaaggcagtctgggacctggatcctcccctccagatgcctagaggtatctcctgggaccatgatgggtctcagtcataccccttcattcattggttcatgtcttcatagtcattttctttttttttttttaaaccactgaaataaccctcattgtttgtcattatttctaatactcaatgtagttttaaattttctccccatgctcaagaagagaaatggaaatatggcaaacatctccatgaacccacattttctcacatctttagatcaaaaactcttattcttcagataaacaggttgtaaaattttcagtgttgaagagaatgaaatatgacatttgattttattgattcattgcttatttttggcagaagttatcctttattcagtttcatctctttatgtcttaccacctctttgtgaactagccacttgccttgagggtttacaaattcaagatttctcagcacgattagccctaatagtatgctttccttccaaggtttccagattatccaatacagtattatttctatcccaatcatgtttaaggattattattttacatagaaataaataaagaaaggggaaccaatacaaagtgttagaaagacagctacgattaatatattggactggcccattatcagaccctctagattttacaggtagctttctgatcagaaatctcgggtgagaaatagtaagaatgatggccttagttaaatcctctatcaatatgacaggttaaaaaaaagacatatgagttagttaaaagcacctctcccttggtaactctaagtgttttagtttttcagatggcaatttgtgactttctatagctttttcttgagatgaatttgtggaccagttgaatagtgatagaaatacaggacttgctaaaaattacaaagtgtttatggcagttctggcaaatatcctctagatcaccagataatgccaagtcagcaatattatcaataatgagttgcctactaagaaccaggggaatgggggcatggactgaaactttaccatagacatctttgctattctggactgttggtttgcttcctagtgtacttctgcttatcctttcttccctttggcttcattgagatcctcagccactgagttctatcttggtgcattccagccacaccccaaaagaataacaagaatgaataagccatccatctctgaatgtagagcaggttggaaaatgataaccttattcattattattgcttgatacatttccgaatttgtgttatctgtcattaaatagctaccacagccttctttcattcttctcggtatcagtttaataatttgttcaatgaatatgagaaagaacaggatcacatccagattttaccacttactggctgtgtgacactgggtatggttattaaccccatggaacctcatctttaaagttcagatgatggtaactaactcatgaggttgctagggattaaatgaagtaccatgtttaaggcttctggcgtgggtgctgagatatagcagataagagatggtagtcaaaaagaatgtgtcttactttttttatagtatatagagtgacaattttcaatacaaatagtgtctgtatatatgcagtcttaacacggcattttaaaatttcattgtagactttaaaaaacctaacaaattggatttcagcctctttcttactatattagaaaataaaagaagattaaaataaaaaaaggtttccttttaatcaatctattaataaaaagataagtactgagattccgttgacataaaagtaattgaaagtttataggcaaattcttgaaatagaaaggcactttttttcctcataagaggacagtttagaggatttaaaaagcaatcaaaggtctcatgttttatatgatcaattcaaattgactgaattttcatcatcatcctcctccctccttctttctgatagtctacatttgtggaatagagagatttttgtctttcaaattctaaccctgaggatttttgctaggcacaagttaagacctgtattgttttctcctaacagttcctatgacatttttaaagtatttactttattctagtatgtccattctgttgatcttcgaaggacctgtgtctctaggtgacatctgtattcaaccaattttgaagactcttctgattggatttagcaggagatttgtagagtgtggggctttgactaggcccaggtcctttgccagccaggcatagtttgtccttgtgagggcagatattggaaaggtggaggagaattatgttctatggcactttcagaagctcgagaataccttggcagagccaagccttctgcttagggaatggctagcagtaacaaagcatggtacctgagatcaggtacatagtcaagagttaggttgaaagtcgaatattaacctgaaaaaggaagatttggcagcacagtgtatcttacagtcccaggaaaagagccagttgacatgttctgtgagacttcagaaaactgtacgacgtgaaagtagaagcatttctaatcatagttatattttgagtaatctcttcacagtagaatgagtcccccaacactggatgtactaaagccaaaggaagggccaccacttttcagagttattgaaggaattcacccatcagatatgttttgattttattcagtgattgttcaaactagatccgtttctctaccttattttcaatgggcagtggttctctagttcatcaaaaagtttttcctctggaatttttgagaagcaatagaaatccagagcatttaaaggtgatgattaattagtatattaatcttagataaatgtccccagataatttttaaatgatcaaatttgtatcaaagacattatttattttagcatcattttgatttcttctactttgttgctggggttggggtaaaagagggagaaatggagaccatatataattccgaaatgaaaaaaaataagcaacaatacactgaattttcttagagtaaacataatgctatgctgggttgttatagcatttacaatgctcatcttcccttacacttgaatgacttcctcctggatctgaaacaccttcctcaagagcatcatcacaggactgttaaaaatcctaacatgttacaattttactacctttcttcttccagtattccagcttggagactttgcgtagccctggttaattaatgttgaacttttcagggtatctgtgaatcatggtggggggtagggttggggactagaatttaattaaaggcacaagcttcatggggattgtgaaatcacagattccaaaagggagacagccattctagggagactgctaatagggagtaagcagggtgacaaagtgtgcaggaactgaaggaagatgacattcaaaggtctaaacaggggagaagaaaaacaaagagatcagcatgttacagctgagccttttcaaatgcacggtgataaagaacagatatgttttgtgtgtgtgtatgtgcgtgtgtgtgtgcgtgtgtgtgtgtgtgtgcgtgtgtgtgtgttatgcacagtggcttgaaggtagcagccctttcccctgatagaaatttgatgatggcagcaacaaaacctaaacagagaataattaaagagtaagggggtagttaatgaaatgaaaataactttaaaaggatgaaaagaaattgttgttaacacaccatgtggtttacctatgaacctagctgctgtggaaacataataacacagagtcagctcctgcaatgcaagtaagccacttcctgggtagaaatggggctcttcggaaaaagattaacttttctgtccacaggggtattatttagctcactggaatagcaatttgacaaatggtgcctttatggcccaagtgaatactgctggtttctgctaaaagggcaggtgctacaaacccaagaagaaaaacattcttgcatacttgcccccctcagcataaggacaactttgagcctgttcatttttgagagttccagcagtggaaagaaagctctaaggtttggtaacctgtgactcacagagagcagaatttcaagcctagttgagaaaacattccttcaagagggtgctgcttatctgctttggccacgttggattttggaatcttaactgttcttgtcactttggtcctggttcaagtcaaaagagtttcttctacttgggacttgaattaggtgaagactgacggacatttatttacgtaccaaaatacacaacatatgtgttgcagttagttcctccttacagaggaactggtaagcactttagccaggtagggctaaggcaattttcacagttctgactgtatgaggattcctgtttctttgttgtcctattttatgcatcatccactgattctcatctaaaccccaggccattttgcgtgaaaatagtccttctataaataaaaaatttagaccagaggcaaaggagcctccatctctctgcttacaattattgctcaatgttcaaagttctcaagacttatctcttcctattgcaatccctaatatacccgtatatagatacatttaggtctgagaatgcttgagcttaaagagagtaagttcttgtttggtacaagctctgcataatacgtctgagctgtctccctgctttagaatgcagtggtagaagttttttttacagcactctgattttagccaaggaactaacaaccgttgtgtaatgcactagctaaaatagtctcctttatcgtgtaaaagtcatccattgactcatttatttatttaccaagtgcctactatgtttcagaaagggttgtaaagggaacagctaagacaaggtccttgtcctcatgcatgtcatactctaatgagaggagacagatcatactttaattggtaaattatagtcaattgccaacagcagtaagtgctagagaggaaaggaccagaataagggtaggaggtacttttgagaggtgacaacgtgctagcagccctcgctcgctcttggcgcctcctcggcctcagcgtctgctctggctgcgctggaagagcccttcagtccgccgcggcgctgtgggggcccctctctggggctggccaaggcctgccctctgctggcggggaggtgtggagagacaggcagaggtgggagtcggggctgcactgggcgctcgctggcaggcaagggttcgggctccgtggccccgcactgggcgcagccggctgatgcctgctgggcttgaaaagggacgagctccctctgggctgccggagtgcccgtgctaggttccaaagtcgccagtgagtgccactgagaggtgaagccggctgggcttttgggtggagtggggacctggacaacttttctgtctagctaaaggtttgtaaacacccaatcagcactctgtgtctagctaaaggtttgtaaacgcaccaatcagcactctgtgtctagctaaaggtttgtaaacgtaccaatcagtgctctgcatctagctaatcaggtaggggacttggagaccttttctgtctagctaaaggattgtaaatgcaccaatcagcactctgtgtctagctaaaggtttgtaaatgcaccaatcagctctctgtcaaaacggaccaatcagctctctgtaaaatggaccaatcagcaggaggtcggtagggccagataaggaaataaaagcaggccacctgagccagcagcggcatcctggtgggtctccttccacactgtggaagctttgttctttcactctttacaataaatcttgctgctactcactcttagggtctgtgccgcctttatgagctgtaacactcaccgcgaaggtctgcagcttcactcctgaagccagccagaccacgaatccaccagaaggaagaaactctgaacatgtccgaacatcggaaggaacaaactccagatacaccatctttaagaactgtaacactcaccgcgagggtccacggcttcattcttgaagtcagcgagaccaagagcccaccaattctggacacacttcgagtagtgtggttggagaaggtccttgggagaagacaacatcacacctgaaataagagagattagaaggagccagtgataacagacctggaagaagggaattcaggacagagggagcagaaggctctaacgtggaaacaagaaggccagagtacccagagcagaatgagaaggggattcctaatcaggaaggaatcatatgtggttgttcactgagagcaatcattgacagtctcacccatgttctacaaaatttcacttcatgattaaaacaaattatatctctgtctttgcctaagacgtgtattaaataacagcaatacaaataataaacatattaagtccattctgtgttctagtcacaatattaagtattttatatatattatttaatcttcacattactgctaagaagcagtgataaaaccaagattttaaaatattaaccaatttctcaagactaaacacagctagtaagttgcacgacctggatcaattctccattggcttgtttccaaagccacaggtttactttaacatatacagcttttatagcactaacattgtgttctatgtgtccgtcattaagttgggtattttacacacattatcttaatatataaaacaattatatgcagcagatgttattaccatgatactgcaaataagaaaactgagaaatagaacattcaagggatttgctcacagccaaataatagtaattggcagtgttaggatttagactgatttctgtgtgatctgtagtccattctgttcaacactacatgtacctgccttcccgtggtatcattgccccagttctgaaacctaggtctaggtcgcaggagaactagcttgataaggatgggctttagagccaaaatttaagccatgctttgtcttatctgcataattttatgttcccagtcaggtaaaaccttacccatttatctttatttcctatcaaatgcagacttccctatgagctgttgcttggtaagttccaacccaatatgatgtcaccactgggtggacctctatggcacctgtctcactctgccttggttccagttatttttgtatatgcttcattgattatttctactcacttcccggaaatgttccctttccctgagaaatggagttgtatctccctcattgatgcatcctctgtaacatctagctgtttaatgtgtcactcagaataagtgctcaataaatatttatcaaagtagctgatgtttcaggaagtctaggaagcaaaccacctcttctgttctgctcttggattcaagaacttaagaggattttgttggaaatccacaaagaatattttaaacgagacacataataagactctcttttgagatgagagaaaccaacaacagcaaaagatgggtggtaacagaacggtgctgtttgctgccagctgatgttcttcttgcctcctggaaagatagagccagaagtcttccatcacttcttgggatgagccaactggcctgttttaacctatattacttgagttttggctaccaaaactctaagcattcacatgggcccccacgaagctctgccatctgacactttcagcaccttcaactctatccagtctcactcctgctgtactaacaaacattccataaacacaaaaccaaaaccacttaaaaaaaaaaatcttaggctgtccctacaacttttgctatcctcacgaaagagtgttactccagtgagacaaaagtccatcacaagaaatgatttttctacggaaacagctgtgattggagcaagatacaaggtaaaacatgttgtggtcaagttcaaggagaaaacagggtggctagccctagcaatcctactggtggacttacttctgcacacttcatgctactatctatcctgtgttgtctaaggctatataatgtcgagagacgggctagtccaggaatcatgacagcaaatgagggagagagagagagagagaggagacagagagatggctcttgcaacctttccaatagcttttgataggttacgtatggaaaaagcctcatattgacatcaggtttacttaggttcaagtgaaaataatgtctttaaaataaattatctcttttgatgaaggaagtcctttttgttttttgataccatgttgcttttgggaaaacatgcctgaaagtaggcaagtttctctaaagcaagaactgtaaaactcacagaaacataaagttgacttgatcatgcccattttataaataaaggaatggagactcaaagcggttaagggacatgtctgcagtattttacccgtgagctatatgccctctgggtttctcctcatccatctgcccccaacaactatgctctttcctctttcctttactgtttctgggcatatcaaagccaaacttaacagcaccaatttcacattaaacaaaagaagaggaacctactgaccaacctttccccatcgccaccacgtctagcctcgccagactctggtaatcattacactactctgtaattctaagatcgacctttttagattccatatatgagtgagatcttgaggtatttgtccgtctgtgtttggtttatttcatttaacataatgctctctaggtttacctttgctgcaaatgatgttctggtgttctgttgcacagtagggtaactagagttaacaataatatattgtgtcattcaaaatagctagaagagagaattttgaatattctcaccacaaagaaatgacaagtgttagaggtgatagatatgctaattgcccagatttgatcattatacaatatacacaggtatggaaacatcacattgtaccccataagtatgcacaatgattatgtgtcaattaaaaacaaaataaaacataaacaggagagaaacatgagctaaaaagaaaaccagtaagcaaatgcactagctgaatcagatcattttatgcctcttgatcggactttgatggtgggaacatcaggctacaactcttgcctgaatccacagacatggaaggcaagagaaattatttaagcctatgcaatcatccaggaatggaaagtgggaatggggttcaccaaacgtactagttttctagggctgttgtaacaaagtgtcacaaactgggtggcttcaaacaagacttatttttttcctattctaaatgctagaagtctataataaagccagggccacattcctgctgaagactgtagaatccttccttgcctcttcatagcttctggtatgtgccatccacctttggtgttccttggcttgcaactgcatcactctaatctctgcctgtgtcatcaaatggcgttttccctgtgtgtctgtatttgtctgttctcatgctgctttgaagaaatactggagactggataattcataaaggaaagaggtttcattgactcgcaattccacatggctgggaaggcctcaggaaactcaaaatcatggtggaaggggaagcaaacacatccttcttcacatggaagcaggagatagaagtgcagaccaaaggggggaaatggcccttatggaaccatgagatctcatgagaactcactatcatgagaacagcatgggggaaactgccaccaagacccagtgactccttactgggtccctcccatgacatgtagggattatgggaactactattcaagatgagatttgggtagggacaaccacatcactgtctgtcttcacatggtgtttctttcttcttataggaacaccaatcattttgagttaggatgcattctaatgacattatattcgtttgattacatctataaagatcctatttccaactaaggccacatttgcaagtactagggattaggacttcaacatatctttttggagacacaatttaacccataactccatgttataactgtactttttcagaatatcagtacgatggtgcccctaatcaacaaatatattgtcaccaatatgctgcagtctgggagaacattcagggatttaatttttctgacacacagactgtgagttcttttgttttttgtttttgtttttctttttttgttttcagcacatcacactctggctgtcattatcagttccccataaactgtgataatttttgtgtcacatagagtgtttaggttggcctctgatgaaatgaagcccaagtacttgctcttccaggcacctaacccagggcaaaaacacagagacctaaatgccttctctcagattatttttttattatatttccagtgagcagaaacattacagatgtgagacttgttctagaaatcagagtatttccccagggaagcattatcactgttcagatattactaagaagtgtaaaatgctggagggcaattgcatccacaccgtcctctgcccatcactgcaaagggagaaaggagaaggccatggggggatgcagcaagaccccaaggtctaggctcctctgccaaaggagcatggatgaccaatttggaaagaacacttgagaacctctgctctgtcctcttcacttcactagtgagaaagctaaagctcagaaaggataaatgacttgactaagctacttattggaaggtgggtgattaggatgtagcataggggtaagactgtgtaaccagctgacactgctttaaatgataaagcattgagttgttctgttttaatggtacacaagtcaaaattgttcaaggattgagagtggagccagaaagcctgggtgtaaatcctggctccttcacttacaagctgcgtgatttggggcaaatcaggtaaccccttcctacttctgtttcattgtctgtaaaatggatattataataatgtttacttcatagattgatgtaaaggtcaaattcataatatgctaaaagttcttggaacattgccttacacagatcaagtgttaaagaagaattgatattattattattgttattgttattattcttattatccttgagttcataatcagggtgtcctgaatatactacacccaggaatggaagccccaccacattgtaaagacacattcacttcccttaaacctcggcatatttgaggtggttgtagcaatagtggagggagagcagcaaggatggacacaaagcttacagtcacccagcagtgtaggaaaggggggaatcctgcacacactcccagacatggtggaggtcctcaatcactgcagagaagactgttgtgggaatgacagcaaacatgtagctcatcaagaaaatcagctgacttattagttcttctggatctggttggagtccctgaccccagagctaaattataaaggttattttgttgtaattttgatgctctaagaaactgatgtaagatatagaaaagttcttttttttttttttttttgagatggagtcttgctctagcacacaggctggaatgcagtggtgccatctcagctcactgcaacctccacctcctgggttcaagcgattctcctgcctcagcctcttgagtatctgggattacaggtgtgcgccaccatgcctggctaatatttttatttttagtagagatgggttttcaacatgttagccaggctggtcttgaactcctgacctcaagtgatccacctgcctcggcctcccaaagtgctgagattacaggcatgagccaccgtgcctggccttataaagttcctcctatattatacgtgcccatacctctatactagtttttctctcttaaagctacattgccatctcttgtattatccgtgcatttgtcacctgccacttgtcccccatgcccctcctttctagcctgtggtttataacatgctgtaagtctggaaaccaaataatcatgtttattagacttgtatgtaaatcgaacctaatgctcctttcctttgttgttgttttccttgataatgtggtcttttaaaagagtaaaatttgaactaggatttatgaaatctaggtttaagtttgagttctttttctacttatgtgatcttattcgagtctcctgacttctttggataaagcccaaaacaccattttacaggtgagaaaactgacagagtgacgtatgagtagaacagaggagaaaaggaattgaaaattcaggtctgtcaaactgtaatacccaggttctttctgtttgataacaccgttttcaaatgttgagaatgactaaagaaagatatagaaatttgtaatgattaggtatttatacattctcaataatgaattttggtataaaaacatatttttttatctaactatatttttcatgcagtcatttcagtcagtatcaccatctaggtttcctctagggaccacatatcaatgactcttaaaatcactgttgtgcaaggtgagtgggaaaggaacaggatggtagagtttggattggggaacagactttgagcactgaacagcaggcagcattgctgttggcagagtaacggagaaggcgctgaggcttacccatgccatcatggcaaaaaatagcacggaaacagctggtgagctgtcagaatgatcttaaggaggaaatgtgaaatgtttctgcttggtgcattaatcgagagttatttggacagaactgaattgccaggggaggaacaagcaaggtggtaactcacccttccctgccctttcatctctctgtaatacggttctatgtcatgggcctccttcacatacacactcccccagttgtccattactcccaccctctccgtcttacccacacctagagatatgtgtgcacacatccaaagagataacagaaaaaaaatccatttgaaatgcttacagatatttcaagacaaaatttaaagagatattggacagattagcaattatgacttttttaaacttttattttaggttcatgtgaagttttgatatataggtaaactcatgtcaccgggctttgctctacagatattttatcacctgtgtatgtaagccttgtacccaatagttatttttttctgctcctctccttcctcctaccctctaccctcaagtagacctcagtgtctgttgttcctttctttgtgttgatgagttctctagaaatctttgtgattagttgtagttgagtactaatgtggctttgttttttttttcatggagttgtttaaatatgtgtcctgattaatttttgttaactgttatactaagacttttcaccatcaatgaattcagtgaagggttgaagggaagaagtgcaggaaaggagaacacacaaatgagaatgtcagtcttgactgctgggtgaactttttttcgctgtagaagatgaaacaaattgagggccaacctcttgaatcaaattgcaaagtaactttctgctgggaacagtttgagtaacccgaagtagctaaggtcataaatatttttacaggtggctaaggaaagagcatttgcagccatggaatcaggtgttgttattttgggtgtgaccttgaatagaggctgctaacttttggcttctgtttccgataataaatctccctcctccccacccccaccatcagccccaaggaaagatgaatgactcaggtgcttcagagacttcccaagaagtggtttcagtatatgcagcaagtggacatttagaatggcacagttatccatataggaatattgttgaggcagttcatcttgttgtccctatagtgtaattctttggagtagaaagcaaagagcaataatttgtccaataaatgaaataaggaaatgaagagaaaatttacataagccagggaggccaacttaattttctaaagtagtgaattgactttttttccttggattttgaaataaatggcaataaatccagttgtggggtagagttctttgctttcagtgatagcttaggaacattctgcagattgttaggattgcttgtatgtggttttaaatgaatgaagctgtttctatacagctattttcagaaattctatgatctaaatgttttagattcaggcaaataaatacatatctatattgggagataaggtttttgctcaaacaagcaatgagtagttttcccattcctaatgtccacactatcttgaccactaccaagaaacactttttgcaccatgatgtgcaaaccatgtatttcttatcatcttgatgctgttgctcattttgcttaagttttaaagatttggcctttctctttttatgttgattaccaagagtgtctttgcaaagtcctttatgcagtactcaaagtatgtccatgccatttagctcctataaagaaaacaagtttttagccttcctaggaaattaagtttcctacaaaatatatgctcttcaaaagctctctcggcttcatttcaagcatggaaagcttgctggtgacttttgttctacttgatacggcatatccattcttgagtgaggctgagtacaaacagcattatcctgatgtaaaggaaacaaaaataattctaaccactaattaactaacagcaaagagactgatagtcttaaatggaaagaatacttccatggtctagtttctagagaacactaccaggggcttgaaggtaagtagcctctactggaggctaagggaagctaaacacttaagttttcttctatattatcagttgctgtttagaataaattataatctccacgtttttttttgagacagagtctcgctctgtctcccaggctggagtgcagtggtacaatctcggctcactgtaacctccgcctcctgggttcaagcgattctcctgcctcagcctcctgagtaactgggattacaggcgcacagcacctcgcctggctaattcttctgtatttttagtagagattgagtttcaccatgttggtcaggctaatctggaaatcctgacctcgtgatttgcccacctcagcctcccaaagtgctgggattacaggcatgagccaccgcgctcggcctcttctttactatagagtaaaagttgcatggtcgttttcttgcatttgggtcacagcttcagaaggttattaccaatcagaaaaaggttttgagtcttttatttcctaaaactgagtgtattcgttattgtctaatgacacagcataacaaaccactgaaattcagtggcttatcataccaaatatttacgcccatgtttacaggcctgcaggttgactgaaatttggcttgtctccgctgggctcagcatgttggctctcctttggactgcaggtcagctaggattggctccaggctgggattaggttcagatatgctccatgcatgtttttttctggggctcaaactgaagggacagtgtctatccagggcttagtctttcatggtacatttctgcagcacacaaaggctccctccaaatgcagcaattccttcctcagcggtagtagtccagacagaaacagttttggtggttgcttgagttctcccagttgttctcctgtcattttgcaggtcaatctgcttcattataggaacattctactggagaaaaaagtctatcattattcaaaatatccctccttatgcatacttcccactgcttagatgtctatactcagaaaagttactatgtggtttttctttatgggacaatactgcgtgatcgtggcgttcacatttctccctccaagtccttgcttttctagtttctgtaatcattcctcaggtgacataaaagtattttccgaagttttgccattttcatcacacaatattgtggacaaattaaagcctattgatgactttattaaagcagggtatttaccacaaattaggattctctgcattttgcctgactcctgcagagcacagagaccattcttgtctccaatagcaacactcttctattaatcaatcaagagctgacatgaatgtttttatagagattctgttccacttagcgatcctattgaacccctggccatgtggtatccccacagctcttcttctgaaatcccattttgaccaagccatccaaattatacacttagactgtaattgtttcttttccataaatgaatttacattcatcttaattcacattcgttgagattttttctctgtttccaagtctcttcacagcatttgtattctgtcattcaatacatttcctccaatacatcatatcacattcatatgcaatatgaatgaacttgtaacaatatctctctttttttttaattcaagccactgatacaaatattgaccaggtaggttgtaaaggacatggttctgtggccagccctgcaagatctccttatctgtttgtttagtacaccatgtatataatgtgtaagcctgcctcagttttcttcatggtggcctcagagatatcactgaagacctatctgatgctttgctgtgatttttattccctgttcacgccattctcctgatttcctgtatagtaactatattctcaagaagatgagattagtttgatgtgactattctttgtgaagctgtactagctaattgcatttcctcttagtttctaaaacccagaggtcccaaagtcaaatgctttgcagccaggcaagtaacaaatgtctgggtcagaagctgggtattattcgtcatttcatgaacagaaatatatatcctctgagtagaagactctgccagcagaacaaaattcttctgttagctaatttcactagccatcatatgatttagcttctgaagcagcttgctgctctgttattcgtgtgaactcatatcctttctcatttggaaagtcaagaccacatgggtacacctcttatcacaagcttcgtagagaccacaaagatgccactttagtcccaactcactaaatctcctctacaatgtctctaaaaattatccaatagtgttttttaaaatatatatcaaattatgctatctcaccacatcacagtatagctgctactattcctcctgtcttcctgtctcagaggaaaaatttgcttatcaccttccacagttgagtctacctaggtccttggcctcctgcccttttatcttttctgagatctcatgccatctgttacctcatctctattttatctgttataattcctctcctctgcttcttccccagctgctcagaacatactgaaatatatgtaagattttgggttttttttctggtcattttgctcaatgacttcctaataccaactgaagagagtttatatttcttaatacaacattgaaagcctaacatgatttggcctcaacctacctttttttatccagtaaaattcatttctctctaatgtatactatattccatccaaactaacccactgattagacttcatttttcttttaattactgctttttgctgtgctggtcccactgcttagaatgttatttcctcaaccttatttctgtttcctacatttgttgaaatcctagatgtccttcagaacccagcctctgagtcacctcttgcaggaagccttccttgctttccctagcagaacaacaatttctactgaaaccctgttgaattttgtctccattattgcctttaccaccttctatgttttgacagctattttgactatgtcttatctacccaattgtaaacttaatgaatacccacactgtatcctatttatctttatatctttagattgcaacacaattctttgcacatagtgtgtgccaaaaaatctctattgattgatggtgcaattctgatatttattaataatgatcaatctaagtatttatccaaatcaacccaatgccctatattttgggacaattacccttgagatttttataaaccaaattcaccccatgtaaaacagatgaaattaaccttaatttttatctgatgtgtaatggctaattggctaaatttctttcataaatattacatatgtactattttttatctctataagtattctagtttgtctagatgaagaaacagaggctaaaaatagttaaacaaaaaattacctgtttcagagcttgaaagccagatctgtccatggaaatctcctgagagaagaaggtttggggatgcatataatgagagcagagaactggataaagagatgtctggatctatttttggctgttgtttagatttactttgtgactgaaggaagtttatctgaggctttcccatttgtaaaactgagattcatatacaactgtgcaaaatatgtgtccctttacttacctccctctaagagattaatgagatgatactcaagaagcactttgattttctctgatgaaagaaatggataagtatgaaatgaagcatttactacttctatcgaaggtttttaagatggcagcctttaaaaattatcaaagtgaaagctaaaggaagaaacagccgtgtacattttaaatcaagtcaataattattgtagtgcacctaatgattctctgatatgtgttttgtgcattaaaatttaccaagcacttttacatatattatctcatttgatccacaaaactatcctgtgaagtatgtaggctaggtggtttcattaccatttttgaaataagaaaactaatactcaggccaaatgacttggtcactgctgctcgactcatgtgaaacagtccagggttaaactcaagtttcctggattccaaatcccaattcaggtatcttgcatttctgtccacttgttaacatcatagcatgcacattggaccatctcctctgtgttcacttacattctatccatgttcaggattgagtttaaatcccatttctgctcttaagacttcccttatcactttaactgaaaggcagactttcttattccatattttttttgtccttaaatatattgtttcctggaggtctttctagtgagttggatttcctgtattccattcttccttaaaataagcctttggaattcagcccagcttccacacttcttgatagctgccaccatccatttcattcctgggactgagcctcagcacaaggattatttaaaagttaaaaatagttgtattcataatcccagcattttgggaggccgaggtaggtagatcacctgaggtcaggagttcgagaccagcctggccaacatggtgaaaccccatctctactaaaaatacaaaaatcagccgggtgtggtggcagacacctgtaatcccagctactcgggaggctaaggcaggagaatcactagaattcaggaggcaggggttgcagtgagttgagatgcgccactgcactccagcttgggtgacagaatgagactctgtctcaaaaaaaaaaaaaaaagtttttttcgtgtcggtattaatgcctggtataatacctcgcacacagaaggtgttccatatatgcctgctaaagaagtggctagactaatcaacaattatggatgggagggaaggttcagaaagtttggtgacaatactgggaaaaaatgttggcacctgataatggtggacctgggataccaggctgaagagtttgaaacttgcccttttggcaacaacagatttattggcaccaaggaatagttttgctggattccacttttgaactcatcaaattccttgcttttcttttccttgtcttttcaatcctactgggacctcctcccaccagtgccactttactggaggcttgtgatatgtatgacaggcagtaaaacccaagtgaatcaaggaagcctgttaagagcactgatttctatgatgtctcagtttgttaactaaattgcaggttgtactgcttggccagagacagctgacaggcaactctgcctgaacaagtagcatctccaaaatgacatgtgcactttagtttcattagaggcagtggtatcatgattgcctgggccattgcaataaatatggtgatcatatgtatcccttgggatttggggttgacagcatagttgggctgcactaaagagtcttactctgacataaatgacggcaaagtagatctctgggcccctcagcaaggaggcagaagttcatgttgcaaagaaagttccacgggcctactgaaatattaccaatcaaaattacaatttcatttattgacaagtcatatttaacattcttctaatgttttttctcacatgccaatgtccaaaaagctaaaccatcagctgcatgatgctaaggctttcagcagtcagcagaagcagtggtagttgcgagctggttattcagaggcagctactgtgctccacataaccataaagtgaacattttgacattcccgaaaatgtaccaacctccaagtcacaaatcctctgtagatgcctgtggattggcttttcagatcctcttaaaagccaatctgtggtggcaggattgtctgaagagggtagacttgggcttctggtacgttacagaaggcatggtttctccatctacactatgctataagacaactgctcttctctgaaaagaaactactggaatcacacttcttgtaacttctctctattcccttatttagttggtgggattggatgaaggatcttcacatgtctagtgagactcctttcttctcttcttcctatccaaagggcttttcttcctgggctgagtgtatccaggcctatttcatctttgtaggaggcaaagggaaagagaagagaactagaaattggtgtaggcagactgatctgtggccaggtctaagtgttgccccaatccgttctcccatccaactccacaagcagtaaagtttgctggtcctttcatctatgtctatttctcaattggcttggatttcacaatgaagagggctatgatttattggcccacttaaacctcaacatggtagagtggcaattttgtttttctggctcttatattgcaatgaatattttttatttgacagtctgttataaacgaaaataatttttttcactatcagtttctactcaaaattaaatggtagctctagaatagtggcctgcattaaatttttctttatggttatagccatgcagatagatgcatgaactcagaggactaaaaatgtgtttccatgtaatttaaatgtacctttctatacggaacggtctgctgtcatgcaactttcaaataatgcattttattatcattatcttttccggcattgattaatcctactgtttattggctaagtgtacatttcctattggtatgtttctgagtcaaggtgaaagcagttaatacttaagagttgagaagcaagtttatttaaatctagtctttcttatgagtctgcctaacagtgatagattttgttgttgagccacagtttatgaaaagtgcattaaaacctcgagccgacccatctctctgaagcagcagttgggccattacattttggcaggcacttcagatgtgtgtatgattttatgatcaggtctgcttaattcatcccaactcttcaaagaggaagggaactaaaattccttgagcatcttctagtatgtgctagatgcctgcatatgttgttttatcctcatgacaatctctcatggtagatagtattttttcagcattgaaggtgagaaaattgaggttcagagagtttaaataatattgtcaaaaacatataggaagtgatgaagttaagctttaaggccaggcctgtctactcaaaagcctgtgattgttatattaagggttaaaaaaacaaaaaagtttgcaagagacagacaagttatttgaacggaatgaagtataagaaaacctgtgctttccttaatttttcttgaatcctgtggccttctcagtctatcctttattgaggttcagagaggttgctacttatatggtagcaaaagtatttcccttccctacttaccctactatacaaaacaaacaaacaaacaaacaaacaaaaaacagaaaacttgatgataaatgtcaatcaacactcagcctctgcatctgatgagcaacagaaattagcggggactgtggtgaattggaaaacctgtgcctttctctcccaatcagctctggctgattgtcctacagaaaatgttggctctgtgttactaaatcttaccattttttaaaagaacagtctagctgttcacgagagatctgatcttaaaatgttgaaaactaattcacatagaaaaatactatgtagtacccacccctcaaaaataaaacttatgtgagcactcgatccagcataaagtctctgaatttgtaagttctgtattacacaaggcagctaataagtaactactgggaaaaataattaacaaacaaaaatcaaatcaaaataattttcattactcttccaataattgtgccttccagatttagtactgtttgtgtattgtgcctctctgtggtagaggcatgacttctggtcctctatctgcccttcacagagtggagatgaggccagtatgcaatgactactcaagttttagatgttctgagcacttgtttctgtgctttctctggatagatctggtagtttggtgagcagagttggcgtggctcatcagcagtcaccctttggcaatggaaccagaaaagcatcatgctgtctgttaaagaatgtgtctatgcttgtagctagtttcctaagatgtttgcctctaggtatttgcctgcagaaagttttttgaagtcaatacaaagtagagtggcaagcgatgcatccatgtttgaggatttgggaagcatttttctgtattctttcaagtaaggcctggtcgataagtttagccacactcaatctaattccttgtctgtatccttattatctcccctcctcttctttaagttttcacttccttctgaccttaatcactccctcaatgaacccataagtatcactgaacatgggtgtcaccagttagcaacagtaagataaccgctaacttctgaaacatggaagctctagcattgcttggatgatgtcttccctgactgcctgtgagcctctggccaggatccggggtaagtgcctcacaaatcactgttcatctaaacagctaaagctcttctcctgatggaagagggatacctacagcagaaagcaagggagtccaccaggcacgtttggaaaataaaagattttatttatatttattttgactctatagtttctaaattccataaatgaaattttgccattatcaaggaaatatttgctagggagtataaggaaggccctttgggtaagagagaagatattctctaagctgtagcatgtttatgaaccttaaaaattacttgtctgtgtttgtatatgttcagctctgagagtcttccttaacattcaaatgtctctgtcttggcaaaaattagtgaggttttagaaagtagaaaagctggttgatagtgtaaggaatttttaggccaattttctattttttccttctatagactgaattttatttttataccaatagtttcaatcttctaaacttctcccattcctctttactttctcaactgcatccacttaaatacatcttattgtttcagtcagccttggctgctataacagaatggcatagattgggtgacttaaaaacaacaaatatttattgctccccattctggagactaggaagtccaaggtcaaggtgccagtcaatttggtttctgctgagggtccatttcccgactgacagatggccaccttcttgctgtatctttacatggaggagagagaaatcatgcctaatgtcttttctatctccgggcaggtagtgcaggaattgaacttggttggaggacatccagctggtgtctgctgcagattgcttgcttgcttgcttgcttgcttgatgtgtggggaaaaacctccacacatctagcgtcagaagcgtgttgtgagagtataggagaaactgagtttgttttttctacacagaagaatttcctatcctgaaggccaggtaatgaatcctctttctctggttacttgggcaatttatcaatgactgtctgtggatatttatttggaaatattatatgggaacgttccttcattttttatatctcaatttaggaaaccatgtgcttctttctcatttctcttttgtccccatcagcgatctatatttttttaaattgttattagaaacatctcttatttaatctccatcatcacccaacaagctcagcaatgtgactttgtcttacggatgaggaaactgggtgcagagtatttgtggctttccccaaaacctgcagtaagtgaacaactagaattatatccaagccttctgattcaaatgcagttgccctatgcaccacaccaaagtatcgtttacactcttgagggctaaagaatgccagatgtatttatctaacttctgatgtgcctcccaaaatgccctatacagaggataggatcaatacacacttgatttcaaaatttctatgacttgattctacttacacatcttattgatttggagaaataaaggtacttcttgggggaaaacatgactacatgttaaaattctgaatttggcaagtctagtgcaaactgaaatggatggtggttgaagtacagccaactcatggtggtccaaaagactgtggtgaggggatggcctcccaagaggcagggattgagccctacactgaccagaaatcactgcattacagaataatggagaaggcaagacaatgaaactgagtttctctgaaagcttggcatcttggatatttcaaagattaaagttgtatttaatgggaatcacgtggttcaattaactggtaataggatggatcagtgtccacctctaggacttcaatttgagtctaatccaaacacagaagcagagtaggttgaagcccttggtaatgaacactaagcctttcacctcccggtccacagagaaagttcctctcaggccacagaggcctgctggcaattttcctgaagacagtttggtagactatgtgaaacaagtgaacagctatggtcacctgagaggtagtggtactctacattttcaaaagttctctcccaaagcaaaaccatagcaaaaattgaaaagcagtaaatgaaccatggatggagatattgcactatgcacttgtcttgctagcagaagaatgcaaaggtgctttcaccattgtgtcagatgcttggctgaacatttattaaacttttgatatggaggaagacatagaacataaagatgcattttcttccctcacaatgctcatggtgtgacaggaaaaaaaaagaattgttccattaaaaaaacattgaaatgaatcaacacaaactgatgttattattgaatagataatggagagattgtgggataattagagaataaatctggttatcaaagatgtctctggaaggcacgtgtgtaaagttgttttcagctctgtacacctgtgcacactggccaggaaagctggaccttctgcagagaaaactgtcttctccagataggaaagtgtgcctcattgagctttgggctaggccagagctagaagatctttcctgtgtttgggtcattcctagatcagtgatccctaatgaccagttccattccctaaagctaatgttgactctagatctttctgacatttgattcatgctggaatccatagtttgttttgagtcaggtctataatagattcatattcctgagaggcttcctattgaaagtgaagactcaggattccactgactgttctgccactgtttaaggacgatattacagttggattatagatgacctccagtggacacagaggtgcttagattctactgagccaccattactttgcctaaaagaaaataagagggtcaaagggactaacttttgtgtaagttttaaggttttattcaaacacaaacacacacaatcacacacacatttacatggcaacatatctacaaataactatttctctagcattatgttcctcagcctcttgaatgacatcatttaccttcgtcatgttaatgaacaaaattgtagctcactcataaagaagagagagaagaatgtttgtgccctttaaatgtcaaaaaataaatgcttcttcatattgtgtatgagttcactataaactcatggataatttgtgtatctgaagctctgaccggcttccagagggcttacagtgcctgccatatcttaggggaacaatgacctcatgctgttccagggacatttctatttctccatttggctgaaacttactcactttatactttggtagggatactgaattcaagtaaattaaaattaggagatgtgttctctaattattctatcgaaagagcacatagctttgaaataattctcaatgctagtatggtggactcttttcaaaaggtatgagtcagctccctgtgacatgttttccagtgtctgcttggggtcacctttactaatttcatcaggactgagggaaagcactttccttttcatatttctgcttgggtgtccagatcattctcccctacagaggctttgatgctgtcatggaggtcatagggccggccttttttcgaagtactggagctttttaaatttcactttttaaaaaatttttgttgcttttattatggtggttgggggtaagtaaggacccaccttttgaattagaattactgatcttatccaagagagaatgttgtagtgggtgatagttgacgaagaagagaaccataaaatatcacctggatgaaagacctaactgcagcactatctccaggacacacacacacacaccagagtccccacgtgcagacaggcactgctgatatattacagtctgttggccattttgtttatgataactaggaaaggaaaaatgagcccttatttcagtgtgttcatcccaagatgatgacacagtagattccccttgcaggtaaaccgagagagctcagttaatcaccatttatcactcaagtgactcaagtattttgcagatgcattggagccctggagactgagatattcattgggctgcaatgctattctcttttctcattccatctaatataataaaataaactcaaatcctaacatcagagtgatgtgtgctatcttttagagtcccaagcctttaaaatgtatttgattcactcccatagaactagatacattttccaaacgaaatgtgatatcattacaattttaatgacttataactttgctccatctcctccattaccagactattcctagctactaccatcttttgccagaagcctctaatttatttctctgcatctgcagctgacctccttcaaacagtgttattttgagttgattttagtatataaaccactctcagtgggatctaagatagattagtttatgcctaattgagtgagcttttgtagatcctcttattttatataacttattagaaaatatctaagatatattgttctatttgccaaataataattgtgaatcaggttcattgtacactggttaccaatatgcctgagcctagtgagagagaacacccccacacacaagtcacatataggcagtaaaggacagcagaagctggggaatcattttgagctcattctccaaggctcaggaaagctgcctatggcaaatggaatccacctgtgcacgtactgcacctaagggaccttggaaagtaccccactctgggttttataccccaggggcaatatgactcaataagctgaagtgttgaaggacatcctgttctggtaggaagtggaacagagacttggctattccagccagttcctccttatctgagaatgttacatttctggtatattctttagttatttttgagaactacaagtgagaaaagaacacaaaccaggttggtccgaggctacctagagaactttcttccaataggtgaatgagcaggtatgttacaggttcctcatttgatcctctcaccctatttgagttattctgaccacttgtacatcaactattgattaaaatctgaaaaaagaaaatcataggtgaccttaaattaaacttaaattaaacttaaaaaaaaaaacttaaaaaaaattaaacttaaaaaaagttccacaacgaacaggggtcagcaactttttctgtaaagggccagaaagtaaatattttaggcttgtaggccacatgatctctgttgcagctactcatgtctgctgttgtagcatggaagcagccaaagataataatacatcaatgaatgagtccagccgtgtcccaataaaactttatttataaaaacagggaacaattatatttggcacacagtttgctgatctctgctctaggccaatctatctcctccaacttttgcatattcatacctcaaacatatcataaaaaactgccacaatctaaaccgtattatctgatgaccctaagtactaaatctctccattctgaaatgtgtatattaattttttttcaggtagagaatggtatagaatttagacagggaatttatctgagggattgactgaaaatgccttacttatgaaaaaagagttcttggttggtgtttattattcatgtaggtccatttaccttgaagccataatgctaatatagcctgtcatttggaagttagataaatagtaaagcactttaaagaatcactaaaagtttcctcacaaccacagaataggtcttggagggttactcacgctttgctgatctctcatttatagaggagcagctgctcatttttggcctagaatatccacctctaagagaagaaatttctcctttgcatcctgttcagagctgatcatgcatattcttggaaactgactaaaatgacctagtctgtagtaaagtaactaatttagagttgggactatcaactaatgttattttgccagaggagatgaatgaaaagacttccttagggactagcagcaatcagtcagtagggaacagggttaccaagaccagatggagaaaatggcataggacatgtgtattagacctgccactttctggctctgtgagcatgcatttcaaagtttatacctgcaaagtgggcatttgacagagtaggggacagtcggagagcttatcgatacatacttattgctctccttgtgttctgtttgctggaacacaattttagatcaaatatttaaaaattcacacgtgcgtgctcatggctgtgcactcatgtgcatgtgtgcctgttgtgtgcgtgcatatataccatacagaaaagtactgtctggagaatacattagactatgcatgtaaatgtgtgtagaatgtttttcttttttttcatgcaatacatgctctatggatatttgttaagtgactgaagttttgcactccctggtgcagtttctcaatagtggcactattgatattagagccagctatttctttgttgtgtatcattgtatatttagcagcatgcgtggcctcgacccactagattctagaagcactccacttcagttgtgacagccaaaaatgtctccagacattgccaaatgtccctggagataagcatccctgttgaaatcactgccttagtgaaccaagacattaatgtaagaaagtggttcctaaactttagcatctgaatcaatcaccttaagttcttgtgaaaatacatgttactgggcctcacactagagtttctgattcagagggtcttgcactagcactagacccaacaatttacatgtctaatgagtccgctggtgatactgctgctgggggtcttagaacctcactttgtaagcacataagtaaggtgtaagatgttctggaaaaattccagatgagttaaaatgtgtttcctcatttcaaggactgtaatgtttgttgttagtgtgagcacagggcttaaggtttctttatgaagaccgctgggtggttcctcacagctgtggttgagatttagcggggaaaccggacgtttatgggagacgttcagtctgtactggattttagtcagcactgccctgccagctgtcacctgagtcctgccaggagactgctccaggtcttggcacagggctggggcacctatggaaatgaacttgaagtttgccttgcagtcaaacttaactaccaaataaaccagcatgacattggggtctgtgaatgagaagtggatgttccgagtagatttgaaggacgtgatgactcaggatgccagttgtgactggtgacttagagccgtggtagctttgacttgcatcttatttacttgcatcggctgtcttgtccttccttgcttctcgccttttcaggtcatggttcctgatgtcctaagctgtcatccctactctctctctctcttttttttttttttttgcttggagtcagagatggagctgtctcgagctatttatcagtcttatctctctgcgccctctgttagcatttcagactgtggatctaatccactttaattgattgacctcgtgcaaccagacatcagtaaaacaccaggtgaagcacaactgcagccaggggagaggtggatgtaactttcctggttgggtgcaaagttcgctgaggcctataaagatttagaaaaggagaaatagttttcaagccatttaatatgaattttctagggacaatgtatacagatcccagagtcgatgaccttgactgggagacagtcgttgtaaatagagcagtatcctatagggagtgtgcaaatgcctctgactcacctgtcatccatattagtactatttctcagctagcatcactattatcaccatctccaaacccatcattaacatatttttacatcattgtttgtagataccttcagaatttgccaagattttatttatttctcttaataagtactatttaacacaagtattactgttgctcttgtcttcgttatcgtttttctagacaaagcttgagccatggatagttgagggacctgctcaagatcacatggaaaaaataatgtggagcctcaatcagtcccaattcttttgattctaaatctcaaattcttctagaacacaaagtagacattttcctctcccctgcttttcctgccacagccacacttcagcttctcaaggggaggggactgggtcattgtcatgaggtgatcatggactttgaaagatcttcaagctctacagccgtggtcttgtcagtttgggtgatttctgaaaggcatcttctctgatttagatttttcaacggagagacctggtctcttacctctcttgaaataccttaataatgaagtgcttactctgtgcttataaaccaacaactgtccagagtgtagaacaagaagaccataatgttgaaagagtagagactaatgatcttcactgaaagacacttaatagccacaaaaagagcgcaaattatgttctactgagttcaatgttttattctaaagaactgcagtaaaagcctctgttagtcaaagtcaaaattgatcaatcaggtaagctgtaactcatctttttgtattttacagatgcatttataaagcatagtgagatgttttgcctaagatttattgcacgaaatttgaatatggtagcaataatttattttatcctataatactgaaatcatatttggtctcttatggtacaaaaaagattcttctaatttttttaaaatcacaaccacacattctaattcatcatttattcatttccatatccattaatttaacaaacatttactgagctcatgttaggatacttacatttaaaatactcacaattaggctaagtggacagataagttaggcctacataaaatatgtaatatgtaacacatgtatttctgttatagaaataactcaattataacatgtaaaagctgtgattgtcgaaaatgcatggattttagagtcagacctggattctatttttccataagtctcttattgtgtgaattctcttgtaattaattgtaagaatttgaatatacttctattataaaaatatttactgagcacctattctgtccatttaggtagcctggtttatgttgcagtgacaaaagcctcaaacacttggtgctataaagcaaccaagctttgtttctcagccatctgcatgtccgtagcaagttggcttattgccatcctcactcaatgacccggaatgacaaagaagccgctaccaggagtttgctgggtgcagtggttgacaacaaatgagagaactctcgtgggtctcacaccagcaactaaatgcatggctcaggaatgatactcaatttatcagttaacactgttctcttggcccaacccatcacaacgagacccaaaagtcctctcttactacaaccctataatggaggagaactaggaaagtgtggtaaacagtgccgctcattattttctttactaggaaccagactttgaaatgggtatggaagaccttgctgtgcctggcccacaagaggcattatttacatattgccttccttgtgttcttgcctagcactgaactaacaaattctgtgggaagcctagcagttaagacactgagacctgcttccattgcccatatccctggcatacatttgaaaatcccagttctgtttctctcagctgcaattttctaaaatagcggatgatgcattccgtcttccccaggggcagtctggaatgaacgaagagatagccttcagtgacatctttattcctgagaattcttcttgcccctgagcatttctgctcctggagtctgaccctggtgtcggtagcatctcttaggtcagcaccaataactgcagtgtgactgattgaggatagggcagctgaagctggactaatttggggagccaggtgggcttataaacagtcattattgatgaagagtgacttactggctatttaaagacagctggtttctgtgctgttcagttttttttttttcctgaatgcacttgaggattctttggtaatgtcttctgatttaccacttgtttttgtttttaatatcaaggaagaatatagattgaagcaattgtcttggtagcaactttagtggtgatggctgtggagttattaaaatttatagtcatgctgtttttgcagctacactttgcatttcttagagaggcttataatatctggttacaaagaatgtagagagatagcaactaccaaattgggataggaaatcaaccctgcataaattgttttaatatatattctgtttgctaaaatttacatttattttcacaatatgtcttgatgacagtgcccaccaagccaactagcccttagctcatgacactactttcagttacactaatgaggagaaagaagggagaaagaagactgacattttgtgggtccaaaattatccacagtgaatgccaggtgcttcacatgtctgtgctctcctataaccctcacagcaagcttcagaggtaacaactggcccctctttccctccacacatctctttatgaaagagaaatcagaagtaaaataaccagaccagggtcatacagctttaagagccatcgctgttatttgaaccatgctaggctaaaacccacatttattctattgaaacagtttctccaaaaatcagagtgttttatatctgatcaaatgatgggtggttccttctcctgatctgttttatctcatatatttatgtaatgttttattacttataaagtaccatcatgttcatcatattatatcatccttacaacagccctatgaagtacgaaatgctgatatcctgtccttatagtgtattatcaagaagtggcttcagaaaaatcaagtaatttgcccaaggtcagtcaggtctgacaccaaagccaatgcttttgttccctcacatcttctcttttctagacacatgagccagcggagttgatttgcatggcagctgtgcatgatagtttcaagcctgggcaactctatgggtattcgccacaaggcttccgtgacttctaatgaactgaaacaaagcagttagccatggattataatgccaccgtggtcccatgacaaatgacaaggaggttgcagtaatgaaattttattactgcaaatagagaccacatctgagatctagcacggccacatttaccattgtgggaaacaaaatgaaacacctgggaaaggatctccactgactttagcagtgagctaacaggattaagaagatctcccagaaacactgattacaatggcaaatgtgtggcacctaagataaggaccaaatatttattctggcagagattaaatcttttcttttcctgaatcaaatatggatcttgcagaaaatctgcccaagaatatatcttgctgatcagcgaactcactgagccagaaccgtacttggccactgctgtcactgaaaagctacagaatgctgctttaaaggtctccatgcttcccctaaaactgttttccatccatgattaattagtgacttaggggtgaattgaatcaccagctgtcctttccatgcatccaggatttatgtactggtttctcattgaagaacagtggtgcaataaacagccctcatttgtggggtgggcagaggagtaatggtgtctgcagtcatggtttcttaactcctctagtacttccattctgctaagcaggttatggctcacattattacagcctagcttatttaggcatgagggtcgtgggcagtgacacacacacacccttagaaatgaataccagttctttaagagaaagcagaaaagtcatattaccatttctgaattccttgagaaataagaagaataaaatggacaataatattagctatgggcatgaaaagtacaaaaagaacccataatcaggttcatttatatatgcatgcatattttaaagctaggtgcttttcctagtgcagagatgtagatagcggtttcaacaaacagatttacgaaatcatgagtgtgtttagtcacaattttgggaggtacctggaactcttttcccagagaacagaacatggggattgcagacatcattttatattgcatattatgtaatcagggcacaaaggaaatactgaggtccaccctgtatctctgcatccttgaatgctcacagcctgctttggttgatcattctatattcctcgcttctaagatcaagacttctgcatgacttgtccattcttttattggatacaagatgaactgacatactaagtgataaatggaaacttgaggaaagccttcattttgggaaaagaagtgaagtgtaccaaactatatatagaaaccagtgtccctccctccagaactcttaatttgttgactttaggtgtagtaggtgcttaataaattttgtatttgtgtatttaatgaatacatgaatgaataaaacaaatgactaaatctgagatttagaaaaactcttttctatatcttgatttatatggattctggacttttctcacattcttctttttcttttcctccttctggttttcctccttctcttccttttacttcttcttgaataaaaaaataatagaagataacaaaggatcgtgaactagtactgtgactcagtcttgtagaatgtcagaattactactgatatggtttggctgtgttcccacgcaaatctcatcttgaattatagttcccataatcccaacgtgttgtgggagggagccagtgggaggtaattggctcatgtgagcagttacctccatgttgttctcatgatagtgagtgagttctcatgatatctgatggttttatgagggggttttcctcttttgcctggcacttctccttcctgctgccacgtgaagaaggatgtgtttgctttccaggcccccacagccatgctgaactgtgagtcaattaaacctcttttgttcataaattacccagtctcaggtgtgtctttactcacagaatggaaaggactaatacaactactaaattttattatccttgaatgcccaacatattgccagtaatttggaaaactaaagaaattgagcaagatgtctcccttctgtccttacacatgcctccaacaccctgcaatgctatgtctttccaagagcttaagagaggctgattatatttgaatagtaaggttacatttatttcatgtctcattgtgactactagttccaacttttagtcataaccaattattagagaagagtcagagttttaatagcattattatgtatgctttgtgttttagtgcacttcccaggaggttggtgatatcaccaccagcatcaccatttgcatcattattatctgtattagtccatcctcacattgctataaagaaatacctgagaatgagtgatttataaagaaaagagtttttaattggctcacagttctgcaggatgtataggaagcatagcagcatctgcttctggggagccctcaggaagcttccaatcatggcaaataggggaggaagagtctcacatgacaggagcaggaacaagagagacacagggaagatgccacacactttaaacaaccagatctcataagaactcactcactatcacgagaacaggaccaagggaatggtactaaaacgttcatgagaaattgtccccatgatccaatcacctcccaccaggccccatctccaacactggagattacaactgaacaggagatttgggtggggacacatccacaccatatcaccgtcttcactgccatagtgttactcttatctaattcattgcaatttcccttctgacaagtctttgatggccacagaggttctcttctgctgtgttgcataagctctggtcttgaatatatctctctttggattaatctgaggagtagggctacaagttgggaagcatggcagccatctaatcatgaaaattctaggtgagtttcattggcctctactggggttaccttttctatgtggtttggaactgcagaaccattatgtgcatgtgtgtgtgtgtacgcgtgtgtgtgtgtgtgtgtatatttatatacacacacacatatatccagcccctctgacattggctcctaaccattctgtacacctctgctttgccttgatcgcatgaaaatatgctgagaagctcatatttccactttaattgtaaatctgaattgataaatgatttaaggtccagtgtcttggtgtactctcttagtaaacaggcctaattcatctcacagaaataaactttgcattgtcattgcatagctactaggtagttccaggcctgatttgccttgaggggaattgaatgatgtaacctgtgcggtgcagcctgtgagagcaatttgggtggtttttatgccattggtttttatgctcaggatgaaagctcatggagaaatgtagaatgctattattatcttatcttcatgctgacagctccctctgggcacctacaggtttattgctggttggaggatcaagtttaaagggagagaacttcgtggttggtgataactatgccttttgtgtttctttattataggaacaggggaaaattggagttgtcttcaacattggcacagttgacatctccatcaaagaggagagaacccctgtaaatgacggcaaataccatgtggtacgcttcaccaggaacggcggcaacgccaccctgcaggtggacaactggccagtgaatgaacattatcctacaggtacatgttgttcgctcaatggtcctactctttttgactctcccattctcacttttcagtggtgatttttctcatgactgtcaccaaattccagaacactgagtgaagtacacattcatgatttttttgtatgagaagataagtcatctctttaggacttgatccagtatagggagcttctggagactttaccaactatgcactggacactttttgtcaacctttgactgatacagcctgactggctcataccaaagacaattacggtagattttgcagggcctgtagatgaggagcagtgaagggaaggatcatctctatcatgagctagtgtcgataatcataagatgctccatttgagacccagactttgtggtgccatttagtcggatgcagttgaaggtgcagatgccagagagagactctaaaaggacaattactgaacttgaagacacagatcaagtcatggtaacaatgagagaaaaactaaggtggaattttattcgtttggtggactttgctagtttttattttctcacttaccctaagcctgcctggatattcaaaggttggtcctagtagtcattttaatagcaagcatgctggtgtggcaggaaaaggggttaatcatctgtttaaattttacagtcaagaaacattcagcaacaaattcccagagccagatggctgaatcaagcacaacgggagaaaaggttgccttccttaaaagagatcattcaaataatccctcagctttccctcttgcctctcacttctcccaggaaaagtcctgaatgctgatcgtaaaagtgccaggaatggaagggacaacccttcagcaaagggccattgttccacaattgcactgtcatctgatggatgcaagagaatagtgagaatattgcacttctcactaatgtgggcatgaagtgatgtgctactctctatcctacacaccaaactcctcacaattttctcaccacttttctctaacttcctttacagtgaggtgggcacaataacaaagaagcttgaagcacattttcacatgtctaagagccattagctaataatggttatgcttgtgagaaagatacaaagtgaatttgcctatttgtaggccaagactttgaatggcttgaaggctgttgtatctccacacctaactcagcattaattttctttaaaagcctatcagaagtatctgcgctgttgggttgttccctaactgctagagtcccgctatatctgtttaagaattgtaagagcatctggaaacagcatgcaagacccccaaggtattgaggcaaaaagctccacccactattgatttgccatctcggtttccataaaacagccagctcagccattgctaggggtctcagaatttcttagattaaggcacataaatgcccttatgaggttatctttgagtatttgaagaaagccaaagctattaacagcttctaggaatttttatcattcaaattcactacacactaatagacttaatttttaaatgcttcctgcttaatccctgatggatgggggagagggtgaaaggaataaaagcagtccagtatcttaaaagctgttcataggctcatagaaaaaaatcaatctctctctccatatgtgttatcattggccttgctagtgttgctgaagggtttgttgtgtttctgttaggaatttcaaagatttctaaattgatgttaaccacttgccttgagccaatatagaatctacaagtttgctgccagcaatgagcaggctctttaatggtcatttttaaagccacagctatgtaaccaaaccggagattcttgctgtgcgcctatcttttggtgtctttctttagttccaaattatgggttgcttcctatatgttttcaaaacagattaagcctttctttaatagcattgctccctcctgaaaactattattatcattggaaactgttatttagtaacgatatgtgttattatttcaggacagggtacagtatagcatttataagtatgggccttggagtcaactggctagagttgggatcttggtttcatcacctgtgagtctaaagaccttgaaatgtcctaagcattgaaatatttggtgcctctccccacatgtaattcaaaatacagtaacactgaaccataaaataagtgtaagaatttctaagagtttttatttttctcctctgatgatttctgtaatgctttcaaaatatattagattctttcttcccaaattctcattttgtactttctctgttttgttgttctttaagaagatgttcattcttctccctgagactgtttcctagtctagacaaccagggtaatgataatacctggttaatgtgaagattaagtgagttgaccacatgtataatgctgggacaattaagtcaatcctcaataaatgttagctgtgaggattaccaatcatttggctagcattttaaattaggacatatttttgagtacagatttcttcattttgaagatgaaataccctatcaattagacaaggtagatattttttattctccatttcaaataaaaacagagacccaaggaggtgctatgcccttcctaaggtcacatagcaagtgaaggaagacctaggacaagatttttctgtttccaattgggcagttttcactattgctcccccagagaattgggggatgttctgaaaaatgcatagctagaaatgagtatttttcttcttgtgtcatcttagatttctttctttaaagaagtgtcatatctcaaaggtcactttccaatgatcacacaaaagtggttattgtgaggtgttgagttcaaaatcctcatttaaaagttttattggcaccagtgaccccaagctgctctccttacaacaatggcaatgtgctcccatgaagcagctgaaagaatagtgagtatttaaaggagctatatccccttaccttgctgcctcaattaaaaagttgttgtgtgatatactagatcgaggtttatgttccactctgccaagacttcctaggagcggttcactttttgagccttggataccttattttctctcctctctgcttccctgtgctattaaaaggatcaatttaactattaataatttaaagtatcatgagaaaaatctggcaatgtttattttaaatcataagatcaaaattccccgtgtctgggccatcaaacaaagccatcaacctggcaaggcagtcttgacagtttctacaaaaatgtgtccttttgttttctaaagtcattctattttattattttatcaataacagtaggtttagaaatcatcaagggtttagtctcactactcacttattactaatgtttaaacagtaaagacatacagagtagctcctatagaagatttatgttaagttatctcacttggagaacatgctctcggggaattgttcctgcctacaaggtctgaatgagtcagctgtgcaccgggatgaatgggtcatctccacagtcttctcatgggcatttatggggctctactgaaacatcccaccgtgaaatatttagaacccagctgggcacagggcatgtagcactggctctttctttgtgaatcagggaagaaacagaatgaaaatagttctatagcaatcggaatcttatatcactaaattctgggaggtagaactgaaaagcaacttctttctttgaacctgaaaatagaaaagctaagaaacaggagagggaaataaaagaagaatcagcccagagctatcatccaggcactgacaaatgttccttataaagtctctgattgttgtccctatacaatgcggtggtaggaacaagggagggggggtgaaaggtgacttgagtatgaggaattaattttagccacagctctaggccccctggaaggctgagctgactgggtttgttccatatcttctctctgctgtgagtgggtggccggtgatactgtcactgctgtaagatccctgagcatggtccagtaaaggcttttcaggtcctatctaggcttcctgggacatgcagactgatacacagcttcaatctttgtatgtcagggggtgctgaggagagcagggcataccaactcagttcaagtgctcttcacagaattcctcttcttcagtctttaaaatgcacacggatgacctacatttaaatcctatttgaccacccaacttagaacgtgaaaaagaggtaaaagtagctccctttcaaggatgctacattagaaaactctctttatatttgagtttgtcaaattccacagaaacttgtctttataggggttggaagagaaaacattgctatggtacttataaaacattgctatagtacttattgatgaccaaaataccttcatatcggttattacatttgagcctcactccatcctgtgaaggacagggtttggtattattactcctgccatacccattttaaggttacgttatcaaggctctgaaaggctaaataactttcccagtgtcacacagcttaaggagcagagccaacacttttctatcctgatcctcagactgcacagcctcaaactttctgctcactttcctatttctcagagccacgattttattaataatgacagtatttctttttgtaaaaacatattctcaaatggaaatctctgcctggagtagtctagttagtaaggtttttcaacctattgacatttggggctggacacatctttgctgttggtgtgtaaggaagggggcggggtactgttttgcacattgcaggatgtttagcagcatccatgacttttaccccctggatgccactctcatgtttccacaagtgccaaataccctctggtcagcaaaatcacccccatataagagccgctgacttagagaaagtttccaacatattttgtttaaatgttcatcatgtttttgtaatttagacagtatacatcggtataagaaagattttttttttgtccacatctcttcctcaattattgagactttaaaggattaaaaacaagtctatgtacttgacatgatgctgaaatttctcaggccttgggttttcattaattcctagccaggaggtttactttccttttctttatgtcttttcctgcgaacatttgagaccttgccagatttgaagcatgcattaaaacaagccccatctacctgctcattcatccgttcaggactagcgttgctttcagttcaacagggggaaaaacagagagagcagagtcctgcagagggaataagaagtataaatacaatcaagaaggaaagccatatttgaacaaggtttcaggactacagacatataagggcaaccagagaaagcctcacttaatgaatgtgtttgaacattgtgaggaacattttaaaaccatcttataaagaaggtgctccaacattcagtcacaaaatgtatcaattaatcactcaaactagtgtatcttgaatattcacactgctaactagtcatcctttccaatttgtcagaaatgaattaggattcacatgtttgtgagtttctatttccaagggaattatttccacattatgcagtttgtcttcggttaacaaaaatgttttaaaagaatgttttcaataggcacttatatatacatatttgtgtaaagcaatggtctgcaacctggctgaaattgagaatcccctgggaagtttaataaattgccagtgctcgggcactggtctcagggcatctaatttaactgaactggggtgtggtccatggatcagcagcatcagcttcccctgggagcttgttaaaaatgcagactctcaggcaccaccccgtacctgcaaaatcagatcccccagtgctatgggtacattgtaaattgagaaacactggcccaggcatttttttgtttgttttttgttgtttttaaaaaaagctcctaaggtgattctctgtgtagctaagtttgacattcactgatatgtagaagctaaaaaatgtgtctttctttcagactgactaccggtactgttcaatgtggtagccgccaaccatatgttgctattgagcagtgtggctggtatgacggagattctgaaatttttgttttattatgtacttatgtcctaggcactgaaggctttaaatacatttctcattcagtcctcactccaacactatgaggctataggttagaggctagtattagccagtgcaggactacaatatgccatcttttatttccttttatgtgttttctaccatgtaaacgatgggcatttgccttcatgtaccttctgaactcatctaatgagttttgatattatacaatcacagggataataactccaccctatccaagcagctgttggagagtcattaaagggtgatgattaagcatgagggttttggagtcagactttctaggtgtaaccaagggcccctggccctgtcacttgccagcttgcccacaaccttgagaaggttcccgctgtcgagaagtttctctatgctttgatctccatgatcatatatatgcattttctcgcattaaaaccaagtgaatgctcagattgacattactataggacacttcacaaaaaaagaaagtactggctagaggtatgtttcctaaacacacatggcaaactaccctttcttaagctatatttgtatgctctgacagcatggctatggtgcaaatctatcaacaaacttgaccctaagaagccagttacatgacctataaaatggggattgtgttcattgttctgtcttagaaagtggaaagttctttgaataccttaaagcattgcatgaataataattgtacctgcaggtgtattgtctggattatctaccacccgtatacattttaggaccattttttatcttgactttctacaatgaagtttacttatgaaaggtgagaataggggactaagagattttccatcttgctttctcatccttcatggagaattccacaatagtagaaacggttccaaagtgagggacatgtgcactgaataaacactttctcccagaggtgtaggaagtggcagatggtgccattcaccgtctctcagccaaactcacccaggtggtgatggctgccatttgccgaacatttatgacatactccccacttcatgggcagcatcctacttagtcttgaaaccacccattaggacagcgttggtcttattcccatttttttagattaggaacagtctatgggagtgtagcttagtttgggaaatgctggtattcaacccagaaccatctgacttaagagtcttaatgtttaatcacactctgctccttccttagattctcgtaaacaccctagaacagttgcatatcctagaaattctgggtttaactcaaatcttgacaatttagaatttttctctcaagttaaattatagaattcccccctcaggttaaatctctgatttctgcccagtctagaagtcagcatttccttgggcatctatacatatttggctttatctatatcatcggtgtggcctctggaagccttgtcagcctctttctttttgcgatcttgttttaccttctagtgccatatctatgcaaaaagaaagaacttttaaatgaaggtttgttttgccatttaatagtcttgcttggggagtgacagagtggcaagaaggtgcttagtatttttttaatttaatttttgttttatcaaggaaacttcctttcttctctgtgaattcccagccacagataaacaggcttgtatcttataagttaaatacaattactgctatcaaacctagagcctttttctctctcccataaatgtctctaagaagctgataagcatttcaaggcaaactggagcttggactaatgctaaaattaaacataaccacccagaagacaaagagaccagatagaaatacataaaacatttgaggtggtgggaacacatggacacagggcacatagaaacttgcccccaaaacattaggttaatacatagctcaaggttatttataaaggaattaacatacacaaaggagctttttataattataaggatttacatcagataataacaattgtagtagccaaagatattatttatctagaattcacttgtgaacagggcatgcttttggtctacagggctgttgagcaaaagaataattttgctgcaaccctctgtaggactttataggatgcacatttacattttccccatttttagtagactatcttgggatttaaagaagaagttggaattttaaaaattagaaagcacatcatatttatttagccatatgttaaatgttataaatattatagtttagggactcagtaaaatgaataattaaaaatttgagggtcacttctaggtacaatgtaaccagggatgtaagataaagaatttcttgatttccaaccataatgcatctattttaattaaataatatctttcaagattagaaatacagtgtagtcacactttatgggatttttaaaattatacttatctgaaatagtgtgacataaataaaaatattaataacatctccctctatgtgaggcatcagtaataacatacattcttctgaattaaaacaatcatcaaatattgcataatttcaaagctggttagtgaattacaagttttgttttccctattgtcacatggaagctctagtttaagtagttaatacaaattctggcctgcagaagttgtctctaattacgaaaacttagaattattatcccagccataaaatacaattaccctgtaccgtttttcctctgccccagagctgcctgaacaccaagtgtcctaccacccatacaagagcatagttttatttatgggaaaagtttccaagttccagtctcttcaatttaaattttgcacaaggttgcagagtctctctagttatttaaagtctaaaaagaacactgagcttctttgagaaaggtggtacataaatatccaataataataatatatattcacatacagtatgtcatttatacttctataaagcagagaaggtaatgaaaggtgctctatactgtaaatcactcaatcgattgtaatcatattgcagctcatctcaaagagataaagaccttccactcctctaaaatccctgtcaatatcctagcaggctgaagagaggggaaagggggtcagaagaggaaggagggaatgagtcaaggacaaagcggcactttgagtcttcagttcatggagttaacatgaatttgattggattcccagtgatatttacagttttctccataagatgcatttcttttccacacggtacttttacagcctttcagtaagtccctgatgctctgtgttggccttgatggcatagtttactaagtgccaatggtagatatatagcacagcataagaagacttagggactaagtttataagtagcaaatgtcaattcgacagaacttaaatgctgaagtgtatatcaaacaatagaagtcgattgatcatgggctagcaaaaaatttatattgcactttcaaacagcagaaacactgtaaaaacctttttactaactgctgttgcctttaatgtaatagaagtattcccctatcctcatcaccggggtagctctgagtggagccatttctttatgcacttattcattcaccttcattcactattcaacaaacatttgttccacatctactttatatgtgaattcatactaggtgatgggtatatggtgaaaaatgaaacacagctcctgacctcaaggatcctcaagtgtagttgaagagaaatacaagtacacaaggaagacatttttattgagcagttattaattgccaggtagggtactgggttcttgtatcaagtctttgcagtagccccaaggggtagatattactgttatcatttcacaaatgagaatctggagcttctcctagggtcaagctagcacatgaatacctggaactgaagcctgtatgtcttagaaggcaaacccaaagctcccgtacgctgccctatcttgaacctacaattccacaaagtgaaagaaggtgctactattgaggtgagatccaagttcagtagcgggtacacataaatgcctaatggagcctgaagatcagacaggggcgagcatggaatacaatttgggatgtgaccttgaattatctggaacaatgccaataagctctgctcccctacctagtgtgaaagatgacatgacaacttatacctttctcattgaggaaattaatgaccatggaattctttcttttacttaaattttttttttacagttttattgagggatgattgataggcaaaaaaatcctgcgcatactttgatgagtttagacatgtgcgtacacctgtgataccttcaacacagtcaaaataaacacattcatcgtaccttattttacttagtgtcatctccccagtggttccaaggtagaagtattaatctccctcatttacagatgagtaaaccaaggttcagggaggttgagcacatttgctgtggtcactgtccaccaagggtcaactctgagattccacacagatatgtttgccctcatttgccctcacaacctaatacccaggttgcccactccacttttccaatgtcttccaagagcactccagtttgcatcatctacagagctcaaattcacatggttgacagatacaaattcacatgcaaatgtactattatttcctacatcccagtgcatgcagaacactgtaatcccattattaaacatttactagaaatgtgcttctgcctgatgcacaattgccagcctcaatgtttaattaaactagatttgttttcattttaatcacattagagaaatgtgtttttctcagagttcagtggtgaaatcttcattccaaatgcctccaagtgactgaaaactgtatatcccagaggaagggatgagggtattacaacctatccttgcataaaatattttaggggaaaaatattaattaataacaggtaagactgggatacactatttgtttttgaatcatcatagcatcctggaaaggggtcctattattattattaccattttagagatgaggaaacgaagtctgagtggttaagtaacacactccagtgttgcacagctagtaggtggcagaaccaacatttggatgtagacagggaaaccctgatatctttatttagattagggatcaccaaaccttttcccccaaaggccaaataacaagtagcataggctttagaaaccaacctatcttataaatataaatatatttagatattaacttcaatattttattaatataaatatgatatgatttgcatgatctttgttgcagttattccagtctgctgttataatgcaaaatctactatagacaatacataaatgaataggcacagctgtattctaataaaacttgctttacaaaaacaagctgtgatgaaccacgtttccccattaggtttagctgggggaaccctgatttaaatcacggatagttggaagcctacagcttttactaatccatcagctttattttttgaattgtcttatctgtttggaataaagagagcaagagtatctctaagtggatgggttaaatccctagagagacagagaatagtactaccgtgtagggtgacatagacctactggtgaggttaattcaggataaagaaataaagagatacaatatgtaagaaggacaggcactccatttacgtatagttaaaaatgacaaacaacaaaatagctaaataccatttttttaattcaacaccaaagacagacacagattccattctagagcaagatttgaagatgatggacagaaagcattgtttctttacttctgttacttctacttaataagccgtggtgatttaaatacacccctctctcctaaaaaaatagtgcttacttttcttttaaattcaagaattttgattagccaccctagcctatttctcatagcccttatgcataaaggtgccagttgatgccttgcattgatctttcttttctcctacccgcaccctgattgatatgtctgtcttctaagtcttagagagcatgcccttcattatctcagcattggttgtccctgtcttgctgctgagagcttcctgcttgagcttcagttccattttcaagccattgatctgatgttctgaggatggactagcccactttagaggtggctcagcccacttcatgctattgagttttagagattttagaatcagatcccctatttattaaagcagcaagaccaggctatcagtttttatagatgtgcatatgcctaaaaccatgtagtatttaaaataaattttgacctacatcctctattccccaccacgcctggtacccaccattttactttctctttctatgtatttccttcacttttattttttgctttttggattccaaaaagtgagattgtatagtattttttttctgtgcaaagttataagggatgaataagtctagagatctaatgtacaacataaggactatatttaataatattgtattattatatattgataatttgccaagagagtagattttaggtattcatacgacaaagaagaaagaaaggaaagggagagaaacaatcactgtatgagatgatgggcatgttactttgcttgactacagtcatttcagtgtttatatgtatatcaagattacatatataccttatatgtatatataccttaaatatatactttttttaaaagccaaactaaagcacactgggtttttatttacaaaatagggacccccttcacagtttgctgacctcaattttgactccaattaagttatcaaagttctaactaccagaatagaaagcatatactgccagatttggccctatagtgcaagaaaagtggtcacagttttcttaatcctcttttaaaaaggaaagaaacaaacatagtaggtaatcagtaaatattaaactgtacaactgaggtttttggagctttctgacttcaatgactgcatatacacaacaaaaatataagttgttatacagcatccttgacaagcattaactataaatacttttataacaaaagaaaaatatcatttactacaaaacttttaagcttttgctttagaaatgtttctttattgaaacaaatatgattttattgaaatattttttatattagtacgatgactctttattggtctcaaagggtggattgccaagtataattaaacaaaatgataaataggaggaagatttcagtatccttgacagaaaaatacatataaatctaatatagatatatatgtaaaaagtaaatctaaaatcttagccaaggtttagaaatcttattacttcatttttatacctttataaaactgttgcgaggtgctgtttcaaataaaataaaaatttatgtaagtaaaatacaagctaaaatagaactgaaatgtctttaggtttacaaaatgaatagctggattagtttactgaatttttttctgtggtatgggtggcactggatctctagaatcggtaaaaataaaggcaatatattgttctcagggagcaattgagctctcctagaggaggcaaaccaagtgaaatctaatagttttgcttcattctgtgactttcccccgctatgacctcagaattttgagctacaagtaggtctataaagggaattttggaatactcttaatagatctgttcttgaaataagtcagctaaactgagtgaggtgctttgccaacacattaactgaaagtcctgaccaaccctgatcccagaccttcatggacaattctcttgttttatttccatttccagtagttgtatgtaattcttctaagagacttgttccaagccaaccttcctagtggtcttgttgaaatgagatagtggttgtaggtatcattgatgaacacataggccaaaacattattgaactattcagaaagtaaatctagcttattctgtggctgcataattatataactgtagctttctgtcaggttacagtggctttaattttctgatcaaataaaacaatcaatataattgtactttgttcctccctcttctggcttcgattctttgatttgtgccactcaccactctcattcttccaacctccccctactccactggcccctgcagctacttagaatagctagctgttgattaaagggaccaagagtttgagcagttactgtatactttcaaaccccactgccatttggaagtgaagtcccaactgacatagccaaactgtaaggacaaaagcaactctaatacctgctttcctttgtttatagcaactgctcaaattctcctctaaaagtattcattaagcatccttctctataaatctctgtggtagaaactgaataataggacttgaaccattattcaatcagaccaagtttaaacccaggttaaggaaagaggaagtctacacgtctttgctgctcactgtgtttagtatatatcctctataattcacaatcaaaagtaaatctttggacagcattcttgtttgggttagaagaaaaatttcaatccttgttcagaagtctaagcacttgtgaggattccaatatgatttttaaaggccaccatccctgatagtcagaaataaaaacattaaaccaagaagactgcaggctttcttctcacctgtccatctcttgtcctaattacaccttatacttactaatgttgtaagtgctttttgacaagacagcaatggtacatcaatagatactgcatgaacttgagtaggcaaatcaagtcactcagaggccttcttttaatctcttggatcattattgcaaagataaaagcaggtttctgaaggagtgaaattcaaaggaacctagtaattagaatggtgaaaataccaggtcacccggtccgtttccctgcttggttcagatatttctaacaatatgtactagtttaattttattcatctaatttaaaatgagagactttatctttcttccaccaagataatatatctgatttctcctctttggcttaaattttttttttcattcacatcttttattattagggttgtcagttgaaattattttgaataatttctttaaatcatggatttttttcttacatctcatatctaggagctatttcttgttgcaaggtgcaaggttctatggcacatacaaaagcatgctttcatttgggatatttataaaatctctctatacacacacacccatcaatgggcaaatataaaaagtattgcctttgtgctagcatgtagttaatattcaatgaatatctttacacgtaaaatcacctataatctttagacatgttcctcagatagccaagatttaatattacatataaagtcatatgaaatagcttaaagaaggaagaggcattgttattttatgtatatgtctcaaatgttataaaggttataagaacctttctgaacatcgaaaacttcaaagctaatagtttaatagtttgttggatacctgccatcttttgaggtggccaatagttgtcaactttttgagtatccttgagcactgaaggtatgtcaatgtttggtttcattgtgtgttaaggagggaattatagaagtagaatggagtaaaaagcttaaaaaagaaaaagcactgcttctaaggtgattctaatttcataggaaaaaaatactttaaggactaatattcaatacagagtagcggaatctgggtgccagataaatatttaacatttgtggataattttacataatcattggccactttcttaaaagtgttttttaaagccctaattttaaaaaatgctattctggccatcacatttacaatgtgaataatatttgagtcatgacgtaactataagttacttctaatgattgactgtcacttgagttgtaaatcacagcatttagcagtgctagttgtccttacttttggtaaccccttagtccctggatcttgatcattttggggtctttactctagagtctatctttgctctagagtctagctgccattcacatgctaaagaaatgccccttaaatagtacctataacatcctaaggaaatgatttctaaactcttctcaatgagtttaaaaaggctgctttttgctaatccataaactttaacaggggctgaagaggcagtgcctgctttttaaaaaccaatgttgcaggctgggcgcagtggctcacacctacagatgcatgcctatagtcgcagctatttgggcggctgaggcaggggaaggcgggaaaattgcttgagcccaggaggtgaaggttgcagggagctaagatcctgccattgtactccagcctgggcgatgagagtgaaaccctgtctcaaaacaaaacagaacaacagaaaaaaaggtaaaaccaaggttgcaaggtaggactgtttgtgtgtgtgtgtgtgtatgtgtgtgtgtgtgtctagttttgatctttaatgagagttttggtttgtttctattgttgtgtgttagtagggaatgtggtggaggagtgcctttctagtctaagtatacgtaagtgtattcatgaccagtattcaaagggtattcataccctgcagggacataaatggttttgttttggaatgttagggttaagaatgaaagtgatggccctgtttgctcagaaaaaaaagaaggtaatccttcagtgctctctgtgaaatcatgtatggaatgaaaaaattcattgatggggtgagaggtctcagtgccagcaagtcttactagtaaattcagaattcagcctgctgttcctagagatcttcctctccactcctcatccaaagagtgatagaaggaggtcagataagtaggtccttgtccctttagggagctacttaactctactcattatcgtcttggagtcaatccccacctcattccctgctcttcccctagtctgtgtctagaatcaaggatcagagaagcatcaacacatgcatcaacctttctccaattttccttccctttcccaactccctcagccttaccctctcctctcaggaactgcattattgcatctcttcttttggatttggtaattctttccttagaaagaggaacagggctaaggataggcaacaggggcccagctgtccatgtctccatccttggacccctaagacttttgccacacaaactcctttgaatctggagactgcaacggagctgcttccctcctcctgctgagccttcatggaaatcctcataggagatagtgtttcctttacccactctcggacccctgttcttcctggatctcctgaattcctggctatatcatttaggttcgctgcattgcaaaccactccaaaatttccgtggctcatgtgagtgtttttttctcttctgggttggcttggatggagctagatgatcttgatggcctcatgtacccctctggggtctcagttcagatagccgagtaggttcacatggctgggtttcttttctcatggaagttcacatggcaatctcaggtgtaggcagcaggcaagggcaagcattcatacacagatggctcttcaagcttctgcttatatcacatttgctagtgcccatatgcccaagcaagtctcacggcccacccagaaccccaagggtgaaaagatagattcaaactgttatgagaggagtaagagtctcactgccaagagacagattttgaaatgggattgtagctattttttttttttttccaatttaacacactggaaaagaagaaaggctctggttctactaatcatatttccctcgtaaattttctccttccaaccctgattcaggtctcaagctgtggttggaaatcagtgactttcactaagggattgtcctttcttttctttaggacatggctttttgaaattaatcttgattctttctgccatatcccaagccttacatttttttcctttttttctctatgtctgatcattttgctttaagtcaaattgattttttaaaaattaaatgcccattaagaaaattatccacattcatgttcccttggatgctttcaaatattttattttcctttgcttttggcagttacaatctatcagtgttatttgtaaaatgtcttatatttgtatagggtatgttctccctttcctcttttcttcttttctttttaaactaagatagatgtgttataaaacagcccccatgctgatccatacttttctctagacatttctgtgagctcagtactttgttgtttatcattatcctttgtttgtagccagatttgaggccatgttgcagttctcacaaacaaatcaatttgaattaatttgccaagtagaattaacgaggcattgtatgaattcaagacatactacaactacggcatcccctgaggttatttcttctctgggaaaattttgattcttgtaccacattttaatagtgtatatctgacctttgaatcttgcactaaatgatacatggctgccagctggtttaatttttgagaagccttaaaaattctatgcagccaaacaaataggagtgtagacaattctttaattattaactttacggggagaaagttgtcttcaagatcgatactctctgatgcttgcttgttgctaggagttctttttctaatgatgttctaagcagaagtttgagaaacatcaaaatagagaatatatatttcttagatggtctttgaggtctccacaacctaaaaatgatgggctccttctctcaaattataagctataaatcccagcaaactctactcccagaaactgtttttatttaattataaaatgggaaagcatttactctaaagagggaccatggtgattacctgaaattccttcactccctaaatggacatctacatctgtcactaatatattatttagcaaaagaatttccttcagactatgatgaccaatgcaaacaaaataaataagaaaatccagtcccctcccacccctcacacggtgaggaaatggtaatagagttcttcaaagaaactctaatttctgggtcttagatgaataacattagaagtgcttaaggaacttgaattctaagcccctttaatgttcgctcagaaataattaacaggagccagtcagaatagaaaactagtctgggaaaagtgtcctaaattttacactgtataataggatggatctcttaaactcgggactgatatataaaacttctccagtgtttcatttgaccaaaaattggcacacatttagctagatttaaaaaagaatatggtgatggctgagaactaacctgggctcattaaaaaacaaacaaacaaaaactcacgcatgctagtgtaactttctcttggatagcaatagcaaattggcaggtgaggaggatattataaataccatgcacagtgtatcttcatttccctaaagcagtatactgtaatgtacagagaactatgaagggatcttaaagagacctgcctgtgttccatcatttgaagctttctggttacactgtaaagtttgaggtaaactaaaataataaaagtaaaatttattatctcacagtttctataggtcagaatttgatagcagcttagttgagtgattctggcttaaggtgtctgatgagttgcagttggtatgaactacggctgcagtcatctcagtgctatctagacctgggagatctgattacctggaaatctttcactcacatggatgttgactggaagcatcagttactctctggctcagttccttgccttatgtatgtttccatagaacttcttaagtgtcttcatgacatgagtctagcttgctcgaaatgagtggtccgagagagagcaccttttatgactcagtctctaagtccacacactgttccttctaccgtgttttactctgtagaatcaagtcactaagtccagcccacaatcaaggttgaagaatcaaacctcacctcttacacagaggagtttcaaagtatttttagatattttatagctccatcataatcttcctattcagggactagaatgaatgcacaaaaaatatgcttattaaatttgcagataacacaaagctaagagaggtatctcctaccagaaacaaaaaatcctagagttaaacattttcttaccatgtttggatgctgttatgaaacaaaaagaatacatttaatgagatataaatacctgttggacgttcataaagtatgttgtatgaatgcaacgtggaacaatttctttgggaagccattcaactagaaactggcttgagttttagttagaaacaagcctaatatgcggtcctgttatgatgtggttgttgaagcaacggttgcaaatcagtatactagtcaggcctcctgtgggtggtgactagaacagtgattgttacttttagatattttgggaataataaattcattcttaggcaagggggttcaaggatggtctaaaatgtctacaattttataaacactggcaattctataggatgtatacagaaggattactatgtcataagtttcttgagcatcggagatattaataatagcatgactttcctgttgtcgggatgacaatgttcctgtgttgtgcagcggaattgtcctcccaaacctcctccctgtcctctgagctgtgtggggacaccacatatgtatgtttaaatgaacagaattttaaaaaatcaaatattctggcattctggcttcaaaaaccttgcgtttgatgttctctacttagaaataaataaccaaacatgagaggaatgagaggagatggggatggggagtgggaggaagagggtagatagaaataaaaggaagaacaacattacagagaagcagagatgacacagagggtggacacgtgggaaggcctggatcacaggggaaagagtgagccccaaaataacactgtggcttttgcagcaaggaggaaataagtgataagaggaaaggcacctggggaaatcttgaagggatcatatgtcaaacggctgaagagcaaacattaaagctttattttgaaaaggatatttgaaaatatttgacaccaaaaattctgtagggaagtaattcttgtggagtttgccttctttttagtttaactcttctgaatcaggtacttgttataacaaatcatatattgagggattattttgtgccacagatttgcaacatgctttatatacatttccttttaattctcaccgcaatcccatgttgcaattattattacgatccccttttaaatatgaagaaactaaaacttaaaatgcactaagacatggctaaaactaagcatggttaccagaaaggaacaagacaaaattcagacattgaaatcaactactgtagcttcagtgcatatttcagaataattgtggaaggaaaaaaaaagtgacatttgaggaaagaaagcaaattttacagtcagtttatgttttgttaatttataacatggcctttttgagaggggctcttaaataaagaattggtgccaggttaacctggcatactgaagaaagtttcatttgaagttgcttgaaaatattctcttaaattataggaatgaataaagaggttgcagtcgcctgggcctagttttattaacctaactgggattgaaagtatccttgatagaggaggagaaatgagcttcaggaagtgagttacaaatggcctcaaagtactgagaaaggataatgattggtaaaatatgttgtaattattgcatcaaagtaaatcattttagtacataatacctcagcagaaatggatttttgatttgtttaggatatgaaagagaagtctaatattaacatgtatgcacaaaacatgtatgttcaaccagcaacagacagcaaggaataggggcatgaacattcggatagctggacgtaatacaccagggttacatctccggcatggttccattcccattccatagcctataagatatttggacatgataggccaggtgtggtggctcttgcctgtaatcccagcactttgggaggtcgaggcgggtggatcacgaggtcaggagttggagaccagcctggccaacacagtgaaaccccatctctcctaaaaattagctgggcatgatggtgcatgcccatagtcccagctactcgggaggctgaggctgcagtgagccaagatcacaccactgcactccagcctgcctgtctcagagaagaaaaaaaaaaagatagttggacatgataactacatgtctacaggctcatcagagagagagcacaggcagaggctagagctcaatgcaaatatcgagactgaaaaaggttttggaaggctctcaaggcaaggatttaccctgactcccatccccctgctgttcaaggctccttactgggagaaagaactttcttttctaagccttaggtgagtgttagggaaggatcctaagaattaaaacaaatcacaggctctctcaactcccaacctcttttgattccccacaagctaagcccttgcctgagttattgcatttaatttggataaaaccatgcaatatagatattaccttttttaaaaaaacaaaaaacagatgaagacaccaagagtcatctagattaaataaattgcccaagttcacagaactgataaatgtctggacttgattcaaagtttgtctgactccatatccaatattcttttcactcatgtttgggccatctttgcttaaacagatcaactagcacagcctagagttggtaaacccatactacaactttaatttaggaaggaaatgatactgtctgctcgtatatatttgccattatcagaacatatccagaagacatgtagaggtgagctttatcagccaacttggtgtacgacagggtgatttgcacttctttccagggtctccctggctcaaggagccacttaaaaagctcccttacttaataatgcccttgtgctctgggtctattaatttacttcccacaagctgatcaattttctgttccaagacattaatttctttaccttggcacattaaaggatcaaagctcacaacatataaatagttctttttccttctgccccaaaggtgtgtagtgaggattaatgagatgatgcttataattgcattttgagctccttggtcgaaaggcactttataaatacaagatattagttttttgctgagatccatctatcacttacaagtggccaaacattctagatggcctttgggtgtgcaacacctccctctctgactctgagttggtctgggacaatgccagaaatgtggctcaagccaagttcagagtttctggagttcccttcctttagtgtcatatactttctctgaaacttaacttagaaagtgttctttgggggaagagacatggcaataacctctaaactgccctagtacttgagggcagcagtaccactacattgattttcttttgcctctgactttaatacatagcatttattctttgactgttcattagacccacagtctgattttttagtgtcaacaaagcaataaagaaaatttgttcctcctttatttcagggctcaagacaaaattcaaaaatgcctttggcattcattttgcacagacgaatgttgttaggatattcctattagcatgtccacgtgcttgacaacatttcaggtggtattaatagtctacctgcaagaaagtgctttctgccagcctggtgcaaattggcagaacctttaagccactctttctcagcttagcagcagtatatcatcattacctgtggctggaccaagaaatcacatttgtcaatgcctgaattgctcttttactttcagtggttttagaaatccactttgttttggaaatgggcttagctgagtatgttagaagatacagaaacatataaagtgatagataagggatttaagggaatattaaggatgttacattttctatggtcagttgatctttggaagatgacttttgtgggaccaaatagaatatggtcatcttttgaatgaaggactggtaagtgggaccaaatagaatatggtcatcttttgaatgaaggactgataaggtagtgagacaagggaagcataccgtggaactaatgagcttccttctgatcactagaaaagagtcgagtcatattaataatgatagtttaaatatgctgtactccctattattctatactaagtcctatggtaaattgagaaatggggaaactgaggccaagtgacttgcccacgatcacacagctaataagtgataaagttagaactcaggaccagatttgtctccagagcccatggtcttaactcctatgctgtattgattatggctttaagagtattagtataccttctaattaaataggacccatgtttggaccaataaagtgtaagcgcagtgttgtaaaagttattttccatgttatacaagagttctatttttcagttttttcacttgaaataattgtattccttggagactgttaataaatttcgagtctcaccttaaagaggaattgatgtatattgaggcctactcaagggtcagtttgctttccgtttctttcccttttacttttatcctaagtggattcacccaaagtggaaaatgtgaggttggagtgtaaaggttggaactatgaaccagttgggcttcaatactttcacctcaaagtattctgttcttcacaatattataattccacagtgcatgtgcttgttgcacacgtctccaggagttgaaatacttgatattagagccagtggtccaaatgaaaatgaccagaagaggccaaatgtataatgttctcaatcccttatcaaaaatagatgggaataaacacacatatatttaagtacaataaaatgtgactaatatgtttttttctaaaacccagtcccatataggtgtcggatccacagaagtaatttaagaatggtttatttgaagatctctttgtataatttatagatttctcagtgtgattaagaaatgaagttattacatttttttctctaattagtaatgcacgtatgcctccttttaatgatattatgatgtttactactcatagggccattctttcttgagtatagccatcactttctgttgaagaattgatttcactctttgtttaaatgtacatacttgttgctatatgaaatatatgactgaatatcattaaagatttagcaagaatgtaggtgaatttggtgaggtttgttcagcttttagagtagccctgtataagaatacttatatttagaaggttgtttgcgcttcagtcaaactagcaaatgaggcatggggcaaataactcattctcatgcacatgtttctaaaacagttcttactaatgtttgagataaattaaaataaacaccaacaagaacatgaaaagagactaagaacaatgttaatgcggcaacttaaacaaatttggttttccaaatgaccttccatctttcacaacttttaacagcatgcaagattgctatccttagtgccagatactatcaatctggtgtggaaaacttaaaacttttttctaaatgtctttaaagctgaggtggagaagaatgactctctgtcactttcagaagggtctaaggttgaatcatgaccatgctgtccttccccatgtcacttactgtttatctaacatagttatctctttttctagcctgtatcatgcccccagattattttctatggtgctttacgtttgaaagagagtagatgatgagggtggggatgcttaggagggacaagggccctgtgtatttggaggaagtaaattaatacagcttcttaattaatttggtgtatattaaattctagaaatttggaattttagttacttctgattttgccctgcattttgctaagaatatttagctttatacttgctatcgactacaccaatctattccgtagtgagtagaatgaaggtcattaatatatttaatgtgtagccaacaatggcagatacagaaaacccaaagtaatagaatacattcaaggcagatctggcgcaagccaattaccttttctcagtatagtattctgttgtgtctaaaaccctagaggatgaatgacatcctttatgatatctgtcacctgtagggtaggattatgagttatagatgtatattcgtttcaaaaaggtacacgttctttttctatgaaaacgtctaaaaagtttactcaactttattttgaatgaatagaatgttgtaccaagatctaccaaggtagaccattataatgatctctaatcgatagctatattctttcgccatgggctattgaaacaccaagaaattaacttgcctgtctctttttcctctttgcctgccctctccatttttttctatgagaaatgattccttgaggaaaattttaaattatccactgcagttcgaaactgttaattgttcctattgcattttatttttcaatacattaatatgttataccctgtaccaaccagatacagtcccaaaacataggctagaagcagattcatagttgcctcttttatgagttcttattttaaaaattcctggtagtaaagatatgagtcagcttgttagaataatttgtctgtatgagaagtgaatggggaaccttgtgaacatcctccaatattgctacccgtttcctatcctatacccccaccctcacaacacagaaggtaggtaccagtttattcccaggtggaatctcctcagccaataatgactcctatatggagatggccctgcaattgaaatgctttagcatgcccctattcatttggtctgatgctatatgcaattctaatattctttatggcttttagaattctttgtaaattgtttccaagccacctggtttgagatttttctttcatttttaatattggtagtttggaatggagttccccaagttgcaatataggcctatgaatcaaaagtaatgaattacaattcactaatttctgccagatcaatgtgaggttggttgatgagatagaacagttcccaaggcatggcttcatcattttgttatttgaagcatattcattaagggtgtatctccacagcaccactctccaagtctgtcctaattatggaaaccattcagcagtgttaataacagttacgaaggaagagggggggcatactggcagttaaaaccactatgtttgagccttgaaactaattagatatttcatgcttggaagaagtattcctaacaggctttatgaatggatgcttgttcagaaaggtcctcttacagtaaggtaagagaaagagaaagcaggagggagagaggaaaggagggaagtggagggaggctaaatatacaaaatcagtgtctattataaaatatcggtgctcaaaagtctacaaatgttgtaccactatattataattacctctatttcctttgacatttgagtttccttatttttaaaaatgtggaacaaatctggaaagatagtgatataaaagcttatctgtactgatctacctctttgacaaagataatgagatgcaaggacatcctttatgtaataagaagtctcccttggccatcaaggcttaaattgtcctctcctcctttcccctgtcggaacataaagctgttgcaaacacttgagaggagaagaaaagaaggacatggccctatgtttctgatgggaatacggtagattaatagtgcagcttgcgtgactgtggagcgagggtcccgtctcacatgtgaaactgatctggcaggtgaattagtcatgggtcaaggagatccttgtgtctcaactggcccaattaaggtgtggttgagatgagacagagagagagtgaaggtaaatccatttccgtaaacggccagacctcttaaggattcccattccatgccacttttccaaaacatgatggagtactgcatggctaagactaacctgacctttaaacctatcgaccaagggcagagtgacttcaactccacctctactaaagataaattgatatctatctctaaaaacttcataaaacaaaccaaaaaacctaggatgttttttaatgacttattgacttttcagattgttctttaagctgttttttaaactttaaaggcaacactgataatgaacgcttccaaatggtaaaacagaaaatccccttcaaatataatcggcctgtagaggagtggctgcaggaaaaaggtaaccgtcattaaaactttcattttaaaatcatttgatcctaaaccctcatttttaaagcctgcaaataaatgttccttaaatgataatcgcctgctgcataaatgactgttttaattttcattataatttgtgtcagcttccacctgccatatgttgataaatcatgctataatacattgccattaaaatacagttaaagggactaacttctagcctgctatcagcatgacaaacacaaacaagaaattccaggaacttctaaaacagaaatgtattatggcaatttaaccactgcatgacattatttattaatttgttttaaattaccttttacaccaaagctttctaaagaaattccaaaagggctttttaaacttacacctggaggctgttttggcttgtagcatgcttaacaaaacaaaaaacaaacaaaaaaacaaacaaacaaaaaaccatagattgactcttgtaacttaaactacttaaatattgtaaggggagcatttttttttaacatttgttcttaaagaaaaaaatgaaaaagatgaattttgcctttaaaacctacagaggcaaaattattttctaagagattaaggttgtgtcctagttgctgactgaaactaaaaacaaaaacaaacttattttacacttcggttgtgtgcatacacttgtgtatttgatgttttatgcaacaaaagtgtaagaagttaacataatgagttggaaaagaaaaggttcatgaaaggcaaaacagcagtctctgatttgctggagacaacaaccactgttaataaaagagggcagcggttataactgatgttagaattttcctgtatagcttctagctgttagaaaataaaccattgtttttcaatgaaaaacagtctctaagaagatacgtattctttgttgttgttgttgttgagccagtgtaagctactcttgtctcaacacctaaagggagctcttaacatttgtagagatttcattgagttatatagaagaagtaaccaggtatattacttagtatacaacttaaagagcaaaggactactacagttttaagttggaggaagacattcagacctttaaacgtggaaaatcctcacggagtgttaactgtttgccctgtttttaatgtatgtggtctaattaaaaataagaataactctaaaaagcaaataattttgtttagtaatcatcagctcataaagtccctttaacattaaagacaatgattgcctcactttaaacaggaaaagcaaactagatgcatgtctgagtctcatgtgcctgagaaacctttttgtttctttcaattttatgttaataatttttattttactccattgccttttaagtctaagtttaatagcatgccaggcattttcatttgtataaaccattataaagttattagtaggcttttagtttttcttacaatagaattgttacccgttggctttcacataaaaggtgctttcaaatatacaagttgaggggttgggatggggggaggggtggctgaggtgggactggggaagatatcctagtttcttaaatatatgtatgattatatatgcatataaatctgaaaagaattatttgcaaaccgtgagtttctcttctacattttgttctctgaaaaaaaatttttgttgtaatttgggtgagtaacatctatgcattctattgtcttacctcttcctctgcctagctaaccttcccttcaaaaggaataaaatataccaaagacttgtaaagacaatgaatataaaggataaagatagatggatgattagacagatgcatttggaagtatttggaatgcctctttggagttatttctgtcactggggtggagagctgggtcatagcattcccaagtctcttttctggctctgtctactattgactaactttctgaccttagacaatccacttaacctctctatatctcagatttcccatctgaggacgggcaaaataatactgcctattccccaagggtgttctgaggtttaattaattagtctttgtgcaacactgactggagacatgcaaagatttaatttaagcagtatgtgaacttgatgtccaaatgaggtaataattaatgacttccaagaggatgggtatctaaaacaaaaagtaacctgctacaattcctctaccagtgtttgttataaccaaattttgcattaagaaagataaaatagttctcagattaggatatatatgcataaatatgcacatatatatatatgtttttatgtacatataatggtcagttattataaaaatctgatcataagccatgagtgaaaataatgagaataatgagatctggcattgatttggggaaatcttgggcaaatgataaaaagaaactggtcagttcttcacattcttcatagggaatgaatagtgatggttttttctgttattcactaacccctgtttatctgagagataaattaatcagagtaagggatggcaggacacgaagagtgctctactgttcctttactgattgctagctttgccattaaccacctaatccaaggtacagggagctaggagagggttttactacagcagaagagcagatctagccagaaacagaccatgaaacaaacaagcaaacagaaaagcaaacactccctatggcaagatgaaaaactgaaacatagacaaccccctttactgtctcactccatcagtgtcttattctcaagaattgattagtcagatctctctgggaaagtagctgtagtcaggagtagaggggtagtttaaatcttgtagcccaggaaacctgccttgcctttcctgatgcttgggtcagtcttgaacaggcaaagagcactttgtggagtgaatgatggcaactggaatgaaggagactcatcatctctagccagtgtaattcagctttgcattttcagttttctctgatcctctttttatttgtaagcactggcataataacaccactggagagataagatgagaactattatagaggttatcattgtgaagtattttcaaggatattagaatgtaagattttctacctgtaatcaagtataactgttaacttatcaccagtgctgaactatacacaaaataaagagatggataaatattatgattcgccagcagttgtgtgcatggaaagtatctcttggcattaggctgtctaatgtaagatactgaattttttcctagaaatctcctgctaggcagctgcttctaatttctaattcattatgttaagctgcttcaaatgcctctgtggggttgagggagaatttattttccccttccatcatttcatgtcttttgtagtaagctcagggcttccagaaaaaaaaaaaaaaaaaactgtcatcaacaataaacagtaaagaggtatgaactccagcatattacttagtattattatgcattgaactttctgctgtgtcttgtgtgaagaggacagaggacaaaatacagacagtgatgcatatgcacaacacactaaatgaattgctgagaaaatgatgaaaatctatgagatctgttttgattgcatccttgggatctgggtaattctgtagtcattaaggccagcagatcccatattcaggttctggagatttttataaagtatagatcattttcactataacaaagttctctggccaattcaccatactgcagtgttgaaagcttccaaagggctattatttgtaaatcattcttgattaatgggcactatgagttgcctagtgtgcagaattaactcttgtctaaggagtatcctctgatcggatgagcattctcttctctgccacttccatttctttcattgttatacattgagaaggtatttcacattatacaccaggaattcaaggacagatcaacattgtgtagccttgaagaccatgtaatagtggtagatttttaaagcccaaacgtgacaatatccctctattcatattggaaattataaagcaaaaagctttataattttgttaaaaaccctctttttattaagtagtcataaataacaaaattgtttctagttatttctagctaaggtaattcaggtgattagattaagaatgagtggagcgttgtttgatcactaagtagagaaaacttcagaaggcgtatatttaattccattaataagtctttcttttttcctttcttcatatggaaaagcaaaatgaagtaatctggagacataacagtaaagaaggccttagcatattgctgttctgataaattgcaataaattttaaaaagctcttactttgagtttgcttgggaaaaaaatctcatacttgagagttttataagtagaaagagttgggaggaattttagttgggtttcattcttctaaactctatactggtatgttttttcattttgatacttttcagagcagtataaatggtgtcaaagtgggaactcgaaataaagtgaactattgatattcttcaactcattaacacacctctatgtcattttaaggagttttatatgttgctttcttcattaatatccatccattttaaaaaatttattaaatctgaaggacaacttccccaggactggagcattaccaatatgcttatatttcatactgagggaataatttagttgtgggaccataatccatcctcctaaaaacaaattaatagagataggaatttatctctcatgattttgttaaccagaaaatagaatattatgcccaatgaagatttataggaaatgatacgtttggtgactagaaatgatacgtttggtgactagtagttcatttttacaagtatgcaatgaatccaagtctcttaactgaaatttaatttcagctaatttaattatcagacctggtttttaaatttagttttctgagtcacctcactgagtttttttggccatatttaattcttttcattctcattattttacttcgtagctttaaacattaatgcagtaggtatccgtaatttattctggtcatcacctgatttgagtgtttctttctgtcatcctcaattatatacccaagaagaccataatacttcttatcattgaaccaagatttcttcttcctcactatgaaggaatagagacttgattgttcaagttatcaaagattttcagctagacagtggaagagataaccataatgaaatgttacttgctaacgtcagtactgaggttttgttgtctattttttcctccccttcaattgctcaaggaagcctgttatgatgcctggtccattcagaccaggtaaggcaaacaaggaaaacgtatgagaataataatgtttcctccacccaacccactaggccggcagttaaccatcttcaacactcaggcgcaaatagccattggtggaaaggacaaaggacgcctcttccaaggccaactctctgggctctattatgatggtttgaaagtactgaacatggcggctgagaacaaccccaatattaaaatcaatggaagtgttcggctggttggagaagtcccatcaattttgggaacaacacagacgacctccatgccaccagaaatgtctactactgtcatggaaaccactactacaatggcgactaccacaacccgtaagaatcgctctacagccagcattcaggtaggcctttttccaagtattaattgcgtctgtatttttatctttgcaacattgttatcatggtcattgctttatgtagctaaagagtttgaattactatgtaagaaggatgctggcagatactcatagtaatgagacccaggagaagagaaaggtgaagtcattgctaaagaagtcataaaagtctgtggcactcctgggttgttattcttattgtatttatcactgaaatggtaaagctgttattcaaaacgagcaatggactacactttcagtatgaaatactctctcctttaattttattaccttttcaaataacagaaagggcaagggagggaaggaaaatctgttatcatatgaaaagctatatcctagttcaatttcattcacattctccagatggctttgctataacatgaatctttcattattgaggtcaatgggtaccattaaatcaagggcagttaaagttagaagtgcaactactccttgtaaaatgcagtctttatgtttgttatcaaatcctgattaatcatgtgtcaggtttgtgcccattttgttttctttatatttgatcaagatactaattacagtagaaaatttgaaggtttgagtttggctataccggaagtccttgtttttgtggcagtttttttccacttgaaagtaattatatccaaactaagcttaatactttgctgactcccttggcatttcataaatctagttagtagggggtaggaggttaactgaattattagccttaaatgctctggcataccatgagacattccaattgctgctgcgacaacaattacttacccctatcctagttagtgtttatagaaaaatcagtagattagcacttgtcctgtttgcttctttgttttaagacattatccaggagctcagttgtgtctttaacatcacctttacactgactccaatggacgtggttaacttaaagtcaataatcaattataccacctatgtgttcccatttttcagaattaaatgtatgtgagctaggtaatggtaagtgtattatctgttgccttcctttttccttttccttgagcagaagtatccagacagctctttgcatggctccacagtaacaatttggagttatatatgctgacagtgtcataagggcaattttatcgttttcaaaaggcttctaaaaacctggttagcatagtactgttaccgtcacacatgctattacctgcatacctacacacatgctcacgagaaaaaaaatagctcttctctactgatattaaaccaataactcctgacaccttgctctactcactgaaaagaagataaaaggcaatatatatttctattatgactctctctagctcaagagcagatctgtttattgttggtgaaaggatagttctgtctgcacaggtcttggcagacttgttttgtttctgtcagaatgtattctgctaactctgtgggaagcagagaagcaaatggctttttcttcataggaatggctggtcctgtagttctttttaaggccaaattttcactgaccttgagatgatttaatgttacacggggattcgggaaccaagctgtagtaattattggttttttggctttccctcctgtagcacatacataaatgggaataaactgggtgagttcctgaactctttccgcaaattaagaaagtcagaactttggaagaaaagtagggtacaagatacaaaatcttgctagtgattataactctaaacgttatagaacctatggccattttagaggagatgaacaactgggaatgccttctccaatagcctctctctggcatgtgtttctttaagtccagtaattatcgaactacatctacatgcttttccttttacttccaccaagtctacaaaaatgagttataaacctgttgagactctttggttttaagggtaagtacatcctcttggaggaaagccaatagcctacaagaattgattagactgcgatgagggattttaaaagccctggattttttggaagactaactagaggaaataactttctgccaagggttttggaaatcttttttgttcttgaccactagtcatcagaactctgccctgtgctccattaaaaacttaaaagcctcatcttcaagcctagtctggtcttaaacacattctgttgatcacatcaaacctatgttaggactggggacccaacaactattggattctattcaaagtttaggacaattcccagactctagagactgcaggtaaggaaggtcagtcccagaagcattaatatgcctatgtgaccccactacttttcttagatgaggaggattcataaagttctgatctctgggagatacttcagaagtgagtggggaaaaaaaggtagggaagactggatttcatattcaccgggcccattattcacttttttatctatatgtgaaatcatacatagaacattttccaaatgataccactgttctgtcctcttttgctaaatttaataacattgtcaaagcaaagttttcctaaaatgagactcctctaggagaaagaaaataagcatgtcagtccaccagtataaaaacctgtctgttcaaaaatcctctagttctttcttaaagcataagcaaagaaaacatcctttcaagagttctttcctggtcaacctgaggtagtgttgatttcagatcaaaggaaaactgtaaggtgctttcagtgctgcttttaaccgtgtgtgaatgtgaacaagtagtttttgagttggtatgtctgtctagtgttatagcctcttagaagtaattggtgctttgatctttctgattccattttgttacaggtaagagtgtagaactatctgtgaataacctggctgatgttaatttactcatagcaatcatgcccaagcatcaggtcttgatcctacattgagaaggatagctctaggtactctattgaattttaaaaaatttaagatgtgcattgagaaagcaggtgtgtgagtgataattctcaagtaaaggcctggcacttcataggtgctcagtaaatatttactgaatacatctgaaaacaagacaggctttattacctactttagagtcatttcacaatggaaggtagcatagcttgaggaaagtgtttcctccacagtgatcagggtgctttggccaaatttgttgtatttttcagtagtaaggctatagcatagtgattcagtgcatgcacttggagctagattagctgggtttaaaactttgttcatcctcatattagcttacatgaccccagacaagtcatgtaagttctagttaactatttatatgaaacaaattttcccataacttggtggtttaaaacaattatgtcattagatttcaaaattctgtgagacagaaatttgggcacagttcagcaaggcaattcttctgtgccatctagagagatgattgtgttcactcagtggctgactttgcctggagggtctggctttatttacataccttgtgctttgctgggttaactgggaagatgggactcagcagggcccttttccctctctatgtattctctgggattctccttgtggtttctccagcaaagcagatgggctgtgtttatagaggctcagggcttccagagagagtacttccaggggcaggaagtagagggtgccagttttatatagcctgggctgggtaactggcagtgtcacttgtacaatatgctattagtctaaacagtcacagagctttcccagtttcagaggaggagacataaatatcacttctcaataggaggaggagtagcaataatttgcaaccaacctaagtctaccacattactaaggctaccatattataaagtagggagggtggtgtacttctagtggctatgttatatgattgtcataaggataactgagttgatataagtaaaatgcttaaaataagtgtaccattcaaagtaagactgcatgcgttttaaccattattattatattctgtttcccacaattggtgtattaaatcaagatcctctcaggcaaatatctgcctcagaaaatggggctgtgactaccgacagtagtggctatagtttagagtaagggctaggaagtttgggggaaatagagatttgaaggtggatccaagcagaatttaggggctgaaattagtcctggcaaatcaaaatttctatgatctcaggaacagacttctctgacacctcactacccatctttaaagttctgttttattttaaaccaacttagagttctatgagtctttgaaaatatgttctgtctatccacatgtcttttagggttgcaaagaagacaaatccagattccttaccatcgtggaatttacaatctaaatagggcaagagggtttgacatgagctatccatatgaagtagtgactcatgaatggctctttgtgctggggatggcaagtgttgcatggtgtggcttgactggatctcatgcactcattctactaggccttgttgtaaaaagagcacaattggacaggtggtgagaggaacatattcctggttggtcaaatgtcagccagaagctaagttgttaaaagcagagattataatctctgggagagatagccaagtccaagtagaacagagaatgcataagagggagtttgtgagtagcaaggggtccagaatcaaaatcttggcctgaaactttgccaagtgggagagggcccagaggggtaaactgaattgggttccctgtgtaccttactaccaggaatgccccaataattgcacaaacacttcctctacaactgactccaatattggtgggtaattattatggtgctgataggtcagcttctaaaatagaaaagttcaactcagtctacactcaaattcgttggtcttccttcaggatagaaggaaaaagtgagaaacaagtcttttaccttatgtctccatcctgagttatcagcagaaaaaaaaaaaagctcagtgtgttctgtgcaaatcaccatttggaatcatttataaactatttgcaggatactgatcatgacatactttttctgtgttgggcattggtaaagtcaccttgacattggcaactgctgcctgaaaattgccagaaaatcacaatgctcagcatggattggaactatccttataactagtcaaaatgaaagacttaagaggtttgtgagatttcattctcaagcttcacaaacttggtggttgaatgtgaaccacttttgcaaattccagaaggaagccacaatttctcatgttttgtaaaaattcttataggcaaagtactcttagcttttcagtgtcagactggagacagtaagaagcatgcttcagccttgatactgatgattacaaaacaaagaaaaaactttggattaaaatgttcatcctgcgcaacgtctgttctgggtagagtctcagtgtgttgaagagcgtgggcttttgcgtcagagtttctgagttggactccaggtttttccagttgcttagctgtatgtataagtctgttctcacactgctataaaaaactacccgagactaagtaatttataaagaaaagaggtttaattgactcacagttccgtatgcctggagaggcctcaggaaacttacaatcatgatggccggagagagaaaggagagtggggaaactgcccccctgatcccccctcccaccaggtccctccctctacatgtgcggattataatttgagatgagatttgcctagggacacagagccaaaccatattgctgtatatctctgggcaggtgattagcctctctaagcctcagttttactgtctgtaaaagtggccttacagtacctttcccgtaggctccttgtaaatagtaaagtgcaatcatgtgtgaaaagcaccccataacttttcagtaaaaattttcacataaggaaaccacttcaacctaagggactctcccagaactcacagatctccctagagcttagccttcctgtggggctggataagcccaggaacaattttgtttatactcatacaaactcacaagggcctggattgtgagttcttctaagggccccagattgaatcagagccccaagctcatcaatcaggagagattgctacggcaggctctttcatattctggagtgggaattggctttgctgaacagttacaacacatagactattctattaggttgaagtgtatgaaaccactatttttgtagatcaaaatggttaaatattagcaatatcacatggttctacgatgacacacagatttacagcatgttgttatcaatggcacttcgaggcccagactagaacctcagatattctccaggtcttcaaataatcaaactgccttgcactgggagacaagatagatccaccttatccccaaatactgtgctatagcaggatgtagatcacactgtatcaaaactggttatatttacccaaagaattatcccctctgggtccttccaccttttccctgctgccaccagcttgagagaaatgagataaggaatctacacagttttcatctccttgcttttaccactagacaacagagcctccgggggaagtttatttttaggatcagggctcaactaatattgattaacagccttacataatgtgaggctccagggtttgttcttttcctgccaagcctcataactggagaaggcgctgaagatttgtcagtctaatcagactttagctgccagccaagaaatatcttctgtcttctccttacccttacgcaggtactttctttttccctcttagagaataatttggggggagagaaattgcactctaatttacttgttgcctggtaagattctctggtgacatttactctctggaactgcacagttctaacaacaacagaaaagggagcttgatgggtttaccttcctcttaaagacttagatgttggcagtacaaataggcaagtgaaaagagtgcagtgtagtttgttttcatccttcctttaatacgtaattttggtggatggaacaggtgctttccaaaactaggtctagtcgatgaaagggtcctgagggcagacgaagtgtgaaagctcccaggagaattcatagagatgcccttccaattaggatgtaatatttacaggatggaatttccaccagaactactaataaagtgctggctcttatttctaggcatctgaacagctgggagggaagtggggtcagttcttggctacccacgggtggaggtccctgagtgtttttaaacctcagggtggtttttctaattacctaacagactctttagccgaatctaaagccaaaatccttgctgcgtggcatatggttctcctccttcctattgctctgaccatattttccaccacgttgctccaatcacacaggtcttcttgatccttcttgaacacagagcaagaagaagggtgaaaccggtgaggcaggattatgcaattgcaagcttagattttcatcttaaaattgatatttgactttttgcttttgcagatttttttcctgcattaatattgattttaaaatatttcagcaaatgaaaacaaagttttagcaaacccccgttaaatcttacaccttaagcgagtgtctcattcaatcttctcagccctgcctgaatgtgccaagcgtgcctgtgccttttcacctgccatttcctctgcctgcagcagcccttccctgctattcacagtactcactccctcacttcacccaggtttccgcttatattgcaccttccagaaaggaccttcttgaccgtctgtaaaatacaacactctatcgccttttcctgttttgttacctctcatagcacttatcactgcctgacattatagctcacatttatttgtttattgtccctatttagtagattgtgagttctaggatggcaagatctttattttaggcactaaaatagcacagtgcctagaacagtagcgagcacagagtaatacgcagtcaatgttggttgaaaggtataaatagtcaaccatccaccagtaccttctcagggagtccacaggccacacaatatttacaggctgaatccaagcccctgtttcccaggacccactccctcatgaggctcaccagtgagggtgggcaccactgggtttgctgctcttggatctttgctctaggaataaggagtcccagagatatctccttgtctctggtatgtaagattatttttgttagcttccagtcttgttgctcagccaaaagcaagggctaattctagcacgtatagttttcaaatcacttttggaaatgtaatatcacccacctttccctttccagtttcttcttcttcctttccaaataacttaatccttaattctcctaaaacccactttcaaatatatgcaaataaaaattacttggtaaggatggaaaattaacttgaggcttttttacttttttttttttttttttttggtctgttgagaaaagggcttgtagggtggtgcctgcataaactggccataaaaatatgggacaataagttgttgaaagccacaagaggcctctgaggaggaaagcctcctaaatgccatcatgttcccaggctcagagcgagatctgctctcttatctgtaaacactgtgttcaaaggagaaagactctgctttgaagcattgaaatgtggccagatatgctggctcctagtgaggcccactccccccagctgctctccgataaattaaagaataaatcagtagttaattttatgctgcttcagcacaaagaaaatttacctaaactgccattgctatagattaggtgtatgacacaccgcccccctttcaccgtttcacccctgaacatctgcttcttagagctaagtgattgtactcaacaaatagtgtggagaccagagcttggcgcctttgcagcctccattttacacttggccccctggcactccactctttatgcactcttaacctgtctattctcattcgtttgtcgccaccggacttcgggtaccctacgggtggtgctgaggctggtccccaacattggtctaatggctgagtatattgtgtgagcaccatttattcatgtctgaaaccctataatttgactagccccatatttacccatttttagtgataatttgaaaaaacattgatgattgagagaaggaacaatagctatgttgctcatcattggacatttagagcctagaatggtgcctgccacaaagcagggctcaaaaatatcagttgaagaaaaataaatgtgttaaacgaatgaaagtaagttaagcaaatgcttatcatcagagtgaagaggcagtgggggccaatataatttatttacaaagtaggcaaagggagttaggaggaagcagcctggtacggaggaaagtgcattgaagcaggcatcaggagacttagctcatgactggagaagttcttaaaaccatgactctaggcagaccttcatttctagctgtagaattttggccagggtcctttgtggagctatgtttttttattatctgaaatatggggatgatttccaacttcaagggtaggttaagataatataagtcaagggcttaaatgggtgcggctcaaagattattattgctgctgtcttaaatgggattataatctggtctcagctgataaaccagtattgcaactatattttcttttttattctgttgctagtttgtggtctctgatatggcaattagcttccttgggcctatgctctttcctcagaaaagaaagttttattttaacattatctagcatagtgtcttgggcacacacacacagggacagttaaatgtaggaaacaatgaattagaagaagtaaaagaaaggagaagaagtaaaagaaaggaaaaattgagaaggagagaaagacagcagcgatgctctgtaattattgctataagaattacgtgcccatttcatggatttgtatggcttaggttgagagagatgaataaaatatctttgatataattaaaatcataatataaataatattttttctatatctcccctctttgctgaaagctgttgggtgagacatcacaatgaccacttctatgtaaaaggtagattatagatggccctctgcatatgtgggattgcatctgcattcaaccaactaactgtgaatcaaaaatatttttaaaaaattgtgtctgtactgaacatgtacagacttttttcttactattattccctaaacaatacagtataacaactatttacctagcacttacattgtactagacattgtaagtaacctagagatgatttaaaatgcacaggaagatgtgtataggttacatgcaaatactatgccattttatattgaggacttgaggattttgccatccatgggaggtcctggaaccaatcaatcccccacagatgctgaggaatgactgtacttgataaatgtctcttgaatcatccaaaaaaaagaaaaagccaatggtttcaatttaaactgaggtaagaattgttttttttttttctgaaaatatatgatgttctatttatatataataggaaaacgacttcaagcagcaatcgtcacttgccaggcatcaaggcggatatttccattatgtctatgacaaggtggtgggaggggtgggatgtggtttcatacctttctggtgcatgtttgaatgattgtaaaaattagaaacacactgaggctgttatgacagccttgccttttgaaaccttctaattaatgccttgggttgtctagagagcttgttctgttagctaaatggtgatttgtaaggttctccttgatttcctcatcattcatggatgaaataattggggaaataaaatgattggggaaataaatgcacaccacgtctgtggtggctagcagtcactgagagaattacttgatgggaatttgattgacttgtgtgtataatgcaacctcttatatctctggccccatcttattatgtgtgtgtgtgtgtgagagagagagagagagacagggagagagggaggatgctcgtgtttgcttgcactatggagaacagtgcttcttaaactttaatgtgtgtatacagatcacctgggtaatcttattaagcacagattttaatgcacgtccggggtggtatctcagatcgtgcacttctaacaagctcccagatgatctcatgctgcagatatgtgtacctcactatagagtatagagcaaggctctaggaaatatttacggttccttgctgagtaatcatggtatctgtttacctatctcttccaaatggtcttcccaaacttagctcagttctcttcaagacaggaaattttgttaacccaaagtattaatgtaagtgaaagggtggataccccaactaaggattagaagagaaaactgtatcccatcagacaatgctgctccgggtttcagatgccccttcttcctgtcccttactttactgcatacccccaaggcagatggaaaaaaacataggtaaaatttaacttgtcataatatttatccccctttctgagaggtgacctccaatggaagcagaaggatgtgaatgattttaatccacggtaacaatggggagccagtcctgaccatcttaagcagtataaatgtataaaatgacagatttttctgctctgcctctccactttctcctcccggatactgagagagacacatattcatgcacccacaactcacactataatgcacaatgaaatttcacccagcctttatctcggggctgctgttctcatgattaatgccctactggctgggaagctattccactgaagacagacaaggagagaggaagatgcatgaaatatatctctgaggccatttctcattattattattatcattattagttccttactaccctatctatctatcctgttagaggatgcttgatctattggcaagggggaggggatgacatttgaaagcaggttttatgagggagaaatgaacaaggacaaagagagaaatagacagtttttatgaaagagaattaacctggatggggtttttgttatgattgttgtcctttatttgggggtttgtttgttttattgttgctgttgttttccatttaaagtcaaaaataatagatgcctccatctgcggcttctgatttttttccctagggatttatttttgcatgtgttcttttgtctttattgagtctctgtctgctagaatcaatatgatataacttatgcaaattatatccctgaccacttatgcaaaaaacagaataatttcgttgctctgtaacactcttaatataattacctccatatcctggttgatttcaagcttttgaaagggctactttaaaaaaaaataataaaaatctatttatgtgttgtataaaccacagtgtctgattctctcctgtttctcattcaaagaaagggtgactgctaaatgatttctggctctgtcatttaagaagactgcacagcagtggtcttagttgggaagttgggaccacaataagagtgctattgtaacacgtgtctactgataaaatggcaaattcattagcctagacaaggagtactatgatctggtttcaaaaatgctgtatacttccacagtccagtttatgagggcatgagatatataactgaggtgcccccatgttacttcaattttagtttgactttgaatttcattaaaaaatatttgagttatttgagtgcctagtatgggctaagtactgtcctgggcacttgaacaacatcagtaaacagacaaaaaccctcttttcttatggagaacattttctattccacaaacattgggtgtctcataagtgcaagactttggagaaataaagaatgaaatagaaatttttctgctttagaggaacacacagtctggtactgttcttaaatattttcagactacaagcggactcacttgcagcccagttttttacaaaaactttagcatgctgattggctagtacagttgcaaaggcagcagccatctatatttacagaggtctattccaagaatagggtctttaatttctattcaaaaaagaccaaatttcaaatgtaaacaatatatgttttgactaaaaaagacagaaaccgtaaagcaagttacaataaagtgattgaaacatatttcggtcctggagactaaatttgcaatgtttatggcaaatatcttcttgtgttggtttgagattatagttttatggaatgtttatattggaagaatctcagagattgagccccacacaaccagatgagcttcagagatgggccattctggtttcaagtactagtttcattgctcaaagctctacgtccaggggcaaattgctcaaccactttataaaaaatgtaaacaacaggtaatttcacattttaatttatttttatctaaacaatatattcacatagtttatttttagtgtatatatgtatatatatttatttcttatttatttcttatttatatatttatttatagagatgaggtcttactttatttcccaggttggtctcaaactcctgggctcaagtgatcctcctgcgttggagtgctgggattagaggtgtgagccactgtggttggcctaagtaatacagccacacaatttaaaaccttgaactgtgcctagatatcccctttggggaaaaggcatcaccttagttgctagagtgctggctgatggctgttggctaaatccttcacgaagaactgcctttgactattgaagccaccttgcccaaccaaggtcaagccccttcctgaagggtggcccatatccaattaatgatggtgaagggtggcccatatccaattaatgatggatgatggagctggggggatctatcaagactcagcccattgtctcaagactggataactgggaagggccttttagctagagagtttcctaaggccagctgaggtctctattgcatgaatgttcacctcccccttctgcccagactctgatgtcactctccccaaacttcccaaacacgataccgggcctcagactttgttttctgaaaacgcagctgaagatagatagatagcatcgtgagacttaaaataagaaaacaacaataacaaaagaaaaacagtagtatctttctaaccttgccctaaagtcctgctctatactggtaacccttttatatccttttcagacatttcccttcatagttctagcaatatgcttgcatttctatttcttgactttttcagtttgacatattaactaatgacttctgcttctggaagtaaaagttgagctttctcatgctctccctgccctacaacccacacacacttttttaccttccagtttcccagtaaaattctatcgcatttcgattaaataaatgttcagagtttgttattatgactttgtaatatcgcctattgaaaacaatgtaagatcatacatgaactgacttgttccacaactattcaccagctgcatagaatgtgccagacactgttctagagactgaggatacagcagtgaaaaacaacagactatatttctacctctgacaaaacattatactgttatgacaatttctgttttcctgtaactctttgtttgttaatgaataccctcgttatctcgttagcttatttttctagccacccatcagtgccacagccaacagctacaaaagacctcacaagataaaccgacaggactccattatttctttttctgtcttggaggtctcccttctggagtcgtctgacctcctgctttagtctgggctgggcgctcgctgagcctgcctcacagctatcatcctgcgtcttccttgctcgtcatgctggaaaatccctgggccctgctcctgtattaaatcctagtttcagctctatttatttcctcattttcaaggtgcacattgtcctgtagcctcctgagaaaggatagctaaaaagtaaaatcattgagacattgctcatctgaagaatgttttattccattctcacccttgacgataatttgcctgggaaggacttgtatcttggaaattatcttcactaataaatttaaaagcatccgtccaatgtttttgggcatccaatgttgcagctgttgacatcacagtttggtgtctaattccttgactgcactgatttttacttttttttttttttttttttttttttaccctctctctgaaatatccttatcagtggacctcaaagtagcacttacaactcaggtctcttgaaccacatgctgctgccccctatagttcttgcttttgtaaagttgtggttatttgccgattagctgccctgtgttggcatcctgactttggtatgatttgatgagctaagctattactaaactataacacacacacatacacacaaaaaatgaatagctataattaattagcataaagttttgagggtaaccaactttagtagagatctgagatatatataatgtatatatatatatatatatttgaacattttgccttgggttagagagggaattggtggtacagtaattcttactggaattgtgtagtgatagctagtttatatatacatatatatatacatacatatacatatacatatgtatgtatatataaactagctatcactacacaattccactaagaattactgtaccaccaattccctctctaacccaaggcaaaatgttcaactcttttttgtattcccttaagagcccttattttttttttcagtttcaccaatcatgttcatttcttagccacctcagaaagaatgagaattaaataatatgtataaaccctttgaattttttacatccagaaatgagcataagctcattcctctgcttcacaccagatgcttatatttttgagaggagcaaggattagaattgtcactctggaatttttatgctacaaaatgtcaatcaatatgtttgcatgtcactgggttccatcctacagtgtttggtgataaagtcttttcatttggctcccagctttatcaccataatatatttatttactttaccttacatgtgctagttggtagaagctgtagaaaaagaattactcccacatatttctttcccctaaagagaaacaatatattgtaagaacacagatggggctccacacaaaaagaatgccgaattaatgttggatggatgtacatatacaagaacttgctatcagtacacaattccaataggaattatatatacacacactgaaaatagaatttgattaaataattacactaggtacaagctacattttacttccattgaaggagagctaagtggaaactagtgtgagacaatcatgaatagaaaagtgcagaaggaatttgatgaggatgttcccagggctatttctagccagaaaacgaagctggaggctttgaagtaaatcaaaatatttgaagaagtaagaggataaatagcaaaactcacttccaacatcatactaaaagcaccatgcaaccatatagaaaacatgcataatttattttgactcaaataactatagggagattcttgttttttttaattaggagatttgaggtaactgtctagactacctatttttatgttgcattcagcaatatgtctgctaataattagagggaaataaattacataaaacaatgccagtcatgtcattgataaaaaggaaattaaagtgtgattgtgtttctctttctctctctccctcattttcagtgagctacatcctcttgttgtcctcctcacctgattaggcatttttgtaagggagtttgcctccgtcctctgttgtaaacattttccttacctcagcatcctttttaaattcaaaagacactttcctttgcaatgcactatgaaaggcgattgtgttagagaatatcagagatggctttgtcatgtctggtgctcttaaatccttttcttttttttcttttcttttcttgagacggtgtctcactccgtcacccaggctggagggcagtggcgtgatcggggctcactgcaacctctgcctcccaggttcacgccattctcctgcctcagcctcctgagtagctgggactacaggtgcccaccaccgcacctggccaattttttgtatttttagtagagatggggtttcaccgtgttagccaggatggtctcgatctcctgacctcgtgatccacccacctcagcctcccaaagagctgggattacaggcgtgagccactgtgcccagcctcttaaatcctgttgtgtcctaaagagtccactaaacgaggttgagggtatgatttgacaattgaacaaggcctcagccagctctcctagactgccccaaaactccctgagcagagagacccaggtggtgatggaagtatttttcctctaaaagactgtggagattctggcaaacctatattttgggtttagctttcaaggaagaggtggcatttgaaaagccaggggcctttgtagccattttattcactacctaatgtgaaggtggtggcagggaatggaaaagggaagattatttagtcgataaacacttaatggccactgcctgctgtgtggacagatctggatagagttaaaaagataataaagcaagtgtaggatgcctgtcttcatggtacttatatcatgggaagaaggcatgaacaaaccaattttacacataattattcaatcacaatcatgacacagtgtgataaaggaggacaggcttctaagacagcagaaaaggacctgaggtagtgttgtcatctggggaagctttcttgtagaagcagtatagaagctgtcctgtgcaggatgagatattagattgcaaaagaggacaagggccagtgttcccgccaaaggaaatagcctatgctgaggccctgctgtagggatcatactgtatcgcgttcctctggctttggactacgcattgatgctaaagtctggaagcataccatattcgaccaagtaaagtgaccagttaaggtccccacttaatgggctaaagataggtcattccaagagtgagcctcccattattatgactcatgacaaaggggtgtgggactggttggaaaagagtttccaaagctggactgcatcacatggtcatgtggaatgggctgcctgctctcccagtctgaaccctacctctgtgctatgccaaaggtgcagatccccttagtgaaaattggagacatgaatcatttaaggcaatgcctcacagacccatgtgcaaggttccatggaatgtgttaatatatcacactcatctcaattttgcacggtacatgaaactatgcttgctgatgagggaccatacacattgaacagatcatataatggttatggatgtaatgtcaataatgtcatggaacctatcatatgttgtaatatcaagaaaccttttagcatgtacatttgtctaggtttctggactttacagccttctggtatttcacttgcttgtgtctttcattgaacactaataaccagaaatcagcaacgtgaaaatttgattcttcttcctatttttctcatgccttactttggtctttctttctgcttggtggaaactgcggagttcagtggaagttttcctgcagtctaattagcccctctgtttaattttgtaataaaaacgctgaaccagaagctggagataatgtgcccaattcaattcacagatgtcaatttctttttaattgtaatccttttcttgagttcttcccactcttacttccctggcacagctgaggcttgggtgattacaaaactttcatgcctacgctggagattatgcctcctgctttaggattaaattcattcgttatcattgttgtaattattagtagtaacaatgggcatttccacccaaacctgatgaatagtagttttcacagtctttgcctccaaacttagcttatttcagttctttgcccagataagttcttcactctttaatggcagggagcattccgttttctgttgcatttaaatgctattttgagatcattcagaagacaaggctctttttcctttttagcaggttctcctgggtgtggagagatggcttctttccccagagtaggagtcaccacttagtgaatgctaatggggtcttttcttcgtgatgcgactgctgctttgaagatgcatttgaactggcaaggggcacctcttagctgcaatctcttccttagaagggtgccagctccaggccctaaaaagcacacatagctttgacttccatgctgactccaaaagaaccttttctctgcctttttgatggagtagtccctaccactaacagaacagcagtgtggcccaaccaacttgaaaatggaactggctcctcagcaacatgctaattctttcaaacttccttgtcagactcaaacctcgatgtgtcttttgttcttaaactgcatttgtagtaagatcttcaggaaaagcaatcagtgagagactgggtcaggcttttatttaattactttgcactttttttccccctctgaaccttctccaaatcaaaagaaagcaatgcagtttaattctgaatatatgaaatgtttgcactttaaattataaatgtctctcaacgataacaccttctgaaaataatgctccgtgggctctttagaagaatatttaggacagttcatctcaggtttaaggtgcccaagctactatagtgccctttcttatcttggttttatgtttttccactatggcttactgatataatttcctaatccttcttatctcaaatgtctcttagaccgttaaacctttgcctataaaatgaaggggtttgactttgaatctaaaggagtggaccatccctcaagcaccctagtctctcagcgcattcattccacaaacatttttttgggagagcagggtgattcctgctatggacccatcacccttgtagactctgaggctgcaatgaaaatacaataaaatcagtaattctagttcttatggaacatacattctgggagtgggggcagagactaccgataaataaattagcaagagaatataatatgcagggacaagtgctatcaagaaaataaacctgcgcaatgtcacacagaatgcctgatgggtgggtaggtagtttaggggaagttactctaaggaagaaacatttaacctgagattggaatgataaaacatgtcaggtctgtgaagtctgggggaagaacatttacagcagagggaacggttagtgtaaaggcctttaggctggaacatgttgagcagtgtttgaaagatgatgaatatggctgtagcagaagaaatctggtgtgaggtaagatctgagaagtggcagggactgaaacagacagggcctgtttggctgtggaaagcagtttaggttttataaaagtgcaatggcaaactattagaacgtactaagtaaaggagtgacatgatgtgacttatgttttttaaagattactctgccatgttgagaaaatattgtaaagcagcaagagaggaggcagagagacctaatacatggctattgctttaattctgatgaagtttgattgtggtttgaactagtatagcagccaggcccccactacaggcccacccagcttgatggcctcaccctgcatcttgtcctgtctctgaactgctaaatctcaaaactttaaagccctaatatcttgctgattaaccataatttccaaatcttatgcttaagtccaggcagtttttaatttttttttattttttggcttcagcaaatttttcatttgtctatatctataaagtacttctcatcatcaacccagattcctttttctctctgttgtgttcattctagatcattccaaatggtctctgttccttctgccttcaacctggtcttagaagacttctctgttttttatctctcccccattccacctccaactcttgatcagcacctatttcaaactctcaacttggtctcctttttcactttttacacacttggattttaaatgttaccttcttttagaaaacaatgctgaccagtcatgagtttctttgaattcctccatgcttatccacatcagtccttactttaggggaatcccttcgtccctttgtttgaaatcttatgctaattatctcttcactcgggtctcttcccaaggtttggacatcatttagtgttctcattttccactggtgccattaatatcatcccgtcatcatagacatatatgtgtgtgtgtgtgtgtgtgtgtgtacatatatatgtatgtatgtgtatatgtatgtgtatgtatacacgcgtgtgtatatatatgtatatatacacatatatgtgtattgtgtgtatgtgtatatatatgtgtgtgtatatatatgtgtgtatatatatatatatatacctttcccatttcaaaaacaaaatcaaaacaaaaaaggcaattatctatgaacctgatttctgtcccttctattagcacttactgtccccagatgaggacactctttcacttccccatatgctcaaatatcctgaattttatactctcactgattttactttctaaacaaggaatatatacgtattgtagaaaaaaatcactgtgaagtaaattccacccgtgatccaaccctccagagaaaatcgtgcataaaaggtcccgcagattcccacctgtctttctttccttccttatctaccaatattttttcacatgcatgcaacattctagtcataccttgttatactttcagacatgttctttctacttgagcacatacaacatacaacttgagcatgcttgtttatctataaaatgaagataatatgatcatttctgtaggagttttgagtcaaaaataaatttatgtatttcaaatgcttagaatagtgtctgttgcatagtgacctttcaataaaaattattattattattgctcttttgtccactttatctacctggaaaagtaataatccctcaagactaagttgaaatataacatccctggggagtgtattagtctgttctcacactgctaataaagacatacctgagactgggtaatttataaaggaaagaggtttaatagactcagagttccacatggctagggaggcctcacaatcatggtggaaggcaaaggggaagaaagacacgttttacatgtcagcaggcaagagtgtgtgtgcaggcgagctcccatttataaaaccatcagatctcttgagacttattcactactgtaagaacaatatgggggaaactgtccccatgattcagttatctcctccttaataatccccttgatgcatggggattattacaattccaggtgagatttgggcggggacacaaccaaaccatatcagggagttatccttctcctctgccatcctgtttcactctgccaggctccttttctcagtgcctccacaagtggtttacttgttgtgatgaacactatgcacagcagagagtttaaggaccttagtcatgtttcctaccaatcagcggttggcttcctattaaacctttctcgatgttctggacctctagagagccattctgtgctgctatgcaatctataatgactcttcaactaggtttctattcatttccaagtcttccctaccactgagatacttcaaggagatatgagtggatcatgaataaatatcctaaaactaaagacagttaagtcaattgcactctcaatattatcagactattttaactaatatgctatagacaaataattcttcagaatggtgtttgctttgtgtgtgtcataagagattcttgtctttagagaattagggaataatattaaaatgaataaatagtaaaggtgggaatatttttaatattattaaaataaataaatgattaaagtagggagcatgtttgaaggtccattttaaaaaatatatgtagacagaggaaacctaagagttaaaatactgagtgagttttgctctgcatcagtggaggctataaaatgcagtatttatctgtatatgagttctataccaatgtgatctatctctctaattagatagtcaactatttttaaagagctgcaaataagccttacaagaatgtcataaatgcattccatttagaaacatcttgcagataaattgtatttttattcttcctgcagcctcctgtagccttaaaagaataacaaaaaataaattcttactacctaattccagacacagatcattactaccagtagtatgttaatcatgcttgccattccttctccttcgatatcattatgctttaggatagaaaaggtgggtggtatgtgagcctccttggataaacaaaacgttggagtgcacaggcttctcaagaggtacaatgttattttcatgcaaaaaaatcccaagtattacaaaggggcttgaaaatgttgaaaacacattgtgaataagtagaattactaacaagagcactgtatcttttgcttcgataggctctttcaagatgtagacaaattggaggtaggccagacagaatctacgggaatgattaggggaattgaaggaatgacttcggaaaaaagattaaaagagctaaatacgtataggttggctaagtgccaactcagagaaaatgacattatgggctatagatatttgaaagtggctggctataagcaaagcaagggattacttaggtaattggattaaatcaagggggtaaacattttaaactcaatatctggatttattttgttgactataagaattattagattttagaactatcccataacctactgcttggattaaagcaagaggtagggtgtggtagcatgaagtctctaatagtttacccagttctgagcatcttgttgccaggaagcagatcttactcacttttaatccctaggatttagcacattaaaagaactccatagagagctaagtcatgtttagttcagcgagaagaaaatggtctgtggagtcagacattacagattttatatctctgctgttttattgttctataacagtcagcaagttacttaacctaagccttatccataaggtgcgtattaatatcaactttataggattgatgtgaagtttacatgagttgtcttgatctcttcttttacctatttaacagcggttaaatacacccctcctctccatcatcactgccattgtgttccttctgactttagtaatgtcttcaatggtttcctggattccaattttgcctatcttcaagtttccacaatatagtcaggaataactttttgcagcgcatgtatgagtaagcaagccctagcttaaaaactccaatggatcccattgcctgcaggataaaatcgaatatccttaggatgacaaacttcatgccatcatgcctgtctttctaattccaactcatattaccctacccttctcacataatgctctaactacattcacttgcttgagtttttcttttgtaccttgtacaaatgtataaacatgctggttcctctgctgagaacccactttccactccaatttgccatttctttgccactctttgtcttctgccttgcttcacactctttctaaaatgccaatctcagattttacctcttttgagattccaggtgcctctcccatgtgtttccacagtaaatggagcttatcattatcctgctattaattctactgtgttctaagtgtcttttcactctgcctctcctaatagatgttaggattcatttgggcagatacttagattagtgcctaccatttagtaggcattcaacatatttttagattcaaagaatgataaatggtagatggatagatggatggatgggtaggtaaaaagatatatggagtgtaacaaagtacctacaacataagaaattatcaattaatttcagttttctttccttggagttttgagattaagaaatgcacttcgttgtcccgaataagcatagtcttgagtgggctttagtcagagttatttgtgtgcatttatgtcgatactacccactccattctatcatattgggaaaataatgcaatctcgaaggaataggagtctaggaaacctaggatataagtgagcacataccggagaaaaatatgccaacatagtagcttggaggaaatacttggaaatatcttgcctttatagctagatatagaacttcattttttacaactagaagctttgtgacttctgagaccatgactgaagaaaaatggaaatgaagacaaaggggactgaaatgggagtggaagtaggaaaaggggatccatagacacaaaacaaacttttccttttacacactccatttccctctctggtgcttgcccatggcccagctatttaaccttaagacacatggccagcccccttgtctagagtttgccctaattgttgggcgcattgtagcgtcttagatgatcaattgctcatgccaaaagcagagtgttaagattcatgaaattcgagtctgtgctattaataacctgagcagggttttcatgcctccttcccctttgttttctcctttgccaagtctccattctcactcttttgtggatgtgtgtgttatggagacgaatgaaatttcagacacagcaatgaattgccacctaaaaggatacaccccagggtcttctgtgttcctttgcagctgtgtgataaattgccatctccaaaattaattgttaccttttcaggaagtgtttactcattttcatctcctcactggcatcagtgaacctctgagctagaaaaaccaactttcctttcccttctcaagcccttgatatgcagctagaacggcaatcagtggagctgacaagggcgagcagtggtacctccgtgttgttctctagcccatgaattcaatgaacatccaggctatgcctttcatctcaactgccttttaatagactaacccatttctctttacttttggctccacattaaaatgtctataaaattttactccaagctaggtcttccaggtttacggaagaaggaacatacattcagcaaaacagttttctctttttgttagatttctgctgttctcaagagctgaaaaaaagtgtgatacttcacatgtactctttaaaaaacttactaagcctgctcagcttttacacagggtacgccggcacacaagtgtgacctggtccttactccatcctcaaagataagttgtccccacagtctgccaaaaagatgtccctgatgcaatgagaatgagctggagtcctgactgtgctacatttttagtggtatcctaactctctattccacagacatcagaaaatgtcacaacatactctttgtaactagtccctttattatgtccatgaatgtaatatatacaatgattttcaaagagggtgatttttcacccctcttctctccctgccccacatacaaaggagactttgcctatgtctggaaacatttttggttgtcacaattgaaaaggaatgtatggaggtgttgctgttatccagtgagcagaggccacagatgctgctatacattttataatgcacatgaactctggaatatataaatcaagtaaatctcagtattctgccatgtactctgggagatacttaaaattataagccatgacttctattttccaagcattttggagaaaaacaaccaattttgtttttgatttctgactatatggtagagttcagctacacagtatatggtactttaacaaagctatacggtagctgcaagacaacaccatggctgggcccttcagagcctcataagtgtattggggacactgagaatctagtaatagactaacacatatgtaccaccattgagtggcatcaaacatgctttcatttagtgctgaaattgatgatataatggaggctagaaagatctaataatgaaaaaaagaggaatttaaccagtcttgaggtgatcaaatgaggaagcagaaaggtaggattgattgtaatgtgtgcacagaggagtgaagcctgattacctgtactactcattgccagaccttcaagaatcgcgtgccaagtgccaggtgcagaagttgcaaaactgtttgggagatcaaagagaaaatatcaacctggctttcaagtcttttcagggtgctttcttagaaaaactgtttttggtcttgaaacatgggcaaacattggctgcgggccaagaaatttatagttcctgaggaactttagattgatacatgtctgacaatttccattttgcaaaacaagagaaggcaaaagtgggcttggaaggcattcaatctttgatgttgtctttgcttcagctgagcagaagtgagaatttagacacactgagccattaccagagtttaagaaaacttaccatcagtgtggtttccccctttctctcagtcaagcacatgggtgtgtgtcattgtaaaaggactataggattggaagtggacacgtgaattccatttcttactctccactaactacctgagtgacattaggcaaacttgcaaatgtggaagttgggccgggctaggttatgttccgctctaaccttaaacactgatttccccattgactttcttgttccattcaaagagattaggaggaaaaaaaagtggtatatcccaggcacgttttgtgatatttcagtgaaatattgaaataagcaatgtcagcagcctcatgttctcgctaatggtctggtatactttatgaataaacaacactagctttatattactggatctcatttccagcagatttataaaattgtaactctacagtgttttctgacagagcttctggaaggggaaaaatgacagtgcagttgtttgctaacatctgggtgtactttttgcaacatggggagaattgttccaaggcagggagctaatctgattcatatctctacctagaagcacttaaagaagctgtcagatgattcccacagtgacaaatttgagtcccaaggagatgatggagtgaaatcagacacattttgggaagaaattcctactatcttttcaaaggataaactcccacagtatttgtgccaatctcttttacagcattcctatctcaaaaaccagagacttaggctaattttttttgtttctgttattctctaatatatttgtttaaaaaggaagttttaatgaaaagtcagtcatgtgacttagagaattaaatgtagggctctagcaaggatttgctttaaaatgtttctctccgatttagttgctgcacctgggtaataactaccttggaagtattagtgttgtttctctgtcataaaattgacatgcttggtgtggataagaatatttgattgtagaactgcttctacctaactgcattctgttatactaacaatttggctagcagaatttttttttaaaatcctccatttgcagctttttgtactctgatcacaatatattaaatcccccagaagaactactaccttgaatacaaagcacatagcggtgctcttttaattgatttgtaaaggttagttgctcagtactagtggaaagtttcatgattacttaattgaattacctgcttcccccagtagagtgcttactgggcaccatacagtaagctgagagttttacatgcctggtactattatttccccagtttacagattaggaaagcaagatgtagcttacaaaatatgctgaaagaccactggcataaaagccttttaattccttgctgaaaaactccctgggttttgaaatatgataaactacatttttgttgttctctgaagattcaggttcatatagtatgacagttttatttttgtgactctcaatcatatatgagataaatgatgggggaaagagaccgctttgaggtcaagcagacctatgtccaattctaacatcaaggagaagccacgtgctttggcaaagtttgtgtatttacactgttgggaaaactaaaagtaatttatataaagtacctagcatagtatctggcagggtaggtgttcagtaaatgttgctggtattatttttgctagtgataacattattcagccatataaacacatagcactaaggttaagcaaaatatgtattgacattacagcatgcctaggtatttattgcctaaaatatatttccgataagcttttcttagcatttgctgctttctactaagagttgagtgaaactacgatgaccacaatttagtctacttatttaaacctttaattggttggcttccggtaaattgcagtttgaatgactagcccaatcatgtatgagtagccgggaatattcgataggtatagaattcttcctgcctaatcaagtcagggataccgatgttaatttctgaaataaatactttctcctctcaagatctacccagtggttcgttgccccttgggatcacttctacttttcaacaaagagcaagggacagtaattgcaacttcagggtagaaggagagtttgcatgcctggcccagaatgaaataaatgtggaggaacagagcccaaatgacttgtatgtttcaggtacagctccatgtatgctgcagatgatttgggttaaaaaaaaaaattggccagcctaaactttgaggcaaagaaattgcatttcccaatgtctcatttctctttccttttactttacttcatctactgtgaatgacccttatttttttgttgttgctttatggcaataaataaacgaacccccattgtgcaaatattatgctcttctcattggcctggagggaaattgctacgagagaaatcctggacttttttcccctttttagaaggaaataccaggttacgaatggcccttctcagtctctagattgagactaggattcttctgtcacctcctcagagccctggatgcagaaagcaattcatttcacatgtgtgcaaatcagacacagaaattctgcaaggcacctcttggcagtaaaagtggactattaactctcaaattgctggcctctactgagaggcaacttctccctgaagccaggtgggagtgtccctttgaagccttacacaacccgacttctgttgctagggtagagtactttagagcaagagtagtcctgcggtatgttaactgagtaggtgtttcccagaaaattaaaagcaaaagtaactacctggaacagtctgatttttaaagcaaagcaggatctttgtacgtttaaaatttagtccagctacttgatagcctatagagcccccaactccttcttccagcccagggagagtctgcagtgagcaaggtaagaggtagctccagcattttcagcatggggttaggttggaagtcccagttgacagggacagtccttcctgctctcacctgccaaaatctctctcctcccaggagatagctcccttttctccctgattgcttcctctcatgaggagaaggtcattggcgctcaccacttccagggcaaccctttatgcaagcagtgggtgcctttgaaaggcaaaccgcagcaggaagactttgaaggcaagaagagactttttcatctttgcaggccccagccagaacattggttctcagtgcagtacaagcagtttcaaagttatctcccttgctgatatggatgtgataacatggagcggagaggtgccataatgatttcctttcaaatggctgcctcaccatttatctttgcacactgtcaaagactgatattgtcgggagttagcagtggcatggaataattaatctcgtacgggggaagtaagttcttcatttgtctcctgagaaattagcactgcattgacagcaaaagtagatgatatcatcggaaagggaaagggaggtgatctttgtaactccagatgccaaattgtaacattgattcagttctgtgaagttttgattgaacacctactatgtgccaggtgctagagatacagatacagattcctgtgctacagtagatcataatcccttgagggtcacagcttatttcaaaatccttgtcaccttgacaaaatgctcaagaccaccatggtgacatgtgtgccaccatcattattattatctaaagagttttaccaagtgtctgtatcattaatatttattgtaaaggctcaacttttataagaaagaatccttgtctcccacaccaccagtgcaaagtagattaacaaagttggcatttatttattttattttttctttaggggaaaatcaagaagttagtgatctagggctaatggggatattgtgttactcccaatatgtggttcccatatttggattcaagtttttcctattttccaatcagtgggaggagaaaaagaaaagcatgcctgcttatatcctattaaggccacacctgtctgcaaaacaggtgggatccatgtgaaccagaagcaagctattaaggatgcaagaaaatgtagtgactagttggatggccatataccttgcttaaaaccagttagggtcttttatttctgaaagaaagaagggaaactagatatttggggatgataagcaatctccccacagagattctgggtgaaatcctttttgcttctctgaatttccaataactcacctcttaaatgagagaattgaaggaggtgtgctgtgtagtccttttcaatttcaaagtcaaaataacaactctaggctcctcctccttcctcagcttctcccaggcagtaggcacagtgatgggctctgtgctgggaattttgttttgagcctgtttcttttatttggaaacatcaggtgctgaacctatcctggattcgagtgagtgcagggcatggctctaagaagcattttgtggaaagagtcaagcttgtcatcctcctcctttgaggcactaattgggctgactgggccaagcaaaacaatggtatgatccatgtgaaccaaaagcaaattattaggcttggagagtggtgggtagtcagagaagcacttctgttgtagacagaaaaacagcatcatgcttctcagaaagaaagggggctgctatctgggtggaaagcttagaatcaagggagaattatacatgtttttaatggaccgaggaagaagccagatttgtgtatgcggagtttgatagggaagggcttctcttctttttcctactaaaggaatagtgtttttgacaaggtgccaaaaatctaggccacagcatcccactttgtgccacagcatcccactttggtgagccataccaggttgcaggaaattaattgctttagactttgggctggctgagtggggcctgaagccaccgtagtccctgggcaagccccctcccactacacaggcctcctccatctccctcattttctctgtgtgctgtgatttggaaaaaattgacaagcacttgatagaggctaccaaccaattagaattggttcacacgagacacttgggaatgaactcagctggtcactatggtgatttaactaaattgtgttatccagacacattagtgaatcaagtctggcatttcaattttctctataagatgaattgtggaaagaagttcattataataattaaggaagatttatgcagtgagtacatttttatctctgtagcctgttataatgctggtattttgtgaccaaaaaaattgagttgtagatattaactatgtaattccacaaactgtgctcccgaacgagttatttatatagttagaatttaataaatggaaactttttgaatgcacctgcttaggaaaatattgaaagaaaacttactgtaagtttttcagcacagtgaacaatcatcccccagtgaacaaaatgctagccttaacccggtcagtaaattatttggccataggcagatatctcatctccctgtaaaggaaagccagtttcctccactgtaaaatgagtcttagtaggaaagggggcattagcaaagtaatccctgtgcctacccaatcgttctaatgtgatgtttcctttggaaaaaacctacaactcagaaatatattgaatgaaaatctccctattacaggaagacactgcgggttgctaaggagtgtggtttctgtggttggagtagagaaaaatagtggtgttttctgagatctcaactcaactgtgcagggtagatcgaatgaacacagcacaagccacagccactgttctgcttctgcctgatttgcttctccagaaatttcccagattacaacaatgccgaagtgcccattggctaccacggagataacttcataaattgttaaacaggcagagctcaggtttaaagaactgcctttattttgagctgtgattttacttgtgtttcagacattccctcagatattttatttaaaagatttcacaggagcatcatgcaaaatggtaaataataaaacattctataaaccacacatcccatctaggactaatcattatattttccaatttaacattcattccttccagatatgttcttactcgttctttaaaactatcataaatggaaagctaccatttaagcacaaataaaactcttaagaaagctaagaaaatctgaactcattaaatatttctaactagtgaactccttggttctccaaatgacctattttttcccttccttcttttttttttttttgtatttttagtagaaacagggtttcaacatgttagccagcctggtcttgaacacctgacctcgtgatccacctgcctcagcctctcaaagtgctgggattacaggcgtgagccactgagcccaccctccttccttccttttttaaattagaattttttattttttatttttttttttaattttttttttggttgcttttagccacctcagttaccttgaccatccgatttcacttactgtagccagatttctaaagtatgtgtttctgtggcttttccatagtttttttccccaatattttggcagtggttgaatagaatccttttattcctccctccctcacccctcccaatcagctccacctatagatatagaaatacaaagtgaacaaatgtgccatgcaacttctatttttgtgcccgttcttcctctttgtctctatttttgcctctagcacatagtatcctggtaaactggatttttttttaagagacatggagaacacagtgcagtgctcattctctctcagcctctctgtttttactgtaatgaatctattctacataccatgttctcaggatcccactgtatgtctgataaactaagtcaagctaaggtcattattaccaataagtaatcaataaactcaatgtttaccctaagtttgatacggtaacttagttattttaagaggaaattttaagttcttgtgtgtgtgagtaagaaggagcatgagaatagggaaagggccgtttcacagaagcggtcctatctggttggcctcaattgtgcctctcaggcttgtatctcatctgcttagctgtaaggccagtcctgttaggcaagaaaaaatttaatttgcaacctagtttatgaaaggataaattaagggaccttgtgggaatttaaatcatctaaggtaatagaacatgaaacttgcctagattaaaaactgggtcttttgtgaggtttcattcattatggccccataataatagctacatgtctatgcacttttgagcttgggtctgtttaaaatacttatttgttatttcacttaattcccacaataactgtacaaatatggttctcttgcctccatcttatatatgagaaaaattaggaacaaaaaaacttaagaaatttctttcactttctatagctgataaactttggagatcagtttgaacccatatactcttaaacactatttatacagtattaatgtgatttgacaaaagtggcataaagagcaatgactctttaagactcaaaagaagatgttcagatttatattttgatattaatattaatatcagcaagataagctgttaaataagcattacatgtaagaatcctgaccttggataaaattaaatctttgtcataaatctactactgtgacaaaactgcaaaatatgcagtgaataattaaatccagatgtctcttccggcaacagcagcagcaaaaactggaggtgggggtgaagggaagatggaagtgacagactccatattcataaaagctctgatgataaatttttttaaaaaaatgtgtttgttttaaataccagtcttccatgaatcctaagaattgcacagtaaaaaataaaatctgcctaccatttaacagcccgcaatacaaaaatcttactgtgtcaaatgtaatatgcatacctggcttcccaatttggttttcttaaggaggagtaatttagttgtcattaaactctttgggaaaccgttttaataatgttctttggttatcaggggtatcctttttttccttaaggcaaagaagagaaaacgtgccgctaaaacctttactgtgtgtggtaatgaagttggtccatttctgtgcaggattgcaacaattctttatcacttaacacgatcggaggtgtgagagcagacagtttctcaaactgcaggaaaatgctgaattcaccgattgctatcttgacacaatgaagggaccatacattatatgaagcccacatttggtttgctgttgttgttttttttttttttataactgtgattattttttgatggaataataatcacagaaaaaagaaaaacctgtaagagaagacaccactgtatcatctttttatggcaatatgcaagagggtagaaaaaatgagagtgtctaaatttatcttattttcctgtgggattttcagcacagacatattcctaccactacaaggaccaaggacattcacttgcctgcttgctctgataatggccagtagctggtcccaatgttgatacaattaattaaaatgataaacatgactctagctagcttcagcacagtaagagtaccacagcattttctggatcatttattcaagattcactgacttggagtcactgatggtaccaatcattttatgaaataccttccactagagacagaaaaacgttgttttgacaaattcatggtctgcacctcccccaaaccagtgcatttctaaacagacttgtttttcctctaaatagctttgccaatccggccaacaccccaatatttctttatattttgaaaagtaggtctttcacctgctgataatggaggatccaattctgtgtaaactctggaattctatttaaaattgcagattttaaatgtagggaccaagacaggatgtaggttgtgtcaacttgggaatgctgaatgactgaactgtcatgacatttacaatccagatgtcatggcaagctgggagacaagacagcttggttgataattagatggcagatgtccatgcagtctcacgtgatacacgttactttttgtatattcaagatttgggactttagccctgaaagataggtgatacatcatcttctctatacaataaaaaatagtttcaataattgtatattattttgttttgctttttttctcatttatttggaagtagcaaatacaagaaacaaaaattactcataacccctatttttggtgtatctctatgcaggcaaatatactgatgatgattattttcattttttgaaaatttagattctcacactcaattaaaaaaagaaagcctgaggaaattaaatgatttctaaaatcacccagctaattagtggcagaaatgagaccagattccagtctcttgctttcccgaataccttattctggaattcaattataagtacaaggcatcccactcttggcttcctttctgaataaatgcttgcaccaaatccccagtggcttcttgagaaagctggctacaaatcttcaaagcctcagttgaagaattcttattaagcctactaggtaccaaagcaatagcctgaagtttggaaaaattctagttggtgaagctagaattttattcaatttaaagaatacttggtaggggggaatgtaatgaattcactccctagcctttcttgaactctacctatttaacaccctatttctaatacagcagcttctcactatagaatgttaggtttatcaaatctctcttccaccctgttatacggcattttccatcccttggatgtttcaagtccaggaccttgggcttaaaggcaaaagtaaaatctattacacatttgtagctttgtacaccaatcagggaaaagtagtaaagtgggctattatgtacattattttacaatgcagtatgttagttgtcaattgttacgcaagactaattttttccacagcaaaaaataaagctattttaaaatattttggaagcaagtcatggttgaagagaagcatcccttgaaaaattagacttaaagctgcaaacttcccggggttgacattagcttgaacttgatgaaaaaggaaaaattttaggaggatttgttcagctgtcttctgagttatgaaagcaggaagaaatgagttttacatattgcctggaggtaatttgtgtacatataagtcaaaaacaattaaacttcaaacttcacacacagccactgtcctgtaaagggtggtagtgtataagcagaagaaaaatgactagaagagaacagggttataaagcatccagacatttcccatgtgaggatcttgaaaaacttctgcagccctgtgactggattctttctcctgatctaatagggctgtttggaggaagtatttctactgctcttgagttgttgctagttttcctttgaatatcctgctcagttccctgccccagttcaagcttccttccaaaatgtgtttaaaataattagctcttcctgttggtataggaaaaaattagtcacacataattggtaattcacatattgtattataaaataatgtacaaaattaccacccttacttctttttggagggcctgtggcttgtaccaatggatttatcttgttccagggcattgagaaattttgccttactgatggcatcaccacttacatttctcaacatctttgcctcccatcagaccaggatttcagttactaggtatcctaccttgttccattgatctgagaccctcattaataccctagctgacagtcttaactcagcactgtcttctattttctaccaaatagaatacaataatcagatacattttactctctcttctgaataaagatattaacaaaatttccatgagtacttataagggtgagtttccagaccaacctagatgagttaccaggatatatagtttgaaatattaactttaaacatttcttgatttttctgaccccatcaggtattttttggaaactggtattaggcttgtagaaatggacaaggagctctaccatgcttgaagatggtttaagccttcagcaaaataattgagagcttcctcttctgaatattccgaatacacaggtctatcagttagtgtatcatgttatgtgtagatgtgtgttggggtgatcagatccaacaccaggtcgtgggggtgacaaaggccggcaattcaaaggaatgagaaaaagacagtttgagagagaaagtgggaccagggggccatcgcgagtgtggaggctgtgaaggccccaagttctgggagcccatgttatttatgggtgctcaaacaggtggtgaggatgtcgagtgaatgagaaacatatggctgtttgacataatgggagtactagaagcaagaagccagcaagtctagcagacatgcaagccctgcctcagcttctctcccaacactcagcttttctccaacagatgtgtatgaataaggcttattaataacaaagcctggctccacaggtgagagggaagatgtaacttaatctactggaagtcaccaacatagccctctaaaatgagtcattattttgactcaaaaatgaacagattaaaaaatgtttcagctaatcctcttagctatttgatgtacatcaagcatccagatgttcacaacatccaagctgcaattttttgtgtgttatttaaaagttttacacttgcatatattattcctttcctcaaagacaaagtatagaacccaaactggactttttaaattcactccttaaaagtgtggtaacttaccattccagagctggtgggtccccgattattggcccatgggttgtccactttgtggttttgctgttaggaaatgttggctgatggcttccttaaccactcagcagttaaccaacaataacttggaatgtgtctaataagtgcagcctaatcttaattttattgggagttatctcagctaaataatggaaaatttgacaaacctaattaatgaattatccactgttaaatcttctgtgccactgagtcctctttttagtaaaatgattaaaaacattaactatagtggtatataattactattaacaactattatgccaatatatattgttattcctgcctaagatactatgtctcagcacggagtttatattaggtattttattttaacagttttctaattgctgccactttttcgtcagattgcatattttgacccacaacattgatttcaccttaatgtcaccagtgggaattaattatctgaagcttggcataatattaattaaatccatatgtcacatcatggtgtggcattcttttctttctttcttttttttttttaagtcagggtctccctatattgccatgctggtctcaaactcctgagctcaagcagtcctccctggttggcctctcaaagtgctgggattacaggtgtgagccaccatgcccagcccattgtgcagtgttcttacaaaagtattctaacaatccaaaatcaagactacttccaaaagtggcaggcttcatatagaatccaacattctgttgcaatgagattgggatgagtgggtttagaccaacattgatatcaaaggccagtttccctttaaatcaaaatcacctgtaaactagcatcttgacattcaagatcccaccagggggatctagctgggaatgtcaccatgcatgtcttgagagagtgcattagcccacctgcagtaggttgaaaaatatcttccaaggataatttcttaagctgtatattttaccttatttagaaaaagggtctttgtgagtgtgattaagttaaggaccttgagatgaggaaataatcctggattatctgagtgggccctaaatatcctcaaaagtgtccttataagagtgaggcagagggggcatttcccccgccacacacacacacacacacacacacacacacacacacacagaggagaaggtgatggaggcagatactggagtgaagcagccacaagccaaggaatgctgacagctgccagaacagtcaagaaacagattctcttttagggtcttcagagagaatgtggccctgctgatgtcttggtttcagctcaatgatactaatttcaaatttctggcctccagaactatgagaaaataaatgtgtttttgttttgttttgtttttttgagacagagtttcactcttgtcacccaggctggagtgcagtggtgcgatcttggctcactgcaacctccgcctcccgtcttcaagtgtttctcctgcctcagcctcccaagtagctgggattacaggtgctcaccaccacgcccagctaatttttgtatttttaatagagacagggtttcaccatgttggtcaggctgatctagaactcctgaccccaagtgatccatctgcctcggcctccccaagtgctgggattacagacatgagccactgcgcccagccaaatgtgttcattttaagtcactcactttgtgccaatttgttatagcagccacaggaaactaatacaatacttgtgccaacttaagtaacagcaccagccaaagtacataaagtggaaataaaggtatttttagaaagtctcattactataaaatatggtgtaaataaaaacagatctgaatatgcaaattgaagtttcaaaataagtctcctgccatcccatttcaaagacactggaaatcttaagctcttttctttacaaattctgaaactatcattgcctgtgggttgggttgaaatgaaggcacgtgggtgtttcaagggtatgttctgtgacaaagagacagaatagaaaaatccaaagtcatagcctggagctaatacagtaatatgaatacataaaacaggaaggacaagaatataaaagtgaatttggggacctgagaaagtcaagaaaatgattggagaaatacaatttgggagaccactttagaacccagccctcactgggcatggtggctcacgcctgtaatctcagcattttgggaggctgaggcaggtggatcacctgaggtcaggagtttgagaccagcctggccaacatggtgaaacccgtctctactaaaagtacaaaaattagccaggcatggtggtgggcatctgtaacgccagctactcaggaggctgaggcaggagaatcactggaacccaggaggcggaggttgcagtgagctgagatcatgccactgcactgcactgcagcctgggtgacagaacgagactctgcctcaaaaaaaaaaaaaaaaaaaaaaaaaaaaagaacccaggcctccaatggtgcgatcaggtgccaggtactcttgtctactgtgctgaccatatgctgttgaggtcatcaccagctacgggaaagggcattctcataggggcaagcccaactctatgtatcttacgttatttaccactatttcccaaataaacctgtttcaaagaataccatctttaatgtctttcacaggtacctatcctccactctgcatccttttccatgctatcacttgcagtgaaggtctgttcaccccttttttaacctgtcttccatcttgagttccaatttccagctgccctctgaatatgtccagaggatgctggctgctgcctcagactcactggatgaaacagtttcctgttttctttactaaaactgccaaccttccttttccttgtttgagttagtgtatcactgtcctctagcccctgagctgaaaccttggaatcatctttcactcctccctccccctttatattcagtcaactgacagtaccaatatttcttctcttctccttttatttcttttgccactgtcctactttgggcactaatctctcttctgaagtataacaatagcctcccaactggccactctgctttagctgctccatggtccaatctcccttgtcacatgtgttatctttcccaaacactgtcacaacttgtcagtctactgcaaaactttccgtgactcctggggggcctgcaggagagagtttcagatttctgagtctgccttcctggctcttcacaatgcagcctgagtccatcttttcaaccgtctctctggatacataccaacacttgccctttgtctcaatgaatgtgcctgccacttttgtatctccttacctttactcatattgtggtttaactatgtggttgtcttctccaccctgacaatagatacatctattgtccatcagcccaatttacaacttttgcatctcttctgatttctatcctctgctaatgacacttattaactactgcctttccactggactttgcatttagttttttatatatatatatatatatatatatatatatatatatatatatatatatatatataaccttacttctgcttttaaacatagatcattatttccatgtctaccttccactttctccaacactagattgcaaatttctacagggtgaagcttatgttttcatcccttaacacccagcttaaatgtcacctcacatactgactaatgctttttatctcagttctaaaacattattaatgtacatcacataatttaactccattttgaaaattagttcttgttccagtatcttatctcttaaaatagactggaaccatctcaaggttagagaggatccactatattaaattcttatatatccctcagtagatggcactttgttggatgatttaattgacgtatcttcttaaaaaataaaaatatctggctcttcaaataattagctttgtgacctgaggcaaatcatttatcctctaggacatttagtttactacatggtgaaataaatgataccttcattccttaaatatatagatccagtgacatgttgctttgaatcacagaatttggtttcgtgctaaatctaagaccaaaaacagagcacaaacaattcagaatcaacagcatgctttctggaagcaatatgaaaggtgttattaatagaattcagcattattctaatttcctcttaaaatttcaagaaatatatctgacatttgtcctgtcattgtaagttgaaatatgtgtgtgtgtgtgtgtgtgtgcatgtatatataattttttgttgttgtttttgagacagtcttgctctgtcacccaggctggagtgcagtggcatgatcttggcttactgcaacctccgtcccccaggttcaagtgactctcatgcctcagcttcccgagtagctgggattacaggtgtgcatcaccacactcagctaagtttttgtatttttagtagagatggggttttgctatgttggccaggctggtctcaaactcctggcctcaagtgatctgcccacctcagcctcccacagtgctggtattacaggtgtgagccaccatacctggccaaaatgtgtatacattacacacacacacacacacacacacacacagagtatgtatacgtatatatctgtatataggtaagtgtgcttatatgtatatacacagacatatacacacacaacatatacatatagatttgttgtctagatattataagagtattgcactaatgtttctataaaacaccagttcacaggcttctgtcttctaacaatatccttatacatatttgtcagccactatttaccttaaaatgaaacagaggggagcctgatatataattacggtcactgtgctttgttctattttgtttatccctttgcaatatagtgtggcagacagaaaaatgtatgaaattaattcttttggtttagaatgacattcctatcattgttagaacaagggattacattatacactacctctaaactcaaattttctgagcactttaactattaaatagcaataacagaaagcattgtaaatcttttggagttttgcatgataatgtacctcttgttaattgaattgagagatgattgccctatgattacctcgattcatttgctgcataatttaccataatgataattaactccttgtactgaatgaggtaagatgtgtgttagttagacaccccctccctcccttcttgcctttccttctttccctccctattttagtgtttaaccattttacacacaatttgagacttgtttcagaatctctccacctatattatcatgtcaatccaagtatttctaaataaaagtagaagttgggccatgtttttaaaatttctagctaattgcctgctacttggcttattgttgtgatctaattatgttctggtttttgaaaaaaggactattgcctggcccactgtatgacatttgatttatgtagtctcacctctccctaaatagcccatagttcacaatgcagcagagcctatattaccgcaatttcttctgcactgaaattagacaattatgaagttagtagattattaaactaacgtatgctttataaatacttcttcattctaggataagggagaaggaagtatactgtaattcccaatatgtaaatgccctcacacatttgatagttgatggttccattttttagatgaaaaaactaaagcacaaagaagataaacaatattttgttctgccctataataaaataagcaggcaaatatttatggatatgattctgggttgcctcaaaactttcagggtcagggtaggcaggcagttggagatatgagataatgttagccatgaattgtggctatttttgtggcacctgggtgatgagtccacggaggttcatcacatgattttatttacttttgtatgtttcatattttctataataaaggtattttaaaggaatatatttaggtatccacagtgtgtgacacctgtcaaggagcacatgctagaggcctggctctgccagtgacataggctacgtgactgtcggtgggtcacaacttcctagacttcatttttccctcattaaaatcaaagtattagaagagatcagtggttcccaaggaggtggagttgcttagggaactgtctaaaatttcactgacaactcagaaatctatttggatttagaagctggaggggaatgtatatttcaaaataacttctcaagtgactgtactgtgaccattccttacacacaaacttgggctaacaatgagaatgacttaaccccccaccccacaacactttaataggtttaggatgggttctgagaaataaagatttttaaaacattccccaagtgattctaataggtggtcgacatgccatactttgagaaacacttttttagctcatctcagggtcccttccaactctgacacctcatgatattacttgagcattcttggttctctgcttctatgatgtactattccatgagcaactggagatttagttacaggtgtatacaagtgtacaggagtcaagaaaatgatgctaagtttcttgcactgactgaggaagcaaggtagaagcagactctggcttaattggaattcatgtttgaggcctctgggccctcactaggaaaaatattcaatttatatgtaagcatatgtataatacacatatctcaccagcattctttttgggaaaagagaatttccaaattaaatttaacctatcaattttatactgactaagatgaacacattattttaatatattgtttcctcttgcttcctaatacttacattgtatagagtttcattctttatgctaatcctaatgcatagattggtaaattgagattaatgagattcttcctttactaccacctgtttttaaccaaatgcctacatgctgcatgagcaggaaatgaggtgactactgttgttggccacagagcttcaatatgtcgtgaacaagggttagatgtgaatgtcagaaaaaatgttatgatcaatttctgcctccaacaaggaactacaaatatgggtcacaaaagttctactagtagccccaaatacattttttgaaaggagacaatataaataaagctgaaaagcagtcacaacgctttaatgtgtcattctcttcttcacctttctatccacttagatgtttcctaccccccaaaaatgaacttatgtcacatcacacttgtgactcccactgacatctaaagtagtgtgagccacacagatagaagcacaggtaaatgcctcaaaacctagttattatatttgaaggaatttctgattcagtagtgtttctgtaattgttactaacatcaacgcttcgcttgcttctaggaagacaggatggtaaattcctaacaatggaattgcaaagttcacagtgtgctttaaggagtccctttctccataaacacagctcttgtgatggctttgcagattttgtttctgcatttagtgtagataagttgaacaatcctaattcctgagttctaactagtgatagagcacattatattgttaagaataatggatgttggagaaagtcaggacaaaagtaggtatgaggtgtccctggtatgtggccaataggaaccacggtcctgaagtatccggagcagtccggacatcctcaagtagacccaaatcagccctatcaggagccaacagaaaagcttgctagggcaaggtcagaagataaatttattagccaggaccagtttaagtcaaaagttgaatataagtcatatctttagaaaaaaaaaaaaaaagcaggtagaaaggcacattgtttttagctaactctacaaaaagttcagagcgaaaagaaaaacagtgatgcagaactaggggagaaattaaggagcaaacattccaaaaatagaatgagttgtacacttggttaatttcattgctcagtgatgcctccatagaccagattcttctctctgccatcctcagaaataggctctagggatgctcttagataggctattctgtatgcaagaccttctgtagctgttctagatgccagatcctgaaatgacaacattcagtgaacaataatagctcttcttctacgtcatttccttagatgtgaagaaaccatttccagcaaactcccctcatgtccacaacacctcattaatcaggattaaatcatatgttcatttctaaaccaataagagaaaaagaagtatcgtggctatattatactgaaatgcaattgattttggagagttaaaaacaaatccaaaccagcagcagagcctggggagaatccacgtctccttctcaatccacaagacatgatgggtctgctgcagtgtggtactaaatttggggttacaagaaatttttggcttattagtttcctagggcttctgtaattaagtaccacacactgagtgccttaaaacaactgaaatgtattatctcatagttacaaagtctagaagtctcaaaacaaggtgtcagcagagccatgctcccccctgcaatctgcaggggaataatttcctcttcctagtgtctggtggtttgcccagcaatctttggccttttttggcttgtagttgcttaactccaacctctttcttcctcatcacatggtgttctccctgtgtgcccctttcttcatatggctatcttcttgtaagacactagttatattggcttagggtctcactcaactccagtatgatctcatctaacttaacaaattacatctgcaaccttcctatattcaaataacttcacattctgaggtagcggggattagaacttcaacatatgtatttttgggtggaacaaaattcaagccataacaggcttctatagacctctctagttttactcagtctagatcccaatccatggagtttgaccaaatgagttagggtgctattccctaaacttgctgaaacataataattgctagaggcccttagtaaaatacagattcctggccctcacaacagatgtactgaatcagtctctctaggggacatgcctagaaatctgctttttgacaactgcccagttcaattttatgatgaagcaagtttggaaagcatagagtcagggtgctgagcactttttgagcatctttgagcactttttgaccatgttattcctggctgtgaaagaattctttttgtatgaaatctcatctacccataacaagtcttggaagctgctcttgtcatcctcatcacagacctgcagaaatggaggttaggtaagagtggggctggaaatggagctaggtccaatctcaaaatacatactttttcaatcatactaactcatcatgttagtagtaagttaaagaatcttgaatcatatggtccactgtagtttacttttcttgccttattcccaggagttttgtttttatttgttcttgtccttggagggaacaaaagacagctggtagctgttccctgtttggttttgcatgtattcaaaaggcatcatcttctactgctctcttactcctttactttgtggtcatttgttttgcagctatttagacagttacttcttaaagaacccctaaaactatttagacagttacttcttaaagaacccctaaaactatttagacagttacttcttaaagaactcctaaaactaccatttgttcctctagaaaggattaaagatttgctgaagcaaagttctcctgacactttacctagagcaaggctgaaacaaaagctacctacacctgtattttccttctcttatccctcaagtacacaatagggcatttggctctcagcagttgatgccaagttctgctagggaagaaatgagacttcagagctccctacaagttgaaatggagtcagaaaagctacatatataaatgtcagaaaagctacatatataagctacatacataagctacttataaagtttctgcaaaactacctcaaagggcaggtagttttgcagaaactggagggacactgttttctggagcactctgccactaggattttacttttagtgtaatgaaggatcactgaagacttttaaaccagacggtgacatgataaaatttcatttcagaaatttcatttctgaaaattatgatggctgttggaaaaaagtagattggaagaagcaagaaaatgctaggttacttcacaacttctccaggaaaatagtgcagtgggagaaccctgaactcaggaaatatggcccatttcctgcactatgtttcccaattcaaaatatcctattgtggaattctacagctcaagtcaagagccccttctgaactacaaaggacaaggactgatctactaaagccgtgtagtaaatgtgaggaatttgcctaactcagccaattgatgtgtcaaaatctaaccaatgtgtctaataatctaacatatattgttattgatttcaggttttaagaaccagttttctaaaaatgaaaaacaaaatcaaagcactctagaggaagtaatcatatgtttaatgtcataagtcactgattgtatacttaatagtaaatggtggatatgaacttgggccctggagtcaaacttaggtggctcggtcatgcccttgatgtgtgtctttgggtgggctactgaaactctgtcttagtttcatctataaaatagaatgctaacatcgactttatagggttattgtgaactctaaataagacaacaaatggaaacccaacacatgttctcactcaaaagtgggagctgaacacgtagacatggggaggggaataacacacattggggcctgtcggggagggggagggagagcatcaggataaacagctaatgcatgtggggcttaatacctaggtgatgggttgatagctgcaacaaatcaccatggcacttgtttacctacgtaacaaaccttcacgtcctgcacatgtagcctggaacttaaaattaaattaagtcaaaaaaagctaaaagcaagctttatgccaaaaaaaattttaaaaacttaaaaaaaagcgcctcttaaagttataagggagggtacacagtaagcacttagtgagtgagtgttgtggttgctgtttttcttaataaacatatttttatccaaattattaagcagaaatattggactggaaaagggtaaagtgtggattattaacggttgacattggaagagcaaagagatagagatgttccatgtggttcctttgccaagccatccagatactcacctccatccttttggtcatttcccctaatacacagtatatttatgatccccttctgacaaccccttgaagagttgcttgcctcctgcacagtgctgagttatggacgatgcatttgaagccatatattcactctgtcttccccacatgtgcctagtaactatggcagagctcaataaagaagaggccagtggcgggtttactcatttttaaaaaaatttccttgttgttcttttctgtgattgtaatggctagcactggtactctttccctctctctccccttcttttgccatagagctattgtcaaatgtacaaatacatagtgaattgcgatggtttctgggactgacagagagaaggaacctgttttccccataaatgctgtagaatgaagggtttgcaaacattgtgattgtggcagattaaaaaaaaaaagtcaagcaggctaaattgaaagggaggcatgagaaaagctggtgcaacctgtcagctcctggtccgaaagaagctgatggtattttttttaatattgtgaagagaaggaaaattttttatagtaagtctatggatctgctttaggaggcttttctcttgatctaattgagctgtttgaagtgtgcttgaaagttctcacccagcctgtgtcagccacctgcctgctacaagctgtgagaagttaatcgtcttgggcattgttaggaggagactgtctggtatctgatggctttccattctgaacaagggtgtacggatatggaaaatgtgtgtgctcacatttgtctttggggtgtggggctgcttcactatgcatgagagcacatccacacctccatccagatggtgcctgctcatagtggcagtgctagataaattcatgtcaaacaggcagataatccaaaaaagcaactgtaagtatccacattgctgttttctgcttccaagcttcagtgttgtttttttttttgtagtgacagggtattactatgttgcccaggcttgtctcaaactcctgggttcaagtgatcctccagccttggcctcccaaaaatctgggattataggagtgagccaccgtgcagtgcctggttttttaacatgctattcccttgcctgaaacaaccttgccatttgccatcaacactggcttcatcttccaatctctttgcctgttgcctcacattggatgtcaccaatctgggaagcctttgtcacccctcaccacattgaggtgaggggtacctcatattctctccctgttccttgatttcccattcaaagcacttaatgcaccaaacatttttttttattgcatgtctgaatacattccttagtagttcaacattctttgaggttatatcatgttcatcacagaatttaaagcaatctcctgtgtatagcagattgacaataaattagctatgaaaacaaatgaataactatggtttgggaagaaagacattgtctgagcacacagaattctaactcatgacttgtgcactgtcaagaatcacttgctttcagataattttgatgagtctgattttacgcttttcagtttgtatgtctcatgatttgtccttaatagactgaagaagtcctagcccttataattgaccagtgcctggtaggggaagggcagcagagaaggactggattagaaccatctcaaatgcttctattctgattagtacttagggttggttggagagtaagaatagggactcagcctagttgaaggaaagcctgtatagtggtgagtctgagtgacaaaccagggagaagtaataagacaatttatttctatttttttatcctacacctgaaatgtaaacaaggacacattaaatttttactggttagcattttttaagtaattatgtgctcaactatgtccttatatttgcattcttaccaatgtagactctgttatggaagtaacccatgctgctgctgcctttggacctgaatctctttttgcccttgtcccatttgtgaatttagactttcagcaagttgtctttatgattctctattctatgacatactttgtgaattcatctgtaatcaaatctgtttgatgaaggtcacaaaagctaagtcaacatgagacctgaaagtagaacctgggggtactgattttcctacccattaggaaacagcctccccacccaatcagggcaggttatagtattcaatgccatcttgtcttattgactgagtcatacatctctcattccgcaaagtcagggtcctaaaatacttctgtggagtcgcaaggactcttcctcattagccatctttgactttgtcattgatactattttctacctgtttctgataattaaaaccccccaaaaagtaaaatgtcagggtgaccagagagaaccttagataggacagctaatctcttgcttctagagaaaggtatgaaaatatactgtgcttattatggggatgatggtatgctctctgaattgaaccttaccttttaacatgaaatttctaattgaaacaaagctgtgatgcctccagctttgttcttttggcttaggattgacttggcgatgcaggctcttttttggttccatatgaactttaaagtagttttttccaattctgtgaagaaagtcattggtagcttgatggggatggcattgaatctgtaaattaccttgggcagtgtggccattttcacgatattgattcttcctacccatgagcatggaatgttcttccatttgtttgtatcctcttttatttcattgagcagtggtttgtagttctccttgaagaggtccttcacatcccttgtaagttggattcctaagtattttattctctttgaagcaattgtgactgggagttcactcatgatttggctctctgtttgtctgttgttggtgtataagaatgcttgtgatttttgtacattgattttgtatcctgagactttgctgaagttgcttatcagctgaaggagattttgggctgagacaatggggttttctagatatacaatcatgtcatctgcaaacagggacaatttgacttcctcttttcctaattgaataccctttatttccttctcctgcctaattgccctggctagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggctgttgaattttgtcaaaggccttttctgcatctattgagataatcatgtggtttttgtctttggttctgtttatatgctggattacattgattgatttgcatatattgaaccagccttgcatcccagggatgaagcccactcgatcatggtggataagctttttgatgcgctgctggattcggtttgccagtattttattgaggatttttgcatcaatgttcatcaaggatattggtctaaaattctcttttttggttgtgtctctgtccagctttggtatcaggatgatgctggcctcataaaacgagttagggaggatttcctctttttctattgattggaatagtttcagaaggaatggtaccagttccgccttgtacctctggtagaattcggctgtgaatccatctggtcctggactctttttgcttggtaagctattgattattgccacaatttcagatcctgttattggtctattcagagattcaaattcttcctggtttagtctgttttggttactgcagcctatactacaaggctacagtaaccaaaacagcatggtactggtaccaaaacagagatatagatcaatggaacagaacagagccctcagaaataacgctgcatatctacaactatctgatctttgacaaacctgagaaagacaagcaatggggaaaggattccctatttaataaatggtgctgggaaaactggctagccatatgcagaaagcagaaactggatcccttccttacaccttatacaaaaattaattcaagatggattaaagacttaaatgttagacctaaaaccataaaaaccctagaagaaaaccaaggcattaccattcaggacataggcatgggcaaggacttcatgtctaaaacaccaaaagcaatggcaacaaaagccaaaattgacaaatgggatctaattaaactaaagagcttctgcacagcagaagaaactaccatcagagtgaacaggcaacctacaaaatgggagaaaattttcacaacctactcatctgacaaagggctaatatccagaatctacaatgaactcaaacaaatttacaggaaaaaaaacaaacaaccccatggaaaagtgggcaaaggatatgaacagacacttctcaaaagaagacatttatgcaaccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggaccaagaactagaaataccatttgacccagccatcccattactgggtatatacccaaaggactataaatcatgctgctataaagacacatgcacacgtatgtttattgcggcactattcacaatagcaaagacttggaactaacccaaatgtccaacaatgatagacaggattaagaaaatgtggcacatatataccatggaatactatgcagccataaaaaatgatgagttcatgtcctttgtagggacatggatgaaattggaaatcatctttctcagcaaactatcgcaaggacaaaaaacaaaacaccgcatgttctcactcatagatgggaattgaacaatgaaaacacatggacacaggaaggggaacatcacactctggggactgttgtggggtggggggaggggggagggatagcattaggaaatataactaatgctaaatgacgagttaatgggtgcagcacaccagcatggcacatgtatacatatataactaacctgcacattgtgcatatgtaccctaaaacttaaagtataataataataataataataaaaagaaatttctaattgagttgcctaagcctgcccacctgtcattctcatatgcctaacacgatgtgagattttatatatacagtcctctgtatatatattcacaggttccccatccacagattcaaccacccatggattcaaaaagcaaagcaaacaaacaaaataacaacaacaaaaatacaaattttaaaacacagtataacagccatttacacagcagttatattgttttaggtattatacctaatttagagatgatttaaagtacatgggagagtactttaaaaaaaaagtacacaggcatgggggcagtggctcatgcctgtaatcccagcactttgggaggccgaggcaggtggatcacgtaaggttgggagttcaagaccagcctggccaacatggtgaaacccctgtctctactaaaagaagaaaaaacaaaaacaaaaacaaaaattattcaggtgtggtggcacatggctgtaatcccagctgctcgggaggctgaggcataagaatcacttaaaccagggagaggcagaatttgcagtgagttgagattgcatcacttcactctggcctggacgacagagcgagactccatctcaaaaacataaataaataaagtacagggaggatgtgtatagattatatgcaaatactgtgccattagggacttgaacatctccagattttgtatccacaggggtcctggaatcaatccccttgatggatacagagggaagactcactctcactctctcttgatatatatatatatatatatatatatatatatatatatatatatatatatatatatatatgcacacatacacacacacacacacacatatatatacacacacatacacacacacgtatgtatatttacatgtatttataaactgatattttattcaaatgtttcaactggcccctaggaagaaagatccactctgatgtgttctggctctgtgtgcccacccaaatctcatcttgaattatcatctgaattgtaatccctgtttgttgtgggagggacctctcgggaggtgattggattatggaacggtttccgcatgctgttcttgtggtagtgggtgagttctcacaagatctgatggtttcataagaggctcttcccccttcgctctgctcttcccttctttaagctgccatgcgaagaaggtctttgctttcccttcatcttctgccataattgtaagtttcctgaggccttcccagccatgcagaactgtgagtcaattatgcctttttcctttataaattactcagtctcaggtatatctttatagaagtgtgagaatggtttaatacactctgtaaaagcaaaataatcactcttcagaagcagaaaaaaactttttataagtgactcaaagtcaagatgacccatttctcatttatatgatataaacctatacatatcctctcacgtactttaaatcatctctagattagttataatacctaaaacaatgtaaatgctatgtaaatgcctgttatactatgttttaaaatttgtatattttgttgtattatttatatttttgttttttgaatctacggtttatatgaatatcattctctctccctctgcatctatctgtatctacatatgtatatttgtttttttcttagaacataacctagattcctctacagtgtaaatcccttgctttctggttttctgcctaataaaaggctctcatttctatcttggtctggaaatacccccacttccattttttatgaagtaaaaataccgaagatttttttttttttttgctagaagtagtttactgtctttctctacaactcattctaatatttttcttttcaactccctaccattcttattgtcttccagcaatgtctctatgatcatagagagacaaactgcagccacacttagccaggatcatttacatttacttgcatggctctgtgtagcttgctttttatgctaggcaggttcctgaatagtcagataggaattgaattcttggaaatcatgccattgtttaaggatgaggaagaacttactattttaatgaactttattataaaccttttttctaagcaaataatcaccccttactttatcttatctcctatgcaaatcctgattttcacatttaagctttacttaacagtgtcaatttgtatagttatctttaaacaatggtcagtccccactcttataattgaaaagtaagtaattttcatttactttctggcttctacctccagaaaatctcttacctctatctttattttggtaattctcttgtagggactttaatagcccctggaaaatcatcatagctctgcttcaatctgaaaacataactggcaggcatgagtctggaacacatacgagggaacgaagtacccagagccaagttaaatgaactgttgatgacttttctgaaaatcatagtaaaccatgatttcctcacaaaatatagaagtgtctgatttttggcatttaattctcaaacatactcagatacactttccttcttcctctcccactctgggttcatatcatcatataaatcagaaatgggtcatcttgcctttgagtcatttataaaaagtttttcttttctagctctgaagcgtgattattttgcttttagagaggatctttctttctggggccagttgaaacatctgaacaaaataaaaatcaattgaatatggatatgaaacttaacttgtctttttaccattaaatatatatttgaaaaatgtgctcttcttttatagcttttgtcacatcagcatgtaccaattccaaccagagaacgaaatattaatattctgccccaaagtgctgttttccagcctgtgccaaagcagataatgccagtaacagggagttttccaatctaactttcttataccagtcaaattatccatttcaaaaaagcatccagtcaaagtgctcccaataagtgaatattttgcctagagaattttgggcttgagttatccatccctctgaccaaaatctataagcccactcacccaggagatctgagaatgaaactaaatataaaaactggctttactactgggaacccgaaagttcagctagtgagggaaggaaaacaaagaatagaatgttttccgacaatccttgcttttgtgagtggtcagcagatgttttgtgcctctgctgtattccttagctaagggttcacatgaaatgtaccctctgaaggctgtggccttgttggaacgccaaattagtagttattcctcatgctctgaggtctagcttcaccttcagaaccaggtgagcttggtccccacaaagccctactggtacttaagcttcccatttcaagaggacatttgggttcactacacctctccaagccgtctgattaattgcagctgtgtgcaaattagttttcttcaggggctctctcctgctctcagattagcaacaacgtattcagatggaaagcaaataaagatagttgtaaaatgaggacacaaaagagatgcaacatgtttgctcttgatgggtgcattgatgtcagaacaactagggggaaataagaccaccttggtactgttatcatcgtcctgatgatggtcccgtcttgcagaaaagcccaaacagaagcagggcgttgtctaatcactgatgggtttcctgatattattgagaagaccaagcaaaattaatggtgatattatatctggtgaaattattataaattctccctgcagttttaattagctctgctctttttctcctcctgttttaatccaaagcatatgtgtatgtttgtatcagcaatttcaaaattctgtgaagcatttggtgtcatccatctagtttcaaaataggtacagcatgatgcagtgggaagaatgctagcctagaagttaggactcctgagttcctgcctaggtctgccgctaagctgtagtatgaccttggacatgacctttcaggaccttgatttcttcttatgtgagatgaaggattaaaatccaacagtttgttaaatcactctcaactttttagatactattaagtttaggatcccgtggagaggcctatcatccgagagaccatcctatcatcaaaaggtgaatatcaggtcaaagcaaaagaaaccacattaatttttttctgttgtcagctcacaaagctattttaagcctttggacaataagaaatatactttttttcccctccaataaatatacattatccattaaagtagagtgtgttgtgaactgaccttaagggaatttgctagtttttttgtttatttttgttttttacaggaaactaagtcctgtggaacaaaatagaattaccttcatggagcaagtttaacaaattgtcttcatttttggtcagcaggttgatttctaattccctcttattccctttatatgtatttttggcttcctgtctttgttttgcgttgctataaagaaacatgtgagactgagtaatttacaaagaaaagaggtttattagggctcatagttttgcagcctgtgcaagaagcatggcaccagcatctccttctggtgctgcccctaggaagctttcactcatggcagaaggggaaggagagctatgtgtagagatctcatggagagagagggagagcaagagagaggataggaggttcaggcagtttttaacaatcagatttcatgaaaataaaagaactcactcattacctcgaggaaggcaccaagccattcatgcgggatctgccccatgaccaaacacctcctactaggccctacctccaacattggggatcacatttcaacatgggatctggaggggacaaatatccaaactattaaattcctaaaggacataaaagggtgaactgcacaaggatactatatctccaaacaaatgcccagttaggtccaggacgtgttcaacagtgtccaaaatccaaagagaaccagagatagtgtggcttagtagaaggtaaactgattatacacactcagcattgcaagaaaccttaacgggactgttgtccaaccacacaagcattattcaaaaacctttttacctctcaaggtttggttttctagcatgggttgccaagctacaactgcccagagaagtcatttaaactgcaagagactcagctttctcatccttggaagagagaaattggacaaaattatctttaattttttgtttgccttaatatcctcttattctactaaacattttcagtattacagaaatcagctcttggaggaaaagacattgcagggggtgggagacaaagttggtgataccatgtaataagatttttttagatagtggcaagataaaatgttttgaggtttggcaaaaccatctagtagtttcagttctccctgacagtaagaagttaaggaggccaatttctctttcaagtcagaacttcttgttataactgggtagtaaacatactttttaataagaagtggctaaggcttaagaagaccaactgctgatacccagaaatagccaaagaatacttcattactgacagtgcacactttgatagacctgtcttttactattgacagtattctttctctgctgtttttacaagaaaaaaagcccaatgaaatgtaaaccttgttttcttcagttattggtcctaggagtattcagagtaaataaaaaaaaaataccttacgtatacttctataaaatcttttatttgagcaattaaaaaaagctatcttctttcagtcttatcaaggagagcaaattcctcctagaagtcttatttctacttctaatgacaattgctttattatgtgacattcaaaggaaaaacttgaagtcatatttctagtaaagtatttaatttcagaaataatttaaactgttacttcaaagcaaatatctgctattcctgacataaagtttttacccaagcttggtaataaagttatcataagaataatatggattattctcaggatggaatagaatgtcttgattaggaagaaacacacataagaaattcatttttttggaagaaagaaaatctgtgctgtttatctggcaatggaagtcagatcaaaatatatctatatgacatttgaatggggtcacgtgggaagacaagatctgtctgtatgaatatttttagcttctgaatttgacataagaataggatcaggaaaatgaattctgtgttacatgactaagatgcatattagaactcaggcaagatgattcctgtagttggtctactgggaaattaccctctgcctacagctttcaaatacatatatatactatgtgtgtgcatgtgtgtaaatttccaactgagtacatcagcacataaaatacacttgtccaaggtaaaaaagacaaacagttattaatagggcaaaaataaaatggggttatatccaaccatggcataatacttctcattagaaaaaagtgtggcgagctaattaagacccagtgatagttagaaagtctgagaacatttatctttaaaaatggagtggtaactaactaaaagaaggacccagaacctcctaatacaaatatcagttatattccctgagatttaaaaatataataattcttatttctaattcaaaggcctagagtgtaagtagggataacttaacctttttttttttttttaagcctctgtgagaaataacgcagctgtttggcccgtggtattctctttaaaggaaagaagttacaaagacaagaagaaaaaagtggaagagaaaaataaggagaaaaaatattcaaacagtacataactaaaaaaaaaatttttcacaaacagcaaggggaatcttgaaacaaaatagatttgttttaaaatgcaaagaaagagccttacccgggatgaattgctcagttctcttttgttggttgagttcacttccttccatttctgctaactttgaccagctgctaacaagcaaaagagcttcatagaggccatctacacgtgttctcttctgggttatcgcgatgctgacaaagtgcacctaccgcaaattagaagagcacaaagatttctgtgggtatgcctgcaaaactctggctgcgaggcatcacctcagctcagtagccttggatttacatgtgcctgcccccctgcccatggttactgagggtggcctgaggatggattcacttcataacccttttccataattatgtgaataacaaatgagctctatccaatagagaaaaagaacacattttaatactttgtgaagtgatcatgaggaaggggacagaggagttgagatggccaagagagatcccgccctctggagatgtaatagaacagtgacagataatgcaaaaaaagatttaatatatttttatatatttaatatttgtcttctgttgttgaccttagcttttgagtcaacagtaactaagaagcattttgtcatccgacggctcctcttcctttggccttctgtattgtattatctgataaggaagcagcgaacttaaagctcagttcaacgcaatgatccttcatcatagctgggtgtgaagaatgttgttccctcaaatatgacacaaattgtttggtcaatagagaagagaactgcattctatttttttccaaacatctgttatactccaaaacctttctccttaggccatggctgtctgaccaacagtaggtggatttctttgaaatcttatcttctgtagaactggatctcatcctggccaacatggtgaacccagtatctactaaaaatacaaaaattagctgggcgtggtggcaggcgcctgtagtctcagctactcgggaggctgaggcaggagaatggcgtgaacccgggaggcggagcttgccaagatggcaccactgcactccagcctggcaacaaagcgagactctgtctcaaaaaaaaaaaaaaaaaaaaaaaaatagatctcactagaagtattctcaattcagcagtagtgtccagttttgaatcaaataatttatattttgattatgtgtattaagaagctaaatctactcatatacaaaaggaaaatctttagcttttcatgtgttctggctaaaggccagaattaaaaggaagaggatgtcttatctatcagacatttttgtgcctttgaagccataaacttgagagaaacattagcttgttcctgaccctgcactcagcataagcatttgcttgtagcagtcactcttgggtgactataaattcacaaagtcaagaatttgcatcctgaattgatttgtgtaagatgtctaggggaatgctgattttatattggaaacaaggttagggggaagcctcaaaactgcctttatggagttctgtatctcagcatattataattcttacttctaccatactccagaggaatcagtctgggtgacttcataaaacagtattagaaaaattgctagcactacgaaatcaagcaggttatggcagtatattccttgtaagaaaattagtgcattaactctttccaataagtgattgaattagttttgcacataatctgatttatgaaatgctgcactcgcatgctcaagtagttagaaagtgtgtcgaagcagatgttgaactgaagaaagaaggttgcttgaaatgtaaaggtattataaaatggctaatctgtgggtatgacccaaagctttcagagatttcctggcttcactttttttttttcaatttaataaattttttttcttaaaaggtaaaattgccaatgagttaaatgttgatgctctgatgttagcaagactgagttcatatgtccatcgcttattaactccattttcttatcaatatgtttggcttctgtaagtcttattttcttgtttgtgaaaggaagatctaataatagaactggccttatagaattgttgtgaggattaaatgtggcaacccatggttattggtttcgtgcgatgcctgtcacaaagaaaaaacccaataagttgtagtggctatttttcatcttctcattatcaccattacttaagagagaggcaaagtgatagtatcatacaaacattttcatggagagttaaatgaacatctgttttttcttttcttcaattttttaaaaattatactttaagtcctgggggacatgtgcagaatatgcaggtttgttacataggtatacacgtgccatggtagtttgctgcactcaccaacctgtcatctacattaggtatttttcctaatgctatccctcccctagcctcccaccccctgacaggccctggtatgtgatgttcccccctccctgtgtccatgcgttctcattgttcaactcccacttatgagtgagaacatacggtgtttggttttctgttcctgtgttagtttgctgaaaatgatggtttccagcttcatccatgtccctgcaaaggatatgaactcatccttttttatggttgcatagtattccatggtgtatacgtgccacattttctttatccagtctatcactgattggcatttggattggttccaagtctttgctgttgtgaatagtgctgcaatagacatacatgtgcatgtgtctttatagcagaatgatttatacatacgtgtgcatgtgtctttatagtagaatgatttataatcctttgggtatacacccagtaatgggattgctggatcaattgtttttaaggacaggttgcataaaactgactaatgccattcatgacagtgagtttcaaaggcagatagctatcttagtccatttagggtgctctaacaaaatgccacaaagttaggtacattataaacaacagaaatgtatttgtcacggatctggaggctggggagtctgagatcaagaccctggcagatgtgatgtctggtgagagcttcttcctggttcatagatggcgacttccagttatgtccttacatggtggaaaggacaaggggtctttctgcgaccagtttttcaagagaattaatcccacttatgaggtctctgccatcatgacctaatcacttccccaaaactccacctcctgataccattacactggtgattagctttcaatatataaatttgggtggcggggtggggcacacacattcagatcatagcaatggcagctaggaggaagtaaattttgaatcctcatttccatgtaaagacttcatttgctttaaacaatttatttaacttttattgtgctttttctgaaaatgaaataacatttagctacacacagggagggtatgttgtttctaaagtaaaaattaactcttttgtaaatgtggcattgtttaataatagttcaccctgtccaatgatacttagcttttttatatatgtaaataaattattaggttactggtttttctttttcttttggtgggtggggggggtgttaagatcttattctcagtcctcaaaactctgttgaacagggaacatctgccctcattttcaaccttatttctttagtaccaattgcagccatgttataatctttgttttcatccaggtaaagctgagggaagggaaggagaatccactgagaaaaagattttccccaaagagtgactcagcctttgaaaagaaaatcagctatatgaaaagggaagagtatttaatcattcggagcaataattgcattgtaaatattagctcagctgataaggagtagagaaccaagagaatgagggagccgttacattgttttatcttgtttgatgcctttactcagtgctctagcatgggggccatgtctagggagggaatccactgcagctacatttaaggtcacctaataaaccgtgctgttttctttcttttcttctagactctattccttcattttttttttctgaactttaagcaaggaaactgccagtcatagagcatttccttatacacttccatgttactgttatgcagagaaatctgactggcaggctgatggccaggctgctctggaggaaagtaattagctatgtgactttatctaggccaaaaaaatgggataaaaaacatgcaaaaccattcacctatacagacctgttctcaaggcagtgtttaccctagtgcatctgctaattcctttcaagtctggaaaactgttttgtttgacatttttggaatgctgtgatctgaaccattagactatttttttctcctttaaggtactaatattctgatttttaaacaattaaatatgctctaaatttgtctcgcccacttctacatcttcttccaacatttacatagacatccatgcacattcatgcacaccacacaactacaagtcatttcagacaaatggtcttatctaattctttttagtgtttccattttattatttgtcaaattgaatggaacttccatgttttgccctgctgacatttaggcagacttgcataaaatacaagattatttctagctggataagaagctcagctatcagatagtgttgctgatttatacagtaggaggaaggagaaaagaccaatgggtgagtataataaatagaaacgtcctgaagcaattcacttgtagcctatccaaatcttgcaaactctgcataaaacatcctcccagttctctttcaatggaacaatttttcttttctttttctactcttcactgaacatttcctgtattctacatgcaacagtgcaccttttacattcgtttggcttatgtgctcttgcaataaccctttgctgtgtggtaatatctcatttgtgggaacttctgtgacactattaggggacagatacaatggctatgtgcctagcaatgccttcaccgtgctctatttaaatagattgctcatttatttgctactttgctcatcaccctgtctctcattcactataatatctttagcaaatcacatagtgccaggtaaataaatggtactcattcaatattgaccatatggatgaatctctgcttatgaaatatgagagccccgtgcagggtcattctgtccaggaactcatcttctctggcggtgtgagaccatatgtttaacatgaccagtaaggaagtagaaggaatcttccactactttttacattcttttttctttcaaaaagttttgtaaacttcaagtatgtaaaaaaacagttcttatatgttcatacagtttgctttcaacaataactccacacatgtgcattgacatgtaaagatgtttccagtataaagtagaaaaaaatgggttttaaacatcatatataaaattaatcaattttttaacatatagcatacctgtattcaggaacatgttctttggttattctcatttaaacagtcccctattgttgaatacttgatctgtttctattgtttcattttatatataatatatcctataccaaatatcctaatataacttctctgtgtgcttgtctaattattttgtttagataaaaggtttcatatggtgtccacttcatgccattatgtgatatgatttgcctctcagcctctaggaatgggtttttctctaaggatagtggctgccactctatctagtggctgaagtaatatggcttcatgtcatgtggctaacgattcatgccaaaggttgtccgcatcttatgtatcagtgagttatctgacacccctaatagacgcttatttcttttttcaaaaagcttgttcctgagctgaatttccatgatcagatggtggcaagagccaagtcttctcacataaagagaaatcacattgaatctgctacctacgaccactggccaaggggtcttgtcatcattgcattctggggaattggattcaatttaaaaagttgaagctgcttgctggcttccttcctggtagttttgaatgtgtaatctcacaaagatcttcttagctctggcaaagctgagcctgtctaaaacatttatgttagaatttacatgagttcatttgtgctggcgtcaaacatttcttgagtatttaccatgttattggctgatcttaaagccaagctacaaaggactagtaggggttagcaggcaggcaggaagaagaagggcatggttggcagagattgccacatgcacagaatatagtggtgaacctacatggtgcatttggaattgcaagtagtctggctttgctggaagtgggtttgcaagctgaggagtaacaagaaataaggccgaatagcataccaggaagtggtagatggcagagacccctggatcaccgtgatacttatgacactacttgctcacttgttttttggtttatttcctgataagctttgagccagaacattaatgcaaattcttgttcttgtgtaaaaattactgcaatgacttcccattgctcttggagaagacaaaatccttaatatggcctacaaggtccagtacaatctgtctcctgcctctgtagtcttattcttcactaggtctgccttcttcctcccagccctactggggcccattctctgggcttcaatattacagaccttactttaatttcactaatgggaaatgttgctgccttccaacaaagggcttttgcatgtgctgtttatatgaaatcctcttttcttcctgccactcttgcctattaatgttcttatttctcagcactcacgttatttttttactcagagaaatcttccctgagttccctgaccatgtcagatttttcacttatatgctgtcataacctcatgcatttctcttttacagtgctataaattgtcagtgacacatttgtgtaattaagtgatgaatgttcctttcttcctaataagtaacatcatctataccatcattattaaatcagccagcatcagctggggtacttatcatatgtcctatactgttctaaacacattatatgtattaattcacttaattctcataacagtccctattaaatggataacactgaggaataaaaaaagtaagtcacccaaagttacacagctgataggtgatgaagttagaattagaaatcaggggggaggagccaagatggctgaacaggaacagctctggtctacagctcccagcgggagcaacgcagaagatgggtgatttctgcatttccatctgaggtaccgagttcatctcactagggagtgcaagacagtgggcgcaggtcactgggtgcatgcaccgtgcgcgagccaaagcagggtgaggaattgcctcactcgggaagcgcaaggggtcagggagttccctttcctagtcaaagaaagtggtgacagacggcacctggaaaattgggtcactcccacctgaatactgtgcttttccgacgggcttaaaaaatggcgcaccaggagattatatccctcacctggctcggagggtcctacgcccacggagtctccctgattgctagcacagcagtctgagatcaaactgcaaggcagcagccagactgggggaggggcgcctgccattgcccaggcttgcttaggtaaacaaagcagccaggaagctccaactgggtggagcccaccacagctcaaggaggcctgcctgcctctgtaggctccacctctgggggcagggcacacacaaacaaaaagacagcagtaacctctgcagacttaagtatccctgtctgacagctttgaagagagcagtggttctcccagcacgcagctggagatctgagaacgggcagactgcctcctcaagtgggtccctgacccctgacccccgagcagcctaactgggaggcaccccccagcaggggcagactgacacctcacatggcagggtactccaacggacctgccgctgagggtcctgtctgttagatggaaaactaacaaacagaaaggacatccacaccaaaaacccatctgtacatcaccatcatcaaagaccaaaagtagataaaaccacaaagatggggaaaatacagagcagaaaaactggaaactcttaaaagcagagcgcctctcctcctccaaaggaatgcagttcctcaccagcaacggaacaaagctggacagagaatgactttgacgagctgagagaagaaagcttcagacaatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaacgcagaagcctcaggagccgatgcgatcaactggaagaaagggtatcagcaatggaagatgaaatgaatgaaatgaagtgagaagggaagtttagagaaaaaagaataaaaggaaacgagcaaagcctccaagaaatatgggactatgtgaaaagaccaaatctacgtctgattggtgtacctgaaagtgaccgggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcagatctctcagcagaaactctacaagccagaagagagtgggggccaatattcaacattcttaaagaaaagaactttcaacccagaatctcatatccagccaaactaagcttcataagtgaattagaaataaaatactttacagacaagcaaatgctgagagattttgtcaccaccaggcctgccctataagagctcctgaaggaagcgcttaacatggaaaggaacaaccgataccagccgctgcaaaatcatgccaaaaggtaaagaccatcgagactaggaagaaactgcatcaactaacgagcaaaataaccagctaacatcataacgacaggatcacattcacacataacaatattaactttaaatgtaaatggattaaattctccaattaaaagacacagactggcaaattggttaaagagtcaagacccatcagtgtgctgtattcaggaaacccatctcacatgcagagacacacataggctcaaaataaaaggatggaggaagatctaccaagcaaatggaaaacaaaaaaaggcaagggttgcaatcctagtctctgataaaagagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagattttaacaccccactgttaacattagacagatcaatgagacagaaagtcaacaaggatacccaggaattgaactcagctctgcaccaagcggacctaatagacatctccagaactctccaccccaaatcaacagactatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacatactagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctaccagaaggcaagaaataactaaaatcagagcagaactgaaggaaatagagacacaaaaaacccttcaaaaaattaatgaatccaggagctggttttttgaaaggatcaacaaaattgatagaccactagcaagactaataaagagaaaaagagagaagaatcaaatagatgcaataaaaaatgataaagaagatatcaccaccgatcccacagaaatacaaactaccatcagagaatactacaaacacctctactcaaataaactagaaaatctagaagaaatggataaattccttgaaacatacactctcccaagactaaaccaggaagaaattgagtctctgaatagacgaataagaggagctgaaattgtggcaataatcaatagcttgccaaccaaaaagagtccaggaccagatggattcacagccgaattctaccagaggtacaaggaggaactggtaccattccttctgaaactattccaatcaatagaaaaagagggaatcctccctaactcattatatgaggacagcatcatcctgataccaaagccgggcagagacacaaccaaaaaagagaattttagaccagtatccttgatgaacattgatgcaagaatcctcagtaaaatactggcaaaccgactccagcagcacatcaaaaagcttatccaccatgatcaagtgggcttcatccctgggatgcaaggctggttcaatatacgcaaatcaatcaatgtaatccagcatataaacagaaccaaagacaaaaaccacatgattatctcaatagatgcagaaaaggcctttgacaaaattcaacagcccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttcagctgataagcaacttcagcaaagtctcaggatacaaaatcaatgtacaaaaatcacaagcattcttatacaccaacaacagacaaacagagagccaaatcatgagtgaactcccagtcacaattgcttcaaagagaataaaatacctaggaatccaccttacaagggatgtgaaggacctcttcaaggagaactacaaaccactgctcaagggaataaaagaggatacaaacaaatggaagaacattccatgctcatgggtaggaagaatcaatatcatgaaaatggccatactgcccaaggtaatttacagattcaatgccatccccatcaagttaccaatgactttcttcacagaattggaaaaaactactttaaagttcatatggaaccaaaaaagagcccgcatcaccaagtcaatcctaagccaaaagaacaaagctggaggcatcacactacctgacttcaaactatactacaaggctacagtaagcaaaacagcatggtactggtaccaaaacagagatatagatcaatggaacagaacagagccctcagaaataatgccgcatatctacaactacctgatctttgacaaacctgagaaaaacaagtaatggggaaaggattccctatttaataaatggtgctgggaaaactggctagccatatgtagaaagctcaaactggatcccttccttacaccttatacaaaaatcaattcaatatggattagagtcttaaacgttagacctaaaaccataaaaaccctggaagaaaacctaggcattaccattcaggacataggcatgggcaaggacttcatgtctaaaacaccaaaagcaatggcaaccaaagccaaaattgacaaatgggatctaattaaactaaagagcttctgcacagcagaagaaactaccatcagagtgaacaggcaacctacaaaatgggagaaaattttcacaacctacttatctgacaaagggctaatatccagaatctacaatgaactcaaacaaatttacaagaaaaaaacatacaaccccatcaaaaagtgggcaaaggatatgaacagacacttctcaaaagaagacatttatgcagccaaaaaacacatgaaaaaatgctcaccatcactggccatcagagaaatgcaaatcaaaaccacaatgagataccatctcataccagttagaatggcaatcattaaaaagtcaggaaacaacaggtgctggagaagatgtggagaaataggaacacttttacactgttggtgggactgtaaactagttcaaccattgtggaagtcagtgtggcgattcctcagggatcaagaactagaaataccatttgacccagccatcccattactgggtatatacccaaaggactataaatcatgctgctataaagacacatgcacacgtatgtttattgcggcattattcacaacagcaaagacttggaaccaacccaaatgtccaccaatgatcgaccagattaagaaaatgtggcacatatacaccatggaatactatgcagccataaaaaaggatgagttcatgtcctttgtaggcacatggatgaaattggaaatcatcattctcagtaaactatcgcaagaacaaacaaccaaacaccgcatattctcactcataggtgggaattgaacaatgagaacacatggacacaggaaggggaacatcacactctggggactgttttggggtggggggaggggggagggatagcattgggatatatacctaatgctagacgatgagttagtgggcacagcacaccagcatggcacatgtatacatacgtaactaacctgcacaatgtgcacatgtaccctaaaacttagagtataataatgataaataaaataaaaataaataaaaataaaaaataaaaataaaaatacaaaaaaaaaaaaagaaatcaggcagactggatctggaatctgttctcttaacctctctctctgctcaccggtaggttatagacctaacataaagtagttgctcaataaatatttgttgaaagtataaatgaataaactaattaataaatactttatatgtgtcccactcttaactggggaaaattgggtgggtagatacaaaagaaccctagtagactgttcgctggcaggaatgtgttctagaggattggggaaagagaaacccccgaataactgtacgtgatttatgatgaaaatctttcaagtagtggaaagttataaaatgctaaccaaaagattagttatttggtttatatgttgatcactgtgatctttcccaatattgactggggtttgttgagtgtctgtaatcccacaggtggatgttcatgatctgaagtgacaatggtatatttgctcagcatttcctgtacctgaaacaacccttgaaaactgaaatagaaagagcaagtcaatggtaatatcatccagcactctgccaggcttatggcgaccttgcttacccgaaagcaaattacttccctctcatttctatataataagtactttacggctttgtgttttcatgcattgagatttccctaggagtctgagaagatgtccaggaataaaagagggaagaacaatgattaaactatttctaggactttagacattggattatattcagaaacccataatcagaccgttaatgaatgtcttcgcattcattatcagactctgaaaaagcatatccagtctctccatggactggccttcacatatgctttgctatctggtagaaatatctgcccaaaagattattttttatggaaataatagtgcacatgcagattctagatattattttctatttatcaactgcattcaggcagtgctaagtagatgactgatgctgaaattttactagatgatctttgctctctattttgttatatgacacatggggcaaatacgtgagatgagcaattagtgaaattctggaagggacagatttatgtcatactattgaaagggacaggaagtggattaagtatgatatatatatagtatgtgtgtgtgtgtaggtgtgtgtgtgtacgtataacaagttagtttccttttcctaccactgaaattgttaaatggaatggtgacgtagacactttacttctctactcctggacttactagtaaagaagaaatatataaaagagcaagatagtattgatctggggtggtactatggtatgtattaataccataccgtaattctatgatctattaatgtcacaaccagctacatttagctggcttttatatacgaatgtgcatagtactgttttgtattaaatatcaccagaagatatttgtcacataaaaacagtgagattaatgtttatatattttggcactcatgctagagttgaatgaggttctgtctgtggggataattctaggtatcctggaaaacctccacatatacaccaaacccagaatcaattcagataggcattactgttcgcagtcatctaatttcaagttagggtagtaggatatggattggggggcgtgattcttagtgccagagaaagattaaattattcatagggaaagatattcagcctaagatggataagactgaaatcaggtgcctggactctagaggattgggctctaaccgaaaaaaaaaaaaaaaaaaaaggagaatccagtaggaattcattgagtaagccaaggttacaatctgctggacttcagaggtagagttctagatgcccattttaccaccctaggtcagaagtggggagcagagagacagaaggctataagtgaggagacagtactgagacactaagtagacattctagccaactctgtagaggattctcatgttatgagctgaagtagaaaggctatgtttgaagattctgtctgattttgggcatcttggttctagatctatcataggtgcagattaaattgtttccaggctgtacttgatagttggtaaggatcaaacaataccctcacataacttgtcctagaactggttgtgctatggcatcattgtagtcccacatcctagcatggagcctaaaaaaaagtaggttcttcataaatagccaaggaatgaattaatgagtgatgggatgagtgtgagtggagaaataagcaaaattcctagaaatatggggtgggagtatggcagacaaacgttggcatcatccttcaaggaccagatcaaaatgccacatttccactacagctttctctgagttaattacttctctccactgttactatggtgatgtatttattctgctttaatagcatttatcaatcattttgtggttatattttatgatttctctcttcctcctagactatgaaatccttgactgtagaattgttggtttgtacctacattactgcagatagtatctggcaagggctgggctctcaataaatattgaccaaattgaggctgtaaagattccaatggaccaatatggcttgtgacccatgcttcatttacctaaatgaggccacaaggctctgtgatcacgtggcagtcaaataacaaaactctccaaaatcaggatttcttcttccattccttcaggttccctcccccatgggcatggttatctcatcctttacctcctggaaattatatattggaggttgtcagtgtgtgctgttctgtattgccctatagttaatgcacttctctgacgtagaggactgagctctctatagaactatgcagtgtcaaggaccctctgccttgacatagatgcttggaccacactgttaggtaactgagaagacaaagaatgtggctagaggctaaaagggacagagcaggaaaagcatgaagggcatgaaggaaggagcttgaatttttttcccaatgtactggggagcccaggagtggcatcactttgtactccagcagtgacattttaatttacaagccaagaatgcactgatcgccaactgcaaaaattgatttggttgttcatctgattcaacccatgtcagagtttgaaagtaattatgatagtggggctgataggcaggcaattacatttttgttctcttgctttctggctccttctccctctctttcccttcccacacctccacctgcaaggttgttcttgtcaggaaggcaatgtaagcaggagacgagagagtaatctttggagatgtggtatatggactcttgtggcagaggctataataaataatagtatggctggttctttatcctaatttttgttagcctcttatgaactctaaccagataaaagatgcaaactattttgtctccttctttaaagtacaaaatagaaaaagcacatgtactgtaaggcagtttctgtttctgatttaaatttgagttgtctttgcaacatctatagattcggtgtctttctaaaaaggtttgctccaaatcataatacaaaaggaacctgggatagggagagatttaggcaaagctaaaatccatctgagttggggagcagattccatgggagactgaaaatgtgtttcaaactgtagtgcaagaaattgaacaaagtattggaatttttctaaaaaaaaaaaaaggttcctttgctgaaagtagtacctggcatgtaaacctaaagtaatatagaagatgaagtggaaaagtatatcacaaggcaaaaattactttttagactgatgaagagatggatggatggatgtgaattttttttatctatttcttattttgaaggttatttatttattcacaaacactggaaaattcagtgtttttcactgagcaaaatagcttgtctggtccaaagccagtaaaataagaattttgtgggtggggtatctactccattagtatagcaaatgttgagatatataaattattttaatatatttattttattgacaatataaaaaaaaatttaacaggctccacaccaaggtcaatagaattcagaagcacatctgtcctcccaggaaacttgtggtttaactatttactatagctacctcaagattttacagaaaaaaaaaaaaatgagaccttctcttgaaaactaccatatcccagatctaggcttttctatgcactgtaacttctctataaacctcctttctactgactgccccacttcaatttggcacatacaccctttaaccagtaagcatgtgcatgtagtcagtgtgtcagacaggtttggctgaattgatataagactggtagcataggctgggcgtggtggctcacgcctgtaatcccaacactttgggaggccgaggcaggtggatcacgaggtcaggagtttgagaccagcccggccagcatggtgaaaccctgtctctactaaaaatacaaaaaattcactgggcatggtggtgcgcgcctgtaatcccaactactcaggaggctgaggcaggagaatcacttgaacccaggaggcggaggttgcagtgagctgagatcatgccactgcactccagcctgggcaatagagtgagactctgtctcaaaacaaaaaaacaaaacaaaacaaaacaaaaaaagatgagcagcatggaacatgatgttggcatgaggccctactacccggcagcagactatcagggaataaactagataaacctggaaaatgttttaacttcagtttattttattcacattaagtaatggagtagcatgttgtttgtttgtttgtttgttttacctctaaacctcctgtatagcccccttttaaaagaagggcaggggaagaggcttaaaatatggtagtattgactcccaggcctgttcagtctatacgaattttcaggctgtatagtttaaaaaaaacattgttcaatttcttatacgtttttactagtgatattactttagaaatgggcctcgaaagactcaggttacttttagatttgttcagggtttaaagcttcttttaggcacttcttgggcttcttctacctttcactgtaatatagtggtgaagagaaagactttggaatctgatagatttgggtcagaattgtagttttgccactcattacctttgggtaaccaagctctgtgaacctcagtctcttctgcaaaacagaaatggtgacatatttcctaagtctcttggcaggattaaatggaatacagtgcacaaaatactcagcacagtgcttggcacatagtaaatgccgaattaatggcaatgaattgttgttgttgttgttttctttttgagacagagttttgcttttgttgcccaggctagagtgcaatggctcaatcttggctcaccgcaacctctacctcctgggttcaagtgattctcctgcctcagcctctcgagtagctgggattacaaacatgggccacccatgcccggcttttttgtatttttagtagagacagggtttctccatgttggtcaggctggtctcgaactcccgacctcaggtgatccgcccacctcggcctcccaaagtgctgggattacaggcgtgagccaccatgcccggccaatcaattgttattgatttattactgagattgctttaaataaattcatccttatttctgttgtagtctttaccttgtctccagatctttggaagtctcaggttcatttgtctggactttgggggttttgtttaaaactgcctagtctctgcagccacatcctccaccactgtagcacatgatcaaaaaacttttctctgaggatactgagtatttcttagacctatgtcactagctccctgggaactctctctacccccatcccatcaactctctgaccacaagttttcaaggaatcttcctcattatactcatctatcattcttgcagttttctgtctcatcttgagctgttggtcaagagtagaccagagtatccatttctcaactcatttcttaataaggcaacaccatgttcaatgggcattcattgggccagttgaggctcctctgtaattttattttattttttgagacagagtcttgctctgttgtccaggctggagtgcagtggtgcaatctcagcttacagcaacttccgcctcctaggctcaagcaattctcctgcctcagcctcccaaagttctgggattacatgtgtgagccaccacgcccacccttctctataatttaaatgttatctctctttataacattttcataagaggatccacaattctattttcccattcacttataaagaacaaaaatatatccctaaggttccacaagtacctctggcctttggggaaaaaaaaaaaattcacagatgcttttttgaggaggtaattatttgtttgttgtgtccttgctattcattttgagatagatactcaagctctacacctcttagcttatataccagtttcaaatttatgtctttattatttattataaaatcttttaccagctgggcatggtggctcatgcctgtaatcccagcactttgagaggccgaggcaggcagatcacaaggtcaggagatcgagaccatcctggctaacacagtgaaacccggtctctactaaaaatacaaaaaaaaaacaaaattagccaggcgtggtggtgggtgcctgtaatcccagctacttaggaggctgaggcaggagaatggtgtgaacccgggaggcggagcttgcagtgagtcgagactgcgccactgcactccagcctgggcgacagagcgagactctgtccctaaataaataaataaataatctttaccttgaatattgagatgggttcaatacaatctcaatttagaatacttaaaagatgaaaagttccataaaataaattttctaatcaacagaaaacattttgttaagatgttgctgatgcaaataattctagcatgtatcactgttagttttctatctttgaaaactatcattcaactaccatcgtagttactagacttccattcaggatcttgcatgcctaagagtcatttcactgccaaaaatgaggaaatatagaaaactgagctgtgtttttatcatctaccatttcaaaaaaccctgtggaaaaaatatttcttttagcaaatctcagacattatcttgacttatatgtaagatgtacctctctctttaaatccaagtgcattgaaacttctggctcataaggtaatttttttttttaaataattaactaaacccttaaaactacatagaagtctactttgttttataaattaaccccattattttaggaattaatatagctttgtcttgtgagatgctgaagttatttttcctggttcttaatattcagtctttccgcttatctatttaattcctgatcactagccaaactatatactacagtttggttcatccaatttaaatagctggcctgtaactaagaaaagaaaaatatattttgtgaagaataggtatgaggtagagaaattagtggtagtatgatacgggaaaagagtaatgtcaaaatgcatggtaatttatgtgatatgccgaggactgcaagaagtcaagaaagaaacataacaagctaacagctgtcaccaacaaatagcaattaatttcagcattcattcccttgctcatgcttcatgaaagtatataggtaaacaggattcgtatcatgttctattttcttctctgggcctcaggcttccagccctctgagctactgtcttataacattctgaggatgtaagaaagaacttgatcctgttttctttttcagtctggagcagagacacggtgaagttcagtaaggtctgacacccattagcattttgtgtgactcaggatacgaatcaaacctactgttgtggaagcagctttccatataaatctaattcccaccaactcctgccaccaccaaagctaatagtcaagtgcttgtattgctgatagcaaaggtccaagattattcttattgttttactggggctacttatcaaaatctatttacttgtctattctatggatggggaggtggtaaagaaaaggcttaagtgtcctacagagattcattctatgctgcctcaaatgctttgaagcagtacaatttctcttttaactgcctcgatgtaggtgaagagtcttgcaggatatgttcactgctgaagagcaagcctgcctcattcataaccactagtagctgacaacctttggattctttccacagcttgaaaattcctccattccttgaaagcaccctgcactaatgctcgaagtattaagtgtgtttttatttcctagaaggatgcattttacacaagtcacttaaaagcttctggaagctttaattacaggttgactaatatttagaagaattgaaatacccctctctctcctctgtggtatgcatgagccagattctggttcattaaccagaagtctattacttttcccctatagtttcatggagtaaaatggtagatgcaaaccaagagaggtcaagggacctgagcttggttctgtctttgtcacaactaagagtctgaccttggatgagtcatggtaagactctgtgtcatatataaagagtattctgagagtaaaacacgcatacaaatgaaaagtatggttattatggtctcttgaatattcttagatcaatttcacccattggatggggctagtatatggttgatggatggtatttgtttcatttatctggcatgcatttaaatcttcaggtgcattaaacgaacaacacaaatttggtatatgattttcatgctctcttgcatgatagatataaaatcttaatcagtgattgtctggaaaccacagtctccaaaatgctgcctaggagtgctaaagagctgtcagatctaacttatatgagttgacaacatagagaagagaaagaagttgaattcagttaaacctggaaggagaaacccatagggtggaattatctgaatttgaatttttctgagttttattcccccctacattatgacacactaataagtggtctaccttgacccagagatacgaattttggcctcatttgtagaatagcacctggattcaggaataactccttgaagtgtcccccttaaatctctatgtggcattcaatgttcacttactcatagaccaaggagataaggacatttatcttctcaggtaaggtccctctgttgaacactgaaacaaaggggttacattaccactgcctatctttcagaaaaatgactgctgtgatagcataaatgtcccgagagctttgctttgatagaagtgtgtttttaatgatatgattttggtgtctggccctctgtggatagcttggcatgtgtcttgttctatttaaacagcactgactgataaagtggacgttaattggcagttagtgacgaggctgcaggtctttgttacccagcctttcagctaactgatcattaactaggaggaaatgtgtgacccagaaggtcattactgttattacgtgggaaaatacatttaaatgttacagattgcttttttatgaatcaggtgagcatttttagaaaagagagagcttgatttacaatggagtctgttttcagtcctgctcttttcctgtccctttgaagactaaacggtatatttctagattcccattgctgtattgcctagaacctcacaatgttgatattgactaaaaaacagaaatttcttcaactccattaagagcttttccaaaatcttaaaatttccaaataaaatcctttcgtctggatgccactcactttaacaagctttgagtaactttttttaatgaaaatgtgatagaaagtaatgtaactgcatatgttttattatgtaaaattctgatagtatcatgtatgtctttagaatttccgttgtcacacattgtctgtgctttgtaggattttgcagattaagccttagcactcattttgtgaggacagtgaatcctaattcctcttcttcattctttctgtgacctttttgattttgcctctttagtaatctcctcactgcccttgtaatgcaaaaaataagaataaaaatggtctgtttgggtgctgtgagtcttggcaattaaaacttcacatgaaatttgtctcctgagagaaaatattattctcccttttaataaaaggatacaattaaatactccctgaaacctctctccttcaaatatattgtcttatgtaaaagatggaaatggagccttgtttagctgaaaaactgaagagccaaaaacatttctaactataaattagtttatgcatattaaatatcccagccttagctctaataaaaacaaaaaaaatgtgaagcatggtgtgctctgtggttattaacctgttgttgaaaccctgacttcagttctaggcccttagcatgattacttctttccttctttgggttgcatgatgcttcaaggtctagaaatgccaatgtctttcccaaggggttttaccttttacctctgaagattgaagaaagcaactgagttgttcagaaatctctttaaattagatttaaaaggtactgggtttatttttgcatgtcttctttattttttcctccaaagattaagattgtattttagaaggctcttttggctcctttaaaaagaaagtttatccttgtatcatataggactgaaggagataggctgcagtttgaaggcaagagcatctgatctccaaagaatcagaaaatctcttcttttgttgcatttgtaggtactttttgttgtgttgcttttttttttttttttttttttttaatacaggtaaagttcaaacgagcacagcatggtccaaatggtgtttaaagctgtctaagtttcctttatgtaactttcacttcaacaagtatgttccagctgggagtctatcgggctgttaaaattaactttattcttcttttgttattctcatgcacacacacatacacacatgcctacatgcacatgtgcacacagacacacaggtgtgaacatgaccatttaatcacatccagcagggctgaatgtcactctgcggggctttattgactgttgtacaggctaaacatttcattcagttgcaagacagaaaaactctgcaggatgaatttcaaaacagagagcagaattgttacccacagataagaattctttgtaaggctttcaccttctcataaaagtgttagttaagaagaggtgaaaacaggtattccattcatctctgaagtgtatgcagtaatggcctcattcggctgagatttcccagcagcaaaaaatgtgcttggcagaacagttgctctaaatacctgggacatacattctttctaggattaaacaaataatacttgctgccctttgtataaaaagatcacttttctggtgcaccattagtgtacatttgatttgatttgtttgttaagcagcaaaggtgggtttccctggagccacttacacctcctctcggtcctctttgcctctggctgtatatgcatgttcattctaccacctgatgacttcatgcttactctgtgttctaactaaatcgaatgagtctcttattcccattccttcctttttactttcctgcctctaggcattaatttgtgccatttacctggactatctgctcccacctttgactattaatatcctatttattattctatcaaagccaaagaccatcatccccatgaattcctctgacatcccactcagaatctatctctctttcctcagagcacagttttttttctttttactatcatttaaggacagttaggccaaacacttacctacttaattataagcttcttgaggatttgggccacttcatatggcttttggttttccccaaagcattagctccaaaaagaaaggttgaatgaatgattggtgagtcatcaaccttggcatagttgggactaccctttgagaccactaaccagaatttttctcaatgaaatgaaatttattccccgacaaattgactgcaccatgttagtctccttaacatcatctgctgaaccatctcttaagaaacactttgatactagatggtaaataaccactgtgtcaagacctccaagtgccctttacctccaggtcacctgtgttcctgcagcaagacacacctctgtccccaccatgaggcagaatgaggcttgggacagataagacttccagaacccagctccagcactgtggccactgtctgattaatcagttcttcttctgcactgataattaaatactcactgttaaattttatattacccttgctagtatcattgttataaccaatgtgacagccacaaaagagaattaaagctatagactgtttatggactgtcttcacttcagcacagcagggaagaaaccagggatctgaataagtactagggatccttgctcattttcccaatttggctacaaaagttaatgaaattggggccaacgcttaaaatgcagatattgttatggatacattttatgatataaatagagatacacttgtttcatggaggggtaactagggacttagatttcatttggacctatgtgtgccgagcaattggaagcatattaaaactgttttatgtgtaagcatttattgcttttgcctataagatgttgcttatgtgggaaattaagagtccagtccaatgtattcctgggtatacagcttatgaaggcatttaaaacctaaagcatatttattctgcatttaaaagtgtttagagactgccttgtgtgttaatgtgtgctgtgcgactagcactatttaaatcctatccccctgcatgcattaatgtgtgcgtcgaagggaagaagagcaagggatgataaactctgttaactgcccaatgttcaactaagatttatgtaagaaagaacagtctagtgcattaatgtgaatattctaagatagatgtttatcttaatggactcagaggtacttacaaacagcataattgctgaagtcattttacagggcatttattcagagtgattacactactcttacttttctttacataaagaattccacttaagggtttaagtgagacaggctagtgtggccaaagaatcataggttcctcctatctgctgctcagcgctaaggctatttgaaaggaggagaagcaaaaccccaaatctccattttggcactttgcaagaaattggtccaaatgttcaatcactccagttttcagatctacatgatatttgacttactttaaacctatagtcctgcaaataagaaatttatctctctggtacatggttgtagaattcaaacattagttgtttatggacttttatggaccactgaggcattttctgtcttgaaagcaaatgtactcttccagagaaactcctgttctttttttaaagttttatttttaactgacaaattaataattgtatatataggtacgacgtgatgtttcaatgtctatattcattgtggaatgatcaacccaggataattaacatactcatcacctcaaattctttgtagcaagaacatttacaatttattcttttacatgaatgaattttaaaatatataattttgaaataggcaattcattattaactctagtcaccatgctgtgtaatagatcagaatctacttctcctgtctgaaactttgtagtcttcaaccaacatctcctcattccccattgacctttcctttctcagcctctgataaccaccactctactctctatttctgtgagtttgactttttagatttctacatacaggtgagatcatacgggatttgtctctctgtgcctggcttatttcacttagcataatgtcctttagctccatccacattgttccaagtagcagaatttcctgctttttaaaggctgaatattattccattgtgtgtgtgtatatatatatcacatttaaaaaattttattcatccattaatggaaaaccttcattcttgaaaaaatagcttataaagctatttatgtccctgatacctccaaagatcagaatgagtaataatctcacaaggatgggaaatacttcctctcttccaccttttgcatgtccatcctttgaacatgactcctggtgtgttagtctagtctgttctcatgctgctaataaagacatacctgagactggctaatttataaaggaaagaggtttaatggacttcacagctccacatgactgggggggcctcacaatcatggtggaagacagaagaagagcaaaggcacatcttacatggtggcaggcaagggagcatgttcaggggaactcccctttataaaaccatccgatctcatgaaacttattcactaccacaagaacagcatgggaaaaacccacccccatgattcaattacttcccaccgggttccctcccatgacacgtggggattatcgcaattcaaggtgagatttgggcaggacacagagccaaaccatatcacccgtcttacccaattctgttgaaataaacagacatttcctgagtacctgctatccattcaagttttttctatgagctaggctctggtccaggagtatagtaaccctacgggtgatttcagaccaataataagtaacactattaagaacacatcacagaagagtaacatctctgactcgctgatatccatttcaaaccacataacaatagcatgaagtagatgtcactgactcaaattaacagaagagaaaactagggtgcagtgtttgtgattaccttggactctcaccataatagactgagctcatgttttctgactcaaaacacaaaacttttcccttgatatagttgcctctagaagaagtcccttgtctccctcaaatagcaatcaagtagaagggaaaatagtgtaagtcaatatatattaagtactttcagtgtgattccaagaaactattgagttgcgatgctaaagggagcattttatttttcagccttgggatcagaaaaacattacataaagaagtgtttgggttggaccttaaaaaaaggtataccatttcagcaggtataaatggaatgaaatgcaaatagagttgggtaaggagcagtataagccaaaacataaagttatgaacttaatacccttgttcagagaattgaaaacatttaatagtcagtatgtggaggcatttatagggacaaatggtaatggaagatgatactacaaaattacactggagtccagaggtggaggatcttgaattttaattttttttaagtctagacttttgatagtgagataaatttgaaccaacagagtgaaacatgaaaactatatttttatcctggaagtactttctagagttcattaacaggaggaggtaagggtagacagggagtctgggtagggaattttaggattcatccacataagcaaccagggaagtaggaatgaaaactggagtaacattttagagatggctttgcaggacttggtgcctggaggtgtgacggggagcaggaaggatttgttacaggaaagaggtcccgacttagaccccaagagagggttcttggatctcacgcaagaaagaattcagggtgagttcacagggtacagtgaaagcaagtttcttaagaaagtaaaggaataaaagattggctacttcatagacagagcatccccaagggctgctagttgctcatttgtatggttcttgatgatatgctaaacaaggggtggattactcatgcctcccctttttagaccttatagggtaactactcttgtcccttgatgatatgctaaacaggccatggcatttgtgaactgttatgtcgctaatgagagtgtagcagtgaggatgaccagaggtcactctcatcgccatcttggttttgatagattttggctagcttctttactgcaacccgctttatcagcagggtctttatgacctgcatcttgtgctgacctcctatctcatcctgtgactcagaataccttaactatctgggaatgcagcccagtaggtctcagcctcattttacccagctcctattcaagatggagttgctctggttcaagcacctctgacagatttaaagatgaccctgagagtttgggcttgttcctagagagtaaggacaccatagacagaggccaggaaggcagcagagggaggagttaatcaattcagtctgggatatgctgactgctcatgtttccaagatatttaatcaaaaatattgtcccttatgtgttagtctatgttctattactataaaataaacttctgagactaaataatttatagagaaaagaggtttatttggctcacagtctgtaggctgtacaagcagtgccagcatctgcttggcttctggtaaggcctcaagaagctttcactcatggtgaatggcaaacagggagcaggcatgtcacatggtgagagagggagagagggagcaagggagacaggaggaggaggcgccacccttttttttattatttaattttttgagagggtggcacgatcatggctcactggagcctcaacctcccatgctcgagcaatcctgctgccttagcttcctgagtggctgggactacgggcctgcaccaccacacctaatgtttaatttttttttaattttttgttgagatgggatttcattattttccccaggctggtctcaaacttctgagttcaagtaatcctccctccttcatccccaaaagttctgtaattacaggcgtgggccactgtgtctggcccaggctctttttttttttttttttttttttgagacagagtctcgctctgtcacctaggctagagtgcagtggtgtgatctcagctcactgcaacctccgcctcccaggttcaagcgattctcctgcctcagccacccgagtatctgggattatagatgcatgccaccacacctggctaatttttgtgtttttagtagaggcagggtttcaccatcttggccaggtgggtcttgaactcctgacctcatgatccacccgccttggcctcccgatcttgtgatccacccgccttgacctcccaaagtgctgggattacaggcatgagccacctcacccggtccagctcagactcttttaaacaaccagatctcatgtgaactcattactatggggagggcaccaagccattcatgagggatccacccctctgagccaaacacctcccaccagccccacctccaacattagggattatatttcaatatgagatttggaggggacacacatccaagctgtggtgggcattgtaatcacggtggagctttcctcatcaggctgatacccaagtcccacccctgggtattgctagaatgtcacctggtgactaatgagtgccaaaggaggagaccaatcccgtggcgcccttgcatcctctctgcttgtggttgctctctctgtattgttctctctgttatgattggctctaacttccattaagagaaaacttgacctgcagtgactgaagacaggatacattttcttaaacaagaattccgaagtttagagaacataaaactgcttaatttggctcctataataggagccaaatttttattttataataaataattataataataattatatattgtaataattataattaattatatattgtaattataattaattatatattataataattataattaattatatataataaattattttattctaatttattttataattgtcaagtttaatatttgacaatatctgagtcagcttcccagttcttttcttggctttccccccaacttgccaccttatgggcacaagctgattgctgcagctccacatgtcccgtgcaaacccaaggaagaagggaaagcagtcagaccagccaagtctttttcgttttatcaagaatagaacaagcatttctagagcctctagaggatttccttgtttagctctttgtccagagctaccacatggccacttttagttgcaaaggaggcttggttaggccggtcacattgccagctctcgcaaggaggaagaggggaatggatattgacaatgtctgcaatagtcatcttccctgctacgctgaaagcactttaaaggcaaggaccaagctccgtcaggccatacttatgtccgtgctatgccacacttctcacctggcactttgctggacatatgaagacctgagatgagaagggtttgaggagacacttcctgcccactgtgctaagcactttcttgtgtcttttgggttctctgagcagctgtaggagtatagaagcctccagatatacgttaaactctttttcagcacctctcaaaacagaaaaaaaaagcaagaaaaagactacaagctgggaggaaatctatgctgctgtaaaaatagaatagggctggagtgcattcttcagtaatgaatgcatgaaaagcagcctcttcaattataaatgtggcttctcttgtttgttgcccagtaattctgttttattgatttctgtttacttccaatcacctcaaatgagactgtgttgcttagagatcttgatccctaaaagtttgtcattaaagctactctgctgtatttagttattttttgctcaaagcatttgaatcaatatgtatacaaacgaaacactttttcctttgctccctagaagactacaagaaaaaagaatctagaaaaactaaataaagatgcttagatttttttaaaaaaagtcccagcaaatgacatattgatttctttcaaagaggcagagtgtaaattaaaaatatttttctgacacagtttttaaagatgccactgactcagcagagtttgtgcttattgactttctcttcctagagggccagggtggaaaggccgcccacttttcctaagatcagctggctttcaaaatcctttgagggaagttagccttaaagccaatgcgagcaaaggttcttgattccctgtgatcaggtctgagttccggttttgtcatctaccacatcacttctgtgtataaaaaggtgttgtaatttttttttccagaaaattatatggtcatcattctttttcaaagtggttgcattaaaacccagaattctcagaggtggaaataaacaaaagctgcgcccttattagagaatactctctggaatgttattaaatgggtctgggcagatagagaggggagttagagtgggagcatgtgcattaaaagagccacaccaatacaggaatactagtgctgtttcctcctggtacctttgagagaataaagctagtttagacccacagtcggccgggcgcggtggctcaagcctgtaatcccagcactttgggaggccgaggcgggcggatcacgaggtcaggagatcgagaccatcctggctaacccggtgaaacaccatctctactaaaaatacaaaaaaaaatcagccgggcgccccagctattcgggagcctgaggcaggagaatggcgtgaacccgggaggcggagcttgcagtgagccgagatcaagccactgctctccagcctgggcgacagagcgagactccgtctcaaaaaaacaaaaacaaaaacaaaaacaaagacccacagtcatgaggctaggagggaagcacgagggacctggtttcaggaacataatctatttgtcataatttgagtttctgaaaccatgtcacactcctttggcctgttcaaaatcatttttcagaactgttctcagggttagctatataatttgtggaaaccaatgcaaaataaaactaagggcccccttgcccaaaaatccagaaaaaaaagtgttaaaagtgctagaatagaatttcttttctctttcttcaatagtctatttgttatgttttttatttgctattgaatgacatttaagtaaataaaaatgtaaattagcatgaatattaccattcgtccttatattgtgtgcaatgccagttttaaatccagatataagagcattcagctcaaatgcagaatcattgaaataacacaatttgtatgtcatagcccatatatgcatgtgtcttttgttcttattggaagagtggaaatgccatccaaaagtaacttactgctttttgtttcacttcttgatgcatgcacattctaccaacgctttttaacttcagcctaccgatgcatcaggtagaaccaaaaacaagaggtctcttgccctgtgcaagccaagcctttctgattagcaatcctagagagaacaggtggctcacgcctgtaatcccagcactttgggaggatgaggcaggtgaattacgaggtcaggagtttgagaccagcctagccaacatggtgaaaccccgtctctacaaaaaatacaaaaaattagcagggcgtggtggcaggcacctgtaatcccagctacttgggaggctgaggcagaagaattgcttgaacctgggaggcggaggttgcagtgagccaagatggtaccgctgcactccagcctgggcgacagagtgagactctgtctcaaaaacaaaaacaaacaaacaaacaaaaaaacaaaaaaaaaacaagaagaggtctccgggttgccctatctttccctttcatgtcatcgtctttactgtaaatggttggttgatacagagacttaagaaaggatgtgataggttctcctgaatgccattgccttctctctgtcttctaagcaacttctggttcaaagggagagcatgagctcctggggatgtcagtgttcctactcagcctgtagatataacatccttacctattatacagaggacacgatatagaatccggagagaggaaaagcaaaggaggccagctttggcctgagaacttaccctagtcactcttgcctagaagacagtaccaacctcccaaggagaaacattgggggataaattcaaataaagctgtttgattcagattactcctatatgtaagtgaatccacaggatcctgtgccattggggcatcaggaacactatatgaggatgagcagcaaggaatggaagtggacacacacattgcatgtatctcctctgcttgctttcatgccgcactgttccactgaacttcacttacaaaacacaagtgcaaagataaatgattaggaatttcaagatggtaagagcagagcatacaacctaacaaagggtctttgtgagcaaaaaaccctgtggatgacctcatggatctcatgcctgtgattacacctgctacatttccaacacccattttgacagcaaatgagtgttgctgtttatgaactggaacggggaaaattattagcctcactgtctatcagaaatgagaaacaattcatctcatctctttccacatagaagttctgttgtgtttgcttttgtaaattattttgaatcaatatctaagatgggtttatctatttactactaattgcagcctgggaataaggatgtgacttctggggttgagtgggcccatctgggtttctgaacttctcaatttaatagcacctgaagacattccctacctagagattttttatataaatcatagagctttatgggaacccatcctcccacatttctctgtgggaggttggtatttccttctaggcatgaatagggataaattctcaatcgaaagctgacctcctctgcatttttcctctactgggacttcataccatgttctcaaattgactctcatttttccttcatagttctgtctcaaacttactggccacagatcacttgtaactccctattttattaagtccagtttcaaataccaaaacttgctttaacttctgctattgctgtaacacctgtctctgacttttctaacattatattacatggctgagtgggatatactttttttttcacagtgtaataaggaaaagatagccttgtatttctagaagttgtattttatattcacttcattgcatttgattgttctggataagttttctgtgccacatactaagttttgggatgtactaacatgcactcttttcttgtgtttacatcttcttgagcttgcatctctttcttagagggaaggcatgagggaggaaaataagaagaaagaaagggaaaaagggagggaaaaaagtagatttggtctttggagcttcagttaaatttcccttataatggttagaccctaaatactcaaaatgagtatttgtggtgaaaacaaaagagctgacagtggaaacacagccaagcctttctaattagcaatcctagagaggacagcaccaataagaaagaagagcagccatcaaagccaggcctttatatgtatgtaatcaacaggcatctgatctagattcttaaagatggtgtggtttgggtgggtgattttatttattttatttttctgtctcctaaataatatgtaatttcttcaggccaagaaataaattgaaaggatttagagggatttgcttatcagtggaacaccacgtagcattacattcctcctgcttttgggaaggtacattgaagtttggttaatcttctgtggttcaatactcctcttccctctgtcagcctgccttgaacaacagattaatcccttttccacccactctcttctccttcctccctcccctctctcttgatctacccttccctttttgagcaaatagaagaaaaatcttaaaagtggggggaaaaaaaaattaaactgctgcactacatttatttatataatcctagaagacctcaagggtagaaataaaggatcccaatcctcggcacaaaatttggccaagcttagcttggtttttctactgttaattaaatcttgagtctgcaaagggatttccttaaagactaattcattagcaaaagttattataagtcacgtcattctttatcctgctctagtatatgcattgtggaaaagaagaaaaagaatatgctggctattgaggatgggtagaggttttagggagtgggtgatacgatttgcttgaattcctatgtagtctgctgtctttagtgacaatgaataattactgttgggtgacgcttatgagcccaacactaattttaagattttatagctaatgatttggcaactaatcagtgttttctggtttgacttggcttaaatctcagtagtctataaagtccatgaggacaaggaccaggtcagcctggtcccaagcacagtgattgactggcacatcataggcaattaataaacacttgtcaaggaaattagtgagtgaatgagtcaatgcaaatgtcagtacaaatgtaaataaaatcatatattcagaatatttttttaattcagttttagagagctctgttccaataacctaattttggtcagacagaatgcaatatctttagctcagggtgattctctttaaagctatctcatttcatggctatatgagcaagtaagttatgcatgtagtcatatcttggcaagtgattatcttcaggagtaggtagagggaagaggggaaagtaatagctggaagaacccatggcataaaccttgtaagacagttttaaaattcacagggtgttgttccaatcgaaatacttaagctcatagacataggatacaagggtcaccttagatagtatcttaacaagactagaattctgtcccttcacctccaacattcaggacctgcttcatgagatgcccccatctttcacacctgagtatgacaagttagagtcatttatgtttcatttgatcataacaatgtcagtggctttcaaaggtaactataaatgggatgtttaatcagaataaaataagagtataggtatgacagtcatacaatcttaccacactgtgaggttgtttctgtattgggcttaaattgagtgagtgagagggatgggggagagagggagataatggcttctaacaagcttgcccaagctctatgttttttctagttttgattacatataaaaatcattggcaagacatagtggctcatgcctgtagtcccagcactttgggagcccaaggtgggtgactcgcttcagcccaggggttagagaccagcctcggcaacatggcaaaaccctgtctctacaaaaaaataaaaataaataaattattcaggtgtggtggcgtgtacctatagtcctagatacctaggaggctgaggcaagaggatcacttaagcccaaggaggtcaaggctgcagtgagccatgattacgcccctgcactccagcctaggtgactgagagagaccctgtctcaaggaaaaaaaaaaaaaatcatccagttgtatgtgtgggtattagcactgatcaaagatgagactgtgatggccacaatttagtaaagaaaatcttaatagatacatttaaaaaaaaggtcaaacttttcaaatctcattaaaggttataggtttacttagagtcaataggtattaggtaattgaaaaactcaggcagcttgtatttaaatagagaatgaacattcataatgaagctagatgggtcctctctcatctgagatattcagagctccaactccatctcagaatgaaggtatagaggggaaagaactaaaacagcaaacatttaaaggaatttaattctttttagcgtggagcagctgcagagatgtatggctgttttctgtggggcttcagaatatttatgggcctttcccttttcctttttcaccggaagaaaggagatcatcattcttgagtgtgttatttataatttcataaagctgttctgtggcaggacttattttatctcatactaaatctcaaataactgtgcttccaaggagatgggtggggaaaattgattatccctcaaaatgattagcctattaccagtgtaagataaagagctgaagggtggaatttgaagttacaaaaggcagttgggcagtaaggaggggacagagtgaaacggtcttgagcagttctgatcacagctcacagcagtagacacttttctcatgcccaataatggattaataacgaagaacagtgtagaaccattgccaagaaagggtaaaacccttctgagtacataattagaagccaatgattatagaagcaataactcactggaggaaaatacgtcagatttgtgaaacttagggaattggaaggtaaatatacccataaatttacttgggtggacagagttctgagctttcttctgtcccagctttattctaaggtaatttcaataaacaatgttaggaggaaaaaaagaacataaatgcaataaaaaatcttccaggaaaggaatacatagggctcctgccagacagatattttattgaaagttattataatacctatctttagttttatgagtcctaacacagaacaaagtaatttcaacacgtggattaaaaatatgaaatacatattttaacatgtagtagtatgaattattgttttaaatataggacttggctaatatataggggcagaggaatatttttctccccttgagaaagcaagttaaggtgcttaatatgcattgtgaaactgcattgcagtcatactcatgcactatgttctataaaccatgtgtagtagcttccaaccaaatgggacagatgacactggtgagatgcagggagtggagaaaggagagaagtctgatagggcaggacatgaaattcatgctcagtatctaagttttcaagaacaacatagctcaagtagtggtcacactgtcattctagtccatcccttccctccagtcatcctctactactagtgggtgtataaataaaccgtgttttagacctctaagcctttgcaaatactatttcacctgaaatgcccttctccttctccagcccacccgtcctcacttccttcccctgtctcaccactgcctgtccctgagggctcatttcccacatgctctctgccttcttgctatttccttccttcacacattaatgcttcctcttgtcagagcattcggtttactacatcaagtttgcctgtttacttgcctgtctcatcagactgtgaattcccagagcagaggaactgtgtcttatctatagctttatcccttataactgttaaagtgcttgacatataggtgtttgaaaaagattcattaaagtaatgaatgaatgaaaaaagcaccttgatgacatataccactgacagtaaatctaacagcccagccactgtgaaaattatttggtgggtggtcatagagtttttaaaaaatgcttccttgaataacttatagagaatattggtatttgacataggggaaccatcatacgtcagcactttaagcatagccattgaaagttatgagagctttagacaatcattgtgaggggaaaaaatgtgaagatgacattgaacgcaacttgataaacattcccaacgtaactatgaatagaagagtttcctaaagcaacactgtttcctggaggagcgtggatggtggacagttaaaaataacaattcactacaagtgtttatacccttggttacagtgaatactaaattaatgtgaattaacagctcagcacaaagcctaaatgtagccagtgtttattaagtggtaaatgttattagtaggcatgagtctagatagtctagatatccatttctttgcaggcatactaactgctctttcttctaagtaattaaaagtaattacagacaatggttgtgattataggaaaatacacagacatgcagcctaaggctaccacattttattaaaaggcagagatccaccaatttgttctacttatagcaattctattctgagtctgagtctatctgcaacatgaaacctgttttacaagccatggaaagcaatcaaagaagtgtgccttttctttcaaggttcaacatcagatcctgcatttgcttacatctgaaaaagaacacagactgaaaaagccaaaacaacaacaacaacaaaaaactgctaaaagaaagccctgggttttctgaaagtatctttgaatccaattgccattaatttaggatatgatcttaagccgctcatatcatccaaaagccttggtttgtaatgtttggattttctagatgttagggacaaaagtagtttcaaaaaagtctaagtgtagcattcctaattctaagcctttttgcaaattaaggcctctggcagaggaagtctttccatactacacagtgttctgtggcaggtgtggccaatgttgcatgccaggttcttgaggaaaacattggttaccaaaacaggcaaagagggactgagatgtttgtaactgctttgggagtttcagttggctgtacctctaagtggtaacgatgaggtctgaaagacacaaaggaaggaactgaattcatataagacccacacagattgtctagattcacagccactgagaacagatcacctttgaatgattgtttaagctctttatgagtacatttttctttatcactcctcatggcaggtgcaaccagaaatagtatgtgtaccataaaatggaagtaatgaattgtcagcaacaaagaacacttctaatgtggggtaaatcgtaacaaatagagcacataggcagataccaaatttatttaaattaggagtggctatcaggcttggaattactttgattgagaggctgatgttgattaattgtgaagttaaactatgatgttgattaatagtgaagtaactaagtgacgtgtgtgcacgcacacacacacatcccaggtcactttctgaatctacgtagaggagttgggattcacagttgtgctatgtctagggccaggcccattcttacgacacactgctggatcatttccccttcaaactcctttgagtctgggcaccattgctaggagctactggtaaaatgtggttctgttgcctgggaagaacactgtattcacatgtactcatatagaagatcaacagaaaacaaatctttgggcaaagtggagcgcagagagggttaaaggtggaaaaagggggtcagaaggtgaaagatgatgtgtggggtctgcaatggggattaggggcccattcatgggatggaattggaggtagagaaggggtgggagagtggggctggggatggtgtcacctaaaccacaggggagagaaacttagtagtatgagaggaagccaaggaagctgagaggaagacagtatcttttcaacctcagagtctactcctttttctgaaaaaaaaaaaaaaaattacatttcttcttttggcccatgcaaatgaagaagtctcctctgagttaaagattcaactaatattatgttaatgtatgttttggtttctactgaagttatgcattgttttttaaacatttgttcaatggcctttaaactttattgccaggctttcagttcttgaaaggagctcattagattttcattaactcaccagctttcactcaatactagggaccaaagtcctaccgggccattctgcaaggcccttacagtcaaatcattaataatttccagttgaacacacttcagcagtgtattctcagcctctttattaccaccatcctaaggagttttttcagataagttttccccctaattgcccttttcccacaacatttcaattccaaagatatactacatattcatttatgtaactgtggccttttggagggtcacaaaccattgtaatatttaagattgtccctcagcccaaaccaaactttcctgcctttggtgggagacattgcccctataaagaatgcatgcttaaaaactactaaacaatgattgtggtccttccaaaatagtgttttcctcttataattgccgtatttatttcaacagttaactcttttcccacttaccagctcctttccctaagtaactagaagtagagctattatagggccccctctcagcaggaaacaccaagggaatatgcttaccatgtctctaacacaaataacagccccccaggatgtaactaccagtttcagttgctggaactgaaatgaacaattcagtagtgtgtgttttttttaagtatgtttaaaaattcttttttcggtgtggagaaggagagcatcaggataaacagctgatacacgcggggcttaatacctaggtgatgggctgataggcgcagcaaaccaccatcgcacccatttacctatgtaacaaacctgcacgttttgcacatgtatcctggaactttaataaaattaaaaaaataaaaattctttttttctgctagccttgaggagcaaggtttgaattatacccctttcagatgtagaataaagatcaatattgttgtgtagggcacttctctgccattgttaattaaatcaatgaattatctaatgtggtttttccagttctttgctgtgtccagtaattccatacctaggatgtctatttaaaaaaaggatgttttctggaactcctaagtagaaaggctgtcatatatattcatttattagggttgtcataacaaaatatcccagaccaggtggcttagacaatagaaatttatttcctcgaaattctggaggctagaagcctgaaatcaaggtgtcagcagaattagtgtcttctgagaactctccccttggcttgcagatgactatctgccagcgtctttatatggccttcctcccactgggtatgtctgcgtcctactgtcctctttttagagggacacaagtcatattggattagggctcatcctaatgcttcattttaacttcattacctctttaaggctttgtatcaaatacagtcacattctgaggggctggggagtaggacttcaacatatgaattttgaggggacataattctgtccataatgtaagaccaggtataaagaagcctattgcaagccacaaacacagaatttgactaagatgtatttattcaaattcccactatgtgttttactagctgtatgtctttcagcagctcacttaacctaactgcaattctaattagtcatgtaatagtcatccctgtcccaaaagacggttgtgagaatcacgtctaattaataactgtaactaaaaagtgtgtgtgtatatatatatatgtatatatatatatgtgtgtgtatatatatatgtatatatatatacatatatatgtatgtatgtatgtgtatatatatatgtatgtatgtatgtatatgtatgtctaggacagcatctggcttgtagtaattgctcaatagaaggggagtggtttattacctcttcctcttgaatttggatccagactttagtacatttgggaattggaagatcaacaagtcagtaaatattggtcacatgaagaaggggaaataaatgagcattattgaactataatatattgagtcttcttatgcacatagtaggccaaaagttttgttttttgcataagatctgtagattcattcattcaatatttattgtgcatgcaatatgtaccaaatacagaaagcagtcatctcacctactgtatggagggctcttctcacagctgatactcagtctcctatatttcttgtaatagattccctgggactggggagtttctgcgagactcagaatttaaaaggtgcctcaagtcgaactactattattgcagtcagaactgtttttgctctcttcaggaacagccttacctgtgttcagggactattgtgtggtatcatgctactggtctacattaccaattcagctattgcagcaattacatgaaggaattcttgctaatgataaaagccattatgcagttcctaaagagaatgcattccacagcattcattaattatgccagcctgtagatgcacaactaccacggcatacacttgagaccacacaccataaggattgaaactctctcaaagccacaatgtatgtctgtgttgctttgcactcttacattgcccatcctttacaacagcccttctcctgtccttctgattcctaaaactcaaaaccagaatgaagtaaggctacaaaatgtcatttatggggatgggtgaggcttaagtctcctggaaccatcttgggtcactcagctctacggaagacccccctaagacggtctagacccagagtcattctcagtcacacagtagttaagaattcttcatcctacggtatgccctctctagaaaaataatcgtaatgatgggagatgggacacagtgataaatctttgatgtctttgttcattagtttccttatctctctctcttctctctcttcccctaccccattattttctctttgacataaacagccaacatcagatgatcttgtttcatctgctgaatgttcaagtgatgatgaagactttgttgaatgtgagccgagtacaggtaggtcaggtcagtcttattttgcttgctttcttttttcttttgcaaaaaacaatacatacatatatgtgattatacatgtgttttatatatagattatagtgtgttaatgtgtgtatatttttatatctatatatgtataagtatacatatataaatattatatcaatgaaagcatcaaatcccatggaaagagcaataagatcctacaaaaattaagtcagtctcttgatagctaacaaaaaatcatggtatatgacttaacattgggcaagcagatgcccagacttaccactggagcagcaaatgtgtaggagccagtggcagctatgaaattcacagagggtgggaacatgaggaaatatatgttggaatgacatcaagaaaggatgaacccatggaggagcttaaagattggtaagtggagccataaagattggtaaatgacttaaaactcatgaattattctgagctaagagaaccaaaaatatatgtatatatatattttccatgggatttcaacagcagttaacatggtattatctttgtactaattttgttaactgtgtgtctagaaaacttgtgcaacaatatagtaaacacaaaattagtgctgtaccatgccgtgtcaacagctgtgatgcttcaaaatgtatctactgtgctgaagttgagaagactttagcaatcagaagcttcaatgtgttccccatttggacccagatacattttgatgttttatggtctttctttatagtgagctacatatgacctaatgtccagcaggcaattgcagtccctgattatttcctatcaacttttcccagttgtctgttttgagacttactataagttaaacgtttatatgtatataatagagaacagatatcatcgaatttctgtgtatgtttaatagaattaatagctggagttgggccaggatcttatttctgtgaagactaaaataaatagaattttctagttattttttgcattgctttcagatttttttccttttaagaaaaggaaagccattaaaaattctcttttgctaattctagaaaatttaagcttcatgaaaaaataatctaataaaaataaaaaccttccatttctgacccctaaatgatttacaagatttcaaatctgttgaagcctgactgctttggtttcttgcaagtggaattggatccaggaagttctgtgggttcatacccttagtatgacacagggacacatcattaatatgatagggcttccattctggagtgtaatctgttccattgggagctcagctgtgtggagggaaagtaaatgtgatctggtcagggctttctttttcatatttttaggtaataatctgtatgtgctatgtgaggttttaaccctaaaagggcagatacatccgaactataccagaacttgggtgccatgttttcattaatttattcattcattcattcaataaatatttttgagcactcaggcaggatacaatatatctctagatttgagtccttcctattctgttttttttttttaagaaattagctgtcagagaatagaatagttttgctatctaactcctcgcgtaattcaattcaacagatatttttgagagtcaactgtatatgttaagcatgtgctagatattaagggttcatatattaataggtcacaatcctcaatacgtacattaaattagcttgttttgtggcaaaccctttaagaaatctaggctttaattttatatatatatatatatatatatatttttttttttttttttttttttttttttttttgagatagggtctcactctgtcacctaggctggagtgcagtggcgtgtttatagctcgctgcagccttaaactcccgggctcaagtggtcctcctgcctgagcttcccaagtagctagaactacatgcaccactatgccagctaatttgttttattttgtgtacaaatgcggttctcaccatgttgctcaggctggtctcgagttccaggcctcaagaaatcctctcgctttgacctcccaaatgtttttcttcctttcttagcagtgatatctctatatgcagcaatgtttatcaaatctgtagattttaaggcttatcaaaattgaggcttggtcattctgaaatattatcaccatctttcctcaactactcaccctgcctcagaaagtcatctccacagcaacattcataataaggcagtgggcttttccagatctcagcttcagattctctagctctgtagctccccagtttatgggtatatattgctatttgttatgagacttgaatagcgtaaacctgaatggccccaaactaaatccatttgttttctagaggccacgcaggtattttctctgattcagaagcagaggacagaaattcaacaccaacatttcttgaataacatggggtgggtggggagatacagtttttagaacaatctgttgtgttctgtaagggagcatgagaggagataaagtgagtgacagaacccctacctttaaagagtgaacatgtagctctaggaggctgatattgatttcctccacctgtgattattcaactcatcacatttgaagaatgagcattgcatttttctaattttatttactccataaagtattcctggtgagtgatttggatatacagggaaatacgtcagtggtatatttaatacaagaagtaggtagatattcctagtaatgcagagagagaagaggtttgcccagaggacctgatttccactaatggggattacctgcttagagctatcaagccctctttttcattacataagaaatatctcctcagaagttcaagaccagcctggccaagagggtgaaaccccgtctctactaataatacaaaaaattagccaggcgtggtggcaggcgcctgtagtcccagctactcgggaggctgaggtagagaagtgcttgaacccgggaggcagaggttgcagggagccaagatcatgccactgctctccagcttgggcaacagagtgagactctctctcaattaaaaaaaaaaaaaaaatatatatatatatatatatgtatgtatgtatgtatgtatctcaggcttcacattttccaaaaacaatacagattaaaatcagaaatcagtttcttgggcaagatttgcactgcctaaagagaagggacctactgcccatgcagcaacagataatggtgacatttacacatctttgacataaattgccaatcttgcaattctacattaccactaagattaaaattctggttttgaacaccctaattcactgcctccatttctaaaacatttttccaggccttttgcttgatggaaatacactaaatttggctaacttccttggccttgttctatcatacttactactttatcttctttcactttgccagcgagtttattattttctagctgtctccgtttatgaggcatttaacttctacaggttatttcctgattaatttacatccatttgaagctctcacttttcataaatttgggtagtttagtgtgtgctataattcaatttttattttcatatgagcatcaaattttaaatgaaataatttattttttcttcaaatcacattggatttttaaactgctggttttgagttagttataagcaatcgcctttcactctcagaacttacttttgtgcttaagggtcaccacggtttggtatagcttaatcttattatatttaggaacaaggtaaatatttttggagtttggtcaataggagtctagaaaccttgcaaatccaatggaagtcaagttttcacggtatatttttgctggtaaatatgtagagaaatttaaagaaatcccaaatcatgagagcaaggcataaagtaaaagctcaattaggatttgtcgactaaattagtttgaaacagaactttatatctctaacttcatttcccctttaacagctaaaattaaacctattgactcatttaaaatttatgatttcatataatagggctgccctgacaaaatctatatttttaacaaatttgttttagaatttttatttctttattttgagactgggtaacaagactggctaacttttgtatttttggtagagacagggtttcgccatgttggccaggctggtctcaaactcctgggctcaagtgatccatccacttcagtctcccaaagtgctgggattacaagcataagccactgtgcctggccaaaacctacatttttttttaacaaagttattctctgctttttcctatccctacctttttctgggaactagattattttataagtcacagatacaatcacattttctgaatatttgcttcaagaacccagaattgaacctttaaacaataaagttataataaaaccatctgcatcaaatgaagatattcagaagtgtatctgaatagctatctagaggcgagggtctggattttaactcgatttgtaaatgttaattgtgttcttcacaaaacaaatcagtatctaatactttagattcgttctttgcatataaactgtttcattcccaactgcacttctattaatcttaaattgtgcagtaaattcatatttcattgtcctttttctctttgaatccaagaagaaaaacggatgagctggagagcattcaaataacccctaggaaaaggataccctcatgagattatggaagccaaatagcaattaagatcattagtaaattcacatttgtaatctaaaatgtgggaatgaattctgaaattcagagaaaataatacaattcacttcccatttcttctctttcccttacccctgctgctatccctagaattcccatctttggaaatagagtaatagtgaaaacaaatgtattcttggatgagcttttgtataattagatatgatcaacttcctggattttacatttttatagtttcaagattctaaaagtcttgggggcaggaggccacagagcagagcgaaaaaaaaaagtaatacttttatacctaataagtgggcatggcaatacttaaccacattgattcatccagtcgttatccaggggtatatttttcagtttgtcaagtagctagtttttctgccttcacttttcttaaatgtcctttgatcaaatctcaagggacagcacttccaccagagggcagacagtaaaaggaagtgaagatgaaacacatccatccatcaataagactgtgctaagcagctttcataatggttgggaaggagatgtttaaactaatggcagtaatatgagatgacaaaataattgctattcccagagtggttctcaggtatatttttactcctcaaatctacaatattcacatttgcatttcggtgttactgctacttagttcctctttgttagccctactataatatacaacccaagctgagtgaaatttaaatttggcataacaccaagatcacatctagtattttccaggtggaactggattcttaatctttatcagtctgagatgcctcgggaaagtatcatctgaaaatctggcactgagttactaaaagctcaccaaatcattttactttttatttgctggaacatggtagaaaatgcagctgaaatgttaatagataataataattttccagtgaaggatcaagagaagtttataccagaatttatagataacaagtaaatgtgctgattgttggccttaaatatgatgtttgaaatcttatagagatacgttttgtcatttgtgtctttgtcaagtttgaagttagcaacctgtatgtttttattacaaataagtcaattttatttaactatttattcactttagatttttctatatgaaaactcattagcaaatagaatcatgttaaaatttcattagtcaatggctattcagaatatagtacaaaaataaatgtccaagtaaaatctcataggaatgttggagtatgacagatctataaattcaatggtctgtaaatgctataaattctgataaaaggctcagatccacttaaacactttgaccaaagagataatggaaataatctaagataagcattttagctttggaaagagaactgtatatcgatagaaaattacttaatttaattcattattattggctgtggacatcagtcattttaaaatttgagttacaatacatgtctaatgctcacaaaagcaaatagttgttcacatacttaggtctaggctaaatcatatccatttttcaaccgccttcattgatctataaatgaatatagtatgttcatgggagtataatgttccagattaatgatacagtttttgtctttgttaacccaccaagttatttcactttcttttcttttttcttttttcttttttttttttttttttgagatggagtgtcactctgtcgcccaggctggagtgcaatggcatgatctcggctcactgcaagctccgcctcgtgggttcacgccattgtcctgcctcagtctcctgagtagctgggactacagacgcccgccaccacgcccggctaatttttttctatttttagtagagacgggttttcaccatgttagccaggatggtctcaatctcctgacctcgtgatccacccacctcagcctcccacagtgctgggattacagccgtgagccaccgcgcccggccagttatgtcacttttttataacagccccaacccaacccaagttattttttaaaccattgcagtaactatgtgcttttaaaatccttaatggtgaaatgctttgaaaattagggtaagaacagaaatataagaataggaaagatctactaattagctcttgcactttaggctgaggaatagtgtgcataatatatgtggcccatagatcgactattgtggatttcataacaaatatatttaataataaaaaaatgaaaaaaattctatccaactccattacccaagattttttagtaggttggagagcgaggcaggggaatccataaaatcaatgtatgagtgtatatacttctatctgaaagtttgataaatctcttctatatgtaacacttttgagtaactattacatgtaggcactagaataggtgctgggaaaacaaaagtattttgcttcagaaatatcgcttccagaagttcagtttattaggaaaggcagatataataagaggaataaaaggaagggaagaaacaatgaggacaatgaatggaaatgcccacgatattatcagcaccctaaggatgttggagcactccaattcagtgaacagcataccttatcagggatatgcaagaaaaaaaaaatcacacaagatgatgccaagcagtgacagattcaactaaccccaaggagcattcttctgtattttagtttggtgacacagaattctcatttattacgattgaagaattagtacagttcagtaaagtaaaaaagcaacactcttttggaattagtacagctcagtaaagaaaaaaagcaacactcttttggggacttcacatatacagtatggtcaaaggccacaccgtttttaggtaatagggtaaaggatggacatgttgaagggagaatttcaatctgaactcatgagaacttcctgattccaaatgccaatgcaagtggtacataaggagtgagcttaatgacatcattaagcaagtcccccaaaaataaataaagagggattgggttttaaaagagaagtttttatgggatttattctttttattctacatttttcttccataagccccaagtatatgtactgtgtgtatatatatatatatgatatgcacatatgcaaataatatactgcctgtcactccatatatatgtagacacagtataagtgatattagactaatgtaaccagagattaacagcccctaccatcagtcatgtgtttacacagaaattcacaccatcattcttaaccagcatcagccaacatagacatgcatgatactgttttaacttggcaaacaaagcatgttgatttttctttaagatttctttatcataattataatgctgactccataattcagttatccttgggaggggtggaaagaaaaaattatacagatatatctatccgtatatgcacattcctgtgtatatatataaatagatatataccttgtatatatttgaagaacattttgttgtttcacctcatcttgtgccgcatgaatttttggtggttcaatttattttgttttcatatttactattttgatcattatggctatttttaactcattgctatacttttatgagtaactataatcattattttcaaatactgagagatatatagatatacaaatcaaacaaggcaaaaaaatcttttcttgccatcctaatctcaaattcctcccctttcagcatatccctccagtatttatctcaaaacaaaacaaaccccaacgaaatccaagaaagttgtgtacaaaagaatgaatactgtgttttcctcttcctccttctatgcatatttttccttttaatttccgtttctttccttttgatttacccccatatctgcatggaccacttgcctttactttcccctttatgacaatgtaattaattgaaaagataagagtcagaaaaaaataaaagaaaaacacatagaaatgacagagaaacacacccctctccacaaatttcagatggcataaaaagaattttattgcagatatagaatatttgttgtatcttttatttctgtctggacaagcccaggatcattgtgtggcatgccgtgacaagttttgtagcgcatcaactaaccatggcctccatcacaagtgcatgacaccatcttgtgtttcatccaagtgacacatctaggctaacccagcaagtccagtgtatgagttgtgggaattacattcttttgtagttataatttcatgggtccttgtttttattattatttccattggatcatgacagccctaagagctgctctcgcagcatctctgtatggttttgttcttgtgttttcttttcttggcacagcagtcaagcatgtgtctcttgtttggcacatctgtcttgccatcttgtcttgtccactgtcgtggtgttgttctgtgattctgttctctgtaagatgtgatttgaaatcctctgcctttatttctcactctcctattgtctctacttttaaccttacccctagggaacttcacaaagaagcaaaacaaactttcagtcacattataaggctgatcactggtttgcatctggaagtcataagttgtactttttacctgacttaaggaggaaaaacttacagtgggaaactactgataattatactcaaacagcaaactgatcaacgacaataagaaacccttgttgattatttttggtatgattaaatgggcttactgttaaagggacttcatgtaagatcttatttccaaagagtttttttcataaattatcagtcttctagtcagaaacttttcttcaggagcagatcaacggaagatgtttttcgggaattgttagtgagggagcatcatttctgctgtgtagaacagtgcctgttcctgaattggggaggaactttatggaaatctgcaaatgttttattacaaaatgcatttatgtttatgtattaaaatataaatgtgttcagcaaggcatctgaggatgggaaaaaaaaactttttaactcactggttccacctcatgcatattttgaggtaagattatcttttgatctttctgagtcaactgatatacattttacttttttattttttaattcatggaagcattagagagccaacacttcaactttgacctaaattcattcttttcccattccagagaacacgacatacataatagctttagttctgagaatagagtctgaatttgagacaaacgtagaaggaagtgcccagttaattatccaaatgttggactctacctgtgattatccaggcgatttgatgctttacttggaaggatttgattagttggatacgaacagcatgaaaatgacactttgtaacaactttccctctttaagggttgagcacgagaatatcaaataggtataaaaatgagtaataggtgatatattaatagattaaagattattcaataggcctaaagatttcagatgaaaaatctgtatttgtaatctgaaaaagagaaagcatatccagacctgtggttttctgatgagatctttcagtcaggccagggtagctattggtttttcttaagggtaaggggaaaaaggccaaggatgaggaactggatggctctgtggactaagaacaactttctgatgaaagaaggaagggaaacaagaaaggcgaagaaagaggaggagggaaatgtaaaagaaaggaaggaggaaaggaagagatattgattatgagccaggtaaagctgcttgctgataaatattttaaaaccagcacacacacagagctctaatttgcagttttccagtttctgtatggtgtaaaatattcccaccatggctgatttctagctaccaatatgacagccctaaactcagaattgggaagtgtccttgctcgtacacaattatatggctttttcatcatacgtacactatagacgtcaagaacctcatagataatagtaaaatttagtaaaataattaggaagtaccgagttttaagtttttaattacctgtttttaatatacttgtaactttatatatatattaacttttgaaaatggccatgttttaacaaccagcttacaaatttcctagaaattttgcaatcagttgtcataaactggctcaagcacaccactagcccaggtactatactgggtacatgaaaacatagtattttatttaaatctcattttaagttattgtgagataaaaactagcttggtcatcttacagttgagaaaattgggattttaagtttgcttgttcaaggtcacatacctgcacataaatggtagaggtaatattcaagtccaaatctgtttgaaaatagacattttctttatattacagtgtgccagtcattctttcaacacttctcaaagtactaagttatcgaattttgacacgctcctttgtggagcttagcatgactcgggtttccctattgcctcaaggaggtccttggctttaactgtcttagataaaatggagtttaaatgtattatggttgtgtcaatggcaaaatgaagacagtgaagcaaaattagaactcctgattactctgtttgtaaatgccaccaaagttatgaccatgtcttcatgagaatgtccactttgactaattttgtttcctccaaatattcctcttttactaacattgacaatgaacaggatatttcttaggttttcatattctgtcccttgagctttggaaagactatcccagatacattttctgagcacatagaatctatagcatgatcccattacatagttaggttttataacttttaaactctaatgaattttatttagttacagtatgtaatgcatgttaattaaccaactgcacagtgaaatatgtcaatgtcctttgcttccacattttctaatagagtaagctagtatattaacatttaaaacagcatgagaaccatagtactgcagaaagcaactgcagtttttaaaaagatgattttattgtaagatacttaatcattgctctgtaaaagagtttgagaggcctgggaattaaaaaggaaagtgttgcagctttttagtccttctaatttgacaagatagataatttgattgggtttctgatagtgcagtattttgctttaatttggtgtgaagtttagttgcccccataattattattatttttttttggtcactctgtcacccatgctggaatttagtggcatgatctcagctcactacaacctccacctcccggattcaagcaattctcctgcctcagcctcctgagtatctgggactacaggcgtgtgccaccatacccagctaatttttgtatttttagtagagacggggttttaccatgttggccaggctggtcttgaactcctggcctcaagtgatctgcctgccttggcctcccgaagttctgggattacaggtatgagccaccgttccgggcctccctatatagtaaactttcgatggcagcatacacaacattgaataaagtcctttgaagtgacttctaggctttctcctataggtttgccactgctacaactttgtttcatcattcagtgaatattagcacttcctttagtgaaatatagtcttaagtacttcacattgttaactactttaatcctcacagcaatcatgtgagagtctattcttattatctccattttaaagataagtaaatggaggcacagaggagctaagcaaattatcaaggtcacacagcaaggaagtagaagaaatgggatctgaacccaagccaactgcccccagcgtggacacccatcactatgctatcctgtctcttacgtagcgcttattttccattaacctaaatatacgaaatagctgccggcctccttgataataaaagaaagtctgtgtattgaatgtattacatggttgggaagtagttgataaatgggttagttattatgtatcaaaaaggctttaacaatcttggttgatgggggttataaaattgttccattatgatttattcaaataaccgtggttaaaacaagttaccctggtttcccataaggaggaatgactccaatattggagagaaataccaacacttatgtgaggtgagtctcccttgatgtcacctatgcaataatatgtgcacttgggtttttttttttttttttttttttttttgagacggagtctcgctgtcacccaggctggagtgcagtggcgcgatctcggctcactgcaagctccgcctcccgggttcacgccattctcctgcctcagcctcccgagtagctgggactacaggtgcccgccaccacgcctggctaattttttgtgtttttagtagagacggggtttcaccgtggtagccaggatggtcatgatctcctgacctcgtgatccgcccgcctcggcctcccaaagtgctgggattacaggcgtgagccaccgcgcccggccgcacttggggtttctagctcattattcatgatcaattctgttcaaaacatatgcccagacaacagccacctttaactgatgttaggaatctaaggatagaggctcttagcgagagcttgggttaagatactgcattttctttatttcagaaataaatatgttccttagaacacagtgatttaggtgttacagctaaaagaaagcaaaaaacaacaacaacaacaaaacgaacttgtatttcttatcttagaccctttctgacacccacatgctcttgacatctcttaaagttgtaactatttgtttatcctccctttttcctcacttccttgcattatgcatccaaaactattttaaaagccaaaacacacacacactttttgtgggtctttgagtttcctatgcaagaaaagaatcttaaaatgagttataaagaactaaaaatcacaattaaaaaggaaacataattttaaaactgtgtttgcttgtattataatccttattccaaggcaagtatggcctgcacaaacatctgaggattccattacaaattatatcagtctcaacccatcccgaatccagatcataaactcataaactggaaaatgtgtatagttgaaaatgtttgcataccctctgtcctagagcagtgcttccatcttagctttgaagcacagagacctcctcttactaaaagatcatgaaaactggcaatactgtattgcccagtgttaaaatttgtcagattaattacccagagccaaagttagcaaactttttttctgtaagggctggggtgtaagtattttacactttgagcgtcttacagtccctgccctatctcctcaatcagctcttataatgacacatagcagccatggaaacaaataaatgagcagggctgtgttttcatgaaagttgatttccaaaagcagagatggagctggatttggctcagaggtcatagtttaccccaatctagagaagtcccataggttaaaaatgtgtagtctttttttttgtttttaatagataagaccttcttgcccattttatagtcgttcccaacatttgttgagttctccactaagtacatgagaccacataggatacaacaggacattaaaagcttttttttttttttttttttgagacggagtctttttctgtcacccaagctggagggcagtggcacaatctcggctcactacaacctccgcctcccaggttcaggcaattctcctgcctcaaccgcctgagtagctgggactaaaggcgtgagccaccacgcccagctaatttttgtgtttttagtagagacggggtttcaccatgttggccagactggtctcgaactcctgacctcgtgatttgcccccctcggcctcccaaagtgctgggattacaggcatcagccaccgcacccggccctaaaagttcatctttaaggacatttcccacctttgttttagatatgccactatctcagacatgaaacacaataacaaactaaaccagggtcatctccacccagcttgtacactacatatttgggtaggagcttaacgtcttgcccttcgctttgccagtgtgtcttctgagctccccacctctgctaggtgtgggctgcattcacccccaattttagacctctttggcagtagcttccttgatctcccgcccacatactgtgtcatatcccagtaattcttccccaaaccttggctatgggttattgagctgacaaatgtctaaatgactgagatacgatttcacaacctgctgagagcctcttctttccctgtactctttgatttgtagctttgtaagttttgtgaggaaagtgggaaaaacattcttggtgacacaggcagtgaatgaggaggacacaatggagtgggcaccatatctaggactcctgcctgcattgcgagcaaaagcatgtatttatatcttagccctctgaatgttagaggtagcagattatacagtatggtgcaggaaggagcatcctatgtcctgaggtgaataacgtgttctaccacctggcagcagattagaccagatcaggctatgagaatacaggttcacagccagatttagtactaccagccagatttagtactactgcaaaaatggcttttccttaagaagtttttgtttctaacttttattttaggtttatgggtacatgtgaaggtttgttacctatgtaaacatatcatgcggttttgttgtacatatcatttgatcatctaggtattaagcccagtatcaaaaaattatcttttctgctccctccatcctctcaccctccctgctcaagtagactccattgtctgtcgtttccttgtgttcctaagtcatcatttagctccaacttgttgagaacatgcagtataagttaatgcttactctctttaacatctttcacattagaaatctatggagaagaaatatgaaagactcatatataaacatggggcaaaccatgaagctaaatcttaatgtatcccaaaccccagagggagcataaggttaactttgggtggccagggtgcttagtgataacattatgagctttctacattagcagggccccctggtgtggttttgtgcctggagatgtaaggttctgaactacaaaggaagcaaacaaaatgaagagatgatgcaaggaggcaaaaaagatggaggcattaggaaaggctttgagggcaggaggcacggggtcatcttctaaaataacctattggaatgcatgttttaataagctttgaagatcaaagagattaacaagaacaagaggaaaacaagggtaaattaggcactattgatggcctgacaaggacttttttctccctttctgcttacaataacctctcattttaccatgtggctagttggtttgtttacttgtttgtttacacttactcattactagctttccctataaagcaagggaaaacactctgtccccaggggccagctgcataacatgaatagatgaaatagaccagaccagatgcaatctgcagtcatgggaactctgaactgaagagaacatgccctcatttaaaggcatccaaatgaaacattttaaaaacactaaaataaagagaccccatgaaggtcaaacaaggcataatgagacacacagtgttttttattcttttgtttcttaaattcctttaaatatagccctttcataaatttggcaggatgtgctctcagtaaaatttctggtttagtaaactcttggtgacattatcaaattaaacagcaatcccttccaaattcccctaaagctaagacctttttttttttttttttgcatgtctttttttctctgataatcccagagtttatataacctcaaactataagcttgatgaattttagagttcattgtaatgcttttggtttaggtgacaaaactgatgcctacaaagataaactgatttgctgaaggtcatggacctagtctttattggagttgtaattcaatcccaggtgtcctaaatctttaatccatgccattttattgatattatatattaagattttttttattgtatatccaaagatttctattttaaactgagataacatccaacagagaattcagaagtagtatgaaattgattatcttccctctactggacattgttgccatacaagacgatatcattgacccacttagggctcaaatatacaactctgtattattttagtcacaaagggaactaagagattatagacaagttgtgaagcagttagtggggactggaagtctcctgtggcacagactcaaatatatgctctagtgatgtgttctcagtcatgttatctgcccacacagaggacagattaagcaacctagagtactggttcccaagctcgaatttaaaactagtaccagtctatgccaaagctttcagtgacccatagtgaaatgagaaaagcaaggacaatatggtgagtctgcacaaagtcaaacttacagaactgccctatatttggatactgtatcatgtttttttggatggctaaaatcaatgtcttttacaaaagcagcattttgttactatgtatagcattcttaatcagcaaaataaaggttggcaatggtatgtcagtccttccctacagtttttctttgaagtttttttctcaggcattgaaaacaaacatccgaaaaagcaaaaaaacaagagttttaaagttttaaagtgttctctatgttgccacattagattgagtagatttcaaagactgaaggcctttttacatgtaaagttttattgtgaactaataatgatgatgttaagacccatctattttattgaggtcccaggaagttactagtttaagcatccgtcacttagataacaagcattaaggtaatttttaatttcagttaaaaaaatagattaaaggcacaaaatagatttccaaacaaacaaacaaacaaacaaacaaaaaaaccaaaaaagccaccctaggataaatataactagaaggccaagatcagtttagaagtctacttaaagaaagacagaaacttctaaggactgtgtggaaagataattcatgcctataaaaaagtctctgtgctaactctagatttttttcactgtaagccttgtaacaaaggagagagagctattttggaaagctgaattagcctacatttgagctaacatgatccatctttgtgtcaagagaaagtcaaatattatagtccccagccaaaataaggcatgtgatctacatcaaaggcaattcctgaatgtgtatctacgtcctcatcccctctcctcttttttgtctcttgggtaatctataccaataacctcctgattcatgaaatttattatctaaatattgaaaatattacactaaatttagcctaataaaaattcatgccaaatttactgagtatttattggaaatcagagacttaaggtcctgaatcaggtgtaagaattgtattatcaataacagacttaacagtgattatctctaggtggtgaccgatattttgataatcatactccaaaacatctatgtagaaattgggcatggtggcgcatgcctatagttccagctacttgggatgctgaggtgggaggattgcttgagcctgggaggtcaagggtgcagtgagccatgatcacaccactgcactccagcctgggcaacagagcaagaccctgtctcaaaaaatgaaacagaacaacaacaaaaatcgatgcagagcatgtattacatttgtaatcagagagaagggatatctgttatttcttaaaatatagaagagtatactaggagaccagcaagggaaatgttttaatatttagatacggaagcttcgccagacccgtaattttttaaaaatagtgaatcctttttcctgggttgaattatgatgtatggccctgcaaggaaagctgctggaggaattcaaagatgatgatgatgatgatatgcagggctctatatagcttaacacattagttccataaggtcagttctgttcatcaagtgacaaattgtccatggatacaccaggtggtaatgcagcagcagtgggcacaagctatcctgtaaatgacccattaccagaaagtttaaaatttctgcttggaacccaggaacacagatggaacacgaagtggctttcaccagagtcttgggaatatgcttgatcctttaaccccagcttcaggtgttgtgtacatacttaatgcctgaacagttctcatctgtacatctgctggttagatgaaaagatgcagttgcagacaagtaatttaaaactttacattcatgtctctctacctccctcttcctcttctgtctctccctcgataggatgtccagaaaattaaatcagctgcagattaattgagactctcttccatgtagggaacatctgtcactgcagctacaaagattatattaatgaattaaaacatttgattacctttaatccaagagaatgcagcagtctctttagtcatttagtttatcagggttttttgatggtttttttttccacgtgcatcttacgactatagtccacccctgaagctgtgagatctttcagcagatgttgttttccatatctttaccctttccgttgtggaagggggaaaaagccctcagaaaagcaattttggaggaggcagaaaaggtttccatcatgaacatacttttagaaacagctggtaaaacaaatggtccaagtgcaatgcctggagcatatctattcaaacaaggttgtttaaagataaaagcacccacttctaaatatcagcattagtagtgatttcctcacgtatatttaagagatggaagagcttgtgaagactttttgatttctattttgttttctgagacttctttaactcttttggttttgttagtatttgaatttatcagaagctgctcaaattgttaaaactgtatcatcatatgtaaaatatataaatttacatataacggatgcataaagatttgctttcttattctaagaatgttcttatttgataacatctatgcatagtccagaagattgacatgaaaaactgataatgtacttaggtattaccaatcctataacccaatttgtgaaaaggtcaggcactcctactaaagaacaaacgtttgtatttgtagcatttaaaaatctgattttattttgtatttgctacatttggagtcaaccttatcccttcccttctaatgacttcatttgtttaccaggctgttttgttctgcatcctctgccaaatgccattacgtaacttcctttgtcagaccaattggtgaaataattctttgtgtgcttttttttttttttttttttacggccgtccaattttcaaattatatgtggattttctgagtcaggcattgcacaaatgctgatttgttagcttgaactcgataaatgtgtgttcaccctatcagttgtcattcatgctgacttcttcctctactctcttcactctgattctgttttcatttaagaaaatttcagaagtagtgaagctaggagagttaatgagtagccacgttgaccctagtaggatcttacccattggagaaaagccctgttttaaaacgatgcacaaagaataagcttcaatgtcttcctctcctcaaccccagcatggagcacaatgcttatgtgatacacggaagtgagaaatttaagaagtgcttcactttaacttttctcaataagtaaataaaactgtcttttctagagtccaacacatcccaaagtgtgtgactttgctattttaccttaaactgactactctctgaatagattttcatgttatatagtctgagacttttctttccatcctgctggtgctggaagacatgatcataactactcacaacccagatcttaaaatatatatattgttacacttttatatacttgtattaaagcatcagttagtaagtttcatggttgtttcttctgatgtaaaagtaactgtagttatagatcctccagcacatgtcacactgaaaacctaatcacaaagtcaaaatatgtgcataaatattagcttgattatgtgtcacatgtaccccaaattacacatatatataccttcctcaaagattttttttttgtggggggacagtctcactctgtaatccaggctagagtgcagtggtgcgatctcggctcactgcaacctctgcctcctgggttcaagcaattttcctgcctcaggctcctgagtagctgagattacaggcacctgctaccatgcccagctagtttttatatttttagtagaggggtttcgccatagtggccaggctggtctcaaactcctggcctcaggtgatctgcctgccttgacctcccaaagtgctgagattacaggcatgagccgctgtgcccaacctgagattttttttttaaaccttggattttcaaataactttatagttggagaaaagttgcaagaatagtatatggaattcgttatgtccttactcaggttcaccagttgttaacatttgccacatttgctttaccattctctatatgtgtgagtgtacatgcacacatgagccatttgagagtatgcatacaaaacatatttatgtagatatgtatttcccctgaaccatttgaaactcagttgtagtcatcattccttttttaaataattcagtgtgtatttcctaacaaggactttctcttacaaaatcagagtacagtgatcaaaatcagtaaatgtaatcttgacacaaaatctcacctagagtacatattcacattgcaccagcgtctgcataatgggctttgggattatttttttcccagtctgtgatccaatccaagatcacacattgcatttagttgtcaagctcaccaacttttgaagcatcttcctgatacgttattttatttccccatttgtttactggtcacagaccagtaagagcaagtaaacttcttaaagtcctgccaggtgtgttggtgtagaagcgggaagatagagcctgtgcttcagcacaggaggaagatttcaatttttagaattaaaattatggcaaggaaggacctgtgtttcatctagtattcattccttagagagcacggatataatagtctgacaatgctttttattagtgttttcacttagctgcagattgagcatttactgtgtgctaagcactgaggatgcaagagtaagcaagaacagagatggcccttgtgggcctagtgggggacactgtcatgtaattaagtgacctccaaataaatgtgtgatgacaaacgttgatgaaggctatgaagcaaaggcacttggtgccatgagcataccatggtaggacaggtaacaaggcaggggtgggtgctaggaatgtagagaaggatgaggaaaccttctctgaaaaaaatgatatttgagcagaagagtgtgaaataagtgacagctaagaggaagaaaaaatgcattagagcttgcaaaaaattctgaacattagaaaaagtcagccatttctgggagagagttatctgggagcagcaactgtctcacaggattttgtccaaagtataaaataaggaagtgtgttaggctattcttgcattgctataaagaaatacccgagactgggtaatttataaagaaaagacgtttaattcgctcagagttctgcaggctatataagaagcatggtgctagcatctggggagcctcggggaaactacaatcatggcaaaaggtgaagggggaacaggtatgtcatatggccagagcaggaacaagcaggggtggagatgccacaaacttttttttttttttttttttgagatggattctcactcttgtcgcccaggctggagtgcaaagtcgtgatctcggctcactgcaacttccacctcctgggttccagcaattctcctgcctcagcctccccagtagctgggattacaggctcatgccaccacacccaggctaatttttctatttttagtagagacgaggtttcaccatgttggacaggctggtctcaaactcctgacctcaagtgatttgcccgccttggtcaattaaagtgttgggattacaggcgtgagccacagcacctggccgccacaaacttttatatgaccggatctcactgtcatgaggacagcaccaagccacaagagatccaccttcatgacccaaacacctcccaccaggccccacctccagctttggggattacagttcaacaagagattcaggcagagacaaatattccaaactatatcaggaattaagtaggctttgctgtccttttgcagctttgagtcaacccatatgagagtgaattctccgatcctgtactgctcctgggaggaaagggagtgggctttgtgaaaaatggagatttagtgagtaaagtgatgagttcactggaggaaggttggctagaaaaaaagtgacatggctgggcatggtggctcacgcctgtaatcccagcactttgggaggctgaggtgggcggatcacctgaggtcagaagttcaagactagcctggcaaacatggtgaaaccccatctctgctaaaaattcaaaaattagccaggcatggtggcaggcacctgtaatcccagctactcgggaggctgagccaggagaattgcttgaacccgggaggtggaggttacagtgagccgagatcacgctctgcactccagcctgggcaacagaggaagactccatctcaaaaaaaaaaaaaaaaaaaaaagtaaaattgtctttttttttttttttgcgtaccaaatcctatcaatgaaagagacaggaatagatttgactggaatagtcatgggagccatttccaggctctcatagtcttagagatgacacttggtagttcagtgtcttattgtgcttcttcaagcacatacagcctgattgagagagactcaagacagcatacaaattctaggcatttttacatctgcctagctgtagtgaattagtcatacaataattatttaaagaaagaaatgtttcctccatgttgtgctggagatacaatggtggagaggaagtggagatcaactattgatcgatttataatttacacaattccacactttggagaaaacacattccttcttcctcaccatcaccctcaccattataattattatcaattaacttgttcaatatgtaattttgaagttgccaatcatttaccagtgtgattcatcatgttaaaaggaaatggcttttacattattaatattctgcaataaaagtttgggtttgtgtgcttacagttagaataaaagaaaaatgctttgtactaagactatgttaataataatgataataataaagaaataacactttctccagaaaggaaatttcaggaaatctgtttcagaatacctgtctctaccacaagagctttctaagtcatgttttgattgctaacagcattccagtactgggttggaacatatgtattccttctatcaactgaggaacagcaggttttctgttattgcccatgcatggtcactctctgcttataaaaattcatcacttctgctgattgcattgtgtaggattcctactgattaccatttagatttgttaagtgacatagcacattttatggagtcaggagccagtaaccatcaaggtcaatagcagcaacctgaatcagttataaatgaattgtttaattacccacgcatgatcaatgtgtgcactgccataaaagattagttctagtccctgaatgtgtgtgtgtgcctgtgtgtagttctaagggattacagacttctctgaagtcttcttcattgaaagagattgcaagtgagtatcttttcagtggaatagaactgagttatggtaacaacatcatctatacatccagtctaccgtggccactgaatccaatgacttttttttttattaatatgaaggtgcctgcctatccaaagcactgcttactgtatttcattacaatgtattgcttcactcaacacactctgaatagagaagatatgctctacagcttcaaattcaggcacttcctccaagcagagcttgtttatctgtctgcaacacacttggagcatttgaaagactagtgatgaaatccattcatgctgtgaaaatgtgttgagcatcatggccgcttcctttacaatggcctggcatggaaggttggagaaggccattgttaccatataaatgactgtctatttgcctctggcatgacttgtccagacaagttgcatcattttaaaatgaatgaagttctagggagcatttttaactatagtaccttagttgtaactttgagagtttttaataagcttgcaaggaataaatttggaatctagagtagtttgttctatttctggaaaaaaaggaatgctttgtacatatgtaggatcctttacctggccacagagtttggtttgagaagtggacttgactctggatagtgaacaaaatgctttttcaatttttaaaatggaggcacctttttttctgagagcatagtcagtaactccccaaatgtgtgtctcttgtgtgatagaggaaccaagtaagagaatagcttggtgtgtgcctggttttcttccacaagtacccaattagtaaagggggcttttgctttttacaaagcatgaaaattaggggttgcctataggcctgagagccctgccagacagttgcctaatgccaccagccaggattatggaaaagaagccttggcatactattcaatggcaccgattcacccaaattgcaactgaggaaaacgtgttcatttttcaaatagagtttgagtaaccatagacacaggcaaagtaatctctccatttggtcacaatggactaaactaccttgttctattgtctaccttctctctcactgactccatcaaggcagacttgttcggtaaactattcaggtgactttgtgaacttttatttggtgcaaggctctgttaatagctgtaagtcagctgtttttggtcctccctctcattctcttcacactgattgatgaaatgggaaacaggttgaagaagctcacttttttagatgacaagtattaagttgacagataaacctttaggaggttccagttcatttcaggaacgtgttgacatgaggtctttaaagatcgacagtcctattagagatagagaccaccaggaaatcataaggaaaagaaaaatgaaggaaatatctagattcagtaggaaattgggggtgatgagagaattttaagaaaaacgcttgctttatcaccagctgtgtcattttgttcaaagggacaggaaacataatactctctctgaagcttaacagaactgcagacctattgccacagttttctcttttgcataatcttgtttagtcacttaagagctagtgagtgacagatttcacatgagaattggtcacgtacaagaatgttaatgcagaactaggtcagattatggcatttcacacatgcaagatgggaacacgcttcctctggttagacaaaggcttgacgattgcccatgcatctggtcctgctttaaaggaagctcatgtaatcatgagaactcacaatgtatccatagatttcttagatatcaagtttctatgagccttggcattgtgtatggttttattgttattttgccaaacgagggttttctagcttcacttagtatgcctggagaaagctattttggttcggcccagctccatcactctaagaaatgatgaggatgagcgctctcagtttgtaccgactactcatgagagactaagaactgatcatctggctgctggcaacattccactgcaacagctaatacagtgttttggaaagatgccgacaacaaccagattgcattaagcactttaccgtttaagatcagttttgcagttcagaacttgaagtcagcagcagatctaccttttagtttgcagtttactttgctccgagtttttcatgtcttctgtgagccccccacgtttatctcagggtggattctaacacacatatgcttatgtgaaaatttcataatactttagtatttaacaggcacttttatataagtcaattgatttcaggacaccccctcgccgccctgataccaaaatctgcagacgctcaaatctcttacataaaatggtgcagtgtgtacatataacttacacacatacttctatataatttaaataatttctagagtacttataatacccaatccaacatagttgttatactgtattgtttttgtgtttttaattgtaatattttcatttacctgcagttgttgaatgagtcgagggcaggtagatatggaaagctgactgttactacttcccttttacttatattacaatattatctatgttagtgatgttcatagttcaagagacacactaaaggaattacagtatggagtgtctcctaagttgcattgtggaactaaacactagagacaagagtcgagccctggctcaatagagccagtaataactcagtgtctttatgaccctgagccggtgccttaaattctctgcagcgtagtttctttaaacggtggttctaaactaaggggacttttgtccccaggggacatattgtcaattgtctggagatgtttttgattgccacaactgggaagatgctaacggcatctagtgggtagaggtcaggggtgttgccaaatagcctacagtgctcagacagcccccaccacagagaattatcccacccaaaatggcaatagtgtagaggttgaaaaatgtcactttaaaatgtaaataatgtctatcccattatcacaggattcctatggggctcaaccccacattttgtttaaaaaaagtaaaaaaaacataaattgcccttctatgtctgatgttactactatggggcattgcacatatggacaccaaacttttcccttaaaaaggaaaatggatttattcttttagattaaaagttataaataaagctatcagattaaaatatattaaatatatccactgaatcttggtttgtaattttatggttttaaatgaatgctctaaatataaagagaaacaatgaaaagttattaagtaggagaaacctactattcagtgactaatatagataaaggaaattggaatccatgcaactaatagacttttctattagggtacagccacagcacgtctttcctaatagaagcaagcctgaaatgataagttgtttggatcacattaattaacattcagctctattagatttgtacctgaggttgggttcattttactggtgctgatgaatatcaaactacacaatatctacgcacattatattagaataaaacatgttttacattgaaggcaaattttagattcgactcttaataatggtcttttatattaactcagataactagagatagtaaaagaatgaattaaaattccagtgagccaaactacaacattgataatagtaatgagaattaattctgtgttgattttatggtgcctttgcctcgtaggtatatataactctggagtttatgaggcatgtttatagatcttaacttcttaattttgtaatgctgtcctcttaaaatttttgcttgagacggacaaaacctcctgaatttcttcaatttacatgggcatttttactaggaaagagcatgcagccttcatcagattctcaatagggtttattaacaaaaaatgttgagaaatcaccttaaaaggcaggcagctcttaaatgcttgttctcactgaagtccttctaaaatgatattgcatggactctatcagtctcttagcagctcatctgtagaggtaccaactgatcaaaaattcaaagttcttaattgacatactcaggttttttaaaatttaaagatccagattggtagctcagccatatagctaaattgaataattatgcaaatgctgcacaatatttaattggaccttttggaatgaaaataacccaggtgtgcacaattctttgcaatctggagcaaccattctaatatatatctgcaagtgacaacatcttgtatgtaaacaggcagaggaaaagagttctggctgccctcccaggaaaatatacatgaaagaacgtttgtgttacagcatttgtgttacagcacatacatatttctgagttgtttgttattaaagtcccattgtatgaaaacaactatatagacagactggcaatccagagagttggtagttacataaacaggtcccacggctaccaataatattaacacggtattcttagcccttaagaaacaaaacacagaaatttctaatactgggagtttaaagtgccacaatggaaaagcaaactcaattacaaatgctggattccacctggagcctattcttttcattttcttacttctgtttctgccaccttcccttcttccgataacagattttcaagtactgctcttagaattgctaaatgtgttcagagaatgtgtgataagatctgattctcctggaaggccaggttattttaatctttccatttctcacaccaaccatttaactaggtattatttgtttctggacgtcacagctaaagacacaacattttacatgaaaatgtcagtgttgaaaatattatttatctatctatcaaaatgtagccacgcatctgttcttgtttgattctagtaaaccataaccctaaacatgacacaaaaggggctagtgaaatatttgccgagagcggtactctaagttaacagtaaataattgaaaataagtaagtcaaaaccaaaaccaggaaagtttgcattcattcccaatcatactttaacagaacttgcagctgccacagattcagacatcttcatcttcctgtggagcatttgtcttttcatagcagaggacaatctctgtgactttcttatatcactgagaccatcttgtacagtttatttcaaaagcaagagtgttctttttcgtttcatgccaccagtgacaatacgaaaccagatctaactgaaacttcactcaacacattcccgacccgccaccccaaccctaatagcctctcataaccaccgttctactctacttctgtgagttcaacttttgcagtctccaaaaagaagtcaggtcatgtgatatttgtctgtgcatggtccatttcacttagcataatagggggactaagttcaagagatctattgcacaacatggtgaccatagcaaataataacatcttgtattttgaaaatcactaagggagtagattttaagtgttcttagcagaaaagaaaatacaatgaggtaatgccggtataatttagcttgattcagccatttcacaacttgtatacatttcaaaacattatgttgcacatgataaatatgtacaatttttatttgccaatttgaaaaacagagaagtccctcttcagatcctgtcctatgcagctgtcactcacttggctttgtaagcctgcagacagtgtcatttaaaatattttcctctgtaccataacgcttttccttttaatgatatataagaataatatttctctctaaatagttatttctttaactttgaaataattcagcatctcatgattttgatttccatttctccatatatacattttttggggctctgttctgggatttagggctaacctttgtcatggagacatctgtttttggcagtctttgtttccagggagtgaaaatgtgtgtagaaagaattgaatagctacatcttaggtgacacaattgaggaactggatgaaagatatttgtggaaagcaacataattattcaaactggaatatggccattgccctgggtttcatatttatcttcataagcaaagtggtttgggattctgtgcaagtataaggatttaggatttaaacactaaaccacatccctgcacggagcacatgggctttgttgttgataatcatgatagtcgcacaggaaacttgacagtgacagcaggggaacagcacagtatcctacttggccactggtaggaggatgcaatttaaatcctggcatgcgtagaatagcctcacttatctgtggattgttattgtaatctacatagtaagtttcaatcagaactcagttttgtgcagttgatttccaattcccgactctgcatcattagggtacaatgttttctgtaagatttctttgtaatattatagagagaagagcagaacaaatgcagttattcctctcaaagttcagctgaatgctactaatagttcaagaatgtggattgtaatggttctgtgcattgaaagaacacaatggcaaatgacaaagatgacactaagtgtgagccacagctattgttttgatagcccactctgcttttctagttaactttcttacaaccatcagttccatatttaagactagaggatcagttctgatgatgctcattcaaactcttgccaactgacatttaatgcactttaaagttgttaaaaccaagagcaggaaatgttacacttgtagtatcaagcctggctcatgagaaagttccatccactattctggaaaaaaaatagaactagcctgcaggacacaaagctacctgtggtgatccgaactatgcttctcaaaaatctttcttttgtttggccacctttataataggagttctccaacagagaaagagctgcttacagcttcagagtacagatggataattgttgctgtgccatctctgaacatcttagattgagggtcccagagaacctcatgtatgtgaatgttagcacagtacaaaagatgggacagagctttccagagcagtaacagacagctgtgcccagcactttcttctaaaagttggagatgctggatggaaaatttgtcattgtttacatagcacccacacacacacaaaaaatcctgactcactagcttctgtgttgtcatttttttgtccatggttctattgctgcctaattttcatacgggaccctcacagtggttagtctgcacagtaaggagtcaactgtgacatcctcatccttgaatgctagactccccactttctcagctcaatattccatgtgtccaaagtaatactgttagtatcctacattattccaggatcttgtcatgccacttcaagaaacaaattatcaccgctttctaagacttaccaagctaggggtgttgtaaagtatgtatgcaattgacttttgacttttgattcttatgttgaaaggcaacatagaaaataagcttccattaatgtaatgatatagtgttaggaagacagtatctacagtccattcaaaatattctgaaaattatagtattgattttggaacagttttgattccattggccatagcgcttaccttaagtcatttttttttaaaaaaaccgtcttatccatttcatatgttttacaggcactaaaatggggcacagagactaagtcacttagttgagttaaccaataagtaaaattgccttcatattctgcttcctaatgttgtatcttctctagcaagttcaagagagcttactttctggaagctttgcttgttagtaggatgtataacctgtgggaaaagacccagcagcatccacttttacttatctccttgccttctctgaaaacacactgaacagaaatatccccatctctttctccatcgtgggtttttcctttgggccacaaatagtgaacgccactgctttacaaagttattcttttcaccactaatagttctttgatgtcattttttgtacaagtgtcaaagtttttctctagaggcttccacacagttaagttcttgcttttggattctttctaaaccaaataaataaatcttcgagactgcaggttaatcaaatgccttcaaacatgaaggctgtttaggagctaagctgcacagacattttccaacatttaaactcttcatgcagcatcttcctatctcaatttgtacccgttagccagttccacagggcatattgggaaataccttttattttcaatatttatatttgtcttatagatatttgtcctttcaagtaggacaaagtggtaatgacctgcctctatcaaaaaattctacctagtaatccaagataagcagtgtgttcctagtgagttgcttacataaaagccaatatattttgtactgaatagtatacagtgttaaaaactcagctttttgagggacccaagcaagcctaacctacatgattttacaaagacaatacttaaaagtcataaagtactaagtctcaactttcagacttaagactcataaacgttttaattttttatcccttaaaaatgttattttttggctaacagcattgaaataagcgttactatagattaatactatgaaacaggaacaaaactgttgagcagacattctcccagggaaggactgtgtgtgaacacattaaacttacgcataaaagtggagactgtaagtgggttccagggtttccccacgctgactttttaaattaaatgtggcagtattgctaaaaataaaatttagtgtttctcaaattttttttagatagatacctcatatggtactcacaagtagtgtgaaaacttaagtagtatatccatctaaagcagcacaagcaatatgtcagcaccttttcactattaccacagagaaatagtgttggagaccatattgaaaatgactgtagtctggctgaggagatattaagtgaccagatggcctctggcacttctgttttcaaagctgccttatagtgcctttctcactttgtgataccaagctgctgccatgctagtgtccaccctcgaacaccatgccactcagacatggtgggattcgtgtttctgaaggggcacagtaggaagctcattcttgggccttctggcctgcctgagactgtgctagcaatacagtctcattgtgcacaaaagaagccatttttcttaacacctttgagccattaatgaaacctaccagttagaggtggtcaaaagacaaaattacaacaaatttagcttaaagatgtattggttttacttgcaattgtagaattgggcaacaccttgttctataaaatagtatgttctgatgagctgggcaaggtgttgtctgactttatggacagaaaaggactgaagaaagcagaaacaaaatgagaagtagacaggttgtttcaacatttccttctttctaggctttaagcagagggtactttcttatgctggatcaggtaaagggccccttctgcttggttgctatgaatctcctgtttaaaaagaaaacaaaaacaccacacaaaaaaacctgacccattatggtttggtctggttggctgaggcctagggccggagtctagtctaaaacaatggcctcccctaaacttgaacagggttacattgtagaataacataacaggaaatgaaaagagaaatgtgatgctcttcaacaattggtttatggggccttttaaaaagtgtgtatagagtcaatgatgaattaagatgcagtgtgaaagaaaatgacacaggacagatattcagagatcatttgttcagttttaaaatcagattattagtattgctgttgagtcatttcagttccttgtgtattctggttattaatcccttgttaaatgaatagtagaaaatattttctcccactttttggttgtctcttcactttgtagattgtttcctttagtgtgcagaaggtttttaacttgatgtaatcatgtgtctatttttgcttttgttgcttatgcctttaaggtcttatccccccaaaaatctttgcccataccaatgtcttatagcatttccccaatgttctcttctagtagttgcagaaagcacttgtaatttaacagctcaggaagggaatcaaatcattcagaccaactgaagctttcaaaatgttactgcttgaatgggcagaatatccaaaaacatttattgtgtgatcctaacatctacatattagaaactgatagaaaacttctgatgtatcagtaagatgataattacccttgtaacatttctggaagcatgtatgtatgtatgtatgtatgtatttaaacgaatgcttgtatatctagcatctctttcaattgactcaatacccaaggaattttatctccattttacaaataagagagattatgacttatttcaggtcacagaagttggatcacagctggaactttagtccagttgggtctagaaattcaattttctttttactttcatgactaaggaccactctataactctgaggtaaaaagagcaaacataatgaagttatttagagtagtgtttctaaatctaattttgcatgagtcccttggggaacttttaaaacatgtagataaccaggcacttcctgttatcctttttccactgcccctagcagacagacttagtatgtctagcttaggtaacctgggattgtgcaaaaaagtaaatcttcagagtccctctgaatatcaattctcattatgcaattatgactcctaaggcttaaaagtatgaaataaatctgtagagatcttaggatctcctgtggaagttgtttttgtgcctaaagattagcttgtttgtaagttcccatactcagtgagaactgaatattttaaaaaactggtgaagggtggcactgtattttaacgtaaaacatgcaggactagatacagtcacggccattcaattttttaagttgtatatctttgggtgagttacttagcttatttcagcccagatttactgctatgtaaggtgtaattataattattgagtaaaataaactaaagcatttaacacgatgtctggcagagactaagtttttaatactcttaaaaacatcttctggaggtaggcttctagttaattagtgttttaattatgtaattataatttttgtttcctttctctgtcctcatatttgctagaaaaacactatgtcaaccatttgatcatactcatttgtttctaagcatatatcttaactaatctagagacccatattcattgagcttttggaatgactggaaaatttctcaaagcttcctcccttatctacggtttagtttacaaaaattaaataagcttatgatgtgtgtctcatccacccaagtacatctgcagggctcctctattgtaaatcagctgcctaaggctcaagttagacacagtcaaagccgtgtatatttagggtacataatcttgatgtcaagtgctggagtcttgggcaaacttttcatctttttatgtaaaactgatttccattaagtatgaaaacaccttggtggtattgattttatgaaccctgtacattccctgcaatgaagacagattttagggtaaaagaggatgtttgcaagaaatggtgagttttattgtaagagaacttaccggccctatagagaggagaaaacaggttggaatgtccagctgctaccacccaacgggatcccagcacaaagaaaacagtcaaaattatgttcatcatgacagagcaaatgagcttttggggaaaacagaagcaaaataaacctttttgaataatttattattctataaacacaatcataaagcgtaatggtatcagttcaggagaaaggtcccactgctcctgtgttctacgtcagtggctgcagggccacagcaggcagagataaccaagcatgctttcactgccctgatcaccattcccccattaataatttgcttggccctttccttcctactgcctgaagaaaatcaatgtttggcagctctaggttgaattactgtttattttatctttagcctacacaactgcaaaaggaaagcctgagttttccagtgcatattccaatacctgtttatggaagtgagaacgagtcagatagtgatgtattttttcagagagtttcttaagccagctgtggataagaaggtccaatttgcattggaactgctaactaggactcagggaaatcccatctggtttagagaagagtaaatgaaaataaaacagaattgtgaatgcaatgcttcaataattagtttgcaaaacatgtatccactgccttgtgtgggcaaagcaccatattaggaactatagaggactgcaagaaaaacagaaaaacagagtgggctccttttgcaaggtattcgtggctattccaggcatcctttcttctttcagcagtgatctcctgagttattactatgtgcctggcgctgttctgtggactgcggacaaagacaaagtctctgctctcttggagcttatattccagtgaagtgggggaggactaaatgtaaatacatgggcaaaagtcagctaataaatactgtgcagagaatcatgaggagttgatgttcagttagtgagcaggctggttcgttactagggaagatgtgaagggcctctgagaagtaaaattgtagcagagacctaaataacgagaaagacctagccaagcactgagcaaggcaagggatgttcctggaagggaagccagagagtatggccagagcccgagatatcctgggtctggtgagtcatagatgagactggagtactggagtaggcagctggcaggtcacagtggactttcccagtgagtcagggattttgatttggggaaacctttggggattttaaagaggaaagtgacttgatctgatttttattggatactttaagaaataaattttgttttgtatacttaaggaatacaacatgattctatgagatatatatatatagtaaaatagtcaccatagagaaacaaattaacatatctatcatctcacatagttatacattttccccttatgtcaagagtagccataatctgatttagcaaaaatcatgaatacaatacactattactaactacagtcctctgcacattagatctttagacttgttcatcctaaacacctgttacttggtattctctcacctacatgtcatttcctctcccacctctagtaaccactgttttattctctatctctgtgggtattagacattgtttttttagattccacatataaatgagatcatgtaatatctttctttctatgcctggcttatttctcttagcataaaaccctgcaagttatgtatattgtagcaaatggcaggatctccttatttaaggctgaataatattccacttaatattttataatgtgtccatcccttgacagatacttcgattgctttctatcttggctaatgtgaatataggtcgggtttggttccaaaccatttcaacaaagtgaatattacaacaaagcaagtcacatgaatttcttggtttcccagtgcatataaaagtatgtttataccatactgtgctttgttatatgtgaaacagcactatatcttttaaaaaaatactttgataaaaaatactttactgctaacaaaaatgctagtgatcaacagtattcagcgaatgtttttgctggtagagggtcccgtcttgatgttgatggctgctgacagatcaggatgtgggtgctgaaggttgggatggctgtggtaacttcctaagacaaaaatgatgtttgctgcactgactgatttttcttatcacaaaagatttctctgtagcatgcaatgctgtttcatagcattttaatcagagtacaacctctttcaaaattggagtcagtcctctcaaactgtgcctctatcaattaagtttatgtgatattaatatttaaatattttgtcatttcagcagtgttcacagcatcttcaccaggagattacttcttatgaagtcattttactaatccataagaagcaactccttaaccattaaagttttttaagaaaaattaattttaatagttttggggttataggtggtttttggttgcatggataagttctgtagtggtgattctgagattttagtgcacccatcacctgagcagtgtacattgtacccaatatatagtcttttatcccttgccccctcccaaccttcaagtccccaaagaccattatatcattcttgtacctttgtgtcctcatagcttatctcccacctataagagagagcatacaatatttacttttccattcctgagttacttcacttagtataaatggcctcgcactccatccaagttgctgcaaaagacattattttgttcccttttatggctgaatagtattccatggtggatatatataccactattaaagttttatcataacattacagcaattcagtcacatcttcaggtcttacttctaattatcttgctatttccaccatatcttcagttacttcctccactggtcttaaacccctcaaaactctccatgaggttttgcattaaacttcctcccacctcctgctaatgttgatattttgacttttctcatgaatcacaaatgttcttaatggtatctagaatggcggatccttctaacaattttttcaatttatttttcccagatccattagaagaatcactatctatggcagctattgccttacaaaacgtgtttcttaagtaagatgttaaagtcaaaattgctttttgatccatgcacagcagaatggatgttgtgttagcaggcacgaaaacaatgttagtctccttgtatatctccatcagagctcttggatgaccaggtgcactgtcaatgaacagtactattttgaaaggaatcttttattccaagcactaggtctcaacaatggacttaaaatatttagtaaaccatgctgtaaacaactgtcatctaggctttgctagtccacttaaagactacaggcatagtacatttagcataattcttaagaaccctaggaattttgaagtggcaaataagtattgactttaagtcaccagctacattagcccttaactagagaatctgcctgttctttgaagctttgaagccaagcactgactcctcttctctagctgtggaagtcctagatggcatctttttccaatataagaccattttgtctacattaaaaacctgttgtttagtgtagccactttgatcagttatcttagctagattttctggataacctgctgcagcttctacattagaactcgctgcttcactttgtgcttttatattatgaagatggcttttttttttcttaaacctcatgaaccaacccctggtagcttccaactttacttctgtagcttcctcacctgcctcagccttcatagaattgaagagttagggcctttctctgcattagggtttggttaacaggaatgttgtggctagtttgatctatctagaccactaaaatattttccatatcagcaataaggctgttttactttcttatcattcgggtatttactggaacaacaattttaatctctttcaagaacttttcctttgcattcacaactcagccaactgtttggcccaaaaggcctagtttttggcctatttcagctttcaacatgccttcctcactaagctcaatcatttctagctttaaagtgagaggtgggtgactctttctttcacttgaacacttagaggccactgcagtgttattaatttgtctaatttctatattgctgtgtctcaggaaatagggagatgggggtggggggctggagagagacaaggatagacagagagagagagagaccgacccagagagacagagagagagagagacagagagagagacggagacggggagagagacggagacggggagagagacggagacggggagagagacggagacggggagagagacggagacggggagagagacggagacggggagagagagggagacggggagagagagggagacggggagagagagggagacggggagagagagggagacggggagagagagggagacggggagagagagggagacggggagagagagggagacggggagagagagggagacggggagagagagagatggagagagagagagatggagagaaagacagagagagagacggagacagagagagatggagacagacagagacagacagggagagagatggaggaagggcaggttggtgaagaagaacacagacaatattaagttcactatcttatgagtgtggttcatggcaccccaaaatagttataatagtaacatcaaagatcacagatcaccataacagatacagtaagaaaaaaagtagaaatgtgagaattaccaaaatgtaacacagagttgcaaagtgagcacaggcaggtagaaaaatggtgccaacagagttcctggatgccgagttgccagaaacgttcaatttattaaaaatgtatctgtgaagcacagtaaagcaaagcacaataaaacaagatatacctgtatttgtttttaaatataaaaataatttgctttaatgctgaacaaaaatgtcccatgtaaaaaattcatgtgctatctgttcccaaactcagtttccacacctaattacagtaaatagaaaggagagaaaaaccaaactttcaagatggaaaggagaacccaggacagcctcaaacccaacacttagaatggtatttctgcatgcccaatctacagcaaactttcagacttaagaaggaagagagaatggataaaacgttacagaagacagtattacattttaaaaattggtaagatagtagaatgtttagatctggaaggactttaaattaatcttttttccttacattcagataagctttaatgtgtactaaattctatcccaaaatctctattctttgtgaccctactgtaccctacgcagatttttgttgactcaatactccactgcacttaatttgttttttagtctcagctagacctgaaacaactttaggaaagggatagtgtcttcttgcttacttttatttttcctaccaactagaatactaataatcattcaaatgtttattgaatgaattaatggataagcaaatgaattaatataattagttgcttatattttaccccccacactagcctatagctttaaagttgtggtgactacaatgtctagtcacttaacctcacagggcagatttgctcaactaataagattttgaatgagaaagtgcttaaaaattctaaaagtgcttctctaatatttgttactattgtgttcaaagactgttagctaccaaatgaaggtttcatagtcaacagaggaggctgaatcccagacaattacaactgaggcccgggctactccaagtgtgatctttggagtatctgactcagcaaacaaacaagaatcacctcaacccaaaaccctaacccaaatagccatcattactacttccttccaatctccatctccacaccctccaataatgatgaattcttaaagcttgaatacatgttttaattgtaaatttgggttatttctgcatgtaattttacagttattttatttcacccttgtgagttggagttaagctctgaaaaggtcttattttgatgtctttccataagattgtattccttttttggcaagagaacagatctggagttgagctcctgccctctaccaaactgtgaaatttgagacaagtcacttgtcccccatgccaacccctggggcctcacttttcttattcaaaaagatcaaagattttgtcctaactcatgaaatcatgagcattacatgtaaaattaccttagaaactataaaatattcatttcaaatgcatcaagatgttattagctatattttatgagctcagcactccttgatggtcctgaagagaccaaaggggctgaggccaaagggagaattctccttaaatctcttggaaacaatctgacagaccttagaattgtgtagtaagatgaggacataaaggaacagagggtcaaggtagtatcttagctcctttctcccaacgtgttgatactggttaagatacacaaaagggaaaacccacctaagaaactgccaggaattcttttttttttttttcattttgttttaatgctaacttaataatcatgtcttagtgtaactaagcttttcttcatcaagaacattataagctcattgatgcacaggctaaatctttatgcttatttggtgctttttaatctgtctagcacagaatagggcacaacacaggtcttcagtgtgcctttgctgaattgaaatacaaaaaaatagcacatctttcaatacttgaagctcatttttataaagtatatgtgtgtagtagggaattctaaaaactattttttgctggtactagtttatttaatcaagaggaaatatcttcataaagtcaaacaaccagaaaggacagtgcaaatggccctcaaagcttgagcttagcaactgctcccctgttcttagtcttgccactgtgtggaatttaggacttctatatgcagatagtttgttacttgcaaaccattagaccaagcttgtcctacccacagcacacagggcgcatgcagcccaggacagctttgagtgtggcccaacacaaatttgtaaactttcttaaaacattgagtttttgcaatgttttttggtctcataagctattgttagtgttagtgtttttttatgtgtggcccaagacaattcttcttccactgtggcccagggaagccaaaagattgaacacctctgcattagacccttttaatactattataggtaatatattttacaacataaaaaaatcatctgtgtaccagtcagaaatgaaggttttgtatgaaacattttcattcttcagtatcaacagcccaagattctcctgactttatttctccagccctggcccctcacctcaccatctcttagctggccccagatatggcccaggtgttttaatcttctgggtgatctgatccagcctcttgactttaaatggcatctatatgatgataattttcagtttaagcctcccttcagaattccagtttctcaaatccatctggctattcaacctttccactttgatatttaagagacactttgggttcagaagagctaaaacagaactttggattccccaaacttgcatgtcctccaaattttctcatctcttaaatttgattcaggtgtacaaactccacatttgtcatcattcttgggcccctgtcccaactctcttccccacacccagtcaagaagtcctgttgactctgcctcgataacaaattgctcacacatttcctttgctccagctacccatgctgtagtgtaagtcaccatcatttcttgcttgaattctgcaacggcttcccaattgatctccccaattctacttttgcttcccaaaagtccattctccataccgaagccaaagtaatctttaagaagtatacatctaaacaaaacacttcttcacagcaaagaaatcaatacaatgaaaaggtagcccacaggttgaggaaaacatatttgcaaaccatatatctagtaaggggctaacttccaaaatttataaacaactcatacagctcaataacaagaaaacttataacccgattttaaaaatagacaaagtaacccgaatagacattcctctaaaggagacaaaagtggccaacatgtatgtgaaaagatgcttagcataactaatcaccagggacatgccaataaaaatcaccatgagatatcacctcatacatggtagggtaggtattatcaaaaagacaagggacaacatgtgtcgatgagagtgtggagaaaagggaaccgttgtacactgtgggtgggaatttggattggtccagccattacagaaaacagtatggaagttcctaaattaaaaatggaattgccatataacccagcaatgccttttctgagtatatacccaagggaaaggaaattaccatcttgtagaggtatctgcactccatgttcattgcagcattactgtaccgcattatgaaatgggttccttcaccccttttctgagcaccctccatgtctacagaagaagttatgaggaacaaaggtatatgcagggctcgttttgtaatgctgacaacagcaatcctcacatccagacttccatgtccatgtacagggttctctactttcgttctaagtcaaactgtgattcagaaatgagccatccattctcccagaattcctccattcaccccacagacacaaaaatcaaatctatgaaaatgtttttgtatatttcataggagaaacagatgtggaggcttaactcatgtatccaatgccaaaagtcttcaaaatcttcattaggtatttgttatgccaacttctttctcagccctcccggtttgtaactttttaaatctttacccagtgttgcacgaagactgttgagatggttccctctgccttcctctctctagtattctccctgggaagtttaaaatatataatgttatgtaaagtaactcactggggccttcctcttgggcctcacctctatacactgaagacaatgctttctagcaaggaggacccatgcttccagagaggagggtttgcaactggagtaacttgagtatgtctttgggattcttgagctcaacccaaagcagttcagaaacatttctttgaaacaagttcccaagatgaattctaacaactgtaatatcgcatttggcattttaaaaattttgattttacatttagacagagctattaggacatggtgggataaaaatggtagtatcgaaatatactgtttcaaatcaaattattgtattatttgttctcaatgacagacataacccaaacacattcttagtacccagaataaaggcacagccatgaaatcaggcagttattaataaaaacctagtgtagatagctaatgaaagatgaaaatgaagctgtgacatgattatgaactgctattagcaagcaatgtcattttgtatcttagagaccaaacaaggtttgtgtatgtgaactaatggttgacttatatggtaaagatatacatgcattatattcaggctatgttggcttcatttgaaactacagcttccatgggtttaaaaaatacacatatgatttgcaaagtgacaaccctaaattttcgtatattcaattgttcaaaccagtgatttctagaatgtaagtggtgtcctacttgtaagagttttaaaacaggcaattttggaataggtaaattactcagtagaagccttagagaacccaaattgctgatgtatctttttcgaaatgcctctcattatccaggagaatgtgtgtattggaagtatcttattctttaagtctcacacttagaccggttatgtttcctacttttaaaaattgtagaactttattctacagatgtcatttgatgccttttgagaccgaccatatatgcatttatacaatcttaattcaatgttaaaagtataattagtccaaaaaaatcaactaaatggcaacaagggtttttctttttctatattattaatttttttttcctccatctaaaactttccagctgctctttgtgaagttcccagaataatgattaacattattaaaccagagactaaaaatcttggtacggactgacccatggggacacattgctataattattttaaagtaaaataataaaaggggcgtcccatagcgggcaaaagttggactcatcctcaaaatttactctatttgtcaaagtcccctaaaagagttcttaggagtggttggaattggttgtcagaaccaggtgctctcaagtgtcttgcctttgtggttcgcctacctgggtttcccagtccttggttgaacattaatgttctcaacgagatataatactgaatataactcttgtgatctcttccagtggaggctgaggccatttctaaaaattccttccctctgtttcttctacagtatcttcctctccgtgtgcatacatgtgagaggcatagttttccccaacgtacttcagataaaccttattggcatagttttcctcaaagcacttccaataaactttattcctttcatgattgtcctgtagtttacagacactgatattgtactctttggagtggagaggggttttgccattcttacaaaaaaaaaattggctattcctccatttatcaggctcattttattaacattctactgtcatcattgtgctctgtcactttgactaagcccaagaaccctcccacagagcaatgttaattataacccctctatgcccgtaaaatatgccatctaaaggctttgaataaatttgggataaatttcctgaagcagaactcatgaacccatatgtattttgattccaattcctgtcaatacaggttctagttcaactcccaacacacacacacacacacacacacacacacacacacacacacacacctctcacatgctttccttctaattggcaagaagccttcagatgtccttcacccctactggaaaggcatgaaacaaaacccagtaccttcctcctacccctaaactggttttgtcttgctgcccctaatcctagcttgctgttctgtttttctattttcccctaaatgcaacttactttaagcatgtgttaactggattaacattcctacaattgaaggatagtatatgataacccatttgtcagtctagctactttcttctcttttaaatgtctacttacgacgtacatccagactgcacgccctttttattttttcaaagcaaagccaaaaaataaagaaaacgtaaaattagtttttaaagaaaatgcacaatctgtttttaattttggctatcacgaaaaggggaattaaccagccaaaaaagcaaagcaaaaaaaacgtgtcccctgactgctctgtctgtgcctttcaagcctgtgcgtctggttgttcatctctgaaagtgtgtgaaatacttttttctttaaactttttgtttttttctcccttcttgtttgggaattaagtgctttttatattatatatatctatatatatatatcaatgtgtttcttttaattgctagatctttatcttagatttgattttatctaaaattatgagaaaaaaagttatgaattgttttctgcagtttttccccactccctctttaaatgtggaacaacttcagctgcagaatcctcacatccacatctttcaaattagcctggtctcattgccaattgcgtgcaacatgggtggcataaggaagatggatgatgtcgtttggaaaatgccatttctctatagagaagtaattagcaacccagtgcgtgggccccctgcttagtagtgcgtctcaatcacctctgtagatttctgaacctcccccactctagatggggctgtgtggctgccgatgaagttgttcaacttgaatgcataaatctagtcttcttgtttttgctttaaactttttgatcatgactactagtattttatgtattttggctatttttagtaggaaaaagtttaactgtttttattatttgaaaatctttaatgaaactgtaataatttttggagtaattgcatgttgaagaagttgcagcttagggtgtgtgagattgtcagtgttagagttctgttctttatttccatagatgggcatgtgtaggctcatttgtttttgtatattgcccatcccttccttacagccagaagctctaatgcagctagatcactccgtgccgcccttacatggacatggcgactcacttacacatttactcctatcatcttcatctcctgtgtagttcactcatagatatgaccctccccttcctgcatctttccttcccattctccccctttctttagcattgttaaaatttatgtgctgtcatccatctccctaaattaaagaaagcctaaaatttgtcaaaaagacaaaaaaatatatatatctgaaaacttataaatgcagaaattcattcaaaacccgttagagtcatagaattttttgaaaggcaaattataaaagtaaacaggtttttttgtttggtttttcaatcatagcaatcggaattattttaaattcaaaaattgatgccctcccaaaccccccaaagtaaaaatttgttaaagtgcagattttttttttctttttatgttatgtggtgtggatgtatgtgttgttgcctccctgtatcatcctctgttgtaaattattatatttgaaaaattagacattttgctcaaaagtttttaagaaatgacaacaaaaaaagcaagttacaagaatgtggcaattctatttgtccaagagcattcttacacaactttcttttgtaaatttttctttcatgccaaaaaacatgcgggcaatttgttgatgtaagttgactataaattaatatggtatgcttttttagtttaaattattttgcctatatggaaatgatttctttttttcccagaacagcttctatttttaatttgcttttactttttctttccattcttattatattgtgaatgcctcaatgttatttgctctccttctcccagcttactttggctacgaagttgattttattttctactatataattttgaagactatattttttatttcatttgtgtcgatttgctgaattttcactgttatgttttgtgctgaattgcttctaataatcaatgtgaattctactctcagtagaagggggttaatacattgttcttaccacccaaagaaagcctggcctctttgcctgaactttttcaccaccgtgtttaaagccttgaaagtattggtaggctctatttggtatcttaaaattgtttccagccagtgggaggcctgtaccctagaagaaaatgagttgagttagctccaagtagtaccagtggtatttgcatctttttaaaattccttaaaaagcatttaggaaattagttcttttccttcagcaaaggggaaataaggtactctcaagtgactatggtagagtttggttatccaggatcatactctcacttttgcttcaggctacaaaatcaattatactgaaaatgcagatatcaagaatcccaggtgtttcgagtattgttctatgatactgacgccttccagtgtatggaactaacaactggcaaaaacacagacacacacagaaggcacacacacattctctctctccctctttcctttgtctcttctccttttccctttttcatttctctcaaggatttaatcaggtaagctttcagggatcttaagattctaccaagaaaacatgatgattttcatatctaaagttatacttagaaaatatttcaggtgggtaccatcatcgtgtaactacagggtaagactattccttcaccttaagattatttgaaccaatgctgccttatgtacttcaacatacataagattggtaagaagcactatataattttttcatcaagaagttacttgttttgctttacagatatttgtgttatttgaactgttatagaaatatcaaactgaatggtggataagagtgtttccaagccagcagcttaatatttgggctctctctacctcagtttatgcgattttgtgttgtttgacatgctggataatattttaggtctaaaacttagaacttcctaaatgggatgttgttttatcttgatgcattaaaatattttctttctatgaaaaagatatccaaaggtaaatttaataaaatgttatttttaaaaaatacaagctatttgaattataaattatttcttatattctattatttaaaatagcctcaatatataattatacttctactttagcatgaagccactaaataaaaaagggttagaagaaagtgattatgtaagtgtttatagctcagatacattagtagaaataataacattagtaactagcatttctgaatagtagtaggtactgtgttaaccatctaacatataaaaaatacttgatatgcattattttaatatttgcattgatggtttgaggtagggtattttattattctcattttccagagtttaagaaatttgaccaaattcctagcactagtaggaactcctagagagttccgatgttaagagtctgagttacttcagaagcaaagctcttaataagcaaatgaaacactccacttgacatttcctgttttgtaatacataatgatatcaaggggctgtggctcatcttattgttgaaaaatataatctgtagcctttccaaatcaaacctatttcagacaaaccctttgctggggtggaagggtggtggggaagcgagggagaatgccctacctagaaattctcatcctgttaaaatacaagttaagcctctttgagacacttgagtttttctactgtcttctccccaggtacttgccctgtttgtccatgactattttttcccgaaggttgatagagagcaatttcatggttacaagctttatgatatttatgtgttacaaatacacacttctatgtcaccaaagagctaaatatctttgaaaaattaattcttggggggaaaagaattatttccccttatcatgtgaattttcaggaagaaatttggaataatgcaaataagagatgaagtaaaatacccaaatatataaaaagaattcaaggaattcaagcatggtgtcctgtcccagagtctcactgttcagcatcactgttttggtattttcgtgaactctcaaaacccaaatatctccagagaggcaagtgttgaaacttcatgcttgtttttttgttctttttttttttttttccaaagataacccactgcattcactatcacccacaacattctcacagttcagaagaattctattaaattttttatacactgtcttttttgatggcagtgagccccttttgctggatatcagccctagaggcatgaattatatatctacaaatacactcataaagcaaaaaagccgggaagccttcagggctaaaatagaccttttatatctctaatgatctctctagtttaaagaaaagcacaatcctgccaaaaaggggtatgtatgcctgattttaaaatgctaactttaaagaatatagatagcttttatcccaaactaaagaaaaattctggggatagcataggaaattaggattttgatggattacaggttttgtattactctgctcataaccctttatgactttgggttatttgcttccatgaatacttttgtaggcatgggacacatagttgatcactgacttcatgatctctgggaagtgaagaaaatattatcagctacttgaacatttctcagggtagtcacttttgattaaaataaacaagaagctttgaatagcttcccaccaaactacttttttgtttgtttgtttgctttttgagacagagtctcgctctgtcgcccaggctggagtgcagtggcgtgatctcggctcactgcaagctctgcctcccaggttcacgccattctcctgcctcagcctccccagtagctgggactacaggtgccagccactatgcctggctaatttttttgtatttttagtagagatggggtttcaccgtgttagccaggatggtttcgatctcctgacctcatgatccgcctgcctcggcctcccaaagtgctgggattacaggcgtgagccaccgtgcctggccaaactaagttatttctattaatgatcttatagtaggagaaatacatcactttctcctctcaaatgatgtgtgcctttgatcccccaggacactattatcatctgcaatcttaaacatggaatttaatattaaaattaattacaccaacatatacacttgtcccaggcatttttcatgtttacagttatctaaaatgttctacctattttcattagaattgctatttgtcataaggacccccgtgtactgcagttgacttcattttaaactaaaggcaatcttcccacttcttgagaagccaggaaagaggggttaggaaagcttctaccactttgttgtctaaaaatcagcataatttgggctcagattttcccaacagagggtatcatttatcatttttatcgctgctaccgagattaataacaaaatggcaaagaaaactagagatcagtagttctgaaagattttgttttctaaactctgagatggcatacccatcattttagttttaaaataagctcttatcatttcactttgggactcaccaggcttttagaagctctttataaattaacaagcttcagaaccctcttactgtagagttataaaaaatgtggttactcttttttttttttttttaaatctaagatacttgcattagtgtgttaaatgagagggagatagcaaagtaaagtaattcaactgcagagtgaacagtttgtagattttgaaacaacaagtacactgtggaaactttagctggtattgaaaggagaaaaaacaaaccgaaaaaacaaaaaggcaaatttaagactccggttgggtgtcacagatggtacactaaaattgcaaatgaatgccactctgtaatcatgaagatggtgatcttaatcccacttaaagggacactagcctcttacccaacagtttgcctttatattcaaactatttgtaccagggctttgcctcctaagatatcagttattccttgtcctttaacctagtttcctctttgcttactctacatggggtagatttgtcattgccataaggaacaaatgactcggtgtttgtgccagaaaagaacacacatgttaaacctgtgttacagataagttaaaaaaaaaaatcctgccttgtcctctgaaggtaagtaaaactgtgcctgagaaatccttacggaagctttagacagagtccatgggccttcacttcctctctctcatcactgctctcctattactcaaaccttgccctctttcatatatcaccttaaatctaccacttgggaccccctagcagaagaataataaaaaagtttgctcagagttagttttaggactggcttacctttagggaactgcactccaaatcccatttgtaaaaactagcaaaagtgtgtaaattatgcattaaataagttgtaaggcatatgaattatatatgttcacaatgtaaaaaaaagaaaaaaaaaaaaaacaggtgtctgctggtctagtacagtaagtgtgaatctttggcaaatctgcacagatcattttgctcaatagtttcaaactctgagcaccagaatagaggcttaggtttagagcacatactacaagatcatcttgagaatctcaaaaaggtatttttttaaatttcatagtaaaattatcacataggccagagatgacactgcaacattctgttgtcccttcccttctaaatggtacacattatatgctttctcggttccctcagaaactcagtttctttctgcagaacacaattgttattggctaaacagggagagaataaaggcttctgacatgggcaccaacagtttctcagtgcttgaaggtaggtattagctttcttctcaggaagcccttctcttagcacacctgaaacctggacaatttggatgcatgggaaaggtttcaggatgcaaggtgtggaaaggttgcatcttgaagcatttcctatgcattcaaaaggagagttttaatttgtgaatcaatcttcataggaaaaaccctggaagactgtgtaggctccaaggcttattcacttggagtcccctagaactctggtactgaatcacctccttgtctggctttgttactgatgaggtgggtacctcagctacagtcttatctgttaacagctactcaaacactgattatactatcacagcaaagttattaccaagtgtaagagacacacgtacgtggtaccagttgacagctcaatgggtcagctcagaaagaggccttcaacaataacgtcacattagtacctcaaccttctaaataactggggcagggaaacattcgcagcatccctgcgagtggattttttttaagtgatagtgggaatacatttttctggaatatattcaataaagagacatggactatgacttcttaagattcttcctttgcttggaaaacaacattataaagacactgaagagagatcagttatcctgctgacatagatgcatagcaatcttggccttacagtagggtaagcaaccactactgcagaatatttgtggtacccatgatctgcaaggccctgttatttaatgaactattctgagctttctttcccaacttagtctgtatgattctaagtgcaataacgagggtctatgggtaaacagatatgtttttgccacactagttagcaatcaccaatttaaaaaactcactttgctaagtcaacatttctgagtctaacagtttcaagtcatggatatctaggctgagtattttgaaaatctagcttccagctcagcatatattgcatacagcatgaaagcaatgcatacaaatattagactaatgcaaggcaagctgtcatttaatagtcagggggatttctggaaaagcatggtcaaaatggatttgttagatgaatatttttaactttttaaaaatccctattgctcagcttatagtaaacaaggactgtgattaataagtgtgaaataaaaggaagtaacttaagaaaacacaaaagacacaatcttttatgtttcttgatcttggtctcaataagatggtgaatcggtcattctcatcctcctgggagcaaatgagcagaatcccaagaaggcaataaagaaatcttaaacgcatgttaataaattcttaagttaagcacacaatgtgtgcgtgtacccacacatgccaattttgatagccagccagtatttataacagtatcattgactgaatgtcatcagcccataagcagatcctggaaagaacatatatagttgaattttatctaaataattacttgagagtatctttaaaaaatctaagcccctgatctagggatttcaggtttgggtggcaagaggcatacagaaggctccaaatctgcctagaatgattagactccatccagaaaagatccagatctttttattataatttctgaggcataatctgtgaatgacgttggttgagtgagagttgtttacaaatatactaattgtttttctttttcttttccatcccaggaggtgaattagttatccctcttcttgtagaagaccctttagctacccctcctattgctactcgtgcaccttccattacactcccccctacctttcgccccctcctcaccattattgagaccaccaaagattccctgtccatgacctctgaggcggggttaccttgcttgtcggaccaaggcagcgatggttgtgatgatgatggcttggtgatatctgggtatggctcaggggaaacctttgactctaacctgccccctactgatgatgaagatttttacaccaccttctccttggtaacagataagagtctttccacttcaatcttcgaaggtggctacaaagcacatgcgcccaagtgggaatccaaggactttagacctaacaaagtctccgaaactagtaggactactaccacatctttatcccctgagctgatccgcttcacagcttcctcctcgtctgggatggtgcccaaattgccagctggcaaaatgaataaccgtgatctcaaaccccagcctgatatagtcttgcttccgttgcccactgcctatgagctagacagcaccaaactgaagagcccactaattacttcccccatgttccgtaatgtgcccacagcaaaccccacggagccgggaatcagacgggttccgggggcctcagaggtgatccgggagtcgagcagcacaacagggatggtcgtcggcattgtggctgctgccgccctctgcatcttgatcctcctgtacgccatgtacaagtacaggaacagggacgaggggtcctatcaagtggacgagacgcggaactacatcagcaactccgcccagagcaacggcacgctcatgaaggagaagcagcagagctcgaagagcggccacaagaaacagaaaaacaaggacagggagtattacgtgtaaacatgcgaacactgctcacacgcgagttttcacagttatttctatccacgcctatgaatctttggacggtgagatctcacagatgtcagaactgctggaactatgaaatggggtatataaccacgactctggtggggaaaaccgttttttaaaggacacacacacacacagcgatgcatctctctctaaagctcagccacggctgcggcaaggtcccagcggtcgctgggagacagaaggttttgtgccctgctgtatcataaagcacacacttagcgctctggagccggacggtggctccaccacttccgcaggcctggaaacttccttctccggaggaccttttactaaaaggtagaagacttcatggcttacttgttccataactccaagtgagtctgtaatgtttgtgaagcttgactgtaaccatgttttttctgtttaattatgtaaaaaacaaaactacaacaacaaaaaaagaaaaaagttaaaaaagaaaaaaacaccaaaaaacaaaaacaaacaaaaaaaaaaacccacaacccttatctggttctgaccagtgtgcgtgtaactttatgatctgaggggaaaaatggcttttgggtttttgtttatttttttgataatgactggacatcagaagaggaaaaaaactcaaaacaaaagcgagagagactattgccatatgaactcaaaagctatcatggtgttcactctacatatcaggttatggtgtctctagaatctgttgtttgtttcctataagatgctttgctgaacacatagcaaaattcatgtgacggatgataaattgattcgaaaagctggtcccccaggatctaatttcagaatttaccacccaaacccggaacagatgggtttagggctggtgttatcagagctattggctttacgtaacaatattgttcctgtccattcacccagccaaattgtgttaaagaggaaagccccacaaactaaaacagcctttcctagggaagaggaaggggaggtgggctggatctgtgactgattgaaatgcatgcaaataaaaaagacaatattaaagtctgttatcaaaccagacagtaggggagttcaactcgtgatggaaccacaaaaggtcacacaagccaaccatgtcatgccagagtacaaaacacatagttctttccccgccccgaatgtgacaatggttttcatagtggtttaattttgtagcctgacatttatggataactctgtccttccatttgctcacttctctcttcacccatcttttttaaaaacaaataaatgaataaagctgctgtgacacacacacaaaaggaatttaatagtataatatatatataaataaatatatatacagatatatttatcatggtatgtttgatgggatgactgacacaggaaatctgttaaagtcttaaaatggaatgagaatgttgttttaaaagaaaatagcaaaacaacaaaaaagcaaaccttaaaatgtgaagaaagtgtgaattttagttttgtcacagttaactgtgtcaaagagaattaaaaaaaaaaacttcagattttgtttacatattttactacatttttgctggtataattccttagccacctatgtacatactgctttaagaaatgtttttttcctgtttatttctgtttggtttatattctggttgtctttttctttttgtaaagaggaaacaatgtacagaaaaacaataaactggttgtatggccatagctatccgaaaagcaagagacaaagcaagacaaatattcacacaaaaatgaagtgtgtcctctggagggtcagatatacaatttcttttgtacagatgaaaatcaatcagctgcttagatttagaaatctactcttgctggtctttgtaagttgcatgaatatttgactttgaaaaaatatcttaacgacatggggcaaaaagtgcaatctaaatggtagcctttactaatgtgtgtggaaagaggtgttcctcattatctaatatttcaatgtgttaagagtttaatttttttgttatcattaaaaaagacaggattataaagagatatcaaagcacgattttagataacctaaacggcccagcctatacgaagttgattatatctcgatgtctgtaaaagattgctgttcttggagtcttgaggtcttgtgaattgatttcctgctttctttcatttttttcaatttaagtaataatacatttgttatattcctttcagtgtaagtttctatttggacaattttatgggaacatgtgcattctctatgtgagcttctatcatattcctgttttattagcagaacctaaaggaatttatttaatgatgttgtgacattactgctttttcttttttcttttcttagttcatatttgcattttcgttcaaggatatgcttagcaataaaatgttcttcccaa

SEQ ID NO: 2064 - DNA, 585108 bp, Homo sapiens; identical to SEQ ID NO: 2063

SEQ ID NO: 2065 - DNA, 29960 bp, Homo sapiens
attattaaatcactataaaattttattaaatgcatatatgtaaacttgtgttggcaaataaacaaatttgagctgtattcaagcagcgctgaattccttattcttagcaaataatcaaaagtattttccaaagttgaacattattaaatgaaagtaaaacatacgttaagaactagtattgttgtaaatatgtatgcaacagaaactaatcatgtgtacgcatgtgtgtatttcagtatcctgagtaggatacatataccacattaattttactagagattaaagctgatgaaatgaaatgtatctttatgaatgtatatgcatctgcaaatatccatgctacatacatggaagttaagaatttccactggccatttgttcagccacttgagcgttatcttctgtttcctctgattttacaaattccttgataaatttccaaaggccccttaaaatacataagaaatgaataccataggttagaaaaaaatacattaagcatgaaataaaatttcaaaataagcatctattttagacacatttacccaaaaacagacaagatgagactttgtaatcatttacttttttaaaacagatattttgagggagttttggccttgaatgtaacagattctctaaatagatagatggattcccctgtagcatatagtgtggcatgggaagtaggtgtaccatgaacataatgatatacttgagtccattcactttcattgccaaggccatgggaggtgcttccccagttttgtatttgtaactctattccctctttttaagaacacccaacatgatataaggaaccacaaaacctagatccacctgtatggcttgctcagcactctatccaatccctttctcccatggctttttctgccccataagctggagagtggggtgctctatgttctggcctctcttacggctgagagtgaccttggcccatggtgctggccaatgagatgtgggtaggagcacctagaaagaactgtccttcctgaataaaatggaaagcctcaaaatgagaagctctttgccatctgtcattcacatttccctttcttaatccatggaatgcggacccagttaatgcctgaaggcagccatattgagaccccgaggaggcagcagccacactcaaaggaaagcagggaagaaaggtgaggagccctagttccttaatgatgtcattgagcccaagccacctacacctaaaaatctttttcctgttgatacaaataagcctttccctatttaaatcatcatatggttttccattgctcttaataataccacattctgagattcaaactatagtaccaactcaaagaaaagtaactgtgcgaagtataagcttataatgtaaataataatgtttataccaataagtttagttataaacaaatgatataaatcagctacttactttttaaactagaattttcagagtaatatatgcataggagttttcaaagatttaacatcactaaaagccatataattggagaaaataaagccatgccttcccacgttcctgattcctgcccatgtgaattcaccctcacctccagctttatccaataaattcatttatatatgactaaataaagtgtacagattgaggtctaaatcttagactgagcattccaaagcacagaaaagaatgcaacatgtgtatttaatgtaagcattcatgagtgtgaacccttcaaaggtctatctagtctaatctagttttaaataactgatcttgagaacagcatgatactgctctagttcttttatcatgatgtcaatacttactcctgcctctcttcactgatctttcctatgatctgcttcacatggttttcagtaacctacaaagaattacgatcagttggtcatgcttattacacaggacaagcagtcaccagaggaaatatttttattgataaacattgattcacacaaaaaacttacttttattttcttctttaaaatcatattttctgtttccaattgtatagcttcatgctggaagagaagttgttttaaacacaatatacttggttaaaaatatttgttaattatttttctctatttaacaagattatgtgaatgatattataatttcaagagtactcaatagcacattacttaaaaacagatgaagaaacaaagcataaaatgaaggacaattaatgagaaggaaagatcctggtcctcccggtaaaaaactaggagaggaggaaattgatgtttcaaaatatcagaaaattttagggaaattccagaagtgaagggttcttcacttttcagaactaatgatagaatttgttaagggggctggaaaaatataaaaatacaaatatcaataaatcacatatatatcagcaataactgattataaactgtaaggggaaatttttaaattaccagttataatagtaatacatcccataaactcataagaacaaacataattatctttcaccaagttataaaaatacattaagtaagtataaaataatcccagataggagtattaatattgtaaagctgtcactttctcccaaatgcatttataaattcaaaataccaaaagtattattattagaacttcaaaaattaatcaatagtgttaatgaaagtattcaggataactgtgaacaaaataatgatgggcagagggtataaagacttgctctttcagatattacatatgttgaaaagtattagcaattttagtagttaggctgcatggggtatcattaagaaccaagcctgagtttcaatattaagtctactgcttgctaactgtgacctcaatcaagttacttagcatattagtgcttcatttctgtacttcaaaaagaggattaataatagcagctacctgttagggttgctgcaaattaaatgaaattatattttttaaatgttcataaaagtgtctgatacattgtaaatcctcaatacattcagctcttttttttttttttcctggttggaaatagtctatttgaaatctagaaccagataccaattacataatagaataacaatggcaattctattgtattttccagtatttgaattaagcagccaaatataaataagaagtagttaaagtaatataaattagtgatatggaatcttcatagggagttttctatttcttagacttgttttatctaaggaggttttaattatgaaagaatagtttacattgttctgacattatatcatgcttcaatatttaaatttagaacccattactgttttaaaatgcaattataaattgatgcttgtcctgaggacatttattttctgaaagaaataaaggagatcaaaccctaaacaaaaaccgcgaagaaaatctgcagggaggggccaagatggccgactagaagcagctgctgtcagcagctcccacagagaagaacgaaaatggcaagtgaatcctacaccttcaactgaagtatccaggttctctcactgggactgactagggggttggcacgacccacagagagcaagaaaaagcagggtgaagagatggcccacctgggagccgcaaggggaccttccgctcccagccaagggaggcagtgagtgattgtgttaccctgcccaggaaaccatgctttttccacagatctgtgcaaactgcagatctgaagatcccctcgtgagcccacaccatcagggtcttgggtcccaagcaggggtttacagacagaatgtctgctggctctgaagagtctagtcagtctgcacaagggggactcccccaagcgcagtgcacctgctccaccaaggggcagtcagagtgcttcgttaagcactcctgactgggtgagacctcccaacagggatcgccagacaccttatacaaaagcgtttctgttgtaaacaggttggtgctcctctgggacaaagctcccagaggaaggagtcggcagcaatctttgctgttctgcagcctccatttctgacacctccgggtgctagagggaccaaggtgaatagagtccgaagtggacccccagcaaactgcagcagccctatggaagaggggcctgttaaaaaagcaaacaaacagaaagcaacaacaagaaaaacatcaacaaatgagacctcaccaaaaccccatccaaaggtcagcactctcaaagatcaaagatagataagtgcatgaagatgagaaagaattaatgcaaaataactgaaaactcaaaaaaccagagtgcctcttctcctccaaatgatctcaacacctctccagcaagggcatagaactgggctgaggctgagatggatgaactgacagaattagacttcagaaggtgggtaataacgaacttcactgagctaaaggagtatgttctaatccagtgcagagaaactaagaaccatgataaaacattataggagctgttatccagaataatcagtttagagagaaatataaatgacctgatggagtcgaaaaacacaactcaagaacttcacaatgcaaccaccagtatcaatagccaaatagaccaagtggaggaaataatctcagagcttgaagaatatcttgctgaaaaaaggcagacaagattaaagaaaaaagaatgaaaggaataaaaaaagcctctgagaactatgggattatgtaaaaatattgaaactaccactgagtggggtacttgaaagagatggggagaatgaaaccaagtttgaaaacatacttcagtatttcatccaggagaacttccccaacctagcaagacaggccaacattcaaatacaggaaatccagagaactgcagtcaaatactccatgagaagattaaccccaatatacataatcatcagattctccaaggttgaaatgaaggaaaaaattgttaagggtagccagagagaaagcccaggtcacctagaaagggaaatccatcagactaacagcatgcctcccagtggaaaccttacaagccagaagagattgggggtcaatacctaacattcttaaggaaaataatttgcaacccagaatttcataaccaaccaaaataagcttcataagcaaaggataaataaaatccttttcagacaagaaaatgctgagggaatttgtcaccactaggcctgccttgcaagagctcctgaaggaagcactaatcatggaaaggaaaaaccattaccagccactacaaaaacacacagaccaatgacactatgaaggaactacattagcaggtgtgcaaaataaccagctagcatcatgatgacaggatcaaattcacatataacaatattaaccttaaatgtaaatgggctaaatgccccaattaaaagatacagaatggcaagctagataaagagtcaagacccatcagtgtgctgtattcaatagacgcatatcacatgcaaagacacacataggctcaaaataaaggagtggaggataacttaccaagcaaatggaaatcataaaaagcaggggttgcaatcctactttctgacaaaacacactttaaaccaacaaagataaaaaaatacaaagaatggcattacataatggtaaagggttcaattgaacaagaagaactaactatcctaaatatatatgcacccagtataagagcacccagattcataaaacaagttcttagagacctacaaagtctctaataatagtgggagactttaacaccccactgtcaatattaaacagatcatagagacagaaaattaacaaagatattcacgacttgaaatcagctcagatcaagtggacctgatagatatgtacagagctctccatcccaaaacaacagaatatgcattcttctcagtaccacatggcacttactctaaaatcaatcacataattggaagtaaaacactcctcagcaataacaaacagtctcccagaccacatgcaatcaaattagaactcaagattaagaaactcactcaaaaccacacaactacatggaaattgatcaacctgctcctgaatgactcctgagtaaataataaaattaaggcagaaatcaagaagctctttgaaactaataagaacagacaacataccagaatctctgggatgcagctgaagcagtgttagagggaaatttatagcactaaatgcccacatcagaaagctagaaagatctcaaatcaatatataacatcacaactaaaagaactagagaaccaagtgcaaacaaaccccaaagcaaggagaagacaggaaataatcaagatcatggcagaactgaaggaaatagagacacaaaaaaaccttcaaaaaatcagtgaatctaggagatggtttttttgaaaaaaaaattaataaaataaatagaccactagctagattaataaagaagaaaagagagaagaatcaaacagacaaaataaaaaatgataaagggaatatcaccactgaccccacagaaatacaaacaaccatcaaagaatgctaaaacacctctatgcaaataaactagaaaatctagaataaatggataaatttctggacacatgcaccctcccaagactgaaccaggaagaagtgaatccctgaatagaccaataatgagttctgaaattgaagcagtaataaatagtccacaaattttttttaaaaagcccaggaccagatggatttacagctgaattctactagaggtacaaacaggaactggcaccatttcttctgaaacgcttccaaacaattgaaaaggagggactccttaactcattttatgaggcccgcatcatcctggtaccaaaacctggaaaagatacaacaaaaaaggaaaacttcaggccaatacctctgatgaacattgatgcaaaaatcgtcaataaaatactggcaaaccgaatacagcagcacatctaaaagcttattcaccacaatcaagttgccttcacccccaagatgcaagactggtttgacatacacaaatcggtaaaatttatcacataaacagaactaaagacaaaaaccacatgattatctgaacagacacagaaaaggccttctataaaattcaacatccctgcatgtttaaaactctcaaaaaaactaggtattgatgaacacatctcaaaatagtaagagccatttatgacaaacctacatccaatattatactgactgggcaaaagctggaagcattcctctttaaaactggcatgcacaagataagaatgccctcgctcaccactcctattcaacataatattgggagttctagccagggcaatcaggcaagagaaagaaataaagggtattgaaataggaagagaggaagttgaattgtctctgtttgcatatgacatgattctacatctagaaaatcccatcatctcagccccaaagcttcttaagctgataagcaacttcagcaaagtctcaggatacaaaatcaatatgcaaaaattgcaagcattcctgtaaaccaacaacagacaagcagagagcccaattatgaatgaactcccattcacaattgccataaagagaacaaaatatctaggaatatagccaacaagagaagtgaaatacctcttcaaggaaaactacaaaccactactcaaggaaatcagagaggacacaaataaatggaaaaacattccatgctcatggataggaagaatcagtatcatgaaaatggcaatacttcccaaagtagcttatacattcaatgctattcccattaaactaccattgacattctccacattactagaaaaaaaaactattttaaatttcatatggaaacaaaaaagatcccctatagccaacacaacactaagccaaaagaagaaagctggaggcatcatgctgcctgacttcaagctatactacaaggctacagtgacctaaacagcatggtactggtacaaaaaacagacatatagacaaatggaacggaatagagaactcagaaataagactgcacgcctacaaccatctgatctttgacaaacctgacaaaaacaagcaatggggaaaggattccctatttaataaatagtgctgggataactggctagccatatgcagaaaaatgaaactggacccctcccttacaccttatacaaaaaataactcaaaataggttaaatgcttacatgtaaaacccaaaactgtaaaaccctagaagaaaatctaagcaataccattcaggatataggcataggcaaagatttcatgatgaaaacatgaaaagcaattgcaacaaaagcaaaaattgacaatgggatctaattaaactaaagagttctgcacagcaaaagaaactatcatcagagcaaacagacaacacacagaatgggggaaaatttctgcaatctatttatctggcaaatgtctaatgttcacaatctacaaggaacttgaacaaatttacaagaaaaaacaaacaaccccattaaaaaatgggcaaaggacatgaacagacacttctcaaaagaagacatacatgtggccaacaagcatatgaaagaaagctcaacatcactggtcatcagagaaatgcaaatcaaaaccacaatgagataccatctcacaccagtcagaatggcaattgttaaaaagtcaagatacaacagatgctggcaaagttgtggagaaataggaatgcttttacactgttggtaggaatgtaaattaattcaaccatcgtggaagacagtgtggcaattcctcaaagatttagaactcaaaataccatttgacccagcaaacccaaatcccttttgtatatacccaaaggaatataaatcattctattataaagatacatgcacatatatgtccattgcagaactattcacaatagcaaagacatggaatgaacccaaatgcccatcaacgataggctagattttttaaatgtggtatatatacaccatggaatactatgcagccataaaaaggaatgagagcatgtcctttgcaggggtatggatggaactggaagccaatatcctcagctaactaatgcaggaacagaaaaccaaacaccacgtgttctcacttataagtgggagctgaacaatgagaatgcatggacacaggaaggggaacaacacacactgggggctgtcaggagggtgaagggaggtaaaacatcaggaaaaatagctaatgcatgttgggtttaatccctaggtgataggatgataggtgcagcaaatcaccatcgcatacatttacctgtgtaacaaacctccacatcctgcacatgtaccctggaacttaaaatagaaaaaaataaaataaaataaaataaataaatgtaaaaacttagcctgttaaaataaggctagaatcagtacaattatttcatccagtagtatttcattcttacaacagtaaaccatagcgtttcctctatatttaaataattttcttctaaaacaggggtcaaaaaactaatccagtctgcacctatttctgtaaataaagttttattggcacacagccatgtcccccctccaaaaaaaaaaagaaaaagaaaaagaaaaaagaacatccgaacatatgattgtaaaagagaaagagataattttttcataaagaaggttggaccaccaacacctttctatatgctctataattctgctaaagagaataaaagtagtgctggaaaaatatatttaactatagaaccacaataaaaaaaatcatgtatttcttatatactctacaactggaggttacattgagttatattctacacaatttaaaattctgtttttaaattttttaacttttatggatttaggggtatgagtgcagttgtattacatggatatatgtgtaatggtgggctttagtgtaccaccacccaaatagtgtacggtgtacccagtaggtagtatttcatccctcatcccccttccacactcccacattctggagtcttcaatggctattattccactctgtatgttcatgttactcaaaaaattaggttttggctattaacagaaatctatagaatttttttatcactttccttttttcttattttgatagatcttttaattattatgattatttgctacaaacattttgaaataaaaagtacatttgggccaaattttatgatttttttaccctattaccaaatcacattacttcatgtgtttgccaaggtcttcaagcaaaagaataatgtaaatatttaaataaataagttgcgtacctctatgcttttaatcctattctcagtgatatctgaaattccagtatgaaccaaagttgttttaatttctttttccagagcttgtatctcatcccacttactgagtatttcacacctcttcttttcaaccttctcagtaagagtaagtcggttttcatcaattatatgtttctcagatgattctggaaatattttttaaaacaaagtattaccatgtttaatatctcagttattattaatagcattatgtattattaacaatattatgtatgctatagtatatataactataaaatataattcaaactcgaagcatgtcaataaaaataatctgaccccagaatgagggtattcctcctttaattcattcctctaatcaatacatatttgttgaacacatttttgtgcagacactgggctaggtagaaaggttcaatggtgaattagccctttccagagtgtgtgatttagcagtgcagaccaacaagaaacaacaagaaagtgacagtggcagagcagaaggtgcaacggtaagacaaagcaagaacatcagacacagcaggaggaaggctcagggatgactttgccagagaagtgtggctaggttgaaatacaaaggataaagagaagttagacaagcagaagggttttggaagggagcagaagacagaatttagacattgagggacaatcctaggagggaaacggggggcagatctgagaagatttgtgacctatgttaagaaatcggtcaaagatgttgagggcttttaatatgggcagagacacaatcagacaatgatcactgtctccagtgaaattgtgtcctgaaagtggatcagacagcacaagactagaatcagaaagacctgttgggaagctatggcaatcattcacacaggttgatcgggtcagggtatgtattagtctgtttcacgctgctgataaagacatacctgagactgggcaatttacaaacaaaagagatttaattggacttacagttccatgtggctggggaagcctcacaatcatggcagaaggcaaggaggaggaagttccatcttacatggatggcagcagccaaagagagaatgagaaatacgcaaaaggggaaaccgctgataaaaccatcagatctggtgaaacttattcactaccatgagaatagtatgggggaaactgtcctcatgattcagttgtctaccaccaggtccctcccacaacacataggaattatgggagctacaattcaagatgagatttgggtggggacacggagccaaaccatatcagaatagtactcccagcatgaagagaagtgaacaacaacaacaacaaaaaacgatttaggaaatagaaaaagaaaatagaccttagtaattgactagatctggcaatgtagagaaggcaatgtcaaaaataagccctaggttttagctcagttgtagctagaaagaaaacaatgagttcaatgaagcatggaggtaagaaagaacttggtttcaatcccaccttggccacttatttcaagctgtgttggaagaggttgaggggtaggagagtgaaagttgcctggcacatgttctatggctttcatctccatgtgtttggtgataccatccattgaaatagccagggggatgccaatttagagaaggagatgatgagtttaatctcggacatgttgaaatacctatgggacactcaagaggccacgtctaataggcacttggatatacagatctcaagcaaaaaagaagggtttttagcaggtaaaatagatttggaatttaaaaaaatgttaactcttccaaagagatgctggactccaaagaatatcaacatttaaggagtacagaaaggaaatggagacatcaagtgatccactgctaaggccaatttgtcatcaatcaacacagttatatactaattagagtggtgagacttaattttttgagaaaaaaacaattactacttttcgatgggaacaaaagagttagaaatattaataacccttcctggtagatagtaaacaaggtggaagtaacagccatcattcaactttgccaaatttggaagaggagaaactttgacattaaattttgaaatttggggaaattaagtaggcacatgatgagctagctgaggggatagaaatggtcatagttaagcttctacacaaactgaaagaaactacaaaataaagtatttgttctccgccttaacctaagctgaaggtttcagcccaaaaccatcagctgagttcaaagaggcaaaaaggaatgtcaagcccagggaatgacctccacctcacccttttctaccctcaagacataactatagggaaagactgaggtatgaaaatggggacattccacagcaaatgtgtatgattggaggagcaggctcctgagatagaaagctttgggaaaataataaagcaggaagaaccaggggcaccaggtttgttccatcgcaatgaaagggtgatgggaacagtgggctaggatcaaacacgaagaaagattactagagctctggaaagttcgtcactgcatcttatttttattaatctttgccatttttttattagtggctagcagtaaagtaaagcccttaagtttctgcttttttgtttttttgttttgtttttaaatcgtgggcctgttttaagagaaagcaaggaaacagaaaacaccaagcatgggtcctatttcacgtctgtgagaggaactctacaaagaacgaacaacgtggtggaagaaggagggaagcaggtgacctctgagccctgagaagggatggaaggagaagcagagtcagcctgggacagagaacaggcgggacaaggggatgcaaatcaggcgacaagaaacctgtgcaggatccagcagtgttaacagcacccgtgctgctcataggtagaaaagaggaaacaggcagcagggggaaaaaggcggtaaaagcactctggcaaggatcttcgaggccaagctctactaagaattcaaaacaggatagtcctgtgagcatatcctaccagacgctgagaaaaagtatctaaaaacagagtatgagtgagtgtttaacaaacttggagggaaaatggcatttcatttaaagttggaaaacagtcaaagttaatgagcaagatacttaaacttatttttatcatataattgcattctaaattgtatacattcaaaataattttaatatctattttgtaaaatgttaatatctatttcataaaatattcataaaatgcaattaattcctcatgaaatgcgtatttttcctcacatgtaataatgaaaagatgaagaacaaacaggcagtcaccaccacgtgccaggccctgtgatcttgggtgatgtgggtgaatatgttgaattctcgcaacaaaactcagagggagcatcagcatcttccaagttgacagacaggcagccacactgcagcagctgaaataatgaaggtcacagcaaagcacccataaggaaggacatcacacagacacctgcctgatcgttcctttgcagactgcagcaatgccacctccatctccagttcacttctgagtctacaatgtgaggataaacaatagggaaatattagatccccattatatcttttgtcttttgtctgggttacaccacaagtctcttacagttgagaaattaaaatagatctgcttacttttaacacgacagatactctgaagatatttattaaatgacagcctaaatcagtcaagttaaacaaaataatactgtcttaccaagattgcataagcctttaaagagttagttaatttaaaataaatgatttcctgtagaatttattggtattttttgttaatgcaattgctaagaaggaagaaggcaaaaaaaatttaaaaaagataatttaaaaaaacgtagcattttacactcagaggcaaacaacatgttaagggctatggaaagactttcctgatgctgaaatacacggcatctttcctgtgtattattattctgtgcaacagatacgatttacaaatttcactatgtttaaattaaaaataaaatacaagaggccgggcatggtggctcatgcctgtaatctcagcactttgggaggctgaggcgggcagatcacgaggtcaggaaatggagaccatcctggctaacacggtgaaaccccatctccactgaaaatacaaaaaattagctgggtgtggtggtgggtgcctgtagtcccagctacttgggaggctgaggcaggagaatggcatgaacccgggaggcagaggttgcagtgagccgagatcatgccactgcactccagcctgggagacagagccagactccgtctttaaaaaagcaaaaaaaaaaaaacaaaaaaaaaaaaagtaaataaataagtaaataatacaagaaactttaaaaaacagaaaaaaacctccttgtttcctctgcttggttcagagtaacctacatcagctatcttatgttttatagatttaaagagaaaacaaaaaggagtctaacaggtattacatattttgaggacaacactgtgatttgatttaaaacatccacatgcaaataatttaaagccaaatgtctacaaagggcctaacattttaagagttttacacatgttagttcttttcatcacagattaagagagaaatagggtggttattatgaccctcaattttaagaaactggagccaggtgtggtgactcatgcctgtaatcccagcactttgaatggccaaagcaggtggatcacttgaacctaggagttggagaccagcttgggcaacatggtgaaaccccagctctacttaaaaataatacaaaaattagtcaggtgtggtgcctgtggtcccagctacttgggaggctgaagtaggaggatctcttgcacctgagaggttgaagctgcagtgagccatgatcatgccactacactccagcctgggcaacagagcaagaccctgtctcaaagaaaaaaatttaagaaactggggattcaatggattaataataatgatgaaagtcttttcaatatatgtagtaagaaagttttatttccagaaaatttttacatattatagttttaaatattacttaggtttttgttctattgctttgtttttcttcttcagggactttaattatacgtgaattggacattatttgcttatgttctatttcatctactttttctgacttttgatttctgtatctcatttacattcttttaaatatttttctactttttcccaatgcctattatgttttcattcaaaactattcttccttgggtatttcagaatttagtcttgacctatgatataattttgactttttcaactattttttcctcggtttttatcttgttttatttcttctttattgttgttgatttctctccttagtttttaaatttatgactcaagattgttttcatgtcctgaaatgctctttgggaacatgtaatttagcttggagtgctgtgctacagttttcttcttgttcaactttattattactattccttggtaaggcagggactttcatcaggtaaatcatttggattctcattttctgttcttttctcatagtagtttgtatagacaaagattgtttacacctctgcatttttgccagctggactagtgatttggagtagtatgtgagattgctaattcaaatggatacttttccgtcagtgtagcaatttatactattttattattgatttattgtttttttttttcggtgttgttttgatttccttctatagtcctggataccttgcttgtttagaggggaaaaggacagtatgtggaagggttgtgtgcaccctgattttcctttttataggtttctaaactttcctttcttgctccctattgccttcactggacatttctaaaggatgctgctccctttcccttaacccccttctcacatgtattattaccatttcaaagttgtcttctcacttctaccctctcccaagtaaccccaccccaccacacccccaccaccacacccctgccatcatagtcaatgctgccatcagcccagcaggacagttgtgtggctttctcacttatgtggattctctctctggaagtggctttggaacaattttaggcctccatctatctccactgttctctcttccatgaacttttcccaaaacctcacttgctctcacaaacaaagctttgcagcaggaacatggcaactggttcactgccactgaatgttttctttcctattttcagtcatttttaaactttggatgcatttgcaatgaattcagttttttgttgttgttgttgttgttttcgttttttgtttttttttttttttttttttttttttgccttggcattcactttgaacagaagtttaattttctcactccagaagcagggctcagtcaccattgcttgacacagtttctcgtgcttctcctcctcccagtgcctcaaaatggtcagttcagatatctgccttaaacaaccacctcccagggatcacccactatgagacagctaaatacaacctactttcctcaacccactgaccccgcaccctgtaggggccatgagaatatgctgcagtgacccagaaagcactctccatcacagtgtgaccccacagaactcgtgccttcttgccctaaacccaccgatcagaattccccatggaaaacccgcttgggtcccgctctggacccaaacaaaagacttggtccatcggtcctcactctctctcttgctcccctacctgctggtggagcgagtgtgtttcaggcagctccccacttcctaccacccctgagaggtacgctgccttcttttctctgggatccgtaagtaacaaatctgctatttaatgtgctttgttctgtggccttctctgtgcctcacctgatggacacacttgaatgtcaccttttaccagccagggctcccctagagactggctatcttggtaggaataaactagatacacaccagacaacaaccacgagggcttctgccagtatagtcgggtttcttgtgagaggaatatctggtcacaggtcagacacttggacattaagcctgaaggccaggatgaagacacatcccatgaagggtaccctgagaatatcctccaccagcccccaaagctccatcaggggagggctagagttcatagccacccttgtgagagagaccttaagaccaaattggaggccaggtgtggtagctcatgcctgtaatcccagcactttgggaggccgagatgggtggatcacttgaggtcaggagttcaagaccagactggccaacacagtgaaaccctgtctctactaaaaatacaaaaattagccgggcgtggtggtacacacctgtaatcccagctactcaggaggcttgaacccgggagatggaagttgcaatgaactgagatcaccccactgcactccagcctgggcgacagagcaagtctccattaaaaaaaaaaaaaaaaaagaagaacaaattggaacaacaaatacaacagttctctgtcttctggttacactagaagccaaattttgttttttggttttgtttcttgtttcatgctcttgaagatattttggatgttgcagatttcctttaatcttttttcaaatcatacaaagagtatgccctatccaattgttattcgaccccggaaaatgatacagagaggttatattagaagagctttgtaagttaaaaaacaataggggcattcatataaggtgtcttagatctgcagccctctcgcctatcagtcagtcttcaggggaccaccagaaaagacaggcaattccttgagaaacctgcccaaactccccccatggacacaccatacttagcagaatgtcttagtcacataggtgatggcctgtagaaatagccagatgacaggcatgatattagcaaaagtagcatgttttcagcaacgcagaaatcaatgtaaccgtaggcttgtcacagcggtttcagaccttgttacggaagaatctaaacatagatcagatccgtccctcatgcctcacctatcattctgctccagggctgcttttgtggctgtcacgagcatcctcagctcttccctggcgagatccatgtccgccgtcttcaccggcctctgccccagcgccttgagttgagccagaagagcctaggcaggaccaggtacatgaggtgagacaagcacacagggagggcgggaggactccctttcttatttgtcattaatgcgttttcaaggtgccctgggttaacatataagttctagttaaaataggtaaattgggaggatttaagggagggagggccgttgggggagggatggcccatcagtgaagttcccggtaaaatacctttttcaatatgttaaaagtttatttttctaagaaatggaaagatggtagggaatttccctgttggcccgtgtggggggaaggacatactggataaagtcctggaggcacattgtcagtggcaccgcaatcgtttcctctaggtgaatgagaagccatgtgaatgtgcttgccatccgcagatgtaaagcagtgctgtgctcaaatggggagcaacagagatctctgcttcttaggggatgggttgccagggttacagacacagaaagaggcatccagggccctgctggcctgggaattttttcatgctcacatttgaccgagatagggacgtatgccacttatgactcaatctcaaaacgtaaggaacaaggtaaattccccactggaggctttgctcattcttgtgaagacaaaggctgcttctgtgttatgaaaaggctcagcacaaagaaaatggtactcacatcttattttacatgaagaagcaaactagaactgatctccttgcaatgctgtgatcttttgctcatgtataaaagaagcaactatctttcctaatttatgaagtaaaattaatctttaaagtgtattgaattcaaaataccaaagttatcttagctatcttagctacagtgttagattttcttaggttttataagtgataaagttattcctgcagtatattttcttatttgaccaatcacatgtttaacccgaccctggaagggaacacctggaacgctgtcacccgttaaacaaagagatcatggggtttgagtcagcttacagcacaccagccatcacaatgcattctcagtgatttcgccaggacaatggctggacagtggtttttggaaattactggaagagaaccatttatattcccaatttatacatagatagttatgtcgcttgtttgggagtataaataatgctatgccaatcaaaaggaaagttctttatcaataatgttattaaggcagtataaaactcatctataacaaagaacatatcagctattctaaattatggggcacacatggggcttcttggattcagaaaggtttccactgctcatgaaatatgaagctatggataagcaggctctattcaggctctttgtgatcgatcgtcacctcgtactgtgctgcaggctgggactccaggagcgttgccatgtagagttcatattcatcctgtacagaaacaaacaaaagtccactggccatgtatgaggaggccacagtgcaggtgtttcacgtgtataaataatacggaagtcaagaatgttcatttagatcatttcagaaaaatataaaatgttcccacaatgcattaaacggtatacatgctcacattgataaaatcacaccatctttgaagcatatttgagcattaagtattgattacctcagaatatcataaaataccatacaataaaatataaaatattgaggcaatctctgcctcccggttcaagcgattctcctgcctcagcctctgagtagctgggattataggcatgtgccaccacgcccagctaatttttgtatttttagaagagatggggtttcaccatgttggccaggctggtcttgaactcctgacctaaagtgatctgcctgcatcagcctctcaaagtgctaggattacaggcatgagccacagcacccaaaaatcactttcatcatgaaattgcaacaaacctataattccataaggattcaaataacattacacatgtaaagttaaattattaatttattagaattataattaagttatataaaatttataaacggttatgcataattaggaagctttagtgggaaaatatgggtttgaggaatgagttaactgggtgttgattccacatggccccttacaatttacgtgcctgcaggcagatgacctcgagtctctgggagtgatggtccctgtctgtagaagggggcctgtgatacctagcagaatttcagtgcggcttgagatcattcttgtacacagaacctcatgcaagcttctcaactgttatgctgaagatgtatgtttcttaccttaacttttttcaagagatcaccaaatatcaaagaactgttacaaatatcttcaaagacttttccaaagacgtgcagtctgttgaactgctgggggctgcacgtgcaaattttctggagctcctggaggaaaaacagagtcagcccatttcagggtggcttcatctttcttccagaaccgaatttctcaggagtcagtgaggacacagctgccatcaccctggcgagtgggcggggcggcacagggggccagtctcgggggttctgatccctcccaccagttgctgagcttctttgtttccctggtcacccaagatgtgggatttttttaaaaaaatcttttcttctttattgactcccttgctccccgtgctcaagcattcactctccgcctccacagtccccaaaggccctttctctcttccaaccccaaggcctggctgcttcctgggggcctgctattttcttctctttcgtgcatcgtccccatttggaggtgatgcctccagtcagctgttctcctctgagtcggcagcctaccgtagatcttctgtacacatgtgctgcctgggcatacctcagggcgtgacagtgcccatcagctctccctctgccctcacggttcttccaccgtcagccaggcaagccctctctcagacccctctgctgacctacgaacatctgatttactgttgcagccacatggcctccaatgcgtccgctatgggcctcccccagctgaccagttcccagaaggcgccctccttcatttcacccaaactgtccccattgaaggtgctaatgctctcggcacctggtacagtgctgcatcctgcctggacgtatccgggaagcctcagaggacgagcctctcagctcaccgtcgtggctgtccctgacccagagcactgcgcccagaggctgcaccaagagcactgcaccgagaacactgcaccgagagcactgcacagagagcactgcacccagaggctgcaccaagagcactgcaccgagaacactgcaccgagagcactgcacagagagcactgcaccgcgaggtctgcaccgagaacactgccccaagagctatgccccggagctctgccccgagaggtttgccccagagctgtgccctgagagcactgcaccgagagctatgccctgagagctcttccctgagaccaccgcagggctgccctcctcacctgctgcagctttctctcgtggcccgcggccgccttgctcccagtgaagtcattcttcaggagatcttgcttggcgagcacttccttctggaaacgcaggaacatcctgtacctgtctgcgctggtggctccggccaggtaggagctgacatagtggtgccggtccctggtgcctctggacccggcctcctggtagcacagcaccttcaagtcgggcagccggagttcttccctcctgcgccatccaggagggccccgtccaggagggcctcctttcttttcttccttcccctctctgacagcctccactggaaggaaatcctcctctgaagtgtgggaaagagaggcctgggggttcaggtacctgaacagcggggtgtcctgggcctcactggggaccagggccgtgtggatggtgaagtgggccagggcctccttcatcctcgccaccttccctgcgggcggctctcccacctcagaggcgcgctcccccttgggccggtgggcattgggccagtgctgtaagatcgtctccggaggctggtagagcttgttggggttcaggtgtccagagatgtagaggtagacgtcctcccggtggtctttctgaagccgattcagaagtttcttcagattacacagggtcttcactcctggcgtctcgcagtgcttcagattacacagggtcttcacgcctggcgtctcgcagtgcttccacttcaggtacactggtcagaaaagaaaaggaggctcttagggatcgctcttagttccacagtaagtcagctggtgcactggctgagaggcgtagcccctgaccaaaagagggtctatggagaaacagacgaacagagtacatggcccagcccttaaaagtcaaaggcacccgtgcccggcccagtgtgctgctgcagatgagaggcgcccaggcccccaggatgtgcaagtcaacccgaaagctcaggaccgtcaaagccaataagaaaaagacagactatcttgatttggcagagtatttcttacaatactagcaaaggctctgaaagaaaagtgtacaatcttaattataattcttaatgatgatgcttaaagatgtcttctttaacgtatttcaccggccggggaattcagaaagggtttggggggtattctcacttaatgataaactgtctcagcagtccctgactaaacccctcaatgaccaatggcacacacacctcttcctgcagcatccctacagagccaacccccagggcttttgaaccacagttgcctcctctgcaacatcagagtcatcatctcaatcaaaattgttgattgacacccaggtggaaccacttttggcaaagaggcacatggcctagaagagacgcttcataaattctacccatttttgctgcaggtctatagtacaggtaacacgttactgaacacttcagatagaacaagagcagcccagatttgcccccttcatttgctgttttctaacctaagaaggagagtttctttctgggacactgtgtactgtgatggccaaagggcagcaggcccatccataccctcctcagagaaacttcctctgtccattgagaagcaaaccatccttccctgagtcaaccaaggcggctgaatactggagccaatattttcagcagagggatgctagagaatcgccgctgttgatcagcttagtccttcagagcaaccacttaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagatctgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaaggataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctccatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaactgcttcaaagagaataaaatacataggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcaccaagtcaatcctaagccaaaagaacaaagctggaggcatcacactccctgacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaaggattcccgatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggtgaaggacatgaacagaaacttctcaaaagaagacatttatgcagccaaaaaacacatgaagaaatgctcatcatcactggccatcagagaaatgcaaatcaaaaccactatgagatatcatctcacaccagttagaaaggcaatcattaaaaagtcaggaaataacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactatccacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaattataaaaaaaaaagaataatattcatagaaatggaatttctaggtgaatgcaaaaaaaaaaaaaaaaaaaaaaaaaagaaatgattaacagaacaaattctccaaggcaacaatcattgtaattcgtcaaaggcatgaacacttaaagctctaaaaggcaccttgtaccaactctatggaagatggaagaaggaggcgacttcattgctgttgtgttatcctttgtttattttatttccaagaaggatttgaagccatcagcaagtcaatcaacacaatcattttcccacttcaaatgctttttcttttgattgtagtaagagctgctccagacagaagtttccacttctgtctgccacattcttgtaatatatgccatgaatccccatcgtggcaataaatattttaatcattttcccatctgaaaacattgtgtgtgtctgtgtgtgtgtgtatcctgcctctctgcctgagagagaaaacaaacaaacaaaaaagaaagttttaagaatttattggaaattatgactctcttacaaagatttgaaaacaaatttgctgtcagtaaaaccaaaccaagttttgaatgtgtactgaataggaacatgtagtaataggtcttaggctacatttgggttaatacatattgccaaaatttagtattaaacatttttaaacagaggttttttatttgtttgtttctttggaaatgtatccatccccccaccccccccaccccaccaaccccagaataggacaataggcctttaatgtcaaaattattacaactcaggctgggtgcagtgactcacgcctgtaatctcagcactttgggaggccgaggcgggtggatcacttgcaatcaggagttcgagaccagtctggccaacctggcaaaaccttgtctctacaaaaaatacagaaattagacaggcatggtggcgggtacctgtaattactgatactcagaggcggaggcaccaaaattgcttgaacctgggaggtggaggttgcagtgagtcgagatagcaccactgcactccagcctggacgacagagtgagactgcctcaaaaaaaaaaaaaattttttttaatcactgtcccatgttgtcagatctctgggaaactgagaatcccatggaaattctccttggtctcattctagaacattcatattccctctgcgtttctgccctctgccttctctgctcctaccctaaagtcagtgcacatcctaagaaatgtacttctggaaagacttccaagaacagagcagcaggcccagacccacaggctctctgctggaggagagcgggagcctcaggacaggcctggccagtgggggtctgtcctcgagtcctgggctcccctcacagaactcgttgcagaactcacaaagagcgtccatcactcccctgtgtccatcctaccagccggagaatcttttcagactccactgagattgcaatctggcctttcctgaacccacggataaacatctgttgccccacgctgcactgtgtgcttcaggggtgggatgaatgtgagcccccaggaacctggaaatcccacagggagtgagatgcagacccagggccacaggggacctgagcccaagggagaagcacatgcctcacatggactctgtctcagggtgaaatgtggaagcagaatgatgggacccagagctggccaccctgacgccagaggtcagggaaaggggactttaccagctgaattcaggtgatgggccttaaaataaagtgattagtctggatggtcagggctctaatctaatcacgtgagcccctaaaagcagagaagtttctctggcaagagtcagaagggagaggtggaagaaagggggtcagggaagttgcaaggaaaggaagcttccagactcgctggatcccaggtggaagccacaggccagacaggaggcgacttcctagggccagggcccctgctgacaacccacaattcccccaccacaagcgacagggtcatgccaacaagtccactgggcctggaaggggttcttccccagatcccctagaaagcagcaaaactgaccttaccctcgagtccagcctggtgacagcctgaagctctttgtatacaaagaagagaaaagacaactccccaaggactgaaagacccctttttaaaatgactcccactgtctattccacagccggtgtgcggcatgctgattcaatccccacaacagcccaggaggtaggcgccgtcccatcctcctttacaggaggggaaactgaggttcaggtggtcagatggtcagctgcctccaagaccacgctctcaacctgcccactcacctgtacatgaagagcactaaatgcattctgatatcacacaataaaatttcttttaaatcattttcttgttgagactgctttgctcagtctaacaagttttctctctgcccaaatttcgtctgaatcagtcggtagtcctgtttcagtcccagcacatggcgggtggtgggaaaaagcgaaggcttcgaagtcaaaagacctgggcttacctccccacagactcccatgcgtaaaatcacattaatagcaccagccttcagggtcacagagacaaaataaaggacttctgacttgatgaatgtggacgcgctgagctttgtggtcatttataggagcgcggaaaggcagcatgccagggaatgctctgaagtgcggctttttaaaatcaccctctgaacagcctgcaacctgccgcttcgtccctcctcctcctcctcctcttcaggcttccggagactccaacacacggcgcgtccgtccgcgcaggtccacactcgctggctcccacgcccacatggcgcgcaccccccacctctgtgctttgcgcgctggtttcagattctctgaggaggcagcacaaccccaatccagtcctcagccctagtgaccctggagccggcgtgcagccaccagaaaaagattttcacatttcaaatcagtcttcagaagcccatccctccacaattgaacatcaagcaaatctcacaagccagcaagagccgctccaggccacttacattcaggctcccgctcctccgccatcgcttccttccctccagctgcctgggctgggctgtc

SEQ ID NO: 2066 - DNA, 53145 bp, Homo sapiens
gcggagccccctgccccggcagggggatgtggcgatgggtgagggtcatggggtgtgagcatccctgagccatcgatccgggagggccgcgggttcccttgctttgccgccgggagcggcgcacgcagccccgcactcgcctacccggccccgggcggcggcgcggcccatgcggctgggggcggaggctgggagcgggtggcgggcgcggcggcccgggcccgggcggtgattggccgcctgctggccgcgactgaggcccgggaggcgggcggggagcgcaggcggagctcgctgccgccgagctgagaagatgctgctgtccctggtgctccacacgtactccatgcgctacctgctgcccagcgtcgtgctcctgggcacggcgcccacctacgtgttggcctggggggtctggcggctgctctccgccttcctgcccgcccgcttctaccaagcgctggacgaccggctctactgcgtctaccagagcatggtgctcttcttcttcgagaattacaccggggtccaggtgagccgcctcccgctcccgggtctcggcgtccacccgagctcccgggggcgcggacctctccgctcccccacagctggcgagggtcacccggccggcccggcggacccagcacggagagcacgtgccgcctccccgccttcctctccgcatgcttcctgccgttctgccgagatcgctctctaggaagctgtggctgcgtcgtcctgaggctacgagtgggacccgccgcccctttccccgcccctcgcctgggtctgatgctgcttagcaaagtgggtgcagatgcacgttttaaataatagggcacgcgtttagcagtttctggcctttggtccaaagaggtggtcatgttggaacagatcggagacgtctacactccgaagtgcgcttttacagtgacctcttgaaacagaagtacaattcggtcttgtgttctttcccctggacaagtgaaagctgggcgaagaaatgaatacatttgttaaccgtagaagcctaactagatacatttcttgccaactttaactgggcttgaatgtgtgggtgatctgttgtctgattactttctttctgttactgtttctctgtagagattggattcgtagattaaacttgagaaacaaaccataaaagtggaaggccctctttaacagtaggtatttgaagtgttataaaaaaaaaaaaaaggtgaatttttcttttatttctcagtttgaaagaacagctttattcttggttattcctaatgtccacctagtcctcttttacttttcttggtagggttagggtggcatggggaaatgggacggtatcattttgtctttttaactttttttttttccacctacagcagctgtttttaccctgtggtcagtcaggtactatatttagtttgcagttgcactgctgatcgacccttgatggccccagttggaagttgtttggggggaaggaactaggagaggccagggcctccatttaaaccagtgtctgtaagtgtctccttggaaagaaaaaaagatactgttccaggtcatggtttcctggtagttgacgtttaaaatgggcctcatttaaaaatttcaataattcaggctaattttttccctttatatggtaactccaccaagtttgtctaaatgtatgatttttatcatgattaagtttttacttccacatcatgtgacaactggcctgggatgggatataagctcagaacacaaagtcattcacctcttaaaaaaataattctatctgtggcgggttatgttatttttgttcaaagaggacacaatatgatgcagaatacaccattgaaggattttttggtttggcaagttcttatttttttaaatggctgtaaaacctagcagtgtttctgaaattgcataccttacctgatgttcagagatccgatttacttcttgatttcccagcaagtgattttgaaaacatttaatctaatcattccccccaccgtctgttcaaatcaaaggaagtggcatccagcactaattttcatgcatttatgaaaggatgcctgaggacccttaagtataattcaaaattttgtttaatgtgtgttccttgatgaagttctttaggagtcgtagaacgaactgattgcccactgatcatcaaatgcaagttatgaacatttaataaaaatttaaaaccaagagtttcttgttcctgcatttttatttttattgtatggaggggacaaataattattttctgtttagtaacagagcagggtattttgaatttattagggtctttttctgcaatctgggtttcctgtgtacacaaagctacctttcaatattttttattgtttctgttaagattaaatcaatagaggaataaatagctatcttcaaacataagacccaaaggaaaaagatttatagtgatgttctgtcaccttattttttacctgtgactttgtaccattaactttgtcactgagatgttttgattaaaatttttagcttgcttttcttgttttgttaggacactctttttttcttgaattgtttttatcagctttcgtttgcaaggctagtgatgattctcttgttctgtataaagtattgttgactcatttctgaagggagttttagtaatttaagaggttataagtttttaaataaaaggtttattaatttatatatattaaagaggcattttaaaataaaattttttttaaatgacatttttacacctttcaactctaggtttaaaaaataagtggttcacagtagttcttgcagaagaatattttcttttacatagaatttttaagctgaagagaagtagtagtaggtccatgagatttatgatctgtgcttggcaggtaaacctgcttccaacaaatttagttggatttttcttggattctgggtaaatacctttttcttccccaatttcactactttattttcatatgtatctctgagatagagaaatatttcagtcagtgctgctaaaattgttccttataactcgtttatccttttaggtccttccagaatctctcattggtactgaaactcaaatgggtactttcttcaccatttatttctttagaataagtaataagaattttataagcttttttatatttcacgtaatttgagactattgaaaatccagttaagtctctctactgtgttgagaggcattgattcaagtacctgtgttactttcctgtgctgccaaaacagatcacctcaaactaagcggcttaaaataatagaacttaagttctcgtgattctggaggccagcactttgaaatcaaggtgtaggctcaattttactccctctggaggccctagggggaatccgttcttgtgggtttcaacttctggtgactggtggcattccttggcttggggccccatcactttaacctctgccttacagtccttgctgccacctcttctgtctcacatctcactctccctttctcttagaaggatgcttgtcattgggtttagagcccacctggatattccgggatgatctcttcatctcaagatccttaattataactgcaaagagcctttttccaaataagaaaacattcacaggttccagggcttaggatgtggacacattttttgaggggctgcccttcattcccccacaacaatgaactccatagttctgcctattcagtattttgtagttatttcgtagtttaacttgccttatttctttaggtatttacgtattaaagcattttggtctctgctttctttaacagagaacctggttttctgtaataagtttacttactttcccataatcttttagtttcttatttacagatttaccttcacatatcccttaagtagaacatttgattaactgttttattttcggaacaaatctgcattctgtataataaccaacttattcatatttcggtattcttttaattcttatctgattctgaaattaccatcttgtgattatatatatatatatatggaaataactgaaatcctgataaattaaaggtgatataacttctaagacaattaattatgtatgatgtggtgaatatactggtgtttggtttgtttgccacttaaaagccctatctataggataggaagtaacttgaatgtggaatgcttagagactcagagtaagaggccgtatatatatccttgagctggagtttaaggaaaacttatgggaaattaaaaggaaagttggagtactgacagaggattgggtaggactcatgaaaaaggaatgaagttaccttaaattctatcatcgtgagttaacgtgaaactagatttatgttagtttatagcctagaattctatcctaggaatctagatatatcctaaatgttgagatagctgcataaacaataactgtaatcgttatgataaataatgacaaatctttttagcatgttctgtgaagctgataaatgttaataggatgtcttcaaatgtcagaattcttttttctttgcttcttttttaaaaaatttcttttcccccattcctatgcaatacactgaaaactgatcattgaaatttgtaggccaaaaaattaatcaacacgtaatagattggggtttgggtttttttgagtcagggtcttcttctgtcacccaggctctggtgcggtggcaccatcattgctcattgcagccttgaatgcctgggttcaagtgatcctccggagtagctgccgtgccattatttctagctaatttttaaaagtttttgtagaaatggggtctttctgtgttgcccaggctggtcttgaattcctggcctcaggtgatccttctgccttggcctcccaaagtgctgggattacaggtgtgagccaccatgcctagcccctaataaatattctaattaccgatttatcttgcttaaatcagttggtaacacttggaatttacttcagaatatattttacattagtggctctgactgctaattcccccttctccaaatgctaatgtaatataacaataaaatgcacagttcttaagtttatataaaataaacaggttttcagttgacctgctttaagtgtaaaatagtgtgaaaaacacaagaaagaagataaagaatttaagattttgacatttctctaatatgcccttaacttctccaaggattcatacttttttttgtaagacagaatctcacactgttgcccaaaccagaggtgcagtggtgcagtctccactcactgcaacctctgcccccgggctcaagcggtcctcccacctcagcctcctgagtagctgggactacaggtacacagcaccatgcccagctaattttttttttggtattttttagtgggggtagagacgagattttgccatattgcccagtctggttttgagctcctgggctcaagtgatccgtccttgatccaccatgcttagctgattcatactcttaactgaaacattgttccaagtttctcagaaacagtcaaggctttttatctagagaacatttataactggatctttctttgtgtagcactgattcatcaaactaatcctaaactcctaatgagttaaatttatattctgaatcttgctgtaaaagcagccattcattagaatgaaacatgtttacttagaattggagaagggagcttataagtcatctagtctactcccttttatgacacttctacattctttctgcacttctgccaaaatgttgcccagcgtcgtctctgatacctatagtcctaacaagaatatgaatcataccttgtatccttaattttactcttctctgcttatttgccattcatgtgaagaccttaaatagatcttaaattgcttccttcactttagctgagagtgacaggactgtgtaggtgtgggtgtgtttctgcatttgcttatttaagcaggataataaaaacttttactataggaaattaaacatttcccaatcaaatacaattccagtctaacacaattaaattctggttagggaactgcttaacttactagacttataggaaaatactaaaaaaatgtaactagaactctatttttacactttataaatataaacctctgtgaacaaaccagttatttcaggttgcatttgtgtatagttttttaatgcctgatttttctattttaaaatcacagatgcaattatacattcaaacactgccacaatactttgagaaagttaaagtttcccctactcctacactgcgtacacctttcctaggtacatcccagtttggtgtgtaactttagatttcttccaagagcttttgagtaagtgtttgaattgtgggaaggttctttagttaaatgaacttcttacagatcagttttttagtacagtagcacgaaatatacctgcatacctatggggatacctctgtgccattacgatggaaggcacgggaaaacagcactccgtatatacctagtttactttccctcttttgtatatttgtctgattttgtggagctgatgcttctcaagtggaatcagaagttaacttttcctttactattttctcattttattatggtttcttaactagaggttgatgttagtggttggaccattcaatagtaagtaatgacttttcagtaagggatctctagaacccagatcccttaattcctgcaatattcccgtgtgtacattgttccaggtgctgtcctgggtaccaaggggtacaatgtttgatagacaatgtacctgccattatggaggtcacattctagtgtgggaagacaaacaataacaagaaaatgaaaatttactgtgccatgccaggttgtttagcctggtgggtgagaggtaggggtttggaaaatcttactgagcaagtgacatttgtgtggagctctgtaaaagggccagcttggaaggtaatgtagtcatccaggtgagaaatgatggttaggggagtggaaagagtggatgttaagattgaaaagaattccaaatctattttagtggtagctgatagggctttgtgattgaatgtggaggaaaaagaagagggtgggttagtaacacactcagtcgcagttagtgagtgctgctgtgtgcaagtattgttctattatgtaaataattccatctttacaaagtaggcaccattcttcctcttttacagacaaggaaaagggaacacccatggttcacatctgtagtagcctagccaggagtttcaggcacttattttctgaagatgctctgcctggcaatgtggttatattggttgaaatgagaccccctactttcaaggtattcatctaggaaagacatgaactgccaattacaatataggataacactgaaattagagacgtgtttattaactttgccatacagaggtaaagtaactctttaaagtaactctttgcttgggttagtggagaaggctataaaaattacttggagtttttactttgaacatgcgtaattaacatggaatgtttagggaaaagaggttttcaattgataacataataaacatgaggagtttgaagcatggcattcaaggttttctaaattctgccccggttaacttttccattcgttggtttcattctagtctagcttttccttctgggccgcccctccccacattagaccgctcctctctggaattccaactcaagcccttgcttttctccatctgtcatgatgttaccccatctcattgtcagggtaacttttatgtaatattaacatatataatactgatataacattagcatattttaatgtatggatcatctcctctgcaacattgtaacctcttggagatggcaataatgggaagaatgacttgattttactttttcttttaacaaaaatggtggagtagtctgggcacggtgtggctcatgcctgtaatcccagcattttgggaggccaaggagggtggatcacttgaggtcaggcattcgagaccagtctggccaacattgtgaaaccccatctctaccaaaaaaatacaaacacttactgggcatggtggtgtgtgcctgtagtcctagctactcaggaggctgaggtgggagaatcacttgaacatgggaggtagaggctccagcttgggcgacagagtgagaccctgtctcaaaagaaaaaaaaggtaaaagggccaggtgcggaggctcacgctggtaatccaagcactttgggaggctgaggcaatggatcacctgaggtcgggagttcgagatcagcctgaccaacatggagaaaccccttctctactaaaaatacaaaattagccgggcgtggtggtgcctgcctgtaatctcagctacatgggaggctgaggcaggagaatcacttgagcccaggagacagaggttgtggtaagccaagatggcaccattgcactccagactgggcaacaagagcgaaattccgtctcaaaacaaacaaacaaacaaaacaaaacagagagaaaaggcagagtactctagggaattctagtctgtgtttctgtggaaatgtatatgaatctcacttttaagggatggagatttttgaatggcataactagttgataagttttgctctaacagggtacccaagtctagtgagtccgattcattctttccttaaatagatgaaggaggaagaaacatgactccaccctcaagagtaaggcagaatgagcaaagtcagagaagttaaaaaagaattctcacgcagccagcagtgcagagaaaccttggtttagttgtgaatcaaaaccagtactttttgtaatttttgagcctatgcaattctccaaggttttatgttgtttcttctgtttctctgtaggcaccagaaatcaaaaccccaaataagaaagtgttacttgaagattttagagtacttatttgtgtataagtgtaagtaatatttggaagacgactttactgcgctcctccagcttggcatgagaattccaggggcggaaagaaaggagggtgatggtacctggaaaggagagtcatgttaagtcccagccacatattaagtgctaaccacctactgttaaaaggtgtaatgttctagactgacaaaatacatagtctctaccgtaaagtaacacataatttagcagtgcagaaagatgtcacttaaaagaaaacttgaatatatgctgagatagttcacaaattaaagaaatgaacaaagaactgaggaaataaaggaggaatacaactgtgtccaaatgaatacttaactgggtgggagctgttgcatatgtaagcaggtggttcacctaaaagttggatgtaacgtagttaacgccagctcttggtgcacttacatattgcattgcttccgggcttaatttgtgttcatataggaataaattttttgttggtttttaattttactccttgtaattccgtagttgatattcaaagtgaaaaaaattacataagcttctaatatatgagaagtcttctcacttgacattttttatttggaatttttgcagagagtagttttgtcacagtcaaaagattttgggatcttgcagtgagaaacctaggtgtaattcctatttctctgccattccgtatgtcatctggattaagtgtcaacttctcagtctcaagattctcgtccttaaatggaatactttttgtcatgctattttgaagacaaaatgagataatacgtgaaactgcctagctcagtgaatggtacatcatagatactcagaaaaaacacaccctctaaaataagaacagtaccaaaagacaggatgtaaaataagggcagtaccaaaagacacatgcatgctgagtgtatgagaaagaactttgtggccttcttgggtggcacaggccatggcagttccacagcatgacgtggttgctgtgggtggtagagcagacatgccgctccccgtcactgcctggctttgatgcttgctttcttcagctgagaggacgcagctgtgatatgaaggtcttgtgtgtacagtcgtgacctcacatttccaatttcctgctggcagaacccacagtctacaacgtacgagcaccagagttgacgtgagacagacagcatacagaggcttgtaacatccttctggaaaacactgtgtaagctttcagtgcgaataaacatgatcagtggcaagttctgttagatgtagtctgcaagcatcctgattttactgggcaagactatgttgatttacaggcggctgatgattccatggatagcccactactagtatttttacaaatttcacaagacattcttactggaagattgccctgttcttatgatactgctgcccttttagcttcatttgctgttcagactaaacttggagagtacagtcagtcagagaacttgctaggccacctctcaggttattctttcattcctgatcatcctcaaaattttgaaaaagaaattgtaaaaattacatcagcaacatataggcttatgtccttgagaagcagcagttaattacctaaacacagcaagtaccttagaactctgtggagttgaattgcactatgcaagggatcaagtaacaataaaattatgattggaatgatgtcaagaggaattctgatttataacaggctatgaatgagtacctttccatggtcgaagattgtaaaaatttgttttaagtgcaaacagttttttattcagctttgaaaatgacttgcataaatctggagaaagattatcaggatttaatatggtgaattatatggcatgtaaacatttgtggaaagcaagtttagaacatcacatattcttctgtttggacagaccacttccaactagaaagaatttttttgcacattattttacattaggttcaaaattcctaatgcatggtgggagaactgaagttcagttagttcagtatggcaaagaaaaggcaaataaagacagactacttgcaggatcctcaagtaagccattgacgtggaaattaatagtttgggaagtagtaggcaggaattcaatatctgatgaaaagattagaaacataaagccttccatcacaattcccacccggaacaggaattcctactcatcaaaattctgcattcatacaagagggaacctgattatgaccatcttctgttggtcatttggtagattatgtggttcacacttcttccaaatatttgcaaatcagacatcaccattatcagcacaagctaatagcatcattcgggaatcatcactattacaggacacccctggagatgggtagcctccagctttaccacccaaacaagctaagaaaaactgttggaaccaaattcattatttacattttcaacaagatctggaagatcatattaatgaaacgttgatgttctatcttctcttaaaaaatctgctcctaatggtggtattctacatgataatcatgttctaatccgagtgaacctgacgaaaatggaaggtttggagtcaatgcaaagggggatatgatcagaagatgtctgtgatcgtgtcctgagaagcaccaggaacacctttgacctcagtgactctcgattgaagagaagaccaagttgtattgatcagtggttgggactttacagaacacacccatgattggattgtcctgctttttaaagccaactgtgagagacattctggggaactcatgcttctagttctacctatgctgcatatgatgtagtggaagaagtgctagaaaatgagacagacttccagtacattctggagaaagccccactagatagtgtccaccaggatgaccatgtgctgtgggagtcagtgatccagctaaccgagggcttatcgctggaacattctggacacaatttgatcaacttatcaaaaaaaaaacttggaatgacaatttctggtgccagattaccttagaacctttgcaaaaatagatagagatagttttccttatgatgttacatgggttatttttaaaggtaatgaaaactacatcagtgtaattccagcatcataagtcagaacagtgcttgtcaaggggcgttaccacacacttgaacagatttttggcagatgacttgggaacaaggctcctccatgtttgtaatgttgaccacacaagttgaatgtggcagagttaaatgaccccaatattggccagaacccacaggaagttcatcctatggatgctaccaagccttctgccactgagaagaaggaagcactgtctttatcttcaggaagatcacactgctgtttaaccaagagaaaaattagagagtcatcaatcacgcagatccagtacagagggtggcctgaccatggagaccctgatgattcagtgactttctggattttgtttttcatatgcaaaataagagggctagcaaggaaaaaccccttgttgtttcttgcagtgctggagttggaagaaccagcgttcttaatactatggaaacagccatgtgtctcattgatctcattgaatgcagtcagccagtttattcactagacatggtaagaacaatgagagagcagtgagccgtgatggtccaaacacctagtcattacagttttgcgtgtgaagtactattttgaaagcttatgaagaaggctttgctgaagaaagcaaaaggaaaaaaagaactttgtcatctgttaggttccatttattgcatgataattgtgtttgtattgattattgggcaagtagctgtttgctattttgatcttatttcagaagggcataataattttactattcaatgaaacgttttaaacggggtagaaaaagactagtttttgtatgctttacagcagaaatcttataatgattaactggtaatatatttcgttggcataaaaatacatttaaaagttcaagtaattataaacattgtaaattgtatatgtaatcatattgaaattgaaattctttatagctgtacttctgtgtaatcaaagactggggagagatagactagctagctctttctcttatccattaatcacttaacagagttttgaataaaaagttccatttcatgggataagaataatgacaggttaacctattttagttggttactatgttctaggtgttgtatgaagtagtttacatagtttcactgatttcactacaatcccaggaggagtagttactattattacactcattttacaggcaaagaaataggtttggaggggttgggtgttttgcccaagttctcatcgtaaaatgacagatgaggattcaaattcaagtcttaattgaagtccattactttagaacctacctcttagtggctcttatgttacagtataagggagagcagactgttcctttacccttgtagggtagctagggcttgtgaattaagagactgattaacaggagaagaggcatacacatttttttgacgttagtatttttacatgcacagggaaggagggttttatttttatttttatttttatctttattttaaagagacaggggtcttgctgtgttgccagggctggactcaaactcctgaagccaagcgattcttctgcttgagattcctgagtagcagggactataggtgtgctcctctgtgcttggctaaagaaggggtttgtatgtgatttttaacaaaggctgataaattgtgaaaaagtgactagtcaaaggagaagaggatttcagctcccaggggtggtaaattgtgggaagatgactaggaaatgtatagtaataaggtttgctatgcaggtttattttgccagtttctggtctcctaataagggacagggaaacacctttacagatggaaattcatatcacctttccacagggaaatttatgtcctgccttaggcagttaggggaagggcagagaattcttcctgtatctgctgtgtctcaggtgccttcagctcaaaataatccttatgccaaagtagcatatttgggtgtggcatattctctgatctctttcaacagcatcatctatacttaacaacagcaaaagttttttttaaaaaatcatgtttcaagatttgcatgtggaagacaaatggacatgattgagataaatgaagaatatatattttttaacaaagaatgctgtatatttatgtctctgtgacattgtgttatggaggctaaggtgttaagcatgtgattactttagatgccgtatgactacctgtttttaagattaaaaaagaatcaataggcagtttatatgtcatgggagcaagttaaaaacaacacagatgtgatgaaggcgaggtgaaactggtccgcatctaattcaggccttctcctgaaagccagtgtgtgcaagataaataagtttttttgacgaaagcagaataactagtttgtcctttgtgatgaagatagttattcagaaatcatttttattggctacctctgaattaataaatgaaaagagaaatttttttttctgtaggggatgtctgatgagttcttaaaaagtggatgaacctgaaattatcatgaacaagcaatcataatgaacttaaaattacttaaagagttatgaaaaacaaaaagaaaagccgtatgttttcttgtgccttattttgaagtgacaaattatttgcagggtacatttgtagacggaactaatgtgatttaaaaaatgagtactagatttacagaatgaagcctttaaaaagtcactggtgcactttaattattttatttatgtttattctgaaactacctttattttgaaaatgaggtatagctttgcctactggtgacaaaagtgtaaataattcagtaaacatctgttaaaaaccagcttggtgctaggctcttggggtagaaaactgatcaggccattgaggagctcatagtccctaaggggctggggacttgtcattaggtgtgcagtgtgttctggatgctcctgaaggagtgtgggcaggtgcgcaccaccatgcctggctaatctttttataattatgtagagacagggtctggctgtgctgcccatgctgggtttgaacttctgggcttaagagatcttccctccctgcccctaccgaccccgcccgcccactccacctcagcctccccaaagcactgggattgcaggcatgggccactatgcctgggctgtgcaaaacttttaaatcagtgcatactcaatggtcttgatgcaattctggcttgttggtaagagaatggggatttactcacaagccacgatgtcacttttaactctgaacagatcaagctattggtattactcatttatgtcatcgataaactttatgaataaaaactcattgtgcaaatgtttaaacatactacatacatagcactgtgcagtttctaaggaaagtaatggaaacctttgtcacatccctggcttccagaactttatgttatctaagtgcatttgtctgcaaagttgttgggttaattgcccctttctttcttctctttttaagatattaataaatagtgtcatgaccaaaagataatccttatggacaagatagatctaaaaagccttagctaatttataatcttgcataatccatgatgacaagatgcagaaacaaaaatgcccagaataaaaacttagcaccattagcagccatttccttttaagtctttacaagtatactcccagtttcttgaaaaatttattctaaaatatgtaagacacacaaaacagcagaaggactaatacaggtacatcgaacacctgtgtgcctaccgcccagtttaaaaataaactggaatgatgtttctctcatacttacagaataaagttttaatctttagcatggaattcaaaagacttctgccattccagttcagagccacccttctggtctccttgctcctcagccgcgacactgcccatgttcccaacaggcctccagggttactgcttccattcgttcttattctcatgaacattttccttcatctcatctgccagaatcctacctaataatactcctgctctgcagtttacagttctttaaaattaaaaaaggttgtgtaccctttagtgtcctgaaaaaagaaaaaacaaatttaaaaccttaaaaaggtaccatattttcatagtatttgcgttatgtctcattacagttcctgtggacatgtctgtctcttttactagattgattgtgggctctttgaaggaagatatatcttatgaacagtgttttatatattgttagcaatcaatgaatgcttgctatatttttctcatgaggatattgattattctattttaatttattaccgttaacctgtactatacataactgctttctgtacctgcgctatttatgatctctgaggctcctgtgagaaatctaatttttgttaatcatggatggaaatattcacaacatcattcgtcagtttcttcacattgtcttcctttgtatattacagatgttttaaaatatcaaagtaatgtttttttgttttatcttttagatattgctatatggagatttgccaaaaaataaagaaaatataatatatttagcaaatcatcaaagcacaggtttgtatttcatttgcatgaaacataggtttttctacagatggcacatgggcattcaaaataccgttcttatatttaaatgaagtgggttttttaaaacagcaattttctgtgcagatattacacctgttcttgtatttttgtgattttactttttggaaagtcagaaacttgaaagctatgaattttcctaaacttaccttctccctctgttggatgtaagtaagctatcttcttacttgcttgctttgtttttcctttgtgtagctctttaaagagtgtattcattctttttgtaagtgatgtttctagaagtagcattggtgggtcgaagtgtgtatacattttacatttttgattgctaagctgcagaaaagctgtattggtatgtaagtactcgtttccttactatgctcgtcatttctagtgtctgctcttcctttccttcttcaaatgggtttggtttaattctagttgctactgttccatcagaggaattgcagagaactggtcttcaaaacagtgcagtatatactttaggtgaagatacttctaaaaacctttgtattttgaggtaattctagagtcccaagaatttgcaaaaagagtacattgtcagcaatatttttcccaatggtgacatcttaatataactgtagcacagtagcagaatcaggaaattgtcattgggtaaggtactttttaattctccaaataattcagccctccaaaaaaatcccacttcttatgttttcaaacctgtagctacttttgatgcgtacttcctaaattgcatttttattactttaaaaaatataatacctagaagctcaaagctggaaacagcctgatcaatatagtactcttaagctaaaaacaacctgatcaatatagtactcttagggaaatcacttatgcctgtggctttttttaaattttcttcctgtcagctgtctcttcatgattttgtggtttttattactgcttataccatagatgaggtatagaaagtaaaagaagttaaaatgcatttttctcaatttagtgaattaatgattacattcagatttataggacaagggttgaagctacaaggggttgataggaatcttgatgtatctgagtattttccccaactttattacatgactggttcagactattttatctaattacatttcactcttggcaaaaatagcaaaacagtcaaccaatggtcaatgctgctgagaactctggcctgtgcagacatattggctgttttacttctaataccattctgcttttcctgtcctgctgctgatggatgtttcttccaggttttaaatatcaaacaaaagggatctgtgggcccagtacagggaatggctcttgatagatttgattttcctgcatttcctttattttgatccagtgttaatttcatgtagagttgtctgtttaacaggattctcttaaaattccttcttcagtttacctgccagcttttctttgtccaggtttcagtatgaactccactcgattaatagagctctctagtagtgacttgtggagtgggttctctgaacatttctggaagtgttgctgatagtgataatattgatcactagtactgttaatttgtgtgcttactacatgttggcttttatatgtattccttcagattaaggacttctagaaaacatccatgaaaaaacagattaaaaaaaacaattctgcatgtatttgggactagaaggtactatgggaaggataatcttcatactcagaccatactgacctgaatttcatttatcagtttagagaaccacttccccttcccttcaccctacctccgagtgcctgtgactttgtatcaccgctctggcaccacatcctcatcccagcaggatttgggaaggctgctttttgaaagccttttaaaattctgtaagttgagaaaatactaggggaatgattttaaatttctttagaattacaggctttagtcagtatatgacagagccttttcctagaaaaatgtgcatataaaaatttgcatgtagttttagggtttcagagacccctaaagcctatccatagacgtggttcattgtctgattgtgtttaggtacccttctaaaacccttttgagatgttaggaatcacaacagagtatctctgaaaatgtaattagcggaaagaatatttcaaagactgttgttctgcttagactttctagtttgtcttctgccaggcttgccggaataaatgagtttcctggcctgatactcaaaagaattgacatttaaattagtctctctcttcccttgttttcgcttgacacatccttgtctctacattctgtctctgtctctgttagcttatttctctctcgagtcagcaggatatagtggctgttatttcttccccttatccttcaactatctacttttgacaacactttgcctttttttttttgagatggagtttcactcttgttgcccaggctgggtgtaatggtgcaatctcagctcactgcaacctttgcctcccgggttcaagccattttcctgcctcagcctcccgagtagctgggattacagacatgcaccaccacgcctggctaattttgtattttcagtagagatggggtttcaccatgttggtcaggctggtcttgaactcctgacctcaggtgatctgcctgcctcggcctcccaaagtgcagggattacaggcgtgagccactgtgccctgcctgctatttgcctttttaatctcatgaaatgttctcttttcttggctgaagtgtcacttttcttgttgaacagcatgcgtggtgagtagaatgttataaaaagggatggactttggagttagagagacccaggttcctgttcggcattgcagaaatgctgttctgcaataggctgtgtgtcagtgggcaaattacttatctctcagagccttattggtaaggtgtgagtgatagctcctttcaggcaccttacagaggctgtctcctaatcctggtagcgtacctggctcatagatggcatttaaaagtggttgtgatgacagtcatagctcaccattagcatagcgctggatccatggcagggaagcgctgcacatgcagtatctcttggactacacagggccctcatgaattaggaactgctgtttcatgaggatagggatgaggaaattagacttgctgcccctcactgccttccactcctctcctccaagttaatgggaactatgactctgctttggcttgattgccatggaagattctcacacagccaaatttattgctatcttagttaaattatgccagaacacaaaatatgaagttattgtcaaagtaatataatctcagctgtaactgagatagtcagaaactgtctgtaatctgatgtcctatctgaaaggtagctgagaataaacaagaaataaagagaattcagtagcaaatattggtgacacaaagcttttatattttgactagttaagctagttcttaaatgtttccactaaaatattcaagtttaagggcatagcccagggcagcttattatgaacatgatgtattttggaaatcttacactttctcttaaaagttcttgggaggggcatgtgaggccataatataaccataaaaccatttgttttaaaataaaacccatttttaaaattcttccaaataaaaaaattattgcaggaaaaaatgctaaacctggtttttaactttgtacgccaactatatttccaagatgtgctgtagcctggtaaccatacagaaccatacagaattagttctcagaatttattgtctgcttacttttgcatttggtacaggtataacagggtcgattatatggtttctaagacatgactagaaagaaatatgtttatcagttattatttcttccatctaaattagaaggggctagggagagggcttcaacaggaatttatatactttagagaaaagtgatcattgatagcccaatagtatagatatctcaacccaataacacaggttgtgtctgtctctgggatcatacactgtaggggagaatctttgcaagcaacattctacttatagggagccataacaaaagtttcatatgtataataattataagtcttaagtcatcaagaaaaagttaacttgtgaatgataatccctgattaaaaagagagatgtataataatggataagagatttttcttggttaatttttagtattaaaatggctaaatcttttttgggatattctgactagtatggtgcattgtctaatagatttcccatagctgagagctaatcatcttgtaatctgtggaaaactgtcctctttggctaaaactttattgtaattcctctaaatcctcagcttttattttctacagacttttttttttttttaacatttccttcctctgactcactccttttgttctcattttcatggcctgagaacatgggtgatgatagaattattcttttcacagattaacagttttcttttcgagtatcgttgagctcatgtgtgtattaactagagaagtctcccttacatttcatttttatgttttctttctcatcaggagatagtttgtagccatttactttcaaatccaagtttctgcggttcttaagacctgtatcatttgtctcctgaatttcacttcatttcctctttaaaccatgtcctctgtttcccatcttctgcacccactttgccacttcctgtttgtttaattggcaagggccactctctgtgttggaaattttttctttttgaaagctcaactaacaacttctaggaagttttttattgctactgttatcaattcataccatcttacccttgtttttgcaaccctttgttaataacatatttatttaactatagttattagcagtctgagatcattttacttggttacataaggagcacatatatctacccagcatcattgtaaggcatgtgagacctttgtttgattgctgtcctaacctagtaccgagtcctaaaaactcattagtagaagatgaagtgtccttgccttttgctgaacatatatatacacactgaatatttagtggcaattcatagttgcatttggccattttttgtttataatttcccctttctcattaaaaaaactttgttttctagactttaggatttagagaagctcattttgttccatacacatgctgctgttggattatttaggtattttgtgactgtattttatctttgaaataaaaagcctttcaagaaatgcaaaaaaaaaaagctcaaaaaacagaaaatgtatattttttaaatatctcagatagatttaaagaaattttaaacatcctaatcataggacttttttttttttttttttttttttttttttggagacggagtctcgctgtcgcccaggctggagtgcagtggcgcaatctcggttcactgcaggctccgccccctggggttcacgccattctcctgcctcagcctcccgagtagctgggactacaggcgcccgccacctcgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccatcatagtacttttgaagcccattcatagtacaacctgtgaagagcctcatgtacgcgctaactgggtcctgtctctgcagttgactggattgttgctgacatcttggccatcaggcagaatgcgctaggacatgtgcgctacgtgctgaaagaagggttaaaatggctgccattgtatgggtgttactttgctcaggtaacttgtttccatgcttttctctctatatatgtagtttataaatttttttttttttttttggagacagtctcactttattgctcaggctgagtgcagtggtgtgaacacagctcactgcagccttgacctctggggctcaagtgaacctcctgcctctgcctcccaagtagttgggaccgtaggtgcccaccatcatgcccggctaaattttctattttttgtagagatgggggtctcgctgtgttgcccaggctggtcttggactcaagcaatctgcctgtctcagcctaccaaaatgctggattataggtgtgaactgccatacccaaccctataaaaatgttatattttaaaatttaacaatatacttcatgtgaatgtatggtttttaaaatgggtttaatagtttattctcagttgaagtaattttgtttggcatttttagtggtgtgtatttatatacgtctgattatccatatgcggttttccttcagcatctgtggggattggttttagaaccaccacagataccaaaatctgaggtgttcaagaccctcatatagaatgggatagtatttgcatataacctgtgcactactttaaatcatctctagattacttataatatctaatacattataaatgccatgtaaatggttgttatactttattttttatttgtattattttaattgttatattatttttaatttttatttgttcacatatttttgatctgtgatttgttgaatctgcagatgtggaactcatggatgtgaagggccagctgcagtaaaatgaaagagcaaaaatgcaaatgtacaaagttcaaacaaataggaaatttaaaggcatagaatttgataggcaattacattaaactgttgataacagtaattagtgatctgtatgatattaaaaaaaaaaagcaaactgtatatataaaacttactttctccagttctggaggctagacatccaagatcaaggtgttgacagggttagtttctcccaaggcctctctcccaggcttgcagacagcatccttcttcctgtgtcctcaggtggtttttttccctgtgcccaagcaccgctggcactgcttcctcttcttagaaggactagttacactggatgactaatccttctacagagactgctaaggtcccactctgaggcccttttttaaccttaattaccacctctaagtccctctctctgaatacagtcacagtgggaactattagggctttagtagactgatttgggggaacacacttctgtccgtaacagtgccacataaatatctttagcaggattgattttttaaaatccctaaagatcgtgagacatgttaaggacgctttttagtgactctgtaataagtgggtggaagaattgggagttaaatccatctgatggatcaggttttttatttttaaaaatgtgtatttaagaaagaaagcattttcattttaactgccaacaaaactaaacttcatgtgttttccaatacagtgtcacatgcagtttttttgaattatgttgagacaaggcaattttcagctaaatgttctttagaagctaatgtttgaagatattaaatatagattaaattctgaaatgtagttttcattctgtactttttgcaagagaagttgcctttttgatgactctggccaattgttattttaaaagtaaatgctctttctcccgatttgattgtggcagcatggaggaatctatgtaaagcgcagtgccaaatttaacgagaaagagatgcgaaacaagttgcagagctacgtggacgcaggaactccagtaagagcctacccgtttttatttttcttaccagctctcagtttctaaatttaagaattaaattaaaatctaagaattgttttgacaatgtattttcccatgtgtaattactaattcagggttatgctgaggtaacagaaaccctctatgtacaggtaggcaggtttttcagccatcagaaagattgctgtaaacaactaggtcctttgctggtcagtggaccttaaagaggaataaaaagagcatttggtgtcgttcagagtctataaatagaactaactgcattttaacctgacatttaagctagtttacaagctcatcttacttcttgtcttctttagtatcagatttggttttagaagcagcaactgttttctgttagtgcaaattttgaatgtcttacatgtacagaaaaaccaaaaaaggatgaatctctacaaatgttaaatcattcagtgtaaataatattttataaaactttattccacaaaagtggggagagttcaatctgctttgtatagaatgctgattgctgccaaaggcttttcccctggttccctccggagacaaagcaccatgatcaccggggcgacttgggctttctctttcagtacatgacatgtgctcagaagcttagctcgtgtgcacaggctttccctttcctttctggctccctccctctgtcttccctcctctcctcctgccctcccctcaccaggggtcctgggcagcagctggagctcatggtgaaggaagaattcttcacggtcagctggcgaagtgcctggtgtgagcattgtttattcacatgcctcttctaggtgtttttacattagaacattgcatctgttttgggcatgtgttgggtgacagaagcagaatggaatgagatgaacagtgaccctttatcctgttatagctaacccttgagaaccaagcttggtgtcttcaaagggtctgtttagtctgaaacagtgtggtgaatttgggcagaattgtggtcattgcatgtaggtctccaaaagacagaataagttggtaatatggtttatcgactttttacaaaaaaaatttaaaaatcatgaatttataccttaaaatgtccatcccacttctctcccagctgtccagtcaccccagcaatggatgactgctgtggagttccttctgtgtcctgctgtgggcattgtatatatgaagcaaatgaagatagctgccttttgggtgatgttggcatcctatgcacagtggccccttgcttttttgcccccatgaatatagctgccagtggcgctagggctgaaaaaatcagctctttacacttgtcatgtgtcttgtttatgtggctgccttcgtgagtttcttcttgtttttggtttgcagcagtttaagtatcatatatctgagtgtcatttaaaaatttttacctggattggtcctctgagcttggatctatgatttggtgtctgttattaattttggaaatttctttgctcttatttccttaaatattattcctaccccagtctttcttctccagttatgtttgtgttggttcatttctcgctgttctttagttcttagatgcattattcgttttttgttggttttttttttaatttttttttttacgccccctcccttttttctttttgtgttacattttggataatttctgttgacccacctttgagttcatggattcttcctttggctgtgttgagtctactggtgagccagtttaaggcactcttcatctctgctactgcgtgtttcattcctcacatttccctttgaccctgtttcatagtttccatctctgtgctagtgtatctatctgatcataaagcttagtcacgttttccagttgaacctttatcattttattatacttgcagttctcttaaattccctgcttgataattccaacatctgggccatatctgagtctgcaaattttgattactttatctcttcagattgtgctttatcttgcctttgtcatacttcctaagattttgcctaacgctgggccttttttgtaagacaggagaaatggaggcaagttgtcttgatacctggaaatggatagacttgtctttctgcttggcctttagtgttgaggagtggagtcagtccactgaggaggtgcactgcatttgggttttgctcatgtgctttttctcacagcttcaggtttctgtagaactcattactttgtttgtaggttggggatgtcctcccgctagagcttttcctcagtgtctatttcacactcagcgttttcacatagcaccttggagtggctctcttctttatgcctttccccactatacttcttggatacttgttactgaactctcgctagtttggtggtagaaggagagggaagggaagtgtcttttcattcttagggagaatctcaggggtggagccttctctgatcctgccttgcttctggctgtaagtctgtgcccagtatgtattcctgcctttactaagagtttttccctgttctcttcacccagcctcatcgagtattcatccgtgccccatgggtagcagggttttgttgcccctgttcatcagtttcaggctgctgttccataggaaaggtagaaagaaggatgtgggctgggccctgagcccttcccacagggctgcttttccctcccacaagcctacatccagtcttccctgaccgcagtgtgttttcctttttctttgtcttgtgagtacacaggaggtctgtgggtcgagcctgtgaaatgtgctgcattctccttgtgtctgtagcccaggggttcgtctgttccactggctcatacttggctttctgcaaaattgttaaaatttttagctaaattctttttactggtatctgttacattggcccccaactaaacaaccacttgcatcttgtttctcctttgagttttccatgtttccttagacttttgggttagttggttgccttgcaaccttgcagctctctgaagggtctaagaaaagtcatgaatctacagcttgtcagtgttgttgttgttgtagggttggcagtagtattccttcagcattctacatacttaatggaagccgcctcccatttttggttaataaatttcaaaacttggaacaatgttagatttacaaaaacgtcagaaagaacagagtgttcctgtttattctttatatagcctttttttttttttttttttttttgagttggagtctcggtctgtcacccaggctggagtgcagtggcacgatcttggctcactgcaacctctgcctcacgggttcaagcaatctcctgcctcagcctcctgagtagctgggattacaggcgtgcaccgccatgcccggctaatttttgtatttttagtagagacagggtttcaccatgttggccaggctggtctcgaactcctgacctcttgatccgcccgcctcggccccccacagtgctgggattataggtgtgagccaccacgcccagccttcttcatctagctttaacatctaatgttgacatcttacataacatggtatatatttgtcaaaactaagaaataaacattggtaccacactattaattgtactacagatttttattcagactttaccaggttttccactaatgtcctttttctgttctaaaatacaatccagaatagatacaaatccattcaacttcagtgttttaaattattgtttttcattatatgaagtgctgtgtggtttttgtcaaatctgttattttggttttaatcttcaagcttgtctttgtttctttaagtgataaaggcataatttaaaaggtgtgttgggttatttcagtgcctaaagtcttgtctgagtcacttgttttctgctgttcttgcttatggtactttctttccttgtttgctttgttatcttcctttgctgctggctgtgtttggttaagttatttgtggaaatcagttgaagcctcaggtgggagtgtctttctccggagaacatttctacctgttttagctgggccccttaaggctcctctagcgtgggccccacccaaacgagattctgagttgaaggtgaactgagccattcaggcagtgcagccagggttgcagatgcacgtgagacctgctcacctctcatttactttcaccctgagagtagagcctttggtgtttcgttcacttgtctgattctctcttcacagttctattagaaggtccatgggttttggtttctgtgcccttcatcttatgagtcttgtaaatcaaagttctgttttatgcttacttctgctttactgtgtttgcttaatttcagtcttaacatcttgccaactcttgggtacttttaaaataatgttatatccagctttttaagttgttttcagtaggaaggttgattcaaataacctagtctggttatgggctacgagaatagcctccctgttttttgtgggcaaaattccagccttttatgttcctagcgcagtgtggataacagactggcaggttcaagaggccgtgctgagcagctttcactgtaaggtcactgtcccaggtcgggtttctaagaatctggatggttgtttcatttcttaatatgtacgccctgtgagagcggatacatcttgctcaggttcttatgattcttttgtttctgaaggtgaattaagtaagtgacatggtagaatatgttaagtcaactttcgtgtggcttactagttctcatgaatctattccatgattgtatcagttcttattcggtattagtatttaagaaatgcagaattttgtttcaaaaaatatatttgtattataagttgtgaagaaatacatctccataattattgctgggacaatacagtattttcttaaggaacttattggttgtggatgcaaatgaagcatatttgtgataaaaataactaatagaagtcattttgttagactatgagctagtaaaacttatggcacaaacatggagacttaacactttttcttccagctttcacttaagttccttttcagataggaggcagcctggtggataagagtattggttttgaaattagattcaggtttaaatcccagatcttctgtttaatctttattttatttcaggtagattttctggataacttgctatagcttatacatcagtacttgccacttcaattttatgttatggagagacggcttctttccttaaacctcacgaaccaacctctgctagcttctaagttttttcctgccacttctttacctctctcagccttcagagaattaaagggagttagggccttgctctggattaggatttgctttaagggagtgttgtggctggtttgatgttttatctagagcactcaaactttctccatatcagcaataaggctgttttgctttctaatcattcatgtgttcagtgaagtagcacttttaattctctttaagaacttttcctttgcatccgcaacttggctgtttagtggaaaggacctagcttttgacctaccttggctttcaacataccttcctcactaagccatttctagctattgatgtaaagtgagagacatgcaactcttcctttcactggaacgcttagcagccattgtagggttattaattggcctaatttcaatattgttgtgtctcagggaatagggaaacccaaggggcggtagagagaaagagagacaggagaacaggccatcattggagcagtcagaacacacacgacatttatcaattaaatttgtcatcttatatgggtgcaattcatggcacccccaaacaattacaatagtaacatcagagatcacagatcacaataacagatataataatatgaaatattgtgagattaccgaaatatgacacagagacgtgaggtgagcacatactgttggaaaaatggcaccaatagacttgctcgatgcagggttgtcataaaccttcaatgggaaaaaaatgcaatttccgtgaagctcagtaaagcgaagcatgataaaatgagatgagcctgtcactcctaagaatgttcctgtacaagttttttgcatctgttacttaccttttcctatttgtgaatagtatcttttttgagtacgtgtgtttttttatttttatacatttatatgtatcttttgaagaacatacttttaagcttaatttattgattttttttctctcataatttccactttttgtatcctatttaagaagtccttgccaaacttaaggttgctaagattttctcctttgttttcttctggaaattttagagttttgcttttacatttagttctaggatttatttataattaatgttttcatatggtgtaagatcgaagttcatatttttttaatataggtaaccatcactatagaaaagattatttccccccaatgtttgaaataagtagactgaatatagatgggtctgttatccctagatcaatggagcatttgttctgttatattgatctatatatatatatccttatgccaataccatactgtcttaataatgcttgctttgcagtaagtttttaaatagtgtagttgtcttctaaatttgttctttcttttcaaagttgttttggctattttaggttttttgcatttctgtgtgaattatagaattagctcgacaatttctacccaaagtttgtgggcttttcattttgattgtattgaagatatagatgaatttgggaagaattgatataacaggattgaatctttggattcatgaacgtagcctgcatttgtttacttaggtcttctttatttatctcagtgtgttttgtagtttaatgtacagatttgcacatcttttgccagatatatccctaagaatttcagtttttgatactattgtagatgacatttaaaaaaatttcaagtttttgtttgttgacctaggcatatatttgactttttaatatactaaccttgctaaacttatttatcatctagtaacttacaaaatatattccttaggatttcctacataaacaatcatgtcattgttatagaaataacagttttactttgtcctttttaatcttgatggcttttatttctttttcttgctaaattttctggctagacctcctagtacagccttgactagaactggtgtgagggaaatcctttccatattcctcatctttagggaaaagcactcattcttttatccattctttagttcctagccccattgcccttcctaaattttttctcatcattttccttcatcacaccttgttctttttctttgcaatcatatcatgatatgtaacgacatgtttttatttatctgtttaatgtatttcttttcctcacttgtccatgaagggaaggaccatatgtgttgttatcctttgtgcagttcctggaacataataagtatataagaaatagtttctgaattagctgtgaatgaattcatgccttcctgctgtctgtcaatgttcttttaaattaaacatctaagacagcaaataataccacatgagttattaacctgagaaataatcgttttatttataaatgactgagttgaaagctgatagcccacagtaattgctttcatggctttgaatataaaccttactgttacaaaacacattttcatgaaaatgaatgtgtggtgtttggaactagctttaatgtttgtcttcctgtttttccttctagttgctataatataataaggaattttgtatgtttttcctaattgtacccacttttctacattttcttaacagatctggtgaatcttcattattaaatataattatacatataaattattgtttaataataatattaattattaaaaataatataaattattaaatataaagatacatataatattatctgttaatttctaagttaggtgtgggttctgaagactattatatgaatgaacaaaaagcttgcatatttgcgtggaagctgaaagtacgaaatttttagataccattataccagtatctaaagaaaaaattcagtaccacataggtttttaagtaggagctgtatgatcataggtcatccagatgaaggaaggcttctgtaccagacgtacagaggtagacagtgttgtctgagtactgtctgagatctggcaagaatgaatccaataaacgtagttttctcccatgagctcctgtcttgtttcctgtattctgtttgtatttgaaaagatttggtgtgcataacttatttttgtcttttggctgtcaatcaaagttattagtgtagtttttgtaactcagttctcaagctaggagtttttgctgtataattttaatgtttctgtttttactttcctaagcagataagcgtaaaaacttagactaattgattacttattaaacgtccagcttgatattcttctttatattattttagtttcagtttatataacaaatgaggtttcttataaataaaatttaaaatgcactaaaggagctgtgtgaaataggaattctgtgtgaagcttttgaatgtgaacatttagaacgtttcacatggtgggaatttactatatgattttcatcaaatgaggtactttttagtgttggtacttaacgatactgatttctaaaatttgtatttctaaaaatgacgtattacaggatctgaaagggcaaaaactcattgaggctttgtatgagtcagcgtttcatggcctatttttaattagtgaattattagcatataattagaaatgtttttagattcttcatggctgacctaccaatgaatgtagcactgcatttaaaatatagttcacgttatgttcatatttaattgttgcattttgtttgcccctcttgaaacgaaggtcacatgtaaataaatatacattttctcctactgtaggaaatactctgttagcattagtaggtttagcttttttaggttaacaataacaaaaacaaagctcacacaaaataaaccaaatttgctctatgtcccacagatgtatcttgtgatttttccagaaggtacaaggtataatccagagcaaacaaaagtcctttcagctagtcaggcatttgctgcccaacgtggtaagtaaaaatttgagtgtttgaacaaataattttcaaagataataacatttttagtttttcttcctggaaaagatacttttgttttacagttgaaggaatgaatgtattcattccttgaattagtgtacatattatctcttaggaaatgaagtttcttctccttaattcactttcatgctattattacatatatctgagaaattaagttgaagtgcttgttacgatacatattcttgtgccatggatttatttaaaatctatctaagtacatgattatgtagatggaagctttttctacagtgtatgggttatatgtaatggagcttctgttttgtaagatgacagacctaagttggagtccaaactcgtacttttattagctgtatggttgcaacttggaagttgtgtaatgttgctgagcttgcttcttcatctcttaaaagaacatatgccttataagtagatctaaatctgtgtgaggattagattagaaaatatgtcaagtttctattggagaagttacacaaagttggtccacagtgcttggaagctgttaatgtcttcaacaatggtaatgttcttaatatccatattttagaaaattgaataattggtacaccaataagctatgcaatttaaccaaattgggaagtatacagaaaacagtggctatgctatgttcttagaggtgtctttgaagcttgactgtgatttagtgtgtgatctccatatgttgatagtcactcactgagcaaataccttgttggtgacattacagcagggcctatgacagtgctgtctaatggaactttctgcaataatggtaaagttcttcatctgttctgtccagtgtgctggctcctaccaatgtggtttttgagcattcaacatgtgactagtgcatgaaactaatttttaattttatttaattttagtttaattaaaaataagggggagtttttacaaggtgcttacaagagcagatatgtcataggtatatgacatcatttgtaacagtacttttaaaaaatgccagtttgtttttaaacacatgtcctattaagtaaggagtgtttcagaataggagggttcagttggtctccccatctgccagctctcttttgactttcattgcttcctctgtctaatagacatgacgttctgtcatttcagttgctcttttgcaatgccattgtctcttttgcccttttcacatttattaaacagaacaaaacaaaaaccactctcgaatctgtagtctacctttgttgtaagcactttttccagtactcactctgccctcaatttgttttggtctgatttgaaattctctccctagacttctgtggggctgttctccattatcctcccaactctctggcgattacttcctagcctcctttccagcctctttctgcttcatttctccctgctacatgtgttatttccagtgtcaggttttggtgtttgattaatttcactttttgtttctcatggtggccttcctctaaatccatggctttagccatcgtttccttgactgctgatgactcgcaaaagcttcctcccctccatgtctctctgcctaactctggacccatttgtacaattgtccattagagagcttcgcttgactggcccaaaaggatgtctcaaactcagcatattgaagatagaatttatccttccatgcatacactcatatttcttgtcttggtaactccatcattcagtttttttgcctaagttttattcacaaaaagaacaaattgatagcagttgcatacctcttataggaaacttagacatggaggaagaagctgttcagatggggtcctgcagaagtgcaggcactgtggtaatatttaaacttttctcagctgttcgaagggttttgttttaactaattttccttagacttgttttaggtatttggctttctaatggttataagggatgtggaattaaatgtatcttaatctgccacctggacccattaaagtaagcccctatggtggttttttttttttaattgccatggttaaaaccatagttgctagcgaaggtgacatacttaagctttttgaactctcttaaaagaaaacagaaatttaatgatgtgtctataatggcaaaccagatacctagaatttccatgttattcatagggtgaataacactggcgattgtagagatttgagagttctttcaaaacaggagaacaaagggaataagctacaaagcaatttttttctttgtagacttaactgaataaaaattatttttatgtctcaaacatcatatgaacaaatttagttggcaaatggcaagctaataatattttataatataggatattaatatacttaatattacaaaagtgcttcataattagaaaagacataaactagaaaaatgggaaaagggcatgaataagaaattcaagagatacaaatgacccacacacttgaacaaatgtttattctttctcataatcaaagaagtagaaattaaatgaatactttgaagccaacttctgagaaagcatagcaaacaagaaagctagtgctcagctttgtgtggtaacggcactctcgctcttaagaaggtgtgtttgctccctgtggctgctctcaggcagggccacaaacttggtggcttaaaacaccacagatttcttctcttacatttgagaagtctgaaatgggtcttactcagctgaaatcaaggtgttggcagggctgcagtcctttgtggaggcttggggggatcttgttctcctgtacggggtcctgtgcttggttcggggtcctgtgcttggtctgggatcctgtgcttggttcgaggtcctgtgctgggtccagtgctctgcttttaccaccttgaagttcatctggaaatggcactggctcgcccacaccatatagctgactctggttctccctcctcctcactcgctctaaacctgtgtttttggctgatttctaatctctctttccttggcccttctgcagcttgcagggccttctgcagctcttgtctgccccagccccggggtctgcccatcccagtgctgggctgttctgttcctgccctgcctttcctcagcccttggcaaccctgtttgttttctcccttccttagcagtggagaacatcgtaagatcaatgctgactgccttctgcagccaagccaggccatttcatttcagccgagccaagtctgtgtggagcagttcttttatttttctccttttgactacctcatggttttcacggatttttgttctcttcacattcaaggattttttgctttcagaaagttatatttctctggaaagagtgcacccaatatcccttttgatttcaaaatcttaatgtggagtctcttgacttggatttctttggaagaaactgctgaagctgccatgtctaagaagaaaactttggagaaaaattttcttcttagacatggcaacgtcaacagtttctaagctcttgattccgtctaccctgtctccatcgttgcctcagtcatctgccttacttctctgcaggggtttctcccagcttgcaaatgtactccaattctgaaataactaagtctatagctgtgcaaagagaagtctgggccccttgctttcttgtgtttgactccatccactctccagaaatgaatcccacttctcacttaaccactgacctccaaagcatcgtatcatttgtgtcagttgtcatatttgttaactttcacataacttttgacattatttatacctttataaccaggaaataattttaactttattgtagaaataaacaatggagtataatttttcttgttgaagataaatatcacctcctcttcctttaaacatctcttccctttgtttttgtattacattggtttcccccctttttttatttcctgggttgtcgtattccctgttattatttttacctttttttttttaatgtggatgtttccggagtctgtatttcttgccttttcatcttctgccctttattattctcagccactgccattacttcagttatccattcccatggtttccacatgcttagcttcggttgattcttgccattttacagaccatatttccaactacttctagaatgttttgttccttcagcctcagtatgcccaatttgaactcatgttctctctcccccttctttcttccttctttctttcgctctctctcccttccttcttttctttccctccctccctttcttccttccctcactcgttctctcttgcttgcttgctttctctcctctctctcttttctttctgcattcttctccctccctctcttccttctctcccccactccccaacttccaggctaaagcagtcctcctgagtagttaggactacagacatacacgtgccaccgcgcccggctccgtgttctctttgtttccctgcctcctgctcttccacttatctttgcatggcaggtgggtgcacgcaggcatgctctgcatgtcttcctcttggccattccccttctagttatggtgtggctttatctacgcgttctggagcagaagcctagtcacaaagctatttttttaaaacattcatgataattcatttccttttatgttttaaaaatactagctttctgtctttatttccttactaacttacttggatgccagtaattagttgttttagtgaacaccacagagtgatattttgaaactttggacttcataaagttggatgagctccagtagcaaagaaggaagtgttaactagtttaactgacaaataaatgcttcccagcttggtgtgcgattgagatttttgttgcaagtttgtgaatcaatttaactgcccctgccctggggactaaagtcagatacgtgcttgtgggaatctttgtctttcccacaccaccctgcattttaaaacctcttgtgtgggacagtcccaccatgtaatagctgttcttccttactcagctactttccctccagagaggccagtagaaaatctagactagttttttatagtctattttcatgtcacttattgagagctactgttttctgttaaattgtcagtaaatattttaatcaaggaaaagggaggtaataggaaggagagaagaacaaatccttaaccctagtaggaacctaatgaatgggatttgttctggataattgcagtagtcccccagctaaagaaccttttaaaaatatgtcagatatacccaagaggattgaaatcgtatgttcatacaaaagcttgttcacctgcagccttcatatgcaattcctatgaatgttcatagcagcattattcataatagccaaagtatggatgcaacccaaatgtccatgaagcaattaataggtaaacaaaatgtgatctgttcacacagtggaatactaactattcagccataaaaaggaatgaagcactgagtcctgcagccacacagatgaacctcagatccatgctgagcgaaagaagccagaaacaggaggccatgtgctgtgtgactgtatttctaggaaatcttgagtcaccatgggcaagatgctatcacctttgttcagtggccagaagcgagggcactaatatttacccttgccggggtctactagattgaagcgtttccgctaggccataaacttccaacacggtgacttgtacatgtagatatttgatcaatatatagcaaatgaatattgatttaaacagaaaaaggcaagtgagagtgctttctaaacttagagccctaaatatatgaggttgtggaattaatagattctgttgtgtgtgtttgagggaatttaaaaataatttagatgttaaacagtatattgtggaggtgttttgtaactaattaatgacggcactgaattgacttctaggccttgcagtattaaaacatgtgctaacaccacgaataaaggcaactcacgttgcttttgattgcatgaagaattatttagatgcaatttatgatgttacggtggtttatgaagggaaagacgatggagggcagcgaagagagtcaccgaccatgacgggtaagtgtgttcacgcacctgaaatgcctgtacacggtatatacagtgcacatgtttatgtagaattcagttttacaaagtaggttaagtgtacttttttccttcattacatttacccggtatatttttcaagatgttattaagatgtaacagtggagatttcattagtcctgcaaagtgtggtatttcttggctgtcgtgtgagtcctgtggactcaccaattatcattaatccagcctctttctactcaaagttcacacttaaaaggaaagctctgtaaaagggaggaagacgtgaagaaggagcacgcccggcagtactgagtgcacgttattagtcagtgctgcccttttgctgtatttttcgtaaaatatttattaaatttgggtgtcattgtgacaagaagaaatgcagttaagtgtgacctttttttttccccaaacatgttaggttttaagaacctttgagctattgtcagatataaccagaaaaaaatagaattttaagtgagcaggataacttagttaaactaaccaaacatagtgttagctgttagagaaatgtaaacatggaaataggcaaacagggaagtgtgtggagtttctgtttccttttcaaaatatctgtttgagctggggttgagagagaacactaggcttcatggggtttttttgtttttcgttttttgttttgagacaagagtttcgctctgtcgcccaggctggagtgcagtggcgcaatcttggctcactgcaacctccgcctcccacgttcacacgattctcctgcctcagcctcctgagtagctggaactacatgcgtgtgccaccatgcatgactaatatttgtatttttagtagatatgcgatttcaccttgttggccaggctggtctcaaactccttacctcaggtgatccacgcacctcggcctcccaaatgagctttgtgtttttacctcatcagctgtttggggttgagccactatgtatgtcagtgtgcttgtatcagtaggatctactgagggcagatgttcaaaatatgagcctccagcacgttttacatggaaaccctcacctgaagcattcgtctgaagttgatgtgccttggaaattttatagagtaatatttttaactacaacaaaacatttataaaagtagacattattaaagcattcagaagtgagcaaggatagaaattattctgcccaaccttacacgtaggccttctagacgtagtactgtgcaccgttacattatctaacactgtctgtgtgtcatctttggatgttagggatttttccaaagttcagtgagattatagttgtcaaatgattagtctgttaaataatgataagatgagggtcactcaggttttaaaagaaaagctctttgactgaaagagagagcagctgtctactgcagaaagttagggagggaggctggaggagtgaggcccaggggctagctagtataaaaattggttatggtcgaaggaaaaaaaaatgtaacatatttatatctgaaagatgattgttctcataattgtatataacacagagtaattgtaaagtagaaaactaaggtgtttttcattttagatgtaaatgtttagaatatgtaatgcatcagtttaaaaattaaaactgtacgaaatgcacagtgaaacgtcttccttgctttccaccctgctacctggccttcccttctccttcctagcgataaccagttttcttaatttgttgtgcgttgtatgtgcaaatttaagtatatcttcttattctaccatccctcccttcttacagaaaagtggcatattaatatttttctcttttaaactatcgaaggagttacttacctatttttgcatttgaaaacagacagttcatcaagattgtcgttggtttattaaacatagtttaagattaaacaagtgtttataaccaatgaaaaacagatagactccccataataaccttgtttaaatgctgctacttttatcatgtcccctcctgtctaagaaccccttggttcagcagagctcatgggtaaggccagcctctgttgcctgccatcggaggaatgcgttccagccgtgatctctgccttgccttcgcttcctcctgtgctgtgccgtgaagcctcggccgtggtgaagctggctgactgagtcctcctgcaccccatgcatattcagtagttgaaggctttgtgtggccaatcctgctttccacaggaaaccaccctctcttttgttgccctcatccaaggctactgttctcccacagtgacaggcggcacctttcccagcatagcactgtgccttctcctgcccctgctcttgcagtactgctgtggcactgatggcgtgtgttacagtgctggcacttagcacagggctctgcctttctctcttcccagccgcatcataagtgccttgaggaagccaaaaccttctgtgagttgcattgcctgggttccaacctcccactgccctgcttatcctctgctacatgtgagctgactgtggctttggggtggtcactgcctatgtgtattcattacaaattgtctccttttgaaagattgacctttctgacttacccagataccataaagaaaataaaatcttatcacttcagtcaaggataaagtatttctgaattaaaggaaaaatacaccagagtaaaatcaagactgaaagacaaactgggaaattatttacaacctagatcatagaaaaggggtcatttccttcttgcgtaaagtgcacttacaaattgataagaagatgactgataactagaaagaaaaatgggtaaagaacaacaatagacatttcacatttaacctcattcatgataaggtaagtgcaaatgaaaactacaggggataccttttttttttttaatccattagattggcaaacatcccaaggtttgatcataggctcagtgggtgagattcaagtattatcaggcatttttatactttgctgttaggaatgcaatgtagtacaaacctttgtagaagttgctttggaaatgtctctcagatgtacaaatgcattcacattttagatttagcattcccgctttctgagacattattcaacatgtatacgtgtgcacataagatataataataacacgtttttccttctagtgtgttgcttttaacctgtagcttgaaaaaactctgctttcattgtttttttttgttttctgtcactggctcagccctgctttcaattgtttatatgaattgatgggtgttctggtctggttataatctactttagtttaagagtcactttaaattatatgacatctgatataagttgtgttaggtagaaaattctgtaacttggaatactgtaagtactttgtggccacatttcattagtattaaatattatctctatatatagtaggctatttaatattcatattttatgatgcaattaagaaataatttttttctgaagttggtagattgttgatatgccatggcccagtgtttctcaaagcattctgggggatcactgtttgtcagaattagctgcagtgattgttgaacatgcagggcctctgctccactccacgttgctaccaggacgctctgcaggtgagagctgggaagctgtagaagctgcagtgctaacaaatgctacaggaattcttgtagtcaccttcatgaggtcttatgttgaggagaggcagccagtagtgtcccttgtccttcccgttttatggtgtaagtttcattttaagggaggtataaatcaaagcccacctgggcattctctcatggttcactgcttcttgtaatcatggaagatgtcattgcggcagagacgaaacagtgtagtttgattactattgatttttttttaattatttttctgaagtggctgttgtaatgtaataaattgtgtgcttaaggacaacctttggtattctatttgagtattgtgtatgatcctagttaagttttttctaccagtattttcatattacaacatatttactttccatttctattaatatttttatatttaaagtatggaggccgggcacagtggctcacgcgtgtaatcccagcattttgggatgctgaggcgggtggatcacaaggtcaggagttctagaccagcgtgaccaacacggtgaaatcccatctctactaaaaatacaaaaattagccgggcacagtggtaggcacctgtaattccagctactcaggaggctgaggtaggggaatcacttgaatccgggaggcagcagttgcagtgagctaagatcgtgccactggactctagcctggctgacagagcaagaatccgcctaaaaaaaaagggatcagggaagaggggattacagataacccaaagaagaaggaaaaatctccacaagttcacctgtccagcggtaaccccaatttggatattttcctttaacaatttggatattttcctttaaatcctcttttttataatgtctatatgttggagagagtatgtgcctttacgtattttttaaagatgagatttctgtgtgtgtctatatctcctgttcttcatattttcttgtgtgttataaacagctgtacatgtcagtatatatacttccgtaacttttttttaaaggctatatagtgttcattgatgtgatttaacagcagttatctccccggcttcatcttgttggaatgtgggtcctgtgtgttgccttcagagcaaatggggcttggttttgcagcaagtagacctgtgacctgtacgaatagttggaagactttctctattacccaagtgtatcagtatactttagtgcctactagaaatttatgggtagaaaaacaataatatcttagagtattttttcctagattccctaaggtgctatagggtgatttttactcatgtaacatgaactatccttcaactaagatagtttttgcaaatgtggatatataagtactttattaaacctataggaagtatttataccacttatttcctcccttcagtgttagaacctcctaaatggcatttgacattgaactgctttccactttgtcgcatgctcctctcattgtccctacctgggtcctgaaccttagggacttggctgttatagccccaccatggctacgctgggccttggtcgtctctgagacttagtttcttcatcttacaaggagataataacagcccctgcctgcgtagaattgcagagatcaaatgaaataattaacatactcaaaagcatgccgtaaacacattctgagcacatgtacgttttaggaaaaacaaaaggacccatgcacatttcggagtgcttttgtctcagcagcactgcctcttcttccaaagctgacgtcttagtagaggccctgccacgtcctgagcactgtactccacgaagcattctatttctgacattcgaaatgcagtctgttccatcttccttacaatctgtatgccagcacttgaaataccgggtatctgcagtgttgaccaggtgattacttaattatggaaatgttgaggtggagatctagataattcagtgaaggcaggaaaattggtgtcggaatctgtctttttatgtgtcagaaatagaaataagatagggtgagaagtaatttgtggctaaaacactataatagctaacacatagtgcatactgtgtgccaagcactcctgtaggtgcttgaaatcttctattattattatccctactttatagacttgcacccttaggcacagagaggcggacagttgtccaaggttaccccagaggtggagatccaggctacctgactccaccatgtgtgctcttccctagggcacagttgtgctgctaaaaatactttttaagcagttctttgattattcagatgatagtactgtaggaaaattaagacaaaaataatgaaaaattaaaatctttattttagtgttttgcacatgtattattaaagccagtttactcctggaagtgtgtaagaatacagggtatttttgatcacctaaatgctgcatgttactaagagctcgacactgaagtcaagaagagcagttgcagagagtacttagcaaaaacgggaagtgtgtggggttgaaggagcaaagacaagtcttcctcggacggtggagtgtagaattcatcatttctcagaacacgtctttgaacgcattttcaatttgaggccaaaggtctcagcctcccactcggcatacctccctaccttagtcagctcttaaatcttaggaatatttctttgttcttcaaggaacttaaatatgttaacattcttacctgtccacagggagccccctacaaagaagggagtttctagtctccgttctttcttggaataaataatagcctcataccttgtgcaatcgaggctgaaaaagactgtctccttttttcaaataagcaagtcttagaaactacagttgtttacagggctcatggctattccacagtaataattttggttcttttaccaattatataatatgttaaaatatggcaagtatcaggaaagcaaggagtggcaatgattagaaaccaatggccaagttagagaggaggggcaattgctcccccaagtttgttgtggctgtgtagcagtcagtgacgagaagctgtgtgtcaggcgacaagcaaagttgaggattatcaggcgcctgtgagtgcccagctgtgtgccaggtcaggaggtgccatcgtgagccagaccagcttcctctcggcccctgtggagctcgcagtctggtggggaggcagcagtcaccatggtgacaggtgacacactaggatggggctggtggtggtaggcatttgcgggtcccttcagagaggtgagtatggacttagaggaggctccagcttcctattcctgggctgtctatagcactaaaagttgtcacatgaaaaataacatttggtactattgatttaacttaatgacttatgtaattgtagttgacttagaaattataacatgctcttctacttcagcttgaaacccccaaccaccagtttataatcctttttttttaacttttgtttatttttcctaaggaatctgtactttttcttcattttacaactttttttgtcctgttaccttattttcatttttactttatatgaccatgagttctaaaatagtaaaaaaaaagaattatttttgttctttgttagaatttctctgcaaagaatgtccaaaaattcatattcacattgatcgtatcgacaaaaaagatgtcccagaagaacaagaacatatgagaagatggctgcatgaacgtttcgaaatcaaagataagtgagtaacaacagttccagcacttccggaacttcggttcaactagatttcagtatagtcaacaatttgaaaccaatgtaaatggttatattgtctcaagaatacattttataaattcaaatcaaattttatgcatgtctgatcgtgttttaaactttacttgtacaaatcagtctaaaagaacttgttacagtgggcccatctacttgcattgatagtatttcttggacaatactacgtgataacatagcaaattaaattaaaaacaacaacaaacacacaaaaaaactttccagtgtcagatgcccggacctacctgtcaggtcacataaagtggtgttactgtgtgaggtctggctgttgggccagtgtgcgcagaaaagcaagggaggggtagaggactatgcggacgtgcaggtggacatgatgctgttatatttgttggaaatagaagggggcagttgacagcgttatatccaaagtgtcttctgtggttaattatattcagaaattttagccaattgttttattctctaaatatgtactttctgctcaagaaactatcattgttcttcttttccttgttttacagtacagtgtttttaattaaccctcctgggttaactttaccaggtgaaaatgattaaaagtgtaataggttaacaatgaaactttaagcttctatttttcattgactcttaactgtacatgatgtaatgtattcagcgagccattcaggaccactttggcccatggaagaaatttaaaagtaagatctacatgtattgacatgaaaatatgttctcagaaaaaagactaatgtatttaatgtcctacttattttataagtatttagaatacctctggacattttaaaacaatgattattgctagggtgtgtgatttataaagcaatagaagcgctttccctttctgtttgtgttttagattattatatcgggtatgttctgctatcataactttacaaatcttatgtaatatgggaaaatgagttaactatgctgttttccttcttttacctgcctttctaattctgtgggaataaaggcgtttttgagacagcccaggtgcagtgagcagtccatatccatggattccacattcatggattccaccaagcacagaccaaaaatactcagaaaaaaagggggctggctgtggtggctcatgcatgtaatcccagcactttgggaggctaaggcaggcaaattgcttgagcccagaagttcaagacagcctgggcaacatggcaaaaccctgtctctacagaaaatacaaaaattagccaggcgtgcacctgtagtcccagctactcaggaggccgaggtgcgaggatcacctgagcctggaaggttgagactgcagtgagctatcattgtgccaactccagcctggtaacagagtgccttttttcaaaaaaaaaaaaaaaaaaggatttgggaggatatgcatatgttatattcaaatacatgccattttattcatatatcagggacttgagcatcctttgatcttggtctctgccgggtatcctgggaccagccccctgtcgatacagagggaccgctgtctaagaaccgctggtcctatctttgacttctggcggaataggagctccatgtaaaaaggaggagaagctgcagcgggttattagccatttgtgagtcaggtcactgtaaaactttatcaaaagtttaaaagacaaaaagcatcctcataaaatgccttaaaaccacctgttgaaatattacatatacaattcatgtatactaatcatagagcatattaaagatattttagaagactagaaacttctattaaaccaagtttctggatgtttccgtattcatccttattttccagggacctgcataacttttccagcgtgtaatagctacctgattgatattttttgaattgaaatactgaagtgactaaaatctaaactttttccattctggccataggatgcttatagaattttatgagtcaccagatccagaaagaagaaaaagatttcctgggaaaagtgttaattccaaattaagtatcaagaagactttaccatcaatgttgatcttaagtggtttgactgcaggcatgcttatgaccgatgctggaaggaagctgtatgtgaacacctggatatatggaaccctacttggctgcctgtgggttactattaaagcatagacaagtagctgtctccagacagtgggatgtgctacattgtctatttttggcggctgcacatgacatcaaattgtttcctgaatttattaaggagtgtaaataaagccttgttgattgaagattggataatagaatttgtgacgaaagctgatatgcaatggtcttgggcaaacatacctggttgtacaactttagcatcggggctgctggaagggtaaaagctaaatggagtttctcctgctctgtccatttcctatgaactaatgacaacttgagaaggctgggaggattgtgtattttgcaagtcagatggctgcatttttgagcattaatttgcagcgtatttcactttttctgttattttcaatttattacaacttgacagctccaagctcttattactaaagtatttagtatcttgcagctagttaatatttcatcttttgcttatttctacaagtcagtgaaataaattgtatttaggaagtgtcaggatgttcaaaggaaagggtaaaaagtgttcatggggaaaaagctctgtttagcacatgattttattgtattgcgttattagctgattttactcattttatatttgcaaaataaatttctaatatttattgaaattgcttaatttgcacaccctgtacacacagaaaatggtataaaatatgagaacgaagtttaaaattgtgactctgattcattatagcagaactttaaatttcccagctttttgaagatttaagctacactattagtacttccctttgtctgtgccataagtgcttgaaaacgttaaggttttctgttttgttttgtttttttaatatcaaaagagtcggtgtgaaccttggttggaccccaagttcacaagatttttaaggtgatgagagcctgcagacattctgcctagatttactagcgtgtgccttttgcctgcttctctttgatttcacagaatattcattcagaagtcgcgtttctgtagtgtggtggattcccactgggctctggtccttcccttggatcccgtcagtggtgctgctcagcggcttgcacgcagacttgctaggaagaaatgcagagccagcctgtgctgcccactttcagagttgaactctttaagcccttgtgagtgggcttcaccagctactgcagaggcattttgcatttgtctgtgtcaagaagttcaccttctcaagccagtgaaatacagacttaatttgtcatgactgaacgaatttgtttatttcccattaggtttagtggagctacacattaatatgtatcgccttagagcaagagctgtgttccaggaaccagatcacgatttttagccatggaacaatatatcccatgggagaagacctttcagtgtgaactgttctatttttgtgttataatttaaacttcgatttcctcatagtcctttaagttgacatttctgcttactgctactggatttttgctgcagaaatatatcagtggcccacattaaacataccagttggatcatgataagcaaaatgaaagaaataatgattaagggaaaattaagtgactgtgttacactgcttctcccatgccagagaataaactctttcaagcatcatctttgaagagtcgtgtggtgtgaattggtttgtgtacattagaatgtatgcacacatccatggacactcaggatatagttggcctaataatcggggcatgggtaaaacttatgaaaatttcctcatgctgaattgtaattttctcttacctgtaaagtaaaatttagatcaattccatgtctttgttaagtacagggatttaatatattttgaatataatgggtatgttctaaatttgaactttgagaggcaatactgttggaattatgtggattctaactcattttaacaaggtagcctgacctgcataagatcacttgaatgttaggtttcatagaactatactaatcttctcacaaaaggtctataaaatacagtcgttgaaaaaaattttgtatcaaaatgtttggaaaattagaagcttctccttaacctgtattgatactgacttgaattattttctaaaattaagagccgtatacctacctgtaagtcttttcacatatcatttaaacttttgtttgtattattactgatttacagcttagttattaatttttctttataagaatgccgtcgatgtgcatgcttttatgtttttcagaaaagggtgtgtttggatgaaagtaaaaaaaaaaataaaatctttcactgtctctaatggctgtgctgtttaacattttttgaccctaaaattcaccaacagtctcccagtacataaaataggcttaatgactggccctgcattcttcacaatatttttccctaagctttgagcaaagttttaaaaaaatacactaaaataatcaaaactgttaagcagtatattagtttggttatataaattcatctgcaatttataagatgcatggccgatgttaatttgcttggcaattctgtaatcattaagtgatctcagtgaaacatgtcaaatgccttaaattaactaagttggtgaataaaagtgccgatctggctaactcttacaccatacatactgatagtttttcatatgtttcatttccatgtgatttttaaaatttagagtggcaacaattttgcttaatatgggttacataagctttattttttcctttgttcataattatattctttgaataggtctgtgtcaatcaagtgatctaactagactgatcatagatagaaggaaataaggccaagttcaagaccagcctgggcaacatatcgagaacctgtctacaaaaaaattaaaaaaaattagccaggcatggtggcgtacactgagtagtttgtcccagctactcgggagggtgaggtgggaggatcgcttcagcccaggaggttgagattgcagtgagccatggacataccactgcactacagcctaggtaacagcacgagaccccaactcttagaaaatgaaaaggaaatatagaaatataaaatttgcttattatagacacacagtaactcccagatatgtaccacaaaaaatgtgaaaagagagagaaatgtctaccaaagcagtattttgtgtgtataattgcaagcgcatagtaaaataattttaaccttaatttgtttttagtagtgtttagattgaagattgagtgaaatattttcttggcagatattccgtatctggtggaaagctacaatgcaatgtcgttgtagttttgcatggcttgctttataaacaagattttttctccctccttttgggccagttttcattacgagtaactcacactttttgattaaagaacttgaaattacgttatcacttagtataattgacattatatagagactatgtaacatgcaatcattagaatcaaaattagtactttggtcaaaatatttacaacattcacatacttgtcaaatattcatgtaattaactgaatttaaaaccttcaactattatgaagtgctcgtctgtacaatcgctaatttactcagtttagagtagctacaactcttcgatactatcatcaatatttgacatcttttccaatttgtgtatgaaaagtaaatctattcctgtagcaactggggagtcatatatgaggtcaaagacatataccttgttattataatatgtatactataataatagctggttatcctgagcaggggaaaaggttatttttaggaaaaccacttcaaatagaaagctgaagtacttctaatatactgagggaagtataatatgtggaacaaactctcaacaaaatgtttattgatgttgatgaaacagatcagtttttccatccggattattattggttcatgattttatatgtgaatatgtaagatatgttctgcaattttataaatgttcatgtctttttttaaaaaaggtgctattgaaattctgtgtctccagcaggcaagaatacttgactaactctttttgtctctttatggtattttcagaataaagtctgacttgtgtttttgagattattggtgcctcattaattcagcaataaaggaaaatatgcatctcaa

SEQ ID NO: 2067 - DNA, 6901 bp, Homo sapiens
gggaggtttccggcccggggcccgactgcgggtggcatttctggctaagccgttaggcgcgaattgtatgtctggtttattcgtagtggccagcaggggagggagggaggatgcttggggtttctggcttccagggtgggtggggacgaggtggtggagtccagctcaggtccgggctcctgataagggcagaagcgggttctgcgctgcccccaaccctgtaaccgccaggaaagcgcttggtgagcgtcgggactgcgcaggttcctcgggaggtggctaaactggccaccgcctctggggccgcctaaagcaagtccgttaaccactagtcagggaggaatactgtgtttgagtaaatatatgtagagttgggttagaatcattgattgggtctttttgaaatcttacagttctgtgtccagaaaacacagggcacgttacccggtatcgtggtctacacctcgcccacaaatccatcccaggctgtatcctcatggaagctttttccagatgtgcttgagggttaagatcgcaatgtgcaagaagaaaaagtgcacattggaaaaccttctcttcggagatatctatatctatatttatatatatttacagatatggagatatatacacacacgtatctgaaaacattctgacgttttaaaaacggtaagacagacttttattcagaaccatttccttagatgtaagggactgcactgaggttttgcagcaggggagagagattggggtccgaaaataataaggaaaagtggggatttatagccaaggagcagtgtgggggacggtggatggaaagtcattgagaaggggacatcaagtgggggttctggcttccctgacctaacaggattcctgctgagggtgggccaagttgatccacatcggggatgggggtggggtggagcaggtgttggaatttggtcagatatggagggtattcagacacctgaggtggggaattgggattaaactgacttagcaggattcttgctaaaactagactctgcaggaacagaggaaggaatgcccaggttgggcccagtcgtgcagagagctcggaggaggctgtccagagtctgatcagggagacattctttgtcattcatgtatatacccatatattgtaataggctgttcttgtatgactataaagaaatacctgagactgggtaatttatcagaaaagaagtttgattggctcacagttcttcaggatttacaggaagcacggtgctggcatctgctcagtttctaggaaggccttgggagcttatgctcataacggaaggtgaaaggggagcaggcacatcccatggcgaaagcatgttcaaattaacataagaagaaagagaacttggccaggcacgatgtctcatgcctgtaatcccagcattttgagaggccaaggcaggcggatcacctgaggtcaggagtttgagaccagcctggccaacatggcgaaacgctgtctctactaaaaatacaaagattagctgggtgtggtggtggacacctgtaatcccagctacttgggaggctgagacaggagaaccgcttgaacctgggaggtggaggttgcagttagccgagatcgtaccattgtactccagcctgggtgacagagggagacttcatctcaaaaaaaaaaaaaaaaaaaaaaaagagagagagagagagagaatttgaatagtccagtgagtgttagagaaattaaactggtagtcaaagactattcaggtctaggtacttttacagattaattctgccaaagtttcaatgaacagttaactgctacctaatataatttgctccaggaaacaaagaccgaactttacccagcttattttaaaagactgctgtagttttgattgtaaacaaagatatacatagaaagaaaattattttaatgacaagcacagatgcaaaaatcctaggtaaaatgataaattcaaaatatattaaaatagtattatatgataaggtgggttttactatgaattttcacaacccagaaatcctttgatgtcactccattatcattttgaacaagaaaaatcctttttttttctttctttcttgaggcagtctagctctgacatgaggctggagtgaataggcgcaatcttggctcacggcaacctcaacctcctgggttcaagccctgttctcatgtctcagcctcccaagtagctggaattgcaggcgtgtgctaccagactcagctaatttttgtatttttagtacagatggggtttcttcatgttagccaggctggtctcgaactcctgagctgaagtgatctgcctgcctcggcctccccaagtgctaggattgaaataatcaaatgatttttcttggttgggcacagtggctcacagataagaagacaagcatgctcagtatcacaactactgtttaatattgtgttggagggtatacctaatgtataaggaaactgaaggaaataagatcatgtaactagcagaaaggaagggtgagacactcatcatctacagatgcttctctacctagaacaatcaaccttgtcaagctgatgaaatagttcaaaacgtggccgggtgcggtggctcacgcctgtaatcccagcactttgggaggccgaggcgggtggatcatgaggtcaggagatcgagaccaccctggctaacatggtgaaaccccatctctactaaaaaaaaaaaaaaaaaaaatagctgggcgtggtggcaggcacctgtagtcccagctacttgagacgctgaggaaggagaaaggtgtgaacccagcaggcagagcttgcagtgagccgagatcacgccactgcactccagcctgggcaacagagcgagactccgtctcaaaaaaaaaaaaaaaaaaggccaaaaggccttctaatataacttacaaaaaccaatagcgtttctctgtacacgtactatacaaaactggaaaaattaagatagttgtaatagttagaatgtctataaagtgcttaggaattgatttaaaacatacataagatttgtctggagcacaccataaaactctaataaagaatataagaaatgatctgagtagatatattcttgtttttgattcaaacagcttaataaaattgtcaattcttccttaattaatctatacattcagtggaaacttattaaaaattccaaaatgatctttacgaaacttgatagacttactctaaaatgtgaatgaagagaggaggtccacaaattagccgactttgtgaagaaggataaagaggcatttgtacccttctagatattaatatatatcaagaaaaagtcatgtttatagaacgttatggtattggcacagaacagacaaaaaatctatagaatgcagtggagagctcagaagctgacctacaaatacatagaacttaaaatatatgaccaatagcggcaccacaaatcaatggagaaatacaaattgtttagtgaatgtgtgataaaatgagctcattagatccaaacaataaaagtagatctccacctagcgcatgcccacaggtggacgccatgtagagtaaagacctacatatgaaagataagactttaacagaaagaagtacaaaaaatagcagaatatttttatgacttagtaatggagaaggatgtcttaaacaacacctcaaaacacaaaccacaagggaaaaatggattgcatttttttgtgtgtaacaactgaagccttctgtttagtgaaggaccttgtggacgttaacggacagaagttagatacagtgggagaagtgttttgcaatgtctcaaactgacaagtcattaatatatgaaatatacaagtaactcctatatttcaacaaaaacgaggaggcagcaacctcagtaaaaaaggggaaaaggcaatttatggaagagaaaaacccgaaaaggcctaatttactgaagaaaatgtttccaaactgaagataatttaagtgatgctgaaacctatcaatattttaaaaagtgcaaagtgaatgacatcactttatttatttattagacaagatcttgccctgccatccagactggagtgcaatggcgcgatctcagctcactgcaacctccacctcccgggttcaagcgattctcctgcctcagtcttatgagtagctgggattacaggcacgtgccactgtgcctgggtaatttttttatttttagtagagacggggtttccctgtgttggccaggctggtcttgaattcctgagctcaagtgatctgtctgcctccgtctcccaaagtgctgggattacaggcgtgatccaccactcccggcctgacatcacattacttctttagattggcaaaaattacaaactgggtgatgcctagcctcagtagccacataaggtcccaggctccagggacctctggcactgctgctgtgattagagcagttcaggttaagtgtggtacagtctgattaaaaatcagaagcagcgtcttcataattaaggcaattcttattttaatgttgggcatacattttctaatctttatctgtctatcttttctgttacattaatgaaataagaatgagccttgaagttaatattctgcattttacactcaatgtatcaggaatacattcaaatattcgtatagtacttattattgtcagcaaatcctacgcagctgaagattttatttgtttacctatttttgtagtgttgataccactgcaacaaccatttggggaacacagttcctccactgtcctctgctggaatgtttacttttagataaatttccaggagtacgttatgagaaatgagagtaaacggaatgttttggctctataaatttgtagcaatagttgaaggagttgatgtggaagatactggtgtcttctgtggtcgctaaccctgggatgatccacgagccagtcgggccacccaccttcttaagcatccctcttctagtgcgtaggagaaagccatggttgccaaggcttttcttgccccctcctccaagccatgtaaactaatcgtccctcaagcccatccggaccctgtaatgccatggcttgtttgcacctgcatagatagcagatcatgagagtgtgcacagcgtataatgccttctcagtgcatgttgggtgtatgaatgaataagtgaataaacaagtaagtgaatgaatgaaagcaagcagccaggaagcgctgcagctcagtctagtcttttcccagggcaaacacccagtaggtggcgctgttgcaccggcggttgcaaaccctcagagcacgtttaaacagagctctctgactctgggacagaggatgtggaaaacctgtgtcttcaaatcacgtcattaggtttgaagatgacttaatgtgaaaataaatgtattttaacgtcattaaaataatccttagtactttaaaatctcagctagcttctgaatgctttgggaatactttctccatagttaactgcacacaagcccgtggggtgggcagggcaggtatttgctctctgagatccaaagagggcagtttctcggctggtagaggcagagctggatgcagagccaggcacagagccaaggcgcgtctgaccccagtccagcgggatctcctgcaagccgcagtgtttccagaggcgcacttcagtgtgtggagtgaagggagagtctccggacatgagaagagctgctctgagcagtgtggcggccgtttttgtttcctttctctttctcctcctggggctaggcagacaccgggcacaaagaaggaaacaggccttctgtgagtgcagcagcaatcaataaagaagcagcccagagcggccatccctcttctgtctgctgtgacgctccggcccaggtgtccctggggctgccctccccagggcctgtgtgttgcatatatggggtggggtgagggcagctggaattgaggtggggaccctgcaattgtgaggggctgcgtggcagaggtgggcggctctcgcaggcctcttcctggacacttgcaccccctcatcctgctctctttttcttcctgcacttacatcatctcatttgtttattttctcattgtccgtctccctctacaggagcaccagaggagggggacttcatctgacttgttcagcactgtctcccaggccctggcacagagggagcactcgatacacaccgatgggctgaaggtgtgaatggatctggggactagagtgatggttatttggcagacagcatgccccgcctgggcagtagccgtgaagactcttcttttcctctcctcgcctgcactctttaggattgaacagcattggttcaatgcatattctgggagcacagagaaaaaagggatcaagttccaccattatgcaaaagggactcctgtaagccaggtgaagaaggggcaaggcccttcttggtcagcagggataaggcagttgtgtatgggagagcatgcgaggagggcgagggctgggggagatggagcaggaacatttggttggggctctgaggcactcttctgcttggggagtgtgtgggcaaaggcaggggctgtgcaggaaggatttagctaaagccataaagctggaagagggtttggggaacggctttgaagttacatttgttttgcaagttctttgtttttattaatgtttgcatgttatttgggtagctgtagggagtaggttttcggggagttaaagtgcactctctcacccctccttcagtcctactactgcccctagatacacaatcacctcaagtgactttcacgtcaccaggaatgggcaaagtctagattttggaacagaaaatattttaggtccccgtccctctctgtaaccaataaccaatgccatataaatggaaaagtataa

SEQ ID NO: 2068 - DNA, 27128 bp, Homo sapiens
ttttgaattaagtgtccatttattagtcttctctaataaatatagtgtatattttctgatccttttcatcaccgggcaatatgctttctggaggcatgaagtgaggaagccatctgagaagccgatgttggtccacagggcctcgaacagcaagtacatgccttgatttctgcatactcagtgcctgtcatactcaactaatattccttaaatgaatgaatgaatgaagagtatttctagctttccaggctattcaagggctagaaagtttgaaaagaatgagcaaattccccatatcccacccttacttttaccccataacacaaatgccgttgatccaggatatgcactcaagctgaaattcatgcccacagccccgctcgttagtgaattcatgctgttgaatgctctaacgcctacttttgctggacactctgctggaccttggagttagcccagaaggaggactgcaacccttaattagccttcagggaggcagggcttcaagtttaggaagaggtcaccagagggcaaagggcagtggaatacaacctggggacagagggtaggtctgggagagctggagctggggagggcccaggaaggcaccaagaggagatgtttgagtggagtcttggaggacaaatggggagggctggtgaggactcagggaagtgctcatgctctcacctggctgggcgagagactgcatggaggaaggactgagatgctgggatagcacagtgaatggaactatgaatgattttgttctattaacaagctttttttttagatagagtcttgctctgtcgcccaggctggagtgccatggtacgatctcagctcactgcaacctctgcctcccagttcaactgattctcgtgcctcagcctctcgagcagctgggactacaggtgtgtgccaccacaccaggataatttatgtatttttagtagtgatggggtctcactacattgcccaggctggtctcgaacttctggcctcaagtgatcttcccgcctcagcctctcaaagtgctgggattaccggtgtgagcccctgcatccgacccaaagtctcgttatcttcacctgttgtatggaaagtttgtagccacttgtctgcatccccgattggcttatgtggctggccaggaggatgctgatggtctgagagcttattgcagaaagtgtctgcaggtgcccttagtatgtgtcaggctgagctaagttattctactattcctttttagagctctaatattgtaccctaatccaaaagtgtttggagagaataaaaactacccattctggctgggcacggtggctcacgcctgtaatcccagcactttgggaggccgagatgggcagatcgcttgagctcaggagttggagaccagcctgagccacctggcaagaacctgtctctacaaaaaatacaaaaaagtagccaggcatggtgcccacctgccagtagtcccagctactcgagaggctgaggtgagaggattgcttaagccctggaggttgaggctgcagtgagccatgatcatgccactgcactccagcctgggtgacagagaggccctgtctcaacaaataaacaaatgaaatgaaacaaaacaaaacaaaaatacccatccctaaatagcatccagctctctgtgtgcctttctctttgatagtttatgactagacttccttaatcagctacaaaggaaggcttaaagaaattatggaaatacctagccacaaagaacactttagagtggaggagtcagagagaaggagagtgcgagaggaatggacgtttcctcccttctttttggatgggcttaaatcatggatagtgtctcacattgaatggaagtgggaacaaagcttggacataaaggagatggggtggaaagcagcagtgggagctggaagggaactcttggctggccagcctgcacaaaggggagcagcacatttcacagaaaaatacatttatgcagctggccaggaggatgctgatggtctgagagtgaattgcagaaaatgtgtgcatgtgcccttagcatgggtgaggctgagctaagtgagtctacccttcctttttaaaagctctaatattgtcccctaaccaaaagatatgggaatcttagaatgacatttgcactttcagttatgttagttattacaagcacacaggccttacctactcccagaaagcatgcaaattatcttaccaagagatttcataacataatacagttagaatatattaaaatgagattcataaccgctaaatgtgaggcaaagctaattgtaacaagaacctcaaataaaataggaatctgggttttacctttgtgtttcctagaagccacagcaaaaagataaaataagggaacctacagctcataaaaggtagcagacaattttgactggaatctctttctcctcctctaaagtatgttagagtctctcctatgcatgggtggggtctgtgatgtttgcattggacctgcaaaatcatccagccctgtttcttcatttttcagggatgcagatggagattcagaggtgacagtgatgtgcccaaggacacaggtgtcagaagtgggatttcctttctcacggtaccaaatggccagcttggtttgtcagcctgttgtcttatcccaccatgactgtggtcagatgaaaaaactcggctcttgcttcatctgttccctgcagctgcagtccgtttggatagactcagacttaggggtggacgtgaggcagggctcatgggcagtcctcagctgtggcaatgacacccacacaccaacagctgcatggtgacttagctcccttttgggctccagcggctcctctagctctgagatactgagggttcttccagggaagcctgcactggggcagaagcctctacatgggcctgtgcctaggatggggctaatgtcggccatggtgtcggggaagggcgccaagcccactgggtggggcgatgcaggctgggcagggctgctctttcccagcctccttccagagtgggccgtttgcagagtagctgggctgccttcttgttgtgaggatgtggccacttctgcagtggcgctgaagtacaacgtggaactctgctgtccttcccctcctctctgctgcccacctgtccccttcccctgtgtcccagaaacagcgtcagctccttcctttggggtgccctccccctgcgtggctgctgggttctgggtaggtgcttcatcctgctgatcgctggcaaaagatacgtaacttgaggtttccaatgggtcggcctctgctttagggacaccttcaaacgcagagctgttctctaaggttgaggggtcacgggatgaggatgggagctcttgctgggcagacaaggcctttctctgcaggtagtcctgttgactcaacccccatgcaggtggacaataggcaggactgttatctccaaaggcggcattgatcttagacacatttcctgtttttagggcaagtttcacccacagccagtggtgatgactgaggaaagagtcctccacagcaacctgggtccccagcccagcctctggggggacctgctcaggggtagggggcttccctaaaatggttggttcataacttgccccttggcatgagcctgagctctcggttctcttcccagctagatctgtggcccggggagaatctcttctctctgttttatcacctcctgcaatgccacaggacttccttaggcagccctgccagatgtctgtggattttggatgcagcaggctgtaataaattaccagtgagacactgcctgaaaaagaacaaaaagaccacaaggttatgttctttgaagtctgcatcctccctctggtgtgcagtttcaggttctggcccttttgtgtagaggaagataatttgggatccaaaataggactcttgttggagcctcagaactggatatttcgggggaatttaagtaggttccagcttctgtaagctgtaaatgtttctaaagttaaacatgaataacaaggcttaaatccgattgattctatgcttttgtcttgagggcagctccagttcagtcatctacgtgtgtgtgtgtgagtgtgcattcatgcatgtgtgtgtgcgtgtgtacacacaggtacaaaatgtttggcagaaataagcattctactttcaagtaactggaccatacactgcaaattcgactgtcaatacagtggttgatgggttacaaagctgggggaagggagggcattaagaaataacctcaaaaacaagtaagacctaaacagaggttaatcagattcatcaaaaaccccatatcaaggaatttccatgaacaacaacaacacttcctttgtgcataaacatcttaatcacattgttgtcagtttaatttattttgatcagaagtgttgactgctgcaataatttctttaacagagcattccagtaagcctcccacgttatttccagtttcctgttgtactggataaagtgcctggtttcagggtgctcattataaacagcacaaaacctgaagtaatgcctgagaaggccaggagattgcagcatgacagagctagaaagactgcctgaaggacatccccagccccaaatcctctcttgtgtcttgggggactgggagacccagatcaagcagctggttagtggccaggctccaaccttggaaagggaggtggactttctccatgttcagtgccacctctgcagtaggtcctgctcagccagtttctgcactgttttgaattctcacaattgcctggtgagggacatattgtcacccttcttttacaagcagccacccaaggccaggaaagatgaacaaaggcccctgatcacagaagtcctgggcacacttattcagtgaacacaatctttccagaggccatgtggtttgagggttcttggtggcatccccaggctggcacgcagttggtactcagtgaatattggtcccaggatggaaggaaaaggggaggagcctggatgcaagcttgtgctccttggactacaatttgggttcaatcttcctgcctaggattcccaagggtcggctgggagtcaggggtttggcagctccatcagaggccggaggaggagcggcagacaaggctctgagccggtggccacctgggtgctgagtgctgcccgtggctatgggctccctactcactgcccgtggctatggactccctactcactgccctccagctgtgccgtgggccagcatactggctgtgaaaatgtcttctcactggagtggaactggaaggaaaccaggcatccactctcaggagtgtgacaggttttcggagtggtgtaggacatcttttctgagtcagtgttaaaatccagaaagtagatgaggggacattttccctcccaccacactgcccccaggactcagctatacctcccgtgaactggaaaatccagatgagttgttagacctcccggccggcaaggccccttcattccaagtatcacatggcccctccctgaaggaaggattgcttgaaatatgccaggaacacccagaccacgatgcaatgtggtgagagtggtgcttctcacccgggcagcgcgatgtcctcagtttcccataggccatttatccacacacacagcttagaaatcaatgctctgcgattcaaatgattattttaaaaaggatgaaccagatgcccgtccatgggtcgacgatgaaacaagctgtggtccgtccaaaccatgggatgcgactcagccatcaaaagcaaggagcaacccgggaggctctccggagagctctgccaagtgaacaagaccgatccccagggtgcacacactgtgtggtactttcacaacgcattctccaagtgatagaataatagaaacagagaacagaataatggttgccaggagggaaggaggtggcaggggcgagaggaagggggccacatgaagggtcctcgtggtgatggaagggttctccctgcacctcgacgtactactttgagatcctggctgtgatgttgtgccaccgttttgcgagatattaccactgggggaaaacctggtaatgggtacggggagctctgtattatttcttaaaactacaattatctaaaaagtttgatttgaaaaagaaggggttgtctcagctacctgaagctggaagaagtgaggacccgtgacgtctcatgaagaagaacagagctgaaacccagggtggcctgtggctctcaaatgcttgttacgaagccacagtgtgtgacatttctctgacccgtgaacagcccctgcatctcactaagtgtttgtgtccaggtcattcctttcccaggtccaggccactcacacaggccacatccaacccccggctgctgtgagcaagaaaagaacccgaggccacttccaggcacctcttcagggtgtgggtgacagagagcaggctctggagggagggcaggagttgttgcagaggactggggaatctctgtcctggcccatgttgcagaagcacgaggccccacgtgagaggtgcaggtgctggctttgacggtcccaccgcaggcctgagagtgacagtggtggaagcctgctgtgctgggagaggaggctggtgttcgcacctttcaagtggggggcggaatccctgcggaactcatgccaatctgggaagcgaggtcatcaccgtgggtgtgacacagaccttggggccatgcattcataaaacacggctgatgacagtgccaggcctgtgctcaggcctgcactggagctgggcttgaatctcagctctatctgttacaaaccattggatctttcggggactcaacctcctctgtgcctcaccttcctctcctcctctgctagggcacccacttcccggggtgcttgtctatgggctgcagggggtgccatgtcaggaagatgtgaggagctcccctaggtgggaggggagagagaagtcacgtcctcaaccctgcaggaagctccggggaggacgggggctttggggtagagagggatagccccagctttgcttgaggttccgagcacagtcaagcaaggcagatgaggctgagctcagtatctcatgctctgatgggcatggctctgccccccacatcgcagtgagcctggttccttggtctccagttaaccacatctgaactcagtttcctaccctttgagcccattgtaaaaaaaaaaaatacgttggggaggggatgcagagaagaaggtgacattgggacttaccaatcagaaatccagacaggaccccagctatggtctgcaggctggtccacagatgccccctggagaaagtcggtggccaacagcaacaggatgatgttctccaacagcatgacctgcgggacccaggacagaggcaccacacctcgtcaggtgcacactgcctagggacccccgtcccgtgagtctgcagcggctccccctcccctccatcctgagtgcccactggagactccaggctgctgaggagtacccaggagcagggctatgtcccactgagaccttctctggcaaagagagagccaccctgttctcagggtggctcattaaagtgtctgcagaatcataaaggcccaggaaatgtaagggcatccctcaaatggctgtggggctgcctttagagagtcattatgggctgagaggggacttttattttctactttgcatatttctccatcctcacactaactgcaggcactcattagtgttaaaatgaaagatagctgcagagctcatgatgccactgaattccagggagctagggtcacaaactttctaacaactttaggattttgtttccttaaaataattgctttgcggccaccaggtggcagccggagacgggagctcgcaggctgacaaaggagcctggccccgtggctgcagctggtcaaaatggcagatggtccagaaggctctttgtacgcccatctgggtcagcttattaactttgctttccaatttttaaatataaaaagatacgtcttcattaaaataagtaaacaaatgacataattcaaagacgatatatttaaatactgtgtgttttatatttaatatatattttaatttatttttatttaattaaataattatttaatttaattaaaaataatttaattttatttaattaaaatataattaatatatattttaatatatttaatatatatttatattaaatactgtgtattttatttatttaaaaataacacttaaattatatactgatttgctaaaactcttcaaaagatttgccaggttattcattggcttcgtttttcactctcaaaaattcaaataaggagagaaataaaaaaaattatgaggagctgcttcgtaatcctatgaacatccattctcccagtccctctgtgtgcaatgggcagggtttctgccctaaatgccttggccagcagccagtacagaaggcatctttctctccccactcctcagctgtgtggttctggtggttcagattcttaagtttgtcccaactccgtcacctgcctcctgtctttcccgccatttccgtggttctggccccatgcctcctgtctaggcaacccctatcttcattctctctctgaaatctctcctccacaccaatgtcagggtgacccacttcacccagagattgcatcttgccattcctccccgatgcaccttgaaacagccccaccttaacttcaggatccagtccctacttctcaacagagcagatggtcctgtttgccacttagcgcaagttttcctttctggggtcatcttccagcatgctcttcccaaacgacattccactgacaaacagtctttcctcaaccaaactccagtcagccttctctgagccttcttttccatgagtcttcaaccctggccaacgagaactccagactcagcacatatgattccccttacctccccacaccgagagacttgaacaaacactgaccgagtttccagcagctcaaggcctcacccctacgatgctgacctcagtctcctttaagttcctgcctgagaaagcgcagtgctgccaggagaaggtactgtttgttccagccaaaacttggtgctgggtggataggaccctggacttcctttccgagcagttcctttagaaagcttgcagttgcaaatcatttcgctgcgctctgagatatacatcctctattacccagaactgtctcctcaagtacccaagagccatctattcaaatacaaactccaagcctggtgggtgcattgccctaacaggactgactcctgcctcctgtcataaagaaatgagaaatttgtttctgctcccagcaagtgacaagcgccaatgaacaaacacagatggcacactcacatttacgatcccactttcctgctttttgtaaatttccacttccctgtctctggccaagcccccggatgttcctcctccttcctccctttttctcccttttaagccctgtcacctctgcacaacttgaaggtgggttcagttcatgcagggctcttccctatggcgatacactcagtgcaatctgttttcattgcttttaactagcgcagggctttttttccctcggacgctgtgcgcactcactttcctgtggatttccagacactccagggtctttccattacttccgcagctttgcctgaaacgttctagcgccgtccacaccttttcttcaggtgaaccttgctcaccacatagcacatcgtgcaggtcccctctgtaaacccttccctgactttcccaagctctgcctcttgtgtcctgtagggttttgatagcgtcacttctctgatcacagtggctgcatggatttgcttatgtctttgtggcactgagacatgaccctctcacactgtggtgtctaactccattttcagcacaggaggaagctcaatgtgtgctgatgtgaataaacccataacgggtgaaagaagtgagacggggtcttatattacattcagaagtgatcaacaggcaggcttccgcctctgagcaggaggtgaggacagttgagtagatcctgagctaggccagtcatagtgtcacctgtggctgtctccagacgtggattcccaggttgcagtcacacctactgagacagaatctctgagggggagcctgggaatcgccactttataaaagctcccctgagtgccactgacaaccagcagggctgaggcccagctgcactggaggcccccagcccccagcccctgccagaccgttccagcagaaacctctgaaccactgccaggcggtggcctgttggttaaaggccctacgaaaaagtataaaaattaaccaggtatggtggtatgcacccgtgatcccagtgactcgggaggctgaggtgggaggatcacttgagcctagaaagtcgaggctgcagtgagctgtgatcacactgctgcattccagcctgggcaacagggcaagctctgtctcagaaaaacaaaagcaaatacaaaacaccttatgttccttcttgaagggatgtgggggtggtacactctccagtggcccaggaataggctcaacatagctgagcgatgcttgggttggccctgggctacgctgcccaagtctggggcttccagacaggaattgcagcttcttctggggcccatccagggcctggggtctggcagcctctttcctgtgtgagctgctgtctcgagggctggggctgcgtgggtcccggcaccctccgcagaaggtaatgctttcggatggcagcacgggtctgtgccagcagggtgcacatctcagggagtggcgccccagtctgtccactgcactgtggcctcaggcttccaagatcacagtctgggcatttctaacctgcccagaggcactggtttcaggtgctggccactcagccacattggatcaatggagtttagctgggggtgttgaggaacagtgggagaggctgcctcacactctgaatggcccgtgccacggagccagggctgcccagcactgcctggcacagggaggggcccagactcaggtctgggcagtgtgcatggtgaagtgcgaggtgagcatgtccacctgtcatctccgccttttcttcagtttcatggttgcagccccacctcagaatgtgactggcaggcactcttgaaatgtcaggagtttaataggttatcctcggagttatgtgttatttcacctctttatggtgatattggctatctttaccctccacttccttcctcttccctaccttccttcctcttccctaccttcctttccttccttccttccctccctccttccttccttccttcctcctttccttctttctctgctctcttgcccccgatgtctgtttcatttattgtaaattatttatttatctttcagagcatctacatctatctacctgtgccaggcaccaggctcttggctttctatccatcaccttatcaatcctagcaacaaccatttcagagatgcaaaaactgggtgtgggggcagggggagccccggtgactctcatacagttcagaaccgaaggatcctggtatcaagccttagctggtcgggcagcaaggcctaaagcccatgttccccatcacatgctgtagggatccaagcccccgggctaggactgcccggcctggatgggtctgtgcacagcgagagagataaggacactcgtgccactgtggtagatctcactccaaatgtaatggtgtctgatttctgcttttcctatttaatcgctcttgactcagtgatctagtgactgtatgagatggttgggaagaatgaaggatttgctttctttccttctctaacagccctcaaactcctgggagatgacacggcaactgacatgtgagtgtgacaaatgcaagcaaacaaggtggcaggtgtcaaactcctccttattgagctcctgcttatctgggcattggcaggcggggtgtccacctatgaataagccacttcagcaaattggatgagaaaatcaatattccacttctttgttcacttggggatcatgttggttgggaggctgctcatgcatgacctgggccctgccacaagtgaacctatctacaacacgcacgctgttatgctcggtgttcagatgtggacgctgaggttggtgaggctcagtaatgtgtccaacattgcaagtcctgtgagctctgcctggctctatagcctgtggggtcactgtgctatatgggtcctaaaatcagcaggtgtctaggacgcttccctttcctggacaggagctgcatcctgcctttaccttcacccaggtctctaccctggaatgcctgactcctcccacagaagtctctccttttcatatgaataatggccacaatttatgggttattttgtgccagctacttatgtatattattttatttggtctttacaggaaccctgaagagtatgtagatcttatttaatcttcacaggaacactgagaggggggtgacttattcctagcgtgtgcatgaaaaagtaggttcagacagtttaaattcttggctgaagccagctggtggtagcagtcagcagagctgggctccagtgcaagttttttctgactctaaaacccatgccccaccaatgtgattgtattttctctcctttgcccattataatccagctcaacctccactgtcctgccaaaagtgtctgtggtcatcctgacgagaggtgatgctggcagctactcctatgagtcccagacatttttttctctcctggcatctagctacgttctgtctgattttggttatttgggtgtctacttacttaccaaatattataagttcttcaaatatgaagaaatctctacgggactcaaagcaatctgaagaagtattaggccacttttgtgtttctgatactctctagggccatgcctggatcttattcataaacccctaataaaaatggagttgattaacagagacattgagtatatgatattatacagttgaactgtaatgatattcagcaggtgggctgatgtagagaagacatcaccaaatatgcctcagttgttgccacattgaatgcagggccacagctggaggttgggttactattttcaaagcctgtcatctctgttcaagactatcatttctttaagaatttttcttaaactaagctattccttttcaatagataggtgtgcattggtgcacacacacacacaccccccacacacacccacacacaccccacttgctgtatacactgtaaaagttaggataaagaaaagtgccacttgccatgtagaacgtgaccatcctatttctagaagggctgtcccagaagctgaggtagcagaggatgtacacggcccccacgagcaggttgaacagcctccagtggcaggtgctgtcgatgatgtcactctgctgggcgacaagccagaatgtcatcaccagccagtgggcacctgcagagaagccgggtgcagacgtcagggtccatgcaaggagatggggggacaggcaaggacacagagaccaggggctggaaggctctccgaccacatttgactcagcatccaagaagagatatcaaaacccagaagagatttgagggggacagaaaaccaacacagtttatctttgcatgtattatcccattttatccttataaagggtatctgacctaatttgaatatgacacaagaaagagtagcttcaataacacttgccaaatattgtatacctatgacctttttattccagaaagtgtttaaaggggcagttataaaactgactgccaattattttaaaattgttacaagagcaaaaaacctccacatgcaaaggaaagaactctatgtggtgcagctttaatttttatgcccatattttaagacgaataaatcattttggatttcaagctgattttttttaaaaaaagaataacaaaatagctaatctctctttagaagcacagttctttttttcaaaaaaattatctttttggccaataactgtattcaatgtttgctctaggcccaaggggcaaatatttcttaatgtctccaattctcttaaaacaagagtaaactgttccttcttgcagagtatattcactgatgaccagagatgacagctctcctcggcagggacacacaggccctattcagggaatctccagagccagatagactctctgtcattgccattcatattgcgtgtgcctagactgagggaggagggagggcttggatttagtggagctgtcctatttgcaacagaggagatgtccaagattcagcattcaaaggaaatggtgcacttttggaagctatgtgcagtatgacatatagactgtatatttttatatcaggtgaggcaagtgggaccttgtacctccctcctgtttcagtgacagtttttctacataaaagattttggcctgtaacacagaacagtctcctgagaagttctctgctccagatttagctgggagtgttgagggctgggatgtctaagctatggcagagtatctcccaagacagccagcacgcgttccttcctgccctggatgtgtactcatcgggagctgcagtctagtcctccatgctcttgaatctgggctggttgtgcttgctttgactggcagaatacagcagaagcaatgctgagccagttctgagcctgtttttatagaagactagcagtttccagttccttgccattgcaattctcagctgctaattcctgtcaaggctctttatgaatctgaacatctgctaccccattgccatctctgaggccacccaagcaagatccattcagcagagagcccagtcagccttcaggcctgggattgaggatcatatgtggttattcttgagaccttcatttctgggttgattggttatgcagcaacagatgaccagatcattagctcagctcacctgcaaccacaaaaacccaaaagtggtaggctttgtagaacagaaccagactcagcacgcgggttcccaacatgcccatcctccagagctgctggcagaagagggcggcccatggcatggccaggtggcctggcttcatgaagcccatgaagcgagtgtaggacaccagtgcccaggagagtgaggaccaggaaaacagggtgctcacccctgaaagggaagcagaaagatgtggtatgctctgaagattccgaagtaacagtaccttgtgaagattcactcatggcatttctttaatgggatgtgtaacctcttgttaaagcctggctgcacagagagtattactaacccaccactttgaccagtaggtaacataacaactctatgtccaaatacacctgtctatattcaggaagaaatggggatatgcaggaaatatttccactgctcaatgtactaaatgctcttcccagcaaatgggctggactcttcctttctacgccctttaagaaaaacgtcccagctcctgatcctctaagtcctctgtatataacaaagctgattctacaaggctctgaacatggttccaccccaaatgtactttgctgttttatccatatgaaggaggtttaataaaagaacgaaaacatcaaatggtgtcaggctctttgataaagatggatggaaggacagtgcaggcatatatgtgaagcatttaatttgtgcatatgcaattgtggacactcagcaaagaggaagggagagatgaagatggaaggggagaggtggggagggagagaagggggtgaaggggaggggagaaaaggggatagcaggagggagagggagagggaaacaagaagcaactgagagaaacagggagagacataatgagaatgtgaatggcctgaaatgagtgggagctggagacaaatgttgctggggcctgagttgttctcagtttccacatggctttgaaggtataagcctctggctttgttaagaattattattattattattattttgagacagggtctcactctgtcacctggactggaatgcagtgatgcaatcatgactcactgcagcctcaaactcctggcctcaagtgatgctaccacctcagcctcttgaatagctggcactgcaactgcatgccaccatgcctggctaatttttgtattttttggtagagatgggtttttgcctggctggtcttgagctcctgggctcaagcaatccacccacctcagcttcccaaagtgctgggactacaggtgtgagacttgtgcccggccaagaattattctaatgattaaagacacaagaaaaacatgtgcagtgagtttatggagaggcagtctttccaaggcattttgaggataattttgattatgggcaatttctatcttatgggctgactttagaacatgacccttaagaaagaagggagccaactctctgtaaactcaatgcaccagcaaaagccagttttaagcatcatctgtgccagtgagctcaaggtgccctaatgctcctaagcagaggaaatctcgaagggagggttttgctaaacaggctcacattcctgtcccccttcggcagtcagacagtctgtgctctgtggtgacagttactcacctggcacaatatctgtgaagtctgaggctagaaaaacatatgtctgaagcagcaggtggggcccagtctgcagcagggcctccaagagtcgaagggccgacaggtcggcctcctgcagctgcagccagcctcggtggggagcctccagttccttctgcagactggtcagtgcagcgtcccagtgcctagggaacagcagagggcacgtgacacggagccaggctgtggcgagattcaataggacgagctttcatttagagacatactacatgctaagcaatatcctatgcccttactagtcacctagagttactagttaggctgttgccagcctctgactgcaagcagaagacgtcacttctatgtaagttccccgagtcctgtggtgctcagccaggccacactctccccacgtctggtaccccagtacctgacctgggggctctttgagctggagcggctgcatggcaagggaacccagactgccagctctgtgaagctcggcaatcaccccgacctgagtcccaccccggatcctcttgggatgggaattcatttatcgacagatgtctgttgcaaggtactgtgtgttatcatctctttgaaggacaaaaagtagaaaaaacccttgtcttcatcctcacagaatgtagaactctgtgctgcgaaaactggggcacatgaagagcagacagggaagaaggatctggaggctttgctggggagtggccagaggtccaggtggctggagcaccatgcggagcttggaggctgatgtggtcccggtgaagtagatcagggccctgaacttcaggctatggggtttggattttgctctggaaaaatgaatttggcagaggtaatatgtactgtctggggtatgagatgaatgtgtatggatttgtgtgtctatgtatgtgtatgtgcatgtgcgtgtatatgggtgaacacacatgtggtgtacatgtgcttgtgtgtgtgtgtatgtatctgcatgtgcatgtatgcatgtgtgtgtgcaagtgtgcaaaacatatgcatatgtatataggcattatgtgcttgcatatatatagtgtgtatgtttatatatgtgtgtgcatgaaggtatatgtgtgtatattcatgtatgtgtgcagtgtgtatctgtagtgtgtgcagtgtgagtgtgtgtgtgtgcacgcatgtagtgtgggtgtatgaacaggggataggaacatcaggaggaaacagagctaatagaatacttccagcagtaattggtgaagggagtcctaggaatggaaagtagggagcaggtgcaggaaatagtggagttggagatcaggatttgatgactgaacaggggagatgagggaagttgcagtggctttgaggtttcaggcctaaatgacttggaaatggtggtgctaccgacggaaataagccaggtgaggagtgctggattggccacgatatgaatttcttcagcagtgaggaatgtgaggatgggtggagcccccataaggagagatctggatgaccagttgtggttgagggactggaagtggccagaagagactgtgtgaagacagcatagaccaaggacagcaccctggggactgttcccactaaggggcctggatacgaaagggacaccagcaagggtgggtggaagccgagaaccaggcagcggagagagctgctgatctctgcactgtggattacaggatggggtggcccagggccacggggacacatctgctcacccagcctgggtggtcctccgaggctctcggaaaaggaatcaagcaacaagaaagaagtcagaacatgtccttgcttcagtctgtttcccatgagcctatgccaggcacctttactggaaacttcatctcataagtagaaagtggcacagaccaccttccttacaacctgaagatccacatagaacccatgaccacgaagccactccccaccacaccagcgggctctcaggcttcgagtctcacctggaggtcagatttcgccaccacccaccaattcctctctgggtctacctagcagcagcaataaggagatgaccacagccgcctgcacacgagcctgctgcccagcaaacccactggattctgcttccctgtcttgttcaatttaagaactagaggtcacttcaatttagcaactcctgaagccaagctggatgcatctcgaaggtcacctgcaaaactccctgtagagacccctaaggctctgactggcaggtgacaagctggaccctgatgggtggcaaacatttctatgtccagagcagaagattcggggactcctctttgaaatggctttattcatggtgctgagatcccaggacagatgtctaagaaaaacaactttcctttttcatgatttggaatcctggagtgaacccatttcttactgtgtcttgattcctgacataaacttaatgttaagaaaaacatatgacactaaaaaatgtaaccatgagggcaggcagtagttttcttttcactctcaaatcatttgttcctgacatggggtagtttcctcttcttgctcttccagaaagctttgtttgttcaacatgcatttttcttgggctttgagaggcccacctgctacagaccacaggcgaagtaagagaaatgaatcccagctttttgggaggccaaggcaggaggattgcttgagcttgggagtttgagaccagccctggcaacataatgagactccatgtctacaaaacaaaacaaaacaaagagctgggatagtggtgggtgcctgtagtcccagctactcaggaggctgagatgggaggatcacttgagcccagaagttcaaggctgcaagtgagccataattatgccactgcactccagcctgggtgacagaggcagaagactctcgtgaaaaaaaagaaaaggggggaagtgaaatgaaagatgtcttttagaaacctaagattcagtgtggaaagaaaacatacaaatgcgaaaagcttcaagaggaagaaatataagtatcaacatgagtggcttgggtagtggtggaatcagagtcacaggcagagagaataaggtggtcagggaatgcttcctggaagaggaggacaggcaaactctggacaggtagatggtaggaagagcctaaaggagtgtctggggtcagtggcacagggtacaaggcactgaaatgaaggtccatgtctgggaatagcgaatatctggtgcttggtaaggcgggggccaggagaggctgagttgtggggctactcttgtaagaaacagaggaccagtgggaaggtgactagcccggttttctgaaacgagctgtctcgaacccattgcagagggagaaattcaggctgagacccctggacagccactagggaagccggggaggaagctgaggcgggatggagagcgtggggatttggtcactaggtcctatgagatggtgtccgacatctgtcctcacagtcgctgcatcattccaggtccttatcagcacttgcctggatttctggctgcctgcatggaccccgtccctcccaactctgttgcattttattgtccctggtgccatctgtctacaggctcatttgcccatattattcctttgctcaaacccttccaacaggtctccaatgcctgaggataaaatccaaactccttaatccagtagaaaagtttcttcatggtccagcccatttatctcctgccacattcctgccatctaggaaattcttaccctttagtctcaagaacctcatcctaatttcccatatacaccacttctggcacgcatctatgtctttgcaccagcggctgcagcttgctgtgtcggaaacgcctgttccctccctacattgatggaaatcgcaacagccttcaagcctcactcgagggatcctgaggcaggactgggccctccagggctagggctatattttatatacttttaaatattaaatctccacccatttatgctgaacctgtcttacatacctttagagtttaccttaactttccttttgacaaccttgaactttcactaaagaaaaattgctaaaccaaggtgcatgctaaggatgagataggccttcttctgtcatctcatgctgcatttacaagtggatttgtgggcttaaaaagaaagatgaaaaagatgttggtaacatacagtattaaagtgtaagtaaaaaacctaagtagaagaaagtaatggtctttgtttaaataagtggtcaccaatgtcaggttctcttgaacagagtcagacttaaaatgaacatagtatgtattattgggaacgttaaaaagaatacacttatggcttaaatccttgcctttttatatttatttatttatttgagattgagtctcattctgttgcctaggttggagtgcagtggcgtgatctcagctcactgtaacctctacttcccaggttcaagcgattctcatgcttcagtctcctgagtaggtggcattacaggtgtgcgtgaccacgcctggctaatttgtctatttttagtggagatggggtttcgacagtgttggccaggctggtttagaactcctggcctcaagagatcagcctgcctccacctcctaaagcactgagattacaggtgtgagccgtcacgccaggccaaattcttgctttttttttttttttttttttttttttttgagacggagtctcgctctgtcacccaagctggagtccagtgatgcaatctcggctcactgcaagttccgcctaacgggttcatgccattctcctgcctcagcctcccaagtagctgggactacaggcgcccgccaccacgcccggctaattttttgtatttttagtagagacggggtttcaccgtgttagccaggatggtctggatctcctgacctcgtgatccgcctgcctcggcctctcaaagtgctgggattacaggcgtgagccaccgcgccaggcctcaatccttgcatttttataagcaactttgtgttttactggattctcagttagcagattcttttgtattttgtgatgaggacactcaaagtgacctattcttaggcaattcaaaattgtgccaaacgcaattgttttggctccccctacaggtccttttctagaattgcaatttggaaagctggattgcctcactaaaaatactgcttcactcagtgttgtctttgaaccctatgtgctagtttcaggatgaggaatggatccactgctgtctattttaactttcaaagctttcctctatggaagtaaatttctgttttttggttcatgtttaacctgagaaacactgcaaatcttgcggcctttatgcttgcactggctgttataaaccttagggccaaattgtgacccgcttccgatagctgtgcattctggctctatcttgttttctaacatttcatctcgatacctggcctttctcatttcttttcttttcttttttgttcttttaaggatgtgtatttttaaagtcatcttaacttctttttcaaaacaagaataaatatatatgactaatggtttttcctaatttataattttcatgtatctcttcacttatctatatgatttcactagtatataccagattattcaagttcgtttttttatatacaccagaaaatcatggcatcacttaagaaaattaagagtgcatgggaaagacagtgtggggtccactgtgaaataccagcagcatgaatttggacacaccgtggtcccctggcagccctcatctctgaggaaggcagtggattccatgaggcctgagggtccacacagcctcagaaggcagatttgtctaaccgttcattacccaggaagcttctctaagtgaccacctgggcttacctctctctttgggctgccaaacatgggctcatggtagctgactcactcaacaggcctctgtcctcgagggctcatgccttacgactgtgatggtcaaagccaagtaagacccagagcccttaaggattgattactgggctgggccgatcagggaaggagacgacaatggcagctagggcacaggagaggctctgaccctatgaggccctccgaaagatccttctctgccttctccgccatggaaggaagggccctgtcttttcaggggaacggcactgcttgaacaccaaggccgagcttttggcaaaatgcctgtggctgcaaatatgctttcggtgctgttagaggtttagggtccaactctgagggtccagtgaaactgagagtgggtgcttgaagtctttctcagaagcaccctctacctcctagctgagattctactctgggcgggacggcaccattccctgctcacagtgatgctctatgtggggctcatcactcatttcagtgcctccggagaaagtcttgggaatagcttgcaggcataaacccctaggacacacagcagcattggccacgaccccttgaacacctttccaaccctcagtgcctatgatttaatgaacacttgagctgcagggcttcaccgctctgatccctgaatttttctcccttaaaaaaaatcctgtggccaggtgcagtggctcacgcctgtaatcccagcactttgggaggccaaggtgggcggatcacgaggtcaggagaccgagacgatgctggctaacccagtgaaaccctgtttcgactaaaaatacaaaaaattagccgggcatggtggcacgtgcctgtagtcccgcctactcaacaggctgaagcaggagaatcgcttgaacccaggaggcggaggttgcagtgagccaagatcacaccactgcactccagcctgggtgacagagtgagactccatctcaaaaaaaaaaaaaaaaaaaaacaaacctaacaacccaatggaattatgaggcagcagctgccagctgaaatgtgcccttgatataaactcactgacacatctcttctcatagctccttgaatccaggttctcaaagtagaaaaaaatcagccctcacctgtcgtgatggtctatggatcacggataagcccaccaggccccagaactatccctggctacttctttagagaaaaaactagccctggcatccaaatgactttttcctgagacgaagtcttgaagcaaatgtcaacaggctggcttcattgtctagtctgtggttcactaaactatgccaccttcctgttctaaggtgacaggtgtgcagatggaactgccttaagtaagttgctttatatggaactaacggctcaaccaacaaatcaaaacagcaagacagggcttcatctgaagacaagaaaaagcctttcgtaaggtcacagcttcacagagaaagagcccctgaggttggagatgctcaaaaaagtgcaggctggacccgggcatgccaatatcagagcaggggtttgctgtggccgctttgaacctcttcccaatgctgaacttttatgagcttgaggacagaatccacatggagagaagattcctctcactgcacttgtgcaattgtgctccagaggtgaaagaggcagctgttcttaccgcttccaaacaccaagctgtaggaggtgcagcatcatcaaggagcaatgccctggatgcccgtctgctcggaaccacaggtagctcagggcctggaccaagaacccgggcaggaggacagcaagggccagccacccccacagaagccgtcctgtggtgaagtagtaagccacggtgtaaaggcctgggtgagaaggggaaaggcaagcaggttgttggaaggctggagtgagactgggtacctgcattttaaacaactgaacattttctggatgttatgatgttctgacctcttaaaatctttctggctggggagtgactgtccctcccaaggctagcaattatttcagctagcaaagggcccagccaggagcttgcctttgacatgcgaactaaatctagccagagccagacctcccctacctggcccatacccccgcagaaggcaatcttcttttgccttaatcatcccagggcccagtgccaggaaactagggaccacccttataccccaaagccacagaaattattcaaagggctaatctgaagctggtgctctgccctagcaaagcgtctggcctcaacttcccctggttcctgtctcctgcctcctgaccaccctggtgacattcccctgtggcccggcatggtgtgccatgtctcctgtcctaggacctgtgagtacagcaaactttgctttccagagtctctcctgtgtctcatcttgtggccacacctaattatctcattaaaaacaaaaccaaagcactttgggaggccgaggtgggcagattgctcgacgtcaggagttcaagaccagtctgggcctctctactaaaaatacaaaaatgagcaagtttgctggctgcgtgcctgtaataccagctactcgggatggatgaggcaccagaatggcttcaactcaggaggcggagtttgcagtgagtcgagattgggccactgcattccagcctgggccacagagcaagactcttgtctcaaaacaaaacaaaacagtaaccaaccaacacagtgtccccatcaccagcaagagtctcctaggagcaggctgggagccagcagagcctctggcaacagggacaggcattcactaaatgacattgtcagggctttccagagctgttgggcaatatacgacatgtgtgaagcgcctagcatcttgtgcatcctcgagaacgatgaaacctcctctctggtttgtttgcttgtttgtttttgatggtggttacgcagtggagagagaatgtgcactccgcagtcagtaactccgcactacgaaaccgttagtccctgtggggtcacagctctctctgtggggtcccttttctcctactttcacatggggaactccctggcctggaactctgggcctccccaatactcctagcacggcctcctcagggttgtctgaggctgatcttggaggcggtgcgctggtagaggcaccgcacacaggcatcgtttcacacaactgttacttaggttttccaatagtaaagttctaagtggatgaatgaacacaagccgcggattttagggaaactgggaaaactgccctgaggtacagctgcagacgctgcagctctagaccgcggggtccgggctcaggcagcccttagcgcccaggctgggtccggctgtcaccaccccgagcgtcctgcggcagcctcccttgcacgaaaagccttcggtgctgcagggctggggaatgctgacacccagtccgtgcccagctggagggcaagggaggacacctggggtgggtgccgacccccgcaggtcctgtctcagcccttccagtccggggcgcggagccagggcgcttgcgcgtcctccgtgtgcgtcctgctcggcgcgcctcggaagcagcgggacctgcggggacgcccgcgaactcagggaaaagtcccaaggcggcgttcccagggtaccccctcttccaccccagggactctgcccgggaaaaagcttccgcagggagcccggcggaagtgggcggagacgctcctcccggcactgaaggagttacgcgttcaaaccagaagggcgcgaaaaatggggccatcttgctccgccgcggctggcgggctctgggttccccctgcgacggaggtggcctcgaagggccgcgtcccgccccgtcctaaaccccgaagcggagtcgccgtcctacagggccgcgtggatgcggagccctgtccccctccccccgccaccccttctgcgagcggcctccaagtcgcagggtccccctggacggccgggggtcgggggagagcccgggcgcccccagacttgcgctcagcacatcttggcatcgcagcactttgcaaagcttgtgatggaaggaagggcggatacatctcccctgcttctgcgaggggatcttgcatgcgtggggcggggggatcgtgcatgggcgggaggaagtcaagcaccagtcgggaggggggggaaccgagcatgggtggaggaaaatcatgcatccttggggggatggtgcatgcgtgggcatctactaaggacgggaggacgtgctctgcaggtgggatggccaccaccgtgcgtcaccggcgcgcagtgctgggcgcaggctggggcagtgcccgcccgggcataggcagcctgtgcggctcccggcgccggggtggggttaggggctgcaggggtgagcacagcctcgggctgccgcactcacgcgcgctctgctcggccgcctgcagcagggccgagagccccaggagcctcgcgtgcatcttccgtgccgaccccgcagcctgcgcccgccccttcccctgcacgcggccccgcgtcggggaggtttccggcccggggcccgactgcgggtggcatttctggctaagccgttaggcgcgaattgtatgtctggtttattcgtagtggcca

SEQ ID NO: 2069 - DNA, 74 bp, Homo sapiens
actgctgaagctgccatgtctaagaagaaaactttggagaaaaattttcttcttagacatggcaacgtcaacag

SEQ ID NO: 2070 - DNA, 82 bp, Homo sapiens
agaaactgctgaagctgccatgtctaagaagaaaactttggagaaaaattttcttcttagacatggcaacgtcaacagtttc

SEQ ID NO: 2071 - DNA, 371274 bp, Homo sapiens
atgcattttctcttagtttaacaagttggaataaaatacacaatttttataaagataaatgtcaagaagaaaaactgaagtatacttccaagcaaaatttattagatgtctattcaagaaaaacacaatgacctttgcttgtaagaattcaaagtcaattacctggaagccaggtatgaatagttttttcttttaaaatcagatacagagagtagaaacagtaatttttcttaaatatgacaggcaacagatattgaagtcttttctcataaatggcatcaaagagaattattcatttatcagcaaagctgcatgcagttgacttaatttcaaacctgaagcctttaaaatatgaagctggttatgaacttgacagaaatcaaggtaggctactcaacgatgtttctttaccttcttcctaatgaaattcccttgtcatcagtcagtagatatgtacatttcatttggcttctacgatcttttaacttcatagatttttgcataaatgctatctgacagaatcacactatctaggggtgcttgtgatctgtgagataaggagaggctagtctgctgaaagtgttgtcgcaggataaagaccaaattaggaaacgcccctgttttctcaacaactagtctgtacaaaaaaagagcaaacatatgtacaaaattctagaggctacgtacattgtgaaaagatcaatatcactgtccatgaaagagatgccataaaaagttttatctgtaaggtgctcaagatccaaagatgaacagttcttatgcaaagtcataagaaatacaaagctagttttcggagcaggtgtaattcaggcactgtgaaccatattaaaccttccaggtcccaatatcattttttaaatttctgcttcagggcagaaaataaaacctgaatgatttaacattgcttctaaaaagtgcctaatttattcctaggaaatattttacacacaccaggaaaatcaggctcaacatattcctgtcctcaaatgtagccaggattctgagttccatagaagaaaaataattattatagtaaaaataattgtagtaatcctaatccttgctaaaaccaactttaatacttgtgatgcttctgtactctatttctataaaataatgtgtgagattctattacatttccataaaatgtacaacatatcatatggattatatgttctcatacaatctcaaatgtgtatgtgtacacacagtgaaatcttacctactagtattgcttacagatactttcaggtgtctgttagaataattctttgcacctctcactaacactgcttttacttacattttttcagataaataaaacactaagagctcattgttcatgatgctgatcattacattttaatataaaatagcgatgcaactttacaacacaatagttttcccctgtagcctagctcagcctcttgtattgtcatgattattaccgaaggcttttatttacttactgtttgcacttctaaaaaatgcaaacaaattgcagaaaaagactcctatttgaaaactcacattcaatcagcaaaatcacactcatccaaattaactcgcctcctcttgctttaaaggttgtaatcactgtgcatattacaacatgtatgtgcaggcaaacaatagctaaagtacagttacagttgtcatattgtgtaaaccaagacactaggcaaacttgtgaaaagaatacacactgccaagcgaagaatatgaaaatgcaaaccacagcattccccaataaacaattttctggtcgtcttgggggagaacatcgcctggggggagatgttgaaatggagccacgaggctggacagcctcctggagacactttttttttttttttttgcctcaaatatttgaccatttttaaatatcatgatttttttctttctgatcccacattttgacgtgtcaaagcttagagcaggaagtaggaatccacactttcacggagggggaccagcctgccatgtcgtccccaggctcacagcagcggcggctactctgctggtggtttggtggcaggtggagatggtgacggcgcattggaaaccgtaaggcatgacaacgggaggcccgcggggtgtttcaggcgcgttgacgcaggtgcatggctggcaggcggcctctacagaaggagggagcgcaattcacagcctcttgacgtagtttccggggaaagtaccaaagaatttggttcttcttgaggtccctgaaaatagaagcgagtcatgaaaggggggtgacaacgatatcagttcatacacatgggcttgaatacttcccatttacaaggcctcggaagacagcaagccccgaggggtttggaaaagaaggcaggcaactcacatgaagcccataggcagacaaaataagcagtgttagctggttgcctgacgctctcactgcccctccggcataaatgctgcgctgccatcgcggcaggctaaacagaaatgctgagcctcccaagctaaagggaaagtcagccctgctgaggaggggggcggaggagctcagtcactgaggctgccacaccagagtcgggggtgagggatcaaggcgaggctgacaggtgacagggtgagtggaaaatcctaagagcaaagcttctcagggaccagcaacccgcgcaacacaggtgcgacatgaagacatcatctgtggcaggctgtcgctgttccaacagttttatcatcttacagaagatcatggtcagtgccacatcatttatttaaaaacagcactgccagagtccttcatcgagtatacaatttttcaacaatttacaaatcattaatgaaaaaaaggattaagcactatttgtgtgtgggagttctatcagtggcatgatttttaacatggtgtgtgtttaaccacacgcacaaatggctatcataattatgttcgcctctggtttcaaataatgtaattccttggacacttcttgtaaaagttggtgcactaaattgctaaattcttctttaggcagcgcagatggaccggataagggtctctcaagcttcatctgtctcctatatcctggcacttactgccttggtttgatggctgtttttctttttccttggctaggcaagccattttacgtttctcctccctcctcctcctccctcctcctcctcctccttgtttttgagatggagtttcgctcttgtcgcccaggctggagtgcagtggcatgatctcggctcactgcaacctctgcctcttgggttcaagcaattctcctgccttagcctcctgagtggctgggattacaggcacctgccaccaagcccagctgattattgtacttttggtagatacggggtttcaccatgttgaccaggctggcctcgaactcctggcctcaggtaatccacccgcctcggcctcccaaagtgctagaattacaggcatgagccaccgcacccggcctttttttcttcttttaatggaaataaaatcagaggcttgtggccgcaccagggcctcaattctttcatgattttgccaccgatggatgtctagagtgagccctcctctcctctcacctttcctctcttccattctctgccctgcagcctgtgtttccttttcacctctttctgtggcccagtgtaaaatacttttgtctacaaatgttttcccagaagacctctcgtctttttttttaggatggtaaagatgaagttgccttttaagtgggaagaatggaacgtctctctgcttccaccacaaactaaagttaaggtgagtcactgaatgttcgggcatctacgtcagacctaggaaacgggagagctgttcacttaatctcactccctctgaaattagattctcactgtggacaactaacattttccacagcacagagcgttgatatttctcttctggggaccatttgttgttgttgttcttagatctcaatctttcctggtttttgctatttaaagaaattgtcttctctcagttgagttggaaataaagctcgcagaaaatcacacatagctgaagcagtgaatactaaactatattaaaaatgcaatagccttgggattacattgtgcatatgaatgtctgaaagatcaaaggcattacgaattcaaaggaagctcggccatcacagcaaaccacgggagtgagcaaactcaagcaaattacaaaatagccgaaggtgcctgaggaagaagcgcacatacccacaaaccagccgtcatcacacttttccatgacatcaatgacatcactttctctgagctccagctcatcttcattcctgggagtatagttatacagagcctgaaaccttaaacaggacaagggaatgtgtttaaaaacatcttgacaccttcatgaaatatagaagatagaacaatattcattcttcctttaacattcctattcttaacaacattctgttgggtggtacaagcctggtaagcatgtaaatagcattctattggatggtacaagcctggtaagcaggtacatagcaatatgtagatcttcacaggcattagaacactctaacaacattttgaaactcacgaggaatatccatgaaaattgtaacattcataaattggattaaaatatgtcaacatgtataagtcagacccgcatttcagttgtccagccatctaacgtctatcatttagacattaaataatagtacaaaatataaaataagtgatatttgtattatttaactgtttaaaaacaagaaggaatcacaattttagctagccataatcagaagcaaataatgggggcttgagaattgaattttcaaaggttctaaatggagatagacaaaatgtgtcagacatgtctttttaatcactctgtgtgaattactatacaaaggaaaattattttttttactaagaggaattctttagatcagtttaatgttatggtttggatcagtgttttctgaggatgtagaattggaagatttgatgtaattagcctatgaagttgagtagatgtattctatgtgcagttattactgattccatttcaagcagactatggacataagtctctttttaaaatgagtcccagaaaaattgtatttgattttaaaactctctcttgaaataattttatataaaaaagaattattgatagaatgctatcactttcctttcccggcctgaattctttgacagcatatactgtggtggaaattgatcaataatgaattcagacactgaatttgtggtaagaaaacaccatacattataataaatagtaacatgggctggtgtttttggaaaatgaaggcgaaattactgtagctgagaaggtcaagaagaatttgataggcagttaacatgaaaacttcttcataatagtactaaaatattaccagtactgtgagggggtttttaaaaattgggaatttgtttctgctgctttctgtaacagtcatgtcattctgctaatgtgagaaaataattaccactttctagggtattttagattttttcatgccaacttaaaaaagttgataatcttgactaccgctccggaacaagaatgatttatttttaattactttatgagtcagaaaataatattttggtagaacaaaactattctatcatttaaactcaaatcttatgtcattaataagcaacagtgacctactggcttccccccgttcatccagcatttggactgggggagctggatagagttggcttcagagaatgcctaacaacatcccctagaaaatattgttttccctggcctggcaccaaagcctgaaatttcaacattagaggcttcttctcctgttaaaacttcatccttccagtagaccttacagccacttatatccttttgagcatgggcttctgaggccttttcttgagagaggggtttgtgattatggggaagggcagagaaaggcagctagcatcccagagtagtggccaaaaagacaggcaggtgtggaatacagaaacgtcacctgatttggatgtttgcatgtggccagctttgctaggggtagtccatttattttgttgcttgtgtaaagaatttgatttggaggctgctcaggtgaaggggtggtatcttttgtgtatctgtggggaaagttcacggtcccttttccagtttcacatttgagagagatggtggttcctgggctgctgttttgatggatacacacggcatttctcactttgggaaaactgattcttttattgagcttctcaggcttgaaccctgcccaggctcatctccacccactcatggagaccggttacctaaggctgcaaacctcagctgctggaaagaatctcaaggtctcagagctaacgcaacaaaattggcacagactcctgcttcatttttgtctgatgaaagccagcatgtttgtccaaatttatttaccattctggtttaattagaccacagaaacaaaaacaaaacaaaagaaaacccacggagttttatggaaacgtaaacacaccttcaggaaatcctcctgcctctcctggctttcaaagccagtgttgcacaatgggaaatgaagacaaatccaatgttaaaaaatgctgttgtgaaagatgtgttggtgaggtgagtgatggtggtggggtaaggatgcctcaaaaagaaaggtgtcttttaaacaggaaatgctgagccagactggaagccctctcgataacttgcaactttttctagaacatatttcactaaaactctgaattgtagtgacataacattatgttcctactttggctcaaaacttatttttaaatgaaagcaactaagcaacaccctaaaatcccactaattcaggctataatcaaatataaatttaataaacaatgttttctaatatacaaatcaggactttgaaaatgtaacatatctttcattcataaacactttgaaagctgtttaatataacatgttggtaatgcaataaacctaaacagccctggaatttattttttatcatgtgatcttatcatcgtttgggtaaataagagaacaaacaaaagctttagaatgacaagtcgtatttagtgttttccagttaagcgatctttttgtttgtttgtttgtttgagacagggtcttgctctgttgcccaggctggagtgcagggccatcatcatggcttattgtagccttgatctccctggcccaagtgatcttcccacctcagcctactaagcagctgggactacaggcgcatgccatcacacctgactaattttttatttttatttttgtagagatggtgttttgctatgttgtccaggctggtcttgaactcctgggttttggccttccaaagtgctgggatttcaggcatagtgactgcacctaaccttcagtgagatttcaaatgattatcactgctaacctgttctttccaaaatacagactttcccgcaacaagaacacttttctgcctgtgctctgtgagagccagtctcatccggagctgctttttgctaagtttcaggtctgtgaggagcaaggaaggacttgatggtgataaaggcaccaggtcatatgccaggacctgccgcaaggaggaggctattgttagcctgttctgctccaggtgagcagagtgtgggcagtgggtcaggatccccagtgtgtgctcagatatgggggacaaggggttaggtccatgaataagccttcccaggggtctcactctcgactcacagtgtgggcagaggccaacaggaagctgataactcctgaacgtctctcagggacaaaatgggcccgaaaaagaaacacacagagagaatcttcaagacaacgtgtgacaccttcaggctgatttaactcatgtatcagaaaggagaaggaatttgaaaggaaagtttgaaaaggcattttcctggtgctgtggaagtaatcgcatgtaactgaataacagtgagtgttttaatactgcccttttcaaatgacccttctaagcatgtaactttggaatgatggaatgatcgctttaggtcttttttacactgaggtccacttttaccgtctcccagtgggtgtaaaagtaaggttagaacatgttctgtatgtctttgaagctcgcagttactcgttacacagccagcagagcagagagggagacagagttatccatcttaggaatcactgaagcattgggaagttttcctagtgtgtcaattaaaatcttctcagagaactatgggttcttttaaaaattagtttctggtcactgtcataaaagatggagagactattacaatttctcgtaatttaagaggcctcatgttagtttgatctttcacgtgcaaagccatacatcttacattttggtacagttgtccattttgtgggtcaaggttagtctcaaatttagaagataagaagaatacttacggttcccccccaccttgaatattttcatgagtaaacacaggacgctgtggctgaaatgaaatgattttcaatgtaatcaatgtttaaactggtactaattaaaagataatttggataatggcatggtacttttcttgacatttaatatttcctgttgtaaaaaaccaagaggaagaaaaaaaccaaataaaagctttctgcaggattaataattaaaatatttaaagggagctttaaattaaagcaaaataagcaaggtcaaatgttttgaacatgtctacaatctagtctgctcaagctttaaggaaaagtcagggtttggtcccattgatttttcaaaggccaggaataaggcaagaacatagacggcaaaccactagaataggaaatatagacaccttcatacaaccttattctccagcgttttctcaaacaagcagaaaataaaccacatttagtttaacagcaaagtatccacactcattctttcaatctttccttcacagacaacattttcacatacagcacagaggaaaatatcaataggcagacatcccatgctacatttgaattaacattttctgttctcaatgtggagagaaaacatgcatttttaaaaagagaaaacagaactttggaatgcaacgaacaatatccgggtaacatgtaacattttaccttagaagagaaacattggtagaaatttccagtgcactgaactctcaaaagagtttcttttctttttaaactaagcatcaagaccagtatctgtaatagatacttataatattggaaatgacaagccttagcatcccatatacccacattaatattttcagtgaatgaaagttaacatgtttgttgaatatataaactcagtgtaatttatattgactacctaaactttaccttttaggggagaaatgcaaacaaatcattcataatccatttcaaaagcatttgcttctaaatgatagctacagggtaaaatcagaatttgcatggcaattatataagtgactgtttgatgactactgaaatagctattagatccatgtccttagactttgggaccagttcttagatttccatagttatgagtggattactgataggctgaaatctcttgctgccaattgtccatagaaaccccactgatccaagcttggatggataattctgaggttcctttcagtctacgagtcaatgattcacccacttcctaaattctttatccaccccctttctatcctacttgtctatctagcataagactaggtactcacagtactaaaactgtaagctctgactcggttaactggaaacctttattaacagtgttcttagaaatttcactcaacagtctgtggatagaatatttaaaactagagtgcgtaagaattactgcacacaattatgacttaagagtgaaatagtttactcctgtaaatcaatatgactactaatgatgtatctattattaaaattggaagatattcatattttaagaaaaattatgactaaccagttttccaaccatcttaaaggtcatttaattcaagatattattaaatcaatttaaatatataagatggtaattgtaagtcattgataagcctgtatcatattacctatttcaagttctcttccagtccaataaaactttatatatgtataaaactttcatgcagaagtaagatttgtatacatcaattgccattaatattattttgtaataactttccagtctttttttctcagtcttctttcttatttcaaatgtctgcagaataatgttctcccacgtgtgtctacatatcatagttttcttaaccattcctctcttttttttttagttttgaagttagaattggtctagtctttttttttttgctatcataaacagcaatgctatacacattttttatgcaaagagctattttcttcttttgaactattctttagaatatattcccaggagtaaaacttctggccaaagagtatgcattaaagccatatgattttgagaatgtacatgttagtcactgaaaaatactgtactcaaaagtaacttgaaaatgtctaatatgccagactgcatatcatataccaagatagctactactctttccccaaaacaatcatagcaccatttgcagtgcataataaagttatgaataagaaaatattatttattcttgtcttaagagaaaatgttgtgtaaaatatatttcattatgctctaaaattggcatccctgttttcacacatttaaaccattttaatattttaaaattgagtaaaagtttcaacttctacatcatggcatccaatgctttgtaaaactggttagtttcatttcattgctcttttgttaaaatgtgaataccactttaaaaatcaaattgttcattaatgtaaaacaatcaacttttaaagtccgtatatccctttttagttatcatcattataattctactagtttaattcctttaactcaacccacctcatcaatcatttaactgaactgtcccattgaccattatgaaaatttggtgattgctgcaaacctgcagcttcctggatcccacgtccatggctggagaacgtatgttcctgtgtggggcagccagcaccgtccttgctttttttttttttttttttttttgagatggagtctcactctgccaccaggctagaggtcagtggtgtgatcttggctcactgcaacctctgcctcccgggttcaagcgattctcctgcctcagcctcccgagtagctgggactacaggcacgcaccaccgtgcccagctaatttttgtatttttagtagagacagggtttcaccatgttagccaggatggtctcgatctcctgaccttgtgatcttcccgccttggcctcctaaagtgctgggattacaggcgtgagtcactgcgcccggcccccgtccttgcttttacctgtttcccaatttctcttttcccttccttcatatctttcaaaccctgcccctctttttacacacaaatcatcagttttctatactgttcacatcctgaggccagaatcaatcaagacttttcgtagcagagaagttgtgtgtgtcttataatggcgagttttagaacttttcaaagcttacctttaacaagaatcacctccatgttaatgtggataactaggagacagttttgaggaaagctgactaattacagtacttgaaatagtttattttaaaggcatttgactagtagggaatgagtagcaagaacagttatctaagacggctcatctgcgtctttctgttttgggcgttaagcaccatataaccttggggatgcctcagcttccctatctctgaaatcaatgagttggacaagatgagggttaatcgggtcccctcagggattccatgaaggatacacatttccacagatgtatttcctctgctgtgtaaaggtgtccgtcatcagttttacacagagagctgggacactgacattgattggttaattctcatgtgtctcggtcacgtaaaaaaaaataatggttacaattcaactccattttgcagaatggtaaaccaaaacccaaagatactggataatttcttaatacgacaaataggtaaaaaacaaacagaaaaagaaacaaaatggtaatttcgatgtgcacgctattgcatgaaagattactatgatggactacttggcctaccttggctaaaatcagcatcttaattttgacgctgaggtaggtgcaaatgtcctataaggtgatgtaaatagattatctggggagactgtctttcgccctttccccttggtgatgtaactcaaatggcaagtcgcttaagcagagatttgtaatgcagctgcactctgtcgccacctagtggtgagcaatggcagcaacaagctgagagttgtttctgctttatctgcccctttttatccaagttcccaaggctggaaaaattttaaaagcctattttaaaggccgcagagtgatgtggaatagacagtcatctgttttcctaaccatgttcttccctccccacgttttaaatttttgagaaagcatcccttgtaaagccaccagcatttttggtccgtgtccatttctattttgactatctgtgcaggcatttccatttcccctaacttcttagcagttttaagataaatatagaacaatatacacttgtgacattcagagaggcttacatgagctgaacctagaaagatggctttcaactgacacattacaatcactgtgctgggcattttgaacaagaattatattatgcttatatttccttgatgaatcttaagagtagaacaagagaaaaatccagtgaagcatgctgcggttttcatcgtatcctaaatatgtatttttttctgtagccctgactatgtaagtatttttctgtagctattttttaatgttgtcaaaaacggatacaaaagagacaagttttaaacacatgctaatttccaaagccagaaccaatcacaagttgctgttcataaggaagctggtttgaaacatcatggagtctgtaacatcagtaaaatatatactttccgatcttagtgagctacagtctgttgaaaagccgtctaatttatcaaagcttctgcagttatctctggaggattagctatatttagtatcaaataattcttaaagaaggattgactgttactttaaacactaatgcaaaaaaatctctgaaagcaatataagcagtgctaaagtgtttttatctttttttataaaatattagttgtcatatttgcccaccagaattcgatgaaattctcctaataataccacgtttatgtttctagaggcttatttttccttcttaaattatgaaggtaaaacacaactttgcataaatctaaaaaaatagaatatttatggttcacacaaacacacgtgtaatctgacatacaaatacataatgtaaaaatcaggcaaaaaataaaaaaaaaaccttaaggggaacacaagcataccatctcgtggacccacaggagggttatagatgggtccttttcactgcaaaagaagcttatgttttgctttggctctggaaggccattcgggggagtctaagagtctctacaaattggcatttctgtctctatggcaacacaaagctctgcctcagcaacaaaatgaggtcttcctatgcaatgcaaaaagcacaaagtggcatgaatgcagaataatatcgacttttctttagaaataaaaaatgaagacttctgtgaaatcaagcccttgagaacttcttgaaatgcagaagcacggccatgcgataggccagtcaaggttgaatccgggtccattaaaacagaaatgaggaaaggaatcctgacttatgtccagatgaaaatttccaaactccttggctgcattccttagaattgatagtaagtaccatttagagtccatgtattttaaagtactgtagatactatggaacgaagtagctaagggaaagtaatttgacctttaagttcaatcagagctggcaagaaataggaagtggatagaatccagacagcagtatggggacaaaaggcagactgagaggatgtagtgcacatcaccagagaaacagaagatgttagacaagaatcatggatttaaaaaaaatccaaattgaatgacacagaagcaaacatgaccggaagtgtgtgagttcggcactgtagatgcttggcaacagttttttctttgcaggagaaacggtgactagaaagcagtgatttagtgtagaaccatgagacagatgtagaccacaaaacacacgacactcttatttgtagagtagagaatctgaccatgtctttgtggagtttggaaacctcacacacacctaaaagggaagcacatcaccaggtggtcgcttcatcttcagggtgtctccagcctcactttaaggccagttcacagcaaagacaactaaggaagagccagccctgggggcgggggaggtggccaggatgcctgccacaaagtgggggcatgctgaccctaccctgtgggaaccgctgagccctctgacaggtgagccgcagaatctcctagacatcactgggctacgaggaggcttacccaggacacatatctcgctttttacgtcagcctggaaaatgtacaagaagttagttagctctcatcttcgtcacacagacttcaggaggagctttcctggctggctttttccatgcacacacagcatgccaaactcctgcacaacagcagggcagggagggtccacagcttctccagctgcttatacagtttccacaccacaggcaccagctgccatcttaacatggcacccacaggcacagcagaaaaaggttcacagaggaaagctggcatagggaagaggccaagaacatataagaaatgttatatctttttttgtcttttatttttttgagacggagtctggctctgtcgcccaggctggagtgcaatggcacagtctcggctcactgcaacctccatctcccgggttcgagcgattctcttgtctcagcctcccgagtagctgggatcacaggcacccgccaccaggcccagctaatttttgtatttttagtagagacaggatttcaccatgttggtcaggctggtcttgaactcctgacctcaagtgatctgcctgcctcgggctcccaaagtgctgggattacaggtgtcagccactgcgcccggccaagaaatgttatgtctttcatagaatgcttagcaattgggttcaagatgctctcaaacctgccctgctttttcatcttattgaagggatgcaaggtgagatagaggagaatttggcttaatgcctgtcaaatttcatggactgtatcagacatttgttggaggcaaaattttctaacacataagaagaaaataaggcctttttggggggaaacatggtgaaatttgatgaactactgaagtgccaacctgtgggctggactgttttggtgttttttttttattttcagagtaagatctttcatatgacagtgagtaagctgaccttcttttgtgtaggttttattttccttccaatagcggacaggatctggcagtgtactgcctggtatttgatctggcttaagagaacttccggaggaataaaacacgcttaaataaaagcatgtggttttctcaactctcatttagaaaagttttcctaattctcagtaatgattgacctcaaatccccagcctctcgggatgaaatgtgtttggcaccgttgcttaagtgtcgtggcagacgatgcttgatgctctccacatccattctcttcttggtcctcagtaatggggccaggctgttgggtaggcacatggccattctggataaagaccacatttcctgacttgtagctggatgtactcatgtcataagctgagaccgaggggatatatgcaattctgggacttggccttcaagggagaaggtgtaatctcccatcttttctccttcctgctggttcgtgtgagaagggaactactcgagctgccacctgggacccatagcggaagcttctctctgaggatggcgatgagcccacatcagatggaaactcctgggttctctgatgactgcggggccaccataccagtcccggacacccttcatttatgtgtaagagcaatatatttctacgttgtttaagctataattattttgagttttctgggactgtgcttatcccagtcttgactaatacaggggttcaatgcatatcagagctcttagagaaaaaaaataaccccatttagcttttagaatgatgtggatcataacagctggaaagagcacgtgaacatattaggaaaaatcagggcctgatttcatgttgaaaaccgtgcgccggggatccccttctgatgggactgctttagggtgacgagacttcctggtgggaccacaaccactgagttacttggaagaaacctaaaaaagagcctctcactctcctcacagagcttccgctgcaacttgagaccacatgcggcaagtctcttgcaaaatagtctctcggatggaaatggaggctcagcttatagaggagctgagatttatactattttttttgagatggagtctcgctctgttgccaggctggagtgcagtggcacggtctcggctcactgcaacctctgcctcccgggttcaagcaattctctgcctcacccttccgagtagctgggattacaggcacctgtcaccacgtccggctaatttttgtatttttggtagagacggggtttcaccatcttggccaggctggtcttgaactcctgaccttgtgatccacccaccttggcctctcaaagtgctgggattacaggcatgagccaccgtgcccagccaatttatactattttttgttatgaaaaaatcattattttaaaagcagatgctcagaagactgggggaaatattggattcagatttatacattaaacataatttatgtatctttcagtcatctgtaatctataaagtggtaggaacttttacgtttatggaagattctggattgcatttacttttatggagattgtcattgtcttagaaaacactttaaagaatgaaattgcactgacttaacatgagttaactaaacaatggttgatggggttgataaaaatgttattacaatgatttcatgcgtgctatactatgtcattaaaacattactaagagtttattttctctttgctttcagtgctgggttatttcttttctttacaatgagcatcagcattcttgaaatggaagaaataaaaaggcttcggactcagattggcagagtttgtaactgggtcagatgcagaattaaactataatggcctaaaattacgagttgattcaatttgtacttaaatttacaagcacaaataacttcagtgaatatattctttcaatgactacaaaatagatttataaggtttaaaaaaactcagtgggagattcaaaaattgagatttcctcctaaataggagataaaacagagaaaatcactttgatttgctggagttagtcagaagtatctcatgtggtcattaaaatattcttttaaaacatagttattgtgaatacctccattctctcatgtcattctgcaaacaacggaaacttaaagaatatacgagaagaattttgttcttgcagaagagtaaacctttttaaatcctggctttgtcctgatgctacgatggtgcgtcctccgtctttccaaattagagaactcagattctaaggctactttccctcttattgactaagcttaaaaaccgaagaacaagttaaaaaaaaagacaagaaataaataccttggccttaaaaataaaaccacagacagaagagaaaaaaagagaaattcttagccttaggcatcatataaagtggcattatttaaaacatttcctaattattttctgccagctaagaaaaaaaacctcaaagagcaaaagcaattaaagtgtttcattttttacaaagttcctttcacgcctaacaggagcacatagatagactatgtcagcgaatgggtttggtggtagtggttttgagattgtataaatggcacttcctaatacagaaccttagctgtattagagccctaaatttttacttatgtgcagaggctctcatttcacattcaaaagactgaatgtgagggtgagctattgtttgaagtctgtcaccttttttccaaaggaaaatgttttaggatcattctgaacatagaaggaaaacatttcagtgatggactaatttcatgctgtggttgtcattaaatctctttccaaggccagtcattaattttgttaaaataattttttaaaaatagtatctttaggttaaataccagcggaactgtcagcctgcaagtctcagagatggatgctttgtgaagtgctacaaaaggatgatccttcccacatcctcatgaatttacgtcacttttgtggaagaacaaggctcaagacagtcaatgccaaagatcatcctgtctccaggctctgctgaacctgccgatcggtgggaaatgacgggagacaatgagtccactgagaggtgatggagaatggcaggcactgagctaagataccttaaatgtgatgcttctcatgctgacggccaactgaaaacaatctcatcattacttcttattatgatatacattttaatttgtttttctcctcaatctgggtatagctgctatgcaaatatgtcttttaaatgtttggatagaggccacgcccatgatgttaaaagttagcaatcagtatttatgtaacttcgtaggtcttgtgagagggcgcaaatctgaatgcatacatcttactaattaagctcattgaagacatgcaataaaccacactcaagatgcagttacctttaattttggtggattgatctcctgttgataagaatatttagggaggagaggaggtgagcagggctgagaaagtgtagagtccaggtcagaaacagaggcgaagagagaatgaaatggaggggaggaaagcaggtggctgggaaagggtgtgggtgcttgctctcccgaagaaaatgacggaggcttaaatatcgaggaaagacgagaggtgattatgcttgtctcagaatgaggttacatgctctttacggaatttcctctcaacttccaacattttaaagttactaataaccttgggaagttatatttatgacaaattttttgctttgaaaccactaacttcctcttttgaatttgattcaaaatccccaatggtatgatcagtttaatttttcgcatgggggtggctggagataggaacacctatattctatcattttctcatatatttatatgatggctccttctaaaagtgaaggaaaaaagtatttaaaaccctgcaatgactgtaacttgcgtgtaaagtaggttgccaactatagtcagcgtgtcacaaagctggggaagccgtggccccgcgtgcagggtgtgagctggtgctgggatgagccggcctagggtactgtctgtgtcagcaaagccacacatctaatcacaccttcagattgattgaattgaaaggaatattagttactgaaataattgatgtagagacacgtttggctccttgcaatgaattatctatctgttattaaataaggtgtttgttttacacaaatgcaggcctggccgggttattttgaaatacaggaactatgaaagaatttgacttggatagtagcgtaataggaaccatcctttctgttatttcataatttctataattgccagtaattatacttgcttcttaattcacagggtacatttgtgggatcaagtttctttttatttttgaaatggagttttgctctttttgcccagaacggagtgcagtggcacaacttcagttcactgcaacctccgcctcccggtttgaagcagttctcctgcctcagcctcccgagtagctgggattacaggcacccaacaccatgtctgactaatttttgtatttttagtggagatgggggttttaccatgttggacaggttggtttcgaactcctgacctcagatgatccaccagccttgggctcccaaagtgctggattacaggcgtaagccaccgcagctggccttaagtttctctttttttttgagatggagtctcgctctgtcacccaggctggagtgcactggcacgatctcagctcattacaacctcctcctcccgggttcaagtgattctcctgcctcagcctcccgagtagctgggattgtaggcacccaccaccacgcctggctagtttttgtatttttggtagtgacggggtttcaccatgttggccaggctgatctcaaattcctgacctcaggtgatctgcctgcctcggcctctggaagtgctggcgttgcaggctcgttttttgttttaagagagaggtttgcaagctaaagtttctggatattttctgcctttgttgattaaaaccactgttcaagattcttcataacatgaagatacagtacccagttcttaagtagtcaatgtgaagtcaacacaaagagaacgacctctttagaaaatcgaaaggggacagaagtgctgtttttcttttctgttgtctttgtttattattagcattattatttttgcaaagtgccgttatgtcaaaggtatggtgtacagtttctcatcctggaataggacaaatttctgggcatcaacttcctcttctctaaagtggggatgataatgtcacacacctcactgggttttgacgattaaagatgtggagtttttagaatagtgtctgatactcagtaagagctccactattagctatcattgttaatattggaagattacaaagactatatcaattacaaagacttttacaatataagtttatggtcctgaagaaaaatgggataatggaattatatcacatatttacatcatttaattaaatatggtgtgttttcatatacccactccacccccatcttatatagtatttgtgttttttgtttaaaaaaatctgttagtcaaaataggtatttattaatatgattaactctaatagctaatcatggtaaggccggttagttcttccataatcagacaaaattaaaatacctcattactgggttttgctgcattgctgtcctccttgggggtcctaggatctgtgggggtggctatggggtgttttaggcagttgggtttctcctcctcctcctcctcttcaatgtgcaggtgtggggtgccctctgacccatcgtggccacaccaccaggcgtctccttcctgaggttctggcggccctctctggatgcctgacacaatcccctcatagatgccctcatcttcctctccaatgaccggaaggggtacaggcaaggaacccacgctggtgcacgcagaggccacaaaattatcccctaggacttctggtgcctttttagggtctgagaagccccttctcatttttctcaactctgcaaagttgctttgagttgtcgttctgggatcctgaagaggctctgcatggtaaggctgggctgcagccgaggccacacccgcgtgagtggaaggtgattcggcaggtgcagtcgctggggacaatgggaggaggacagcaggttcctccttaatttccaggatggcgtcctctaggatggttggtttggcttggtcagctgacaaggttaaagcaccaagcttctccaattcacccaagaagttgtccaggaaacgaggtggtgttggggccaaagggtttgctggtagacatgaggctgtcagggacaaccagccctggccagttccctggagagctcctttatctgagccaggtgagactttgtgggtgggaggaggggctggttcactggaagccaacttggaaatgagcacggattatgaagttaagaaaaaataaactaagaaaataataataatgcatcaaaacatagcgatggagaaatgcagaaaagatgcggtggtgaatatgaaaataattttatgtttaacatagatttgaagacatttagaagatatctagatttgaaggtattttgctgaaatttaaatacataaaatcatttatgttaattagaaaagttacttcacaaatgaaactctactagttttggaaggggtcttaaatgtcaaacaagataaagatgatatagagattaccaggacagtaaaaccttgagagatttatttttatttatttttaattttttaaaaaattttttagagatggagtctcgctgtggcacccaggctggagtgcagtggtgtgatctcggctcactgcaacctctgcctcccaggttcaaacgattttcctgcttcatcctcccgagtagctgggactacaggcgcatgtcaccagtacagctaatttttatatttttagtagagacgggtttcaccatgttggccaggctggtcttgaactcctgacctcgtgacccacccacctcagcctcccaaagtgctggggttacaggtgtgagccaccgcgcctggcccttaagagatttaatgcttacttactttaaactatgttgaaaagatattacaggtttccagatactgacttagtagagtataaatgactccagagaaatgttaatgtagaatgaaaactaatagtgaagtcattttatttcctgaatgtgtgtagtgttctcttgtcctgcaggatagcccaatcttttaaacgctgacaattttctcacttatgtttgcaaggtgattacaacatatgaataaagtattttagatcattatatgttaacaaatttctaagtgaataagttctgaaaactatgtctcaaagacaggaacccatgatcagaatgaagctgagcttacataactacggcttcaaagttttaaaaaatccaaagtaaatatttacatagaaagctcatttgatgctaacgggagggaggacttctgcttcagctcccgttctctttcaaagcttgacatttatgtaaatcagaggaggtatgagttatgaagcttaatcttctgaagtaaaatatacttacttctacatacgtagtattactgatgtattttggatatagtaaatgaaacaatacatttgaaattttatgcaaaggtattaaaagtagttctgataaatatatacaccccatatgtacccataaaaattagaaattaaaaaatgtagttccagaagtgccacttactaacattggaatacgtttatctacccttaccggactagagaaaatgctacctgctatgtgcctaaaagccttgagaagggacctttcactttaggtctctccaggtagatgtctttgatttggaaagaaaaacatctccaaaaagattctggagatacactttccagctgattgtttaggataacactttacacagggaagcagccctcttgctcctggggacttagtgtgtgtgagtgggtgatgcatttcctacttaacttttgactcctgtgtcctatagtaggagtggggtattaattagatttatttagctttttttttttaagtcatcttatcgtgggatgacataaatatcacaaaactcatgtgagcatcttaatacaggattcaggacctgggctgcttagctgctgacacacagtgagactgcacgtgtggtttgcgcctaggtagacagccactcctgttaagtcctgtagatgctgagttttcaatgatataaaccactcaagtctcattcagcagtctacagaagttcccttactagctagagttctagtttataccccttgttacataacacagaagttttcatagttagatttggaaagtctgtgaaatatataataatttcagaccatcaggtttccactttcactttctgttatgccaggaatattatgtagatgagaaagaaagatcttgaattcccttgtcattactgccaccatcaccattgctatctgatgctgcgactacgctgtgccgtcaccaccacagtcaccgaaatacatgtcagcaggttaaactgcttagctttatgatggacttgcttataccgaaagccaaatgaagcatcctggtataactagatcacaaacctatacctataatacaaaacccatacaattattttgttttccaaaagcatcagaattggattctaatgcactaaaagcagaaatatcagaaataaaatcaacatacattttagtctcccctaagacaaagacagtatgtcaagaaatgtgatttaaatgtgtcaccagagtgatttataaattattaatgagttctctgtttgtaaatatcagttagaaaataggttctgtagcgtttagtatattttggatgttatcatttagaaatacattatatttatctttctaaaaatggttgtcacttccgggaagttttcttcattaagcctgtgacatcacagcatggattaccagttgggataaaaccattaagtatttcttcctaattatggacataagcttctcaacatattttttccccagcagtgagcaataaaaaactggttattagtgaaatttgtacatgcctctgtttaaaatctggtattactttaaaaacttgaaaatatattcaattacagttaaattgtattcacatcaaagatgaaaacattgggatcaaaaatattatattgccattaaatattatattaggacatatggaagaatttgttagatgtttaatgagcttttgtacatacatgcttttcttccttacaacattttatttgaaggtacagttgctttgaaatttctgtgatagttatttaaagatgactgaatggtggataagacaaatatatgcatgaagattcttatcttttctctttatcaatagaaaatactgaaggaaggatgctgatctgtaaatgctaaggtctggtaatgaagtaaatatacttaagaagattctggaaaactataaccaatcaagcaaacaaaattggatagtaccaaactcttccatatattatccatgaatacagggttgagggtaattatttgcaactgaaactcagtcttcaaagaggatcacaataaataaaatgccaagacttcagccttctaaaaaaaaatgcctctcttaagatggcagattcttagatcatttcctcatataaaatccttctcaggctcattttcaagaagtagtttaggtcactgggatgctatcttgaaacagttttttcatcggaacatgaagtgacttcacactttagtaacatctgatatgttgattttattttaccagctctcgatggtttagcttttcatgtcctagccttgatctcaattaaaataattaataaattaggcaacttaatacattttttgaatgttgagaagtacttaaaacattttggaagtcattggcaatttaaagttttattcctagaagttaatgagaaaaaagacccttacatgcctttcataaaaagaatataattcatcagaaaaataagaaaaaatttcacattgtgagtacagacaaatagcctttttacattcaccaattaaagaagcaaagcctcttttaaattacgtattgagaaagataatcatctttagcccgctcaagtgaaacagtagaactggcatataactgtcctaaaactgataaaacaaacttgaggacttataataaccgacaacattttcatttaaactaataaacatcttgacttatagactctaattaaaaatttttgctctagctcattttccatataaaaaacttgtatagatttgtcaacctaataacccggtgttcttgtgatatactattttgagatatacatagtattttgtgttgtgtatatttatatttcaaattataaatcacaattgtatatacatgtatgaatatatgattatatttatttatatgtaaagattatattatatacataaaatttacatatataaaaatgaagctttaggaaaaaattatttcagaaaacatttatgtacacaggagtacagatatatatcatacgagacttcatgatactctcgttttctctttctctttcgatattttaacttgaaaatgaaatgagcaaaattaatcattaaatctttatgccagcacctatttgagaaacactgacttatatttactgatgtggcactcacacatgtagaaacataatatgtaaatctctttctctgcaatagatatgatattctaatctaatatcctaaagtcacacaccgattatcttacttggagcttccaatattacattaacatgatagagtatgttcttaccttatttgagctcaagctgtgaatcctatcactagaatagctgtggggtattggagggtcagggtagtcctcagcaccttttgtgttcttcttgacgacctccacataggaaacagggaagatgccttgtctgttggttcctgggattttaccttcataccagttttgatcaactcttttaagaagaataactctatctccctgttatgaatatgagaaaaatgcattagaaacagagatagaataacatgaaaatataattgtcaatgttttctatgaaaaaataggtttccatttgggcaggttttataccttcagtttttgtttaatcaggggagggcaagtaaggtactagtgcttactagaaaaatacacatgatcaacatatatgtaattgaaatgtccattcaggccatcagaatcttccctaaggatgcctgattaatgtgaacgggtttatacttgtttatgctggtattgtgtgaaattatttgtctaagttatttcaaaaagcagaatagtgtaaaaggtaatgtctcaatgacaataggattattttatctctggcaggttcagtgcattggccttctgtaggaagagcttcagaaagtgcaccatagcttgctgtgagggtctgtctgaaatgggttacagaaaacacctctagaagggagaacatcgaatggtacaccgttttctttttttatttctattttttttttttttttgagagggaatctcactctgtcacccgggctggagtgcagtggtgtgatcatggctcactgcaacccgcacctcctgggtttaagaattctcttgcctcagcctaccaagtagctgggattacaggcgcccgccaccaggcccggctaattttttgtattttagcagagataggggtttcaccatgttggtcaggctgatctccaactcctgacctcaagtgatctgaccgcctcggcctcccaaagtgctgggattgcaggcatgagccactgtgcccggccccttttcttctttaatctacatgcgctaagtagtgacagagtgaactaaagggatgggggaaagagagcgccctagaatatcaatagctgtgacaagactggcattcccctggtcttcaccctgacaatggaaacccagcatccatctgagtagttggtgaccattccatacttgtcattaaagatttgaatagaacccttggctttcacaatgatagaactttctagaatcacttccacctgccatgaccgagccagtgctgcagaactcagtttaaactttaactcaaaactacacgtagcctagaagtaggcaggcaagttgatgctaccgggcaaaaactgcagctgcattcagcaggtgatacagaagctcgggcagcggcacctgatggtgtgatggagctgaaacagtcattaatctcagcccaacagggcacccttcttcaggtgctacccaagaagaacttcgaccttgagtagcacttggaagttctctttgtgttgaaacgctggatggttgattttgtgtgcttcaccaccgctgagcagaacatactcaagaaaagtcagtctcaggctggatgcaatcgctcacgcctgtaatcccagcactttgggaggccaaggcgggcggatcatgaggtcaggagttcgagaccagcctggccaacatagtgaaaccccatctctactaaaaatacaaaaattagccgggtgtggtggcgggcacctgtagtcccagctaatcgggaggctgaggtgggagaatcgcttgaacctgggaggcagaggttgcagtgagctgagagcacacattgcactccagcctgggtgacagagtgacactccatctcaaaaaaaaaaaaaaaaaaaaaaagtcagtctccccaaatctgaaaattgcaccgattttctagtataccaagaacaggtagttgctaggctgttgtgtgagctgtaagaggcattggtgaagcctttctgtagaacatggaacaggagacagagttcatgtaatgctctgtggttctcatgctaggtggggcagcccagaggataggaaagaaggaatcggctgatgatgcagaattaagactgatgggagagaatgagacaaggttctgccaggaccagaacaaaccaggactgtggtattgctcttcatcgcacctggctaaggatttcactagtaggtgtgggaggtcctagagccactctaaatattactacctcgcctgtgttgtgtgcagaggcagttacctcaaacaaatatatgtcatatttagaaagcaataagaataattcatttatcattctcaattatgtaaactagcaggttaaaagaggtttttgattgtttttttgtgtttttttttttttttttttttttgagatggaatctcgctcacctgccttggcctcccaaagtgctgggattacaggcgtgagccaccatgcccggcctcgaggcttttgatattattaagaagagatactaggattggatgggctgctagagaaatttgggtcaattatgaggcccaaagaaggatgatccagggaagagcactgcagagatggctcttaaagcggctcccccaagaggaaggatcttctttacctaggaccattcctagattccaagatagaggaagataaggattggaatatcttgtttttaaaagactgaaaaataaggcagcaaaacaacatattttgaagtgtatcaaactgctttttccttttgtgctcccgaatgtataagtccttgattttcagccccatgcccggcttcccagactaagccacagagggagaagcctggtatcccacggggaactcctctaaaaggacacagggaccagcagggaaccgtgactctgggctgccttaaagagtcctttgtagaaaatagggtaaacataaaaatgtctaaagaaaaagataacctattttagttttgaaaatatacagccttttcaaacccactgaagaacaaacaaacaaaaacaaacaaacaaaaaaccagctgggctacctttctcagtgacagctccacatttgtgtctgcgttgaagttgtatttggctatagcttctccgatttctccgggctgggctggcggaggtggtcttgcaggctgtgctttctcaggaggtgtgagtttctatgaaggaaatagtcatttattctcaaatctgcggtgacctttgaaaccaccgccatccaagagagaaagggagaggacctacctctacgtatgagatcgggaagatgcccactctcccgtggtgttctccctcataccaattttgatcaattttcctgaggatgtagacagtatctcctttcttaaatgacaactccctggaagagacacgttgacatggtctttttgtgatgtacagcaataattctcaagatcaacaccctcgctagatctgcatttgtttggcaaatatacttacaatattaaaaaatccaattgatattgagtccgattagataagaatgatccttgcaaattcttagaatgcacttaaaacattataactttagaaatgatttcaaacagagtaagtataaacattccattggatataaatcacagacagattaataagaagtttaaaggaggggacagactcttgctactttaccattagttcagagaagaggcattttgaagcttggaaaaatgatggaatagttctgcactgattttttttttttttgtcctgaagctagttggctagttagttactagccccccagccccttttgatgtactgaagcttacatgaaggaaaacaaatatcatgtagcctcagaatagaagtgccaacaccagaacaaattttatttgtggatctttgaagttggttgacaggtattttaatagaatatcttgataaggaatttattttgtgtaacagaaaagatcttacacttttaattttcagtggggcaagaagaatgtgttttaagtgcaaagacatatgccaatgcttgcctttctatcttttatttacaaaaaataaaaatatttttaagacactatatttttcaattttggctgtttctaagaaaattgtaggtatatttgatttgggtatttataattttaagttataatgacattatgcattttgaataattcacacctaaacttatcaccttcactacatcaatttttcctggcttaatcacccaggtgattaggttggttcattattttgcctccgcaattattcttggatggagggcgattaatttgtatcttctcccaagagcctcattttgcaatacatctgccctcccactctggaatcttctgcattgttttgttcagaattttcattttttaatctttttttaaaaaattttggttcagaattttcagttggatcatttattagtataggccgtttgatggagagagatttatacctgatggagaacacttctcattgattaaaagaattaatcgaaaaaatggtggtatattaaaagaatgatcacacatttagaagtgctaaaatcttcacaattgaaaatgtgttaaattttcagtaaccctaaaaacaaagaagattcatggagctttacattcaaatacagtgcttccttcttttgtgcaaatgcctaatgtaaaaaacagaaaacaaagcaaagcaagatatttaatgttcacaacacaacagtttcatttgtactaggtatgttttgtttctggaaatgagactagctttttaaaatataatatgaacatatgaatcagaggcaaccaatttttcaaagctatgaaaaagactcttttgtatttgtataggttgcatttaaaattttgaagtccttaagacacaggaaagtcttactcttaagttttcaaaactgtgtccctctcatctcagacctagaattttaaagtcccatttgcttttttcccctcacttttatttttatttgtttttgagatggagtcttgctctgtcacccaggctggagtgcagtggtgtgatcttggctcactgcaaccttcacctcccaggttcaagtgattctcccacctcagcctcctgagtagctgggattacaggcacccaccaccacccctggctaatttttgtattttcagtagagacggggtttcaccatgttggccaggctggtctcgaacttctgacctcgagtgatccatctgccttggcctcccaaagtgctgggattacaggcatgagccaccgtgcccagctgctttttaaaattaagacttctcagaagacctcgtgagccttgggtggacacccttcctacttcacatcccctgccattcctcaggtttttatatatttaagaaagctatggattgatttttacaaagaagaaatgaaacgtgtgctccgtaacattattttataaaactgatatgcattgtacaaattgtcacaccatatccacagaacagtagttaggaccggagtacagtagaaacaaagcatcttatttctctaatttgaaaaaaaaagatgtaagcttttcttcaggccagatttaagccatgttcaacatcttaatttctaaacaggatttttcttatctagttcatttcctatctcagcagcattaccaaattctgagtgatttatttatatatgtcttctgccagagacagtttctagagctattaactcatattatatgcatttttatgagtaaattattttggttattatatatatatatattcagtgtaaacaacatataataatttaatgacaatttacaatgaattcaatatctgtcttgaattctactggagaacaaagtttcttaaaggtctgtgcacataggccacaaaaaatctgggcaacaccctcttatatataagtctgcttatgtgcttccgcaaccacatgcctatctgctgagcaaagaataaaggcaaaagaaatattgcaattcaggatggtgaaaacaccgacaccaaaagaccaaaggagaaaactttgctcagaatctctgagctttgcaggctgaggatggagacttcaatacaggaatctttgtactaagttctagtcatcaaccccacaaactatgcttggaatatttggataaataaatgttatcaaattcccccagctagtgttaattactccccaatactttatttatttacttattcattcttttttttgagacagggtcctgctctgttgcccaggctagagtgcagtggcgcaacctcagcttatggcagcgtctacctcccggtgaagcgatccttttgcctcagcctcctgagtagctgggactatacaggtgtatgcccccatgcctagctaatttttgtattttttgtagagacatggttttgccatgttgcccaggctggttttgaactcctgggctcaagccatctgcctgccttggcctcccaaagtgctgggattacaggcatgagccactgtgcctggcccccaatacttcattaattcattattgacacaaaattctaaaaacaaatattcctaaattctttttgtttttcctatcctttagaattcattgtgttctacctaacatgtttaatgtaatttaaaactcagtaattctcaactaaacttaaaataaaaggtaattctgaaggaaccatttaattagagtagattgctgcattgggaattagacctcatttgtaacagatcctactgcaatgcttatctcttaaagcattactaacatttaaaaccaccttaaatcatatgatgagtatttatcttacttacttagatgtctgagccttaaaatcataaacagcttttgcaggcaatttctgaaaaggaagataaacaattagcactaatttaaaatttgaattttctacaagaaagtagtttaatgtgccttaaagaaaaaggaaacctcagggaatcatcaaacatatgtaatgttaatcctgtaagcaatttataaataagtccattcattcttcatttagatatttaagctataataggaatataatagaaggcttattcaccatcatatttaatcttaggaactaaggtagattaatgttataatgagagaataaaatgcctgcagaggtttgcatcctaggcatcattttggctgttacaaaggctcttcctaggataaatgtggagggtcaatggctctatgttctatggagattgacacagctccctctgaatcataataaaaggaccagatgtcataaaagaagtaatcattcccttcattagacacttattaacatattagcaaaaaatattagctcaattatcactgggaggctggttagtgggcaaaagtataggtgtgatcatcttgcattccctagagggctcaggaatccttcaacactctgtccaccagccactcgtcttttagttgtgatgtgatgtgacacgtgcccatcctcaaactctgggggccacagatctccctgaggtaccctgtaccctatagctagctaggccagctcttccttcctcaccaaccaacaatcccttcactccattcttttcccccatgactctggtgaactttaggaatcctggaccatttctaacttctttggggatcccacaggctctggactacatcagacgcctataagatcctctggagcggctaccagtccaagtccagcttttagtttccatccagccgtcatggctccaaggcagtttgagcaagaactctagccccggctcagggccctggacagagttcagttggtgggtggttcccaggggcagtatcccgagaactgggctggttaaaagctctttttagggatcctctccaataaaaggaagccagcaaaaatgatttctgtaggctctgtattgatttacaacacagttgacatcaggctttctcctggaccagcgggccaagaaattgtagaggaaacctattgcctccacgaggtgccctaactcaggacacttttaggtcataatggttaagttcatgggcatcaggtcaagactcggagaagcctcatggccaaaactgggccaccactagggaagacccacagctagggtcagggtgtggactgcttctagggtcagagttgctatgctcaggccccaaggaaaattgtttctagtttctcagtattttcacatttcctgtccgagttcgttactggtttgggataatttttggctggtaagtgctgtatcaagtgtgttgctgtgaaagactccaatgctattaaattaactacctctttttctggagttcctcttctttcccttggtgcacttctccccatgtcagtcaaagtggatgagtaacttctaggggactcacggtctattggaaagaacagggccagtcatggtgagtatccacttaattacaagccaacctgttccgccattttccctggtggccactacttttttccccaaatttggagagacaccgttatcgaacacatgggcataaaactcatagttcattacaaagttgtgaaataagacacaaaacaagagcatttcaaaaggaaaaatatctgaggttgcagaattataattgtctatataaatatgattactacattgctgattaattatattgccacacccagtaagacaatttatagttagagggatttttcatataaattttttccaaagctttctgtttctatgcctttgcttcttatttataattactattataagatttacagaggatggagaatttgaaaatagcaacaatttgtagaaaaagaaacattttgtggagtaatttaagactgtagtaatgaaaaagaaagagataaaaccaaagaaagtatgaggatgacaggagggtggtgatgaacattctccttctgccttactctcccctcttcgctcttcctctgtttttaaatacttattgaatctcaagatgccatgctgtttatctacgaccttcctttgtgcccagatgataaacaccttatcagaaagcaaagaaacaaagagatattgtttcttcttactccaagcaaaaaagggataaacagaaagcatcatgtcagttgccaaattgcttatgaaatattgaattatttttgttcatcttaaagcaaagcataaataatcacattacaaaattttgattgcatgtagttcttaatagtatcttataccttttgcacttacgtgacttacatatggagatgtaactagacattaaatgtattccagtagtctatgttatagaattttatcagtacaactgggtcaatatttgtcaattctttcttttatcccttaaatatatctagttatccagactaacaagaagcattaaaaataaaatttattttatccatctatgaaagaatttaaagtgctgattcataataagaaaacattgttttaggattttgactactttgatgatgtaaattctaagttaatatacttttatgatcatagggcctcataatgatcataaattttaaattactttttctaacccagggaatataagctatttttcacttgggtgaaacacaattggaaagtaaatattttactaaaaaacaaaatacttttaaatgcatttcaaagcccttccaagttacgtttcaaaaatgtactcctatctgcacataaaattgagagatggttatattaggatattaaaagcctggagaaggtagctaatttattaaaaaatgagattctgacacatttcaattagtgaaaattttgaattgtagaaattgattttttaaattctaatttattattttgaagcatgttgcttcagcctaagggtaggcaaagataaacgtaagtgtatagtgtagcaaaagtgaaagcaaacataaagactaagtagatttgtgcaagttaattaacaatcgagccatatttgacactagtatgaactgtgaattatgtctttttttttgtctgagattatattttatactataaattctgaattattaggggtttgaatctcttttctgttatctactctctgtgtgaccttggacgaatttcctttcctctctgggcccaacttccaaaattgaaaatggcttttgaaataacacccatttcataggcctatgccagttttattagataatgtatgtaaagcactctgtagtgtctggtgcatagaagtttctctgttgaccaactttcagcccggaatgttcattccagcctcttaaaatttacgtagtgaacagatgtgctgtaagaattaatgaaaataattggtcacaaatattaaaacaccctgggctgtaagttatataaatctcaaaaatagtcctctgcctttcaattgctatttattcttgtgttgccacttcaaagttatctatgaaaatagagtttagagtcactgttagcctgaatagtgtaattcaaatttcaatacaggactgttttagcagaaagagaaagtgaatgaattaagtaatggaaaagagaaaatgaatacactaaatggtggaaatgggacttttatatatatagcttaaagatacattcacaaaaattttatcaccattgtgtccttgaaatggagaaagctattaaacaaaccctaatttctttgtgtccatcaattactaatcacatatttcagttttgcttcttgaatgttttgatatagtatcttctatatagaatgtgacaaattatttattaactgaatgaatataaagttttaacgttaatataaacatttttaaaaggctatttgtggaactataggttttgattcatgtcacaacgtaatttattgtctcaatgtgagtagtggttgtttcaaccctaatgctgagctacaaaatggccttccctctcgttttcgaaagagtaaatttttgtgaattgatgatcactttaagccacacatcaagtccaaatatcacatgggcaaatgagaaatattcagtaagacatatttgcacaacaagtttttgcttcacaacacataacgacgccaaatggtctcccagctcgggagtgatgagatgttggaatggaaaatgaaagagctggagggtgggtctctgaaccacaaggaaaaagaaagaaaagctcatccaccttggagtgcaccgccacggtcttggtggtggcagctgctgttggctgtgtccacgtcttggaaagaggcactgcggggcattctcccgcagtcattctggtagggtggacaatgaatagcaccatcgggaggcagtgggtggagaggctggtgcagggggctcctcctcagcgctctcagggatgagttcctctcgggaacatctggcagcagctcactgatgaggcggtgcaggatgctgttgtccggcaagctcccccttttcttttcagctttaatttggtcacagatgtctttaagggcagagtccagagcctcaaacacagatgctttacattttgccttttcagtctgtttcttaggagccgaattttttttcctccggaaaggcacaggactgactagaaaagcaagtttagaaaggccagggtccatttcttgccttctgggctcctcggtgttttcgtgtctggctctttcgtgttttaacattgtggtaaatcgagtgtaggaggccgggcacctgcctttgcaggagctgatgaggtggcggtggtggtggtggtggtgatggtggtggtggtggctggatccgtaaaagctttcggaggatgtgaaggaaaagtgatcaaagtcactttcactgcagaaggatgacccctctaggtgaatgtagtcactgtggtcggacacaaccccgtcctggtcgctgtcggaaaactccacgtgtgctcggggctgctcatcgctggtgacttcaatgtgaatgggcaccagggcgttagactggcagcctcgccggccccgagcgggggggccgctttgattttcttcctccagcaaatactcaatggaaaaccgcctcttgggacataggccattttgcggtggttctagggttacgggagacagcatgtcatcccctaaatttggcatggatttggacttctggatcagcttttcgaattcggagatgcgtgtgggcaccatgtcccggggcacctcctccgtggagcactggctccaggcgcgcagcaggtccttgtgctgctgctcgctctcgtactgcagaatcctggacttcacggagcagatcacctcggagttcatcaggtccttgcggttgatgcggtgcattttcttgtacatcttcaggaaccccggggcgttgcgggctgacctgtgtctgatccttgatctgccgttactgcgaacctccgggacgtagggggacccccacgccatggggcagctctccttggagtcctcctcacataacagggagcccatgctttccgacttgactttcgggtccgggaagctatcgcagtcgtcgtttaggagatcgtcacagctccgggatttgattttgggagagacggtttcttccgtgctgctccagatttctgcgttttgccgggccatttgccagccgttcttgaaactaatggctcttggtgagtcccgagggacatccaagtgctgtctgtaagtgctacagtaatctaactcactggaggggttgccgttgagccctgagtaactgcaaagggatggacatattttgctatcatccccaccttttaatccagagcagcgtggtagaagagagacatttggagaagttaaaaggttcacaaagagaggagagcatgtcagtaaagcatcagacagcatagcaaggagaaagcagttagtgtgttttaatctaggtgctgattgttcacacatggagcttcaactctagagaagaaggtctaattctaaagcgagctaatactttttcagtgaatgtagctttgcagagagagttgacaaaactgtgtataagaagcaaccgacgtaagcaaatacacctactcctactgcataattcatacacctttctgacaatattgtttgccaaaacacaatagtgctgcttcagctgatagcatgatctggtagtgaaggtttaacaattagtgtcaaaagtgttatacccttacgcaatttaatagggccggaatttgagcctcatttgattcgtaatgatacataggtgaagaagggtttatacatttacatcgaattaatactctcatgactatatcaaataattttttgtgggttttagattttaaaagctataaggcaaagtattctccaaaattgcaaaatcaaaatgctgtgaactattgctgctaacatttttctagaaaaaaatagctaaagctctttaaacaaacgaatttacctcttaaattgctctacctttaaccttttattaggtacaaaattctcataggaaaactgaatataatgcaaaactttcatcagaggtgcatataccatgctttttttctcggaagagttctttgaaaaatcatttgcaatttgataatagagatctacatttggcctcaattttgaatagctatggaaatgttcttttgctttgctgagtcaactaataaatgaggagccaaattatatctaataggacattttcttcctagaaataaaatctaatggaggaaaatatctctattcaatacttataccttacaatgttctctaaattctttaaaagtagataagcacattaggtagatctgtactgtctgggaaaggaagttgatttaacattccctgtgatgaaacaaatatctacatttatcagaacccttttaacttttggctagtatccaagaataataggtcaatggcatttcatgacctacttgttaccttaagatattcatttgaataagtgagttgaatctgataaggcatctctgctcctcagaggaaagatgtgatggatggggctcacacgccctgaaccatcagctgatatcacagctttacaaggccttaaaagggctaggcatccacctactcagagtccaatcatcacgaccagaataccttttgcacacaaatcagctaccacttttaactaccatgtggcaatggttttagtgactatagttgataggtgtagctgaattggtctggttttatagaaacttacattagagctcaatttctttacacatttcaaaatctctttctcttctctttcaatcccaagatattagaggagattgtggggtcccacatttggtagagccctagctccctgtaggggctggttcaatcctcactctccatctcagaaatattcctgtcctcaaggaataccactaaatggtcttccagaaaccagaaggagtgacttctttcaacagtgagctccctacacttgcagagaggagacgggccatccagaaaaaaaggcttggtgattcctcagtgatatcattatggtttgggaccaattagtcctgactgtgagctgctgtgaattgaccactgtgttacatggcaggaggtggatgctccactgttcatgtgaaggtggcccaaaatatacagcaaatggctaaagaaattaataggtcggatttttttaaaatctagaattgaataattttttaaaaccctccaaaccaatgtatattttagccaacaatttgctctgttgctgcttgtaatttttatcctataaatttgactaatttgctagttgtagaaacattagaaaattttgactatatgtcaatgtttacaaaatacatcttttagtagcctgatgatacattatttgatactttcaatttgtttagaaagggatctatttgggggaaaaaagcattagcagatgctagtcagagttctttaagcaacctaagtggctcgccagcttgagtcagtctgggtgggaagaaggctattgttctaaaactatattttattccagacactgtaggtgagagctggcacatgccactatcactgggccagctttcacacagtgctctaggctaaaacgtaaactagtaaattgttgtgttttcatttactatgctcaccttttgctcttgatggggaagaaggagaagagctagtgaaagactttgtaagagtggtgcttgatcctgggaggtccactcggcctgggctagtcctgctcgcactttgatctcccaagccccgtggtggacccactgcaggctcgctcttcctccgcttcctgaagtcactggccatgcttgcagaactgaaagaaggaatcagatctgtttgattggcactggaggaggttcgggtgtgcaccagaaaaaccggtggaacgtgctagtgacaatggcgtaactcctaaacctctatccccaaaactgcattgctaggaactcatcccttgatgttcaacatgatttctctagaaggatcttttaaaaaatgaatagaccttattatttattttgagatggcttctggctctgtcacccaggctggaagcgcagtggtgcaatcacagctcactgcagccccaaactcctgggctcaagggatactcccgcctcaacctcctgagtagctgggaccacaggtgggtgccacctcacctggctaatttttttaaatttgttatttatgtagagacagagtctcactatgttgcccaggctggtctcaaacccctgagctcaagtaatcctcaagcctcagtctcctgaagtgttgggattacaggcgtgaaccactgtgcccggacaactaaatttttttagggcagttttaggcttacagaaataatgactggaaagtgtagagagtttccttatagtccctttcctcttgcacagtttcccttatcatttacatattcttttggtgggtacattgtcacaattgatgaatctttcctgatgcgtcgtcaccccaagtccatagtttacatttgagttcatgttttgtcttaaacattttaggggttttgagaaatgtataatgatgtgtgtccatcattaatgtgtcaatcatataaaatagtcttcccgccataaaaagcttctgtcctccagcttttcatccctcccttcctcccgctcatcctggcacccactgatctttccacacggcctccacagtttcgccttttcaccatgcccagttgatatcatgcagaatgtggcctctcaggttggcttcctgcactcggtgatacacttttaaggctcctccatgtgttttttgtcacttgatagctcatttctttgtattgctgagtcacattctattattacatggatgcgccacagtttatgtatccattcacctattgaaggacatcttggttgcttccaacttctagcaattataaataatgctcctaagaaaaccacctgctggtttttgtgtgaacctaagtttttaaacatctttgaacgtcaaaattctcctatagtgtaatatgttgattgagaattcagtgctataatttgtatcttgtatcttttctctataaagcggagttctaacaacatgaatatatccagaggggcataccaaatacaggaaataactgaaaaaaaaaaaagacatcaagagaggaaaatctctctcacctcaagggttgcctgcagcttgtcctatcatctctatcatcttagctttagaagatgttatattggaattccaacattttttatttaaataatgaatgaaggctgagtatgatggctcacgtctgtaatcaagtactttgggaggccaaggctggaggatggctcaaggtcaggagtttgagaccagcctggacaacctagtgagactctgtctctacagaaaataaaaaagttagccagttgtgtcatgtgcctgtagtcccagctattcaggaggctgaggtgggaggatagcttgagcacaggagtttgaggctgcagtgagccatgattgcaccactgcactccagcttgggcaacagagcaagaccctgtctcatcagtcagtcaatcaatcagtaccagtaatctggtcagcaaattaactattaaagattccttcccctcagttgcataaaatactgtcaatagtctagaacagcagggagtttctgtcatggttttgagtttgagtacagtatcatttaagaccaatgttaatgaatgaagccacatatggcacagcacactgtgcatgaaatcactggattcttagacaagacttgtgtagacaacagtgataatagcaacagcagcaaccccagctcctatggagcccagcagaatgctatgtgctttctttatgtttttgtcttatttagcccacacagcaaaccgatgaggtatatgctgttatctcagttttacaaatggtaaagtgaatacatgtgtctgggatgtacggaagcaagcggagaggcagacctcagaactggtttgtcctcttctgaagaggatgcatctcctagacctgtttttgctgggactgtcctgtcatgtgagggtctgtgtgtctttacggcaatctgtagattagattaaaactctaaaattcaaatattttaggtgcatagatagaggcagaagataaaaaggaggggttccagagttcctttctcagggatgttattgcagttggatggcactcagaaacccaatttatgattgacccaattcacaaagaaatctacatagaagggtaaattaatgctactagataaatatttgttattgatgttacaatatggctgggagtttgtattattcaatattactattgaactatgtctgaatatgtctgaattttgtgatttgtttttttttttttttttagactgagtcttgctgtgttgccaggctggagtgcagtggtgcaatctcgactcactgcaacctccaccctcccaggctcaagcgattcttctgcctcagcctcctgaatagctgtgactagaggggcatgccaccatgtctagctaatttttgtagttttagtagtgatggggtttcaccatgatggccaggatggtctcaatctcttgacctcatgatcttcccccctcagcctcccaactgctgggattacaggcatgagccaccgtgcctggccatgaattttgtaatattttttaaaaagtgtgatatttaaagctaatggaacttacttcaggcgaactctgagggaagttaggcctagcggtgacaagctatcttgcctcaatttcttttttttctctctccttgccaactgtgtaaacttggtaagttactaagcctaggtgtcactttcctcagagataaagtggggacaatagtatttaaccatagtgttttcttaggattgaatatgttttgtacttatgcctcatttattggtagtattaataacagtatttctgatttgtgtggtcaaagtatgattaacaaatacgtgtataacactttttaatctataatttttttcaaatatattattataagggccatttaacaacattgaaaattagttacttataattcccatctaaagaaaagaaaactgggtataggggactaagggaagagaaggatttctcagtctgtgaaggaatttataattagttcactaattttttagaaattcttgaaatgatcatataaaatgatgctgaaacaaaataaaacaacttcatgaggcatggtacttcaaataaaaatgagtgatacatgatactcattactacttcactgaataattttattgttgaaaaagaaaccactggtatagaatattctgctacaacataataagattcttacctcatgggtctttccaggcttctgtctatagaggactgatacaaggaggcctgttaagataggataatagtaccatgaaaaattttaccgtggcaaaattttgttcacttgtcaacattaaattaggtatcctaaaaagaatattataaaaattgaggttgaaagtaccattcattatgactataaaaatgtcttcccaaagagagatcatgcgacctgatttctacttgggacctatctgctttcccttctgatataatgcattgcagttctctgtgtagctcaaattatccacaacccaagcattgcatggggggaaattaataatattttctcagggacactgaaataagagctaaagttatcctacagcctgaactgcagaatcttacctgttgactgtaaatagaaatttcctacagaaaggaatggtttgatgttttaaaaaatttgtagtcatcattcaatccttataaaacatcacattttaaagtttttgttattgttgttaccaagtattgtcttcagaatgtaacacataagcagaacttaagacaccattcatctgtcaacatagacatgacgtttaaataaaacccacagagtttgacttgaagaaactaaataaagtacctggtacttcaatcaggtaaatagttatacttttacaattaggtgagttcagggctagtttaaaataaatgagctaatgaagcaaaatataacttttttaaagtgcgcttttaaatttttccttcattctgaataatacactgaaatagatagtaagcaaaaatgataatatgaattttttattttccatggcatctgctgggataattgctaaaatatctaaaaggcaagagaggacactgagctatcaagtgtttgaggtgacactgtggtatgatgtccagaaagcacagggagatggctgggtgcagtggctcatgcctgtaatcccagcactttgggaggccaacgcgggtggatcacctgtggtcaggagttcaagatcagcctgaccaacgtggtgaaaccctgtctctactaaatatgaaaaacgagccaggcatggtgacacattcctgttatcccagccacgcaggaggctgaggcaggagaattgcttgaatctgggaggcagaggttgcagcgagtcgagatggcgccactgcactccagcctgggccatgagagtgaaaccccatctcaaaaaaacaaaaacaaaaaacaacaaaaaaacaaaacaaaacaaaacaaaacaaaagtataaagaaagtatagggagatgtataccaagtatagatagttttgcctttggtcatatttgatgatcaattcatcacagataaaatttggtttgatgaagaactggaattctagtttaaaaacatttgtctgtatgaaagcttaaaaatgtcagccagaaaggcaaggtttgacaaatgttgtcttaagttgccatcatctagaaacattttatcagagtattaaacatctacttagtggaaatcaaatctcactttacaaactatttctataactcagttttctattaattggtaaattagcaccaattaatcaattaaaacaatacaattttgcaattctgtatgtatatcagtcttacaaggtcccttttgcataacttacgcttctattaactaatattttaatttaattctatcttactaaatgaaaatggaatcttgtctagaaacaaaagcatctctgcatgagaatattcccatcctccttttagacagaaaaagtggattgtaatatttttagttcctagaaaatatttagatttctaggttctcaacaaatataaaatcaggagaaaagtttggtttgctagtctgatatgtgtacatggttattttaatttgctgagctctgaatcagacactgggaaggtagaaaaatagatactaaatatgaaagaaagcaaacaagtaaaataaaatcagatcgttatattacaattaagaaatattaattctactcgtttgcagaagagcgacactgaagagcctgagagcatcggcgtctgtgcagatcacggctttcgtgggacaccctcacacacagctgatcaccaaaaagtgtgaagttcacaacactcttagaacaaccctacagtgatcagaaaatttgaattgtcaacttataatgagcctaaacaatattgtaatgtgaaataaaacatagtgtaagaactgattgtgttttagggttaggctaagaaactactatttctccttgtactggtttctacattcaaaataaatgaaaaccagttttgcggtttcatgtacactcagagaaagttcagtattaaattgtaagataagagtaaaaaatctagattgatgactgagagaaaaacttgtacaataattgtaagaagtgtactcatcccaaaatgaaaattatctccagaaaagaggttacaaattttaccagttatgatctactatttacatattaccattattttaacacacttagaaggtcaatttagtgaagtacagatactgaatcactctttctgttaagtagctatgagattaaattttgcttaaatatccgtaactgttcttcattaatgccagttttccagttatggattaaaatctatgttattcatggtatataccaggcagttgataaacggtagctaaggtaatgtctaatcaattacatttgtttttaccagaaatgtttaataacaaaaggttattaaagacaaaatccagaaccttaagagaatatattttcttacattctgaaaaactataatgtgaaattaataacatagttaacatatgctattagaatcatacagcaccccctctcaatcccagagataactggcaaatagatcaactactggcaaagtgctttttatgtgttgtttttttttttttgccactaccatcacataatagaatgcatagagttaagtttctactatttttatgcccaagaattattgtgtaatattaattaacagaactcttttcacaggaattcaatagttaacaagaaataatattaagtaagtaatttgtttttaaaagatttatcctctaaatatatatcttggaagtgctgaaaagtgtgatataaaggaaatagcacagaaatgaaggttaagagagatatatttttttttctgccactatcttaccatgtgattttggacttatttcttaaaattattgcactctacttttttttttaactgaaaaatgagtgaattggacatgatgcactctaaattccatttcagttatctatgaaccaactaccttaaaaacaccctagaaatatctgagaaaaatatctgaccacattgaatttcaaaataaattcttgggttgttcatatgttgaaataagactctttctgcagatattaaggtaacataacatacagaatataaccccttgttttatttgattttcttcagattacatgcctgcctgcctggctataaaatgtaagcctttagaaataactgaattcaataacccagaatgttcctgattactctattttaccttttatttaatatataaatattttgatcacttctcagttttaacacacactctgatgtttaccacagggtaaataatttgaaattgcaagttgagacgctagaaatttgcatattttcttgagactctatacctgcaattccagtggtcaccactatgtgtcagtagtacctcctacaacacaacggttctactggttgtgtttcccagttgcacatatttaagacttttaatgaaaataagatatttattgtgttatagtattcacttaagaccacagagcaactaatgtgcaaaaaacagtttatttacttcgttcccatgctagttgcttctaagagttccttgcaaggaggcttttatatagctgatggctagcaaaacagtgccatttctgcttgtgtcttctaatgagtcatttatccactttctaaagtaattttctgcttttctttgcagagagcaggttaacaagcttttgactctgaatcatttctgcctgtatcattctctctttcaaataaaactctgattcaaataaaaatatacattggctgccataaatttttcacctagttgattattataggctcttaagtagagattgcaaacgcatttcattttatatgccaatgataatttgttatagtggctgcctggattacagtgttgaaaaggagtagtcatgtctgtcatgggtatgaaactgggaagttgtgatacacaatttccaggtatttgccagccctattcttgactgataatacaatccgtaagttgtatttaggaaaatgaaagaacaaaaataaattttagaaatatatgggacataggcatctgattatccacactccaagcattataatagaatggttctaagaagccttcttgtagtattttactctgtctcataaaaagaggtggttaatatatgcactaagactaatacttttgatttttaattttcacgctgctgaataccagaactacatagaatagtataactagcagttgtggttggaatgattcttcacccagagtccagagatagccaacaactctggtataattaatgtccaggcaatgatactggatgcaacataatgatgcaaagatagatattttttcaaaaatagcttagacattacagagaattgtaaaacacagatgtgcagaatcacagtcacagcctctaagggagatatctgaaaaagagagaataacgtgtttttacctcattgaaaacaccagaagaatgatcttgaacatagtccagaggctttttaggaggctgggtgtagacgcaccacagaagcagaagtgtagggatggaatggaggagagtcaatggcagcaaggaatgaacatgtggaaaaggtgacaacagttagaaattgagtgttgacagcaccagctacacaaacagaatgacatgaatggagcaaaatgggggcagctgggaggaagtgtgcaacgtctgcaaatattctcaagcactgggaaaattggctagtgttcaattagtatatttataaattcattttgtcaaatttcattagcactcctagtctctggccacagaggaatgcaaggtaaattaaagaaacattaaaggagcaagtggatagcatgctggtgagtttccatgtgtgactgaaaatgattatggaaaatgctgataacttaggctcagtacagaatagtccctataagctttctttttgaattattttattttattttattttatttttttgagacagggtttcactctgtcacccaggctggagtgtagtgacaccgtctcagctcactgcaatctctgccaccagggttcaagtgattctcccacctcagccccctgagtagctgggattacaggcgtacgccaccatgcccagctaatttttgtatttttagtagagaaggggtttcaccatgttggccaggctggtctcgaacccctgacctcaagtgttccgtctgcctcagcctcccaaaatgctgggattacaggtgtgagtcaccacgcctggccgtccctataaactttctaaccaacagcaacaatacatataaaataaagctagagaatgtttttccttgaaataaaatacatttacattcacactaagatacaaatgagaaaaaatgagagaaaacattcctcctatgagataataaccctaagaaaaatcctttggtttatattcgtttacagtcacttttgattcagttcaataagctaccttgagtctaaccaagtctcctttgcagtttaatggacaaaagagactaccatcaccaatcagtaaaccatatatggtccatatgcaagtatataaatcagcatatggtatagaaatggttatatcctgatttctaaaaaaactatcagtgtaattggtaggttatttaagagtctaaaacgcataaaaacgtgtgtaactgacacacatcaaatgcactgctgttggtggatacagttcctaatcagggaagttgttaactgaacctccagttgactattttttttttttttttttgagatggagtctcactctgtcgcccaggctggagtgcagtggcgtgatcccagctcactgcaatctccgcctcccaggttcaagcgattctcctgcctcggtctcccaagtagctgggactacaggcacccgccaccatgcccaactaatgtttgtatttttagcagagacggggtttcaccatgttggccagaatggtctcaatctgttgatttcgtgatccgcctgcctcggcctcccaaagtgctgggattacaggtgtgagccaccgtgctcggcctcaagttgactctttatcccaaacaggctaagcaataaggcccaacctctgggcttcctctggcgggagtctggggattagagaagctgtgatggctttcactagcaagtctggaaattaagatccacaggacttcctgatttttttctttccttatatccctaatggtaaactaggtacagtcatgtgttgcataatgacgtttccgtcaacgatgcacctatatatgatggtggtcctatgggattataagactgtatttttaccatgccttttctatgtttagatatgtttaggtacacaaatacctaccattgcattacagttgcctacagtatggagtgcaggaacctgctgtacaggtttgtagcccaggagcaacgggccatagcacacagcctaggcgtgtagcaggctctagcatctgggtttgtgtaagtactctgcgatgtttgcacaatggcaagtccacctgatgacacatttctcagaacccgtccacatccttaagcaacacgtgactgtattttgtagtgggattactctggcagtatattatagtgagaactgcccagagattttcatttttctttaacaggctctgcgtttaacttcttactctgccatttactattttgtgcacattacttaacccctccagtccccattttcttcttcttggcgggacatcaggaggcctcgaggagataatgaagacagaagcccgcactctccaggtgcctgatgtttgctcagcaaacaggactcaatgtcaaggtgctcttctgcttgaactagaccaaatagactgtaaacaaatacaaatcttctatacagctgtaataattgtctgaatattccatcacagaaactacctcaagattttgaacttgtaatgaattagatgtaaagaaatcttaatgaatgacctacaaaccacataggaaatgtctgagcacatttgaccatttggtacagaaatgaatctggactacgctgtaccaagtgtgtgtatacattatgcattcggcctttgttctctgaatgacacccacgtctactgataattgtattttagaaatcaaacagtatactcctagttttcttatattaatagtctagcctcacttaccgggcgtccaaactccagttctgaaaagaatttataccagggctcattttctaaatctatgtcatctggatttatgcgatcagtctagagcagatgtgaaggaaaagggaaggaaaaggcacactgagcaaagtgagggaaacgctgtgtggcatgaaaaactcacgcgcgcattgacacgcaaacatgcatcaactctcaccccacgaacctcagcaggagagaacggaggaagtaaagtaaaacgagtagcatgaggatgtgaaggcgagctccatggcagggggtccctagctgtttcctgcgtccatcgtttctgattggcataagttgtgggcaactcttgcttgagttgatccacttacgcttgaggcatgaactatggaccactctctgcggcagcgagactgggtctggctggcacgcctgatgtttggaataggctcaacccagtcaccaaatagctcttttgggcgagtcacttcatcgtccctgccctcattggtggctagcagtcccagcatgggagcccgcagtctgcagacaattcactcgggtgcaggcaggtggtaagcctgggatggggaagggtgcgggaggggtgggaagacaggcgagctggggggagggggacagggcattggggggctctcaggggcctgtggatgagaagattctggggcctggatgggtgcgagcgggacccgggggagtgggagtcgccaggctctgagcaagcaagggctgcacctgcacctctgccgggcatgaagaaaggtaaggaaggaaggagctcacccgggtgggagacagagccggggcgcgcgagcttggtgtgggggcgccactccggggcggaggggaggggctaccagtgacttctccgagtcgggagctagaaagaggcttccggccaggttcccttggaacaggtgtcggagttgttgggagagggggctgcaagaaagaggggtgcagaaactggttcattagatggaggctctgggcggaaccgcgaggacaccctggcagcgcgctgtgcctgcgttaggccgggaggggagaggcctccggacggcgaagtgtccctagggacccagacgcctcgggagcgatccgggccgctgcgaagccctgcccaccaggagtggatccccaggattcacctcccggctgcctgctctgagctgagaaggggatctggttcttcacaataccgtggatggcggggaaggggagggagcctggggtaaaatcccatcttggtttcctcgatgttctaatttagagaaaaagccagttttataattgacctgcttccctgcagaggtttctgaatgttgtttttaagatgaaaaaactagcagtgttaatataaacagttggagaaaatacatacaattattctagtaatagaaaacagatgtagagtgtttaccttacccagcagtgtccttaatattttcaaataatacatggctgactagattgatttaggctgctgattttgtagtaaatctaagagcttaaagtactatatacaagttattacttctttgataattactatatgacactaattaaatgtggtacaattgaagagtacagtatcttaagtcagaaaaaaaattctaagaaaaattatatggttccctaaaagccattcactctggctaggagaggagctgtgactcccaagacatattctaggaggactattaagtgctcactgcttcagaacaattcaatatcatttgcttacaattcttaaagaaactcagggacttaaactgaatagcgacatcttggttgtgaaaaaaatgctatgtaaccttcgcagtgctgggagcttgaaatgttccatattccaacaaaagccatgattttgacattgttctactgttttattgactcgttgcatttacaagttttgctaatgatacacagtctacacttactaataaattatactcacagtgtttttagtgatgtgactttgtttcaatattttataataaaagattataggagtaattacagacaatgatagaaaagtttgaggcatcgtgacaaaatagtgcaaaagcctaagttatccaaaagatgtagtgatcataattataaagactgtgtagtgtccctgggaaatgcttacaatgagataccaagcagtcaaaacggaatctaaccacgcacctgtacagtagttacaaaggtattacaaagcttgtctctgcatgaacacagtaaagaagtcacacatacacaaacgactacaatggtgttctggtattgcgactgtttgttttttctttcttttaaatattattttgctttattgttgtaatgttatttttgtaataaataaattcagagagaacatcctactattagacataggaaaatgcctagaaatcttgagatatttttccttctttatgccagtattatatttggtttacacctcagaagtaatagtgaaattggtagagacaaaatattctagtaaccaatttgctattttctgttgaatttaaaaatttaattcaatttatatttgattcaatagttgcaatagtattaattgagattttaatgtccataaaatactatttttctccaattattatttagatcattatagatgcataattgttcgtgaaatggctttgctggagctggtttttagggtaactgacaggagagagaatttccagtaatttctcttctgtttagagagacatactatttcttctacaggaaaactaacctctgactcttttaaacttcatagtttctaatgttacacactgaatgatatcattaattattataacttctgttttcaagaatagtattttgttttgccaaggggagatagaaacttctcttagaggaaacgaatctgtttaagaaacattatgaacagcagagggcagccaacttactaaatgaataagacttgttagctatgtagcttcactttgactcccacattaagaaaatatgtaacaaatggatataccaagtcctgatttatagtaatgcatctctatgatagaatatggaaaaggaagcagaatatctaccatcttgcatcataccttagaatggcagttttccatgaattatgcttttgtttatttaaatagtcaatttatagttacaatgggcaactatctagaatgcatgccaatagaaattagcagagaaaacacccaaaacaatgatagctggtaattatcgataactttggaatgcaatgaaaggcacatgtttgagcagagttgtgttaaaggaagtgttagtggcagaactagaattttctctttgctgtggttgccgtattgaatcttttaagtcatgcaataattaaatgtcctatggtgacctggaggcactgctaaggaacacagaagcctcgcaacagtcagtgacacacatacagatggtcagtcaacagatggatatacacacaaatcactaatctcagtaatttaacactttccatgtggaacatggacattcctttgagtacagcactaatattaacactcagaaactcatttaggaggtatgattatggtttactctaattgctcataaaaggcaaaagagcaaagatactgatatgcatctttctagccttggtgtgatttttttgttgttgtttcttttcattaaaaaaaaaaaaaaacccaccagcaaacctccgtttaaaactaactttgttagtcatcagtgcaagaggacgtgttcaagaaaagctacaactataaatcacaagtgatccttacttaaaagctaccaagggtgaacaactttaaaaattttagtgttttctataatttaaaagcatttaattgcttttgtggttatcgagattccactaagtattctcagtgaggcatgtgctttctatacgttgttctaaacaaaaagaagtgccagggctattttgtttttcaaattacgctcattccattttaagttttaatgacattgactaccgtgttttatatttattgtggtttcacaataaatgctatatacattattagttgggataattcttaatggtcatcagatgaaactccttaaatttttatagttaagtattgactgacaatctttattgataaagaagcttaagttcattaagggtttaagttgcatttcaactctgctacagtgttttcaatgactattttcttctgcttttatcattatgttcaagtttagttattgtaggttagggtaacattttcatatattttttttttactttatcaagcatacagaggtcctaaacaaatgctttattaatttttttttttaaatttaacattactcacctacaaacatatccaatgcaatgggatataaaggttttagtaatataatcccagcagagtttttatgattgtctcatggaaaaattaaattgtggaaatacggttctgatttgtggttcgagtcagttcaaggcaaattcctggtgactgctaagtacttttccagatcaaacattaggcccaattaattaacatttctaaatttacagtcacatgagtatttatgagcttcaaaaaagtgcgctcacttttactttccctgttaaagaacataaacgcatatgccactgattcctaaggaagatctctttgccagggtcttgggaagatttttgttcaaacagtactacccccctgccttctctgtatcccagggaatcgtggaattatgagtcactactaatagcagtgtgtcaaacccctccaagaatgttttgagacccactgggccttttgcactagaaatatataggcttcatggataaacaacagaacaaggattcagtccctcaccaactttttccactgactgcaagggtgaaacctgtgttccttcattcacttagaaattccacgaatgcatattcactgaacacctgctacaggccaggcatcgtcccaggtgttgggatacaactggtggaccagtcacagccctcgccttcaagaagctcaagatctcatgaggaacacagtgtgccatgggcacacagcagggagagcctccaacctaatgcagaggagtcaggcacattccctgggggaggtgggactgtgctgggacctggaggatgggatagaattctccatgtgaaggaagaggtggtggggagagcttttcctggtggggaggtgcagcctttacagaggcccagcaatgcgggaattgaaagttctctgtgcagctggaacctagcgaggcagggagggtgggaggagagatgaggctggagaggtcagctggagcccagtcacaggtcttctataaattatgctcagggtttcagattttgctcgaaggacagtgaagagccagagaaaattttgagctggaggttttataaagattttctaaagattgccttcgctgtggtgtggagactagactggagaggtagggaaatgaatcaggtggctgtcactgtagcccaggcacggacaattgtgggccagaagagaggagcagcagtggcacttctcctggcaggcgacactgagtccactgcaggagaggggaaaacccaagatgaccctttggaaaagtgggcagatggagaggccatgtagagattcaaaagagcaacacagaattgcccaggtgttgtgtatatttttcaaaaattgaaaatgaaaagagcaaaggaatgcttccaaggcatcttggagtcaaaagacatgagaatgcatgaataagaccttgatacccctcagcgctggccatcgctgcgacgccactctcattcagcacgcctgctcttcaacctctagcctgtattttcaacacttcagaatcttatgtaaactatatcagtacgcggccagtctctacatcaccacggcccacttggctctttttgttttctaatttatagaggcaattgaaacgaagtcaggactaatttttttaaaaagatgatgagctggtcctacactggaaaggctggccaacatgtcccatatggccagctcaaaccattctgcttaaggctggtcctctccaaaattgtttaggagggttaacatttttggttctttctatttctccataagatagccattctcacttccttccaagtttctaagttccttctacttatcttctcctgtggctgcagagacctatccacactcgaatctctgtcacactcatggctccagagtttcctgtcttacaaccagtcacatctactggtcctgtgtggtaactacttagggcctaagtttctgataaagtaaatcaagtatactttattgtaaattagccaataaataaattaatttatactgcaaaatcatcaaataagggaatcaaataactgctacttcaatgtgtttcctgctcagccacacctggagtggctgtacagcagcgaccaagtgcaccaggcatcagtatgcctgggctcaactcctagttctggctcccaccatgtgtccctggggcaaggcgagctaatgtgtgtttcagtctcttcatctgtaacatggaaatgccatgtgtctgcttaatagggctgctggaaactttacatgagataaggcataaattactaattacagcgcctggcatatagtgagtgctcaataaagatttacaatgattgctattgctattattattgctattgtaaaacgaggagtctttaaagtcttttttaacccaaagacaagagtaatgtgacaatttcaataacaatgatagggtcaatgtataaaccctaaagggagcaaagggagggttttttaggtgtgcgtctgttttaaccatataagaggctgtttactttgcacaaactcagatctagtcttgcatagatattaaatgatagacttgaagttcctcaaggtagagagtgtgtcctgttccccgctgtgcacctcacataaagcctggcatgtagctggtgctcagtcagttttactgaatgactaaataatagaaacatcgtggtgggagagcgtctaaaaccaatcctgtttcctgacaccacggctaccaaagcattccaataccattaccatgttcgttatcctaagagtctcataaattactagaaagatcattaaaattttgttatttaatttaaatctgagatatattatttcactgttttcaattttctgcaatgatgacattgtgtttcactcaattctcattctggaaatttcagagtagcatgatactcaatcacagaaactagtaaatgggttacaagtttgcaatggtgcctgcaaatcagtgattttttttttctttcagtttttcttttgtagtcctgttactctaaaagatatgagttatttaaagaaagggtaagaaggcttagacaaatatcatgtatgaattatctgatgataaggttttgaacatgcttctccagaacacaaccgcaaacacagggtttcaaagactcaatcaaggacactcatgttgggtgtggcaaggctagagtttccaattaaaccacagggctggccttggattatatatgagtgtgatttcttggagactcttgaaggagctccacaaagaaaactctctttttcctgttcactgacacctaaaattcttttaaagcaaaaatgagagtaaattgcaattgattgcaaatgttttcctagaagtaggcttggaaggagatgcagaggaactgtggagtttcaaagaaaatcctgaggacactgatttctgaggggaagcaaaggacatgcaagggagtattggggaatcaaaaccaaagaaggccaagggaagacctatgtgtgaacctgcgcttcgaggaggcaagtggttcttcttaagtgtatagatatttttgtttgcatataattaaataattggaaaaaatcctgcaaagtgaaatataatcttgatccattagaatgacaatcaatcaggaagcttgaggcttggtaacctgaggagggatttaataagaagcaattaaaacaacttgttatgaaaagggcatttggaaaattctcccttcatccaaagaaatattaaaaagccaatatggaaaacaagggatggaactgcctgggtccatgtatattggggagattaattaatgatttttctcattagcaagctatgatagcaattaagtattgcacttatgaacttttttaaaagttaaactctgattaatgattaggcacagttagagttacatgcaaatgaatcttgcatataaatatatatatgtgtgtgcatacacatgtgtatatatgtgtatgtatatacacctgcatgtgtgtgtgtatatatatatatataaatacacacacatacacacacacatacacttgtatttggtcagtaaagacaatatattagaacatgtatctttcaattctgagatgagatgtacaaatcattatacaaaataaacatgatttctaagtgattacctttgtgacaaaaattgctaatgggtctgaaattcaggtttattggggagccctgggagcccagcgagctggcatattctgtttaatgacaagtgcttactggtctttcatgctgaagaattgatgacttgccaggttcatattcaaaaatactccttggctcagaccgaaattttcttgtgtccacttttctgtctggaggatcccagtcatgcctagaaataaacaataaatcacacattaaaataatcctttttgcttaaagcaattgtgtaaaaccagttatctgttttcaacattacttttagcatagttttaaaaaaaatctctcaggataaaaagttaacctgtgaaaaataccacattcccccgccactggctccaaaagtcacatgaggggtttgtagacgcgcagagagtgagtccctgggttcctaatggcagctgtgtatatttgtgcttaaaataggtggcagtatgctctgctgaactatgagcatttaacccaccactttgtgacctttgggatccttgatccaaagtgacaaggagtaatgcacacaccatgtttgatcttatttcttgaagtgggatcatcgcttgggaagagcacagaagtgtcatgtgggttggcgtgcaccagagcaggcagtgtggaacaggaggtcgtcttttggtgtgagccttgaaaaaccagagtcaaacatctcattcatgggaaccagcacttttcccccaaggaatatcttccaagaggctgtcagaagacttacgaaggaaagcttcaaaaaagggtttcacaaaattaagcttttctaggctactgagctaaagaagaaggcttctttttttttttttttttcgagacagagtcttcctctgttgcccaggctggagtgcagtggtgtgatcacagctcgctgccatctcactcaaactcctgggctcaagccatcctctctcctcagcctcccaggggccatgatttttaggaggaaggattttctgactgtagataggggtaattctgcttccatggaatggaatgaaattcttgctccatggcccgttggaaatagaaatactctaagagacagaattagggacaagccctagctttctactaaattcatgactgatatggagcaagaccccttaaactttctcagtcttcatttttttccatttgtgtaaaacacagacagcaataatgtgttgttcttccttgcagaggagttttgagcattacatgagataatacatatgaaagccatatggaattttttaggaggttatcatatgttttaatgagatatttaattttaacaaaacatatcagatgggtaatacctttaaatcaaaacgttaattttggttattttttgatgacaaagataacaatttgtgtctagaaaactgtttctcaattttaaggcctcacataattcatcctgaggagattggtattaaaatgagacccctttcacacacgatgtgtgtgttttggtgggatgctgtgccctatatgatcatcaattactctattataaaatttttatttgttttttttttttagtgaagatgggatttcgccatgttggccaggccagtcttgaacctctggcctcaggcaatccacacaccatggcttcccaaaatgctgggactggctgggtgcagtgactcacgcctgtaatcctagcactttgggaagccaaggtgggtggatcacgaggtcaggagttaagaccatcctggccaaggtggtgaaacaccatacaaaaattagccgggcgtggtggctggtgcctgtaatcccagctacttggtaattgcttgaacccgggagtcggaggttgcagtgagacaagatcacaccattgcactccagcctgggtaacagagtgagactccatttaaaaaaaaaaaaagtgctgggactacaggcatgagccaccacgcctggcctgatcatcaattactcttaatggtacaatagggtgttgaatacaatttttctggaatgggtatgataacacttaataaccagtattaataagaaataatttttatattcttatttattaattgctaggatagcataggccttgggtttaatcagagctgagcttggaccctggcttggacataacgagctgcatgagctgagtaagttcctaccattttctaaactgcagtttcttcctctttaaaatagaaagtatctcactgggttgttctcggaatcaaatgatatgacacagaaaaagcacttagcctagtgcttggcttgtaatgagcgctcaatgaaggttacctataagtagaagtattagtcataatcccagtaaaaataacacaataaaaaagtgtttataaatttttattttcatgtagatagtttgtataaaaatatttcagtggagaaaggaaaactcgtattagcttgaaaaactggtagaaacaagtcacagacacttattaactaatgcctcattatgatttttgaataactttccctgctttcaaaaatgtctcttattaatagacctggggaaacagaaaatgaactgcatagcctgtaacctggtatgccaaaggaagtacatgtccattatttctatttacttgtctcttatatgtatgtattgatcaaaaagcagaaaatgtgtccatattacttcaagtctaatttagggcactccagtatcatgaaagaagacagggaaaacatttgctacaatcccagcagaggaggtcaatatggtatatgtatagactagcaagattacacatccgctctctctgtggcaggtgcactgattcttctactgaatgccatgtagacttatttttatcctaagcgaaacataggccaccctggggggaaatgccttacttttctgttgaagaccgatctcttggtcgaagcggcgggactggaggtggaacatgtgggggaggcactggggaggacgcatccttaaaggcattggggctgttgtcggagtggcttttggaaagaggtctgtaggtttgggtctttgcagcagggtgtgactgagcactgtagggtgggttgtacagacctatcatgacaaaaaacaaaagcagacaaaaaacagaagcaaatcacctcttaaaaatgaattaaattatttgtccccctcaaaatagccaatgattgcatagaaattattatcaataagcatattcataatgcatacattagaaggtagtttcttaatttattaatattaatgtactaatttccattaatttattaattacaaatttattctgtacctaagccctgattacagtaaatctttgtcaattatttcagaactagtaataattcagactggtactaggaatagacttataagcactcagcaaattttctcttcaattgtatacactaagaaaatagttcagttttcagagcaagattaaaaacggaactgtttccaaatatcttctaatactttaaaaaccctgatttacatatgaaaattgacatgctaattgtagtcaaacaaaatattgcacacagttgtgtttataaagtgctgtgcaaggtacaaggaaacatgagtcctcaatatgcttagagtgcacctgggaaaatcagacacaaatagaattatgatggaaaataattggtaaaagataataaagaccaaatgaagaaaacacatagtaagaattaaaggatgctagtaggtggtagattgctcagagaaggtattatggaacccacgagtccagagtcagccctgaatgagtttcggtgagcagggcaagaggggagcagggatggtatagaaaaaaaggcagaaaagtgcaaggtgtgaagccatggcttgcacggttagtagagagcaaagagactagctgcagttgactcgtccactgatcaaatgatcagcttgtagggctgtacaaagtaatatatcactgctgttccattcactaatcactaatgtgacacaaacctcaatattaaaacagttataaaaattctaaattttcctgcacccaatcattggagctaattctatttgtacccgttcgcttctcctgaaagtccatgcacatttccacagcaaatgaaaagagacaacatctacacttacagttttgcttggattcaacagtcggacttcaacttttgagctaaataaaggaggtgagtttggtgggcgtgggagcagggatgaaattaagggaaacatctttgtgggcctgaagctatcagtggggcgagccaagacttaaacccagagggcttgctgagtttgttctactgattttccctctatcaatttgtctttggagataggagcacaatcccaaatagttaaagggcctgaatgtggtctccaggggtgcagaacaggaggatcatgcgaccccaggctgcccagaggaccccaagtgaggttgcagctgctgaaggggaggggagcagtgccagcctccgagcctggtctaaagaaagaagaaaaaaaatagttgtgcacctgtcctgagcctgtgactgggcagggagaggagccctgggcagaatcccgaggcaacactcaggagaaagtgatgaagggaaaaacatttgtcaggggtccctccttccagcctgcagacccctgcacgagataccaaggctcgccaatccaagtggcagtgcctggaactgaagccattctattgtgaccactggcaattctgagtcagaaaagtggccccgccaagggggatttttaaactctttcaatgaatggttgcattttggagcaaaaggcagggacaaggtcacagaatactttgtttgacttgtttttggtgaagtgtatctgaaagatcttacacaattgtaatcattctctctgctgataaaagatctttatcttattttgtaccctgggttacagtgtgtcctttcagcctatccttcacactttggttaaacattcctgaagctgagaataaaccaacagtgggaatgaatgagataaaccagtattagttctcatttccatgagaaaagtcaatccttttgttatgcacgctctgagaaaagaaaagaaatcctcctcctaatatatgaactgaaaacatgtgctcaaacagaaggggaaaaaaggtgaccgtgtcgttcttccaaacattgctgagcataaaatagtcattgcgagcaaggaaacccatcctacctgcattgtatgtataaggagtattatacatgtctgtgtcatcatctagaaaatgaaacataaatattatggtaatatagattgtcaccaaaggacaacgagacagcagaacttcagacaaacaacagaaatttgttagaaaagcaacgtatttttcctagttcataatgccattttctttctttttttctttttttttaagagacagggttttaccctgtcgtccagtctggagtgcagtggtgatcattgcttactgcagcctccaaacctccaacccctgggctcaaatcattctcccacattagccttctgagtagctgggattacaggtgtgtgccaccacaggcctctgcaaactgcccttttttatctgtaacatattcgtcttgctgccctcttcgtagcatgcaaagtcaggcccttgtcctcgcttccccagaaacctctctgctctggatcgcaaatttcctttactaagtgctttagtggtctcctgtctacagagcaggctcaggcagacccgcgcaggctcactctcctgatgagagcagacaggggtggacagaggaacaatgtgtttttcacccaggcaacacaccaatttagactgtggacaggggaggatggagggctgaggccagagtgcctggttgtcctccatggggaggcttcttggcagctcaggtgggaggcagaggcacagggatctgtcaccggaggggtgacagaaggagaacaggaggcatgctgaaaagaaaggggacacggagtttgctggggtcttgacattgtgtgtgaatcaaaccgatgcaaaagacgaatgtagtcccttcaacccacaaggacctcatcagaaagcagagcagcagacatacccggcttgtgcaccatgtgaatttgcttaaacatcgtcttgtaccagtccttgggccggtcgactgtctgtaatgaagagagcgtccaatggttacaaactggcttccaatcaacatcgcttctcagtgttttcatttctctattttatgttcttaataacagagtcccattctgtgataaaatgttctgactctttgctatggcttcatgacagtttcagcaatttacttagttatgtgtgcagtttgtaaacatatggccttgtgtttgaatttaggctgagttggaacattagatgctatggttttattttttcaagttatagctgtaccctgcactagagagttgatatttgcacaaatatataaagttcacttaatgtaagttattgttgtactaatttgtttaactccttttggtagataatgatcattatccttagatgctttttattgaatgttctgtaagacagtgttttcagaattaactggggaatatttttgactcaaattgtattctgatcagtgtggctctagagaaataaatttgctatttactagtctaagctactaaaatactgaatgtagtaggcatcccagagtcctacggaaaatttaagaatgtagatattgcttcaaaaatgctaatatgataacagagtgtatacaacatttgctcggctaaaattgtaggttccttgagagtagaagtccttacggatccaggcgtcggacatgaggggagcagtaggctgtagtggaaagatgaaattaatgtagagtcttgaactaagattcaaatcttggttccttaaattgctgcttaatacaccctagcaatacgaatctgggcaagtcatgtcaccttcttgagcctcagttttctcctctctaaagtgacataattatatctaaatcataggattgttatggaaatcgaatgagacaatgtatacacaagacctagaacaatgcctagaatataacaactactcaataaataataacactagggaactgcaaatatttgtagaatgaaataatgaatgaacgtagcctattggatagagctctgcctttctggatacctgtaaaagtagacacatgcttttataatcgtactcacagattttgcttggcaagatcttaccccaactctctgagagctacctgggcaacaggcttgatgattctgcttatagtaactaaacacaccagacgttccaagacagatctcgatttaaaaacttctgttaggactgatacgaaagcattcttatacttactagactgagctttgggttagattttattgcctgatctttttttccccagaaatgtggtcactgcatttttcctctggacattaagggttttgtgctatatctaaatttattttgacctctgagaatatattattctgaaaaatcaccccaaatacaggttaacatgaagggccacttgacttcgttatgagtcagctcttcattctcggctctttctccatggaagagttgaggttattgattgactattcagtcaaaggacgggacatggtggaagggattgcagtggtgaagcaaaggtctattatttgctggttcaaagttgctaaacatgtatctttcaagaaagtttatttttataaaggactgatttctctttcattaaacctcatttcttttactgtaccaaagcaacagaaaatacaacatagtgttgtgcaaaaatgttttcctggacgtgctgatggcaacaaggaagcctactaagtaagtcctatcactgtatatggcaatacatgttgacagacaggtttttttttcttcacttgctggagggcctatatcaggtaggatctcacagtgatgccatctgctagctttatatggtgagcacaaagatgccagaaaatgccctgctggcaaagggaaatatgaagctggaaaaataaaatacgaaaactctatgtccctttctaaaagaagtactctaagcatttaaagttccttttgtaaatgccatcatggagatcgctatgcctaaggctgagaataagaaaatagtctactcaaatttcaggaagtttacttttgtacgtaaaatcattttgcatgaaaaatagctactagcaattcactatgccgttttttctacaaccttgactaaatagacctgaatttttacattcctacagttttcaaaacatcagaactctacactgatttaacacgcagagatttcaaaaaagataaaaaaggacatattttctacatagcagtatacagtgactctgttctatttttttctccttttcagttttgaaaatactcaaacaagtgttatattggaagtagaagaaaagaatcttgtatttcacttaactagctggccttaatgacacaatctcatgggagctgagccctggcgatttttgttgttttgaagaacagcactgaaaggttcacatagatgtcccaggtcacatgagagagggcaatctggagagctgattccctgcattaaaatagctcaaaagtactgtttgttgactcttggctttctagagtttctggatgactttacaaaattctgtttcctcggcataggctggctgtctaaaacgatactgcagcatggtacattgtgacagtaccgcctttggcaaatacactgaatctgatcatcattactttctacacatgagaaagaaaaacaaccttggagagtcttggcctgctgtggctcagagacagcctgacttgacatttataaccacagctatacatggggatgtactctggagggctgtatagtcagtgtaagaggagagtcctcatagacctggaccttctttgtcaagttttaaaggtccaagtaagacaacaattgtgcataaaaattacagttccttataaggaacttctgcattggttatattgtgttttctattttatagaagggaaactggcattaaatgtttagtgtgtttgcttatgcatacccaaacgtgcttttgatttggcagttgataaacattttaaaaattttaagatgatttaattttcatcaaccatctctagcatctcagtttttccttttgaaactaaccaggcaaagtctggttagttaaggaaattatgtcttataaaggaagaaaacatggaccaggcttgcatgtccattatatatcatttattgacctaaaaacatacccagatatctttgataaaatcctctcagacagaatctataactacatagaatcagggctttcttaattttgtctatactatgcctcaagtgccagttacacaaaaccaatgacaccatttctgtctgactgtctatccctatataattagaagaaagtttcaaatttaaccattttgagtcagaaatcttagaagggaaatgaacaagaaaacatcatcaccagaaacatgtaatcatcataaaatgaagaatattggtcataatccctgaacttttctttggcacataaatatggcaatcgtcagtttcaagacagattgttagaatgtcatatcacattcaacgtttcctcaatctaaagagtctaaaaccccagtaactgctgtacagatttactttttggctttcaattgtaatatagatgctgagaataatccattttaaactcttctgtctgtatataaaacacataatccccatataagaatgtaaagtcaaggagagaagaaaatccccacactttatcgttagttctttttgactgtttccaatcttaccacggctttttttttttttttcctgctctctttcccattctttgcctctatcccttattgtcttggctgcccaggtctgcattccaggggagcagctcttggccacaccccagctttacatgggtcttgctgcaaagtatatgcagctgcagtccctccccgcatggcccccaacttcacctgcaaaggtgttgttgctttcatcctgtccccggcttccttctcccggctggcacaagccttctcttccagtggacttggtcagccagctgctgcctgcccaggctctcagaagctgcctctgctactgctgcgttttgccggaaggggctgcccagatacactgagcaatgctttggcagagttttaaaacttaaaaaaaaatccaaacactttcacttatcatcccaggagagctctcagcaggcacggctgaagagggacattaaaatgtgtatttttcttcagacagcttttcctttccatgacattaactctcttcactccaatcatctcacctcccaactcccaaatcacagcttccaatctcccggtgttaacacacatctatttcaaaaaacgaacacatcactgctttattcgcaatgcatgtgggaattcaatgcagccaaagaatttccattgtcttgttccttctcttttctctctattgccctaagcctccttggtaaaaggtaaaagaaaaacaaacaaacaaacaaactaaaccacacaacacagttttaccatttaacaaaatcgcaatgttcatgatgtttcattcaaatggaaaaacagattgtgtaattctctcccatcaacagctttctttctctgccacacacagcataacattcatgagaagtcggatggcacggagggcaatcctccttatataagaccctaggaatgcacaaagccgtggacaatccgtcctttgtggagtctgtgcacagccccagacagacgcacacgctggcatttcctaccgttctaattgctgtggggattccggattcatccacgggcccgatccctgggtaatgcggggctttgatgactgtcactctcttctcttcctctgaggatcggtacagggggatagagctgctggtggtgccatccagagactgcgcatgctggggatatgtgtctgtggaatctgcacagaaaatttggtaacatggaacgtattcgttgcacagggaatcataaattcatgtgtcttgttgtatatttatgccaactgtaacacagagaccatattgccatcactgtcccttttaactcatttactttccatctgagctggtggaaactgtgtaggtgtgcggggaacagacctataccaacaagggcctcaccattttatgaagaaggctgagggaagaatggcatttgttaaatgactgtgtggaggcctctgagttaggaagtgctctaaatgcattatctcttcttatccttccagtaatctttgagggagggcaggatagggggagcaagaaccagtgttatagataaggggcaggagctgagacaagttcagtaatttccctcaggtcatcatttacatcaatattattcttgtgatactgctactactattatttataggttttgaaatgtatttccagacaaagacatgactgttgagtcagtaacagtgatttcataaaaatgaagcaaaaccaaaaatcacttaaaaaaatcttcacatccaagcctttggacatgaaagcttctgaataaataaatgctgtaaaattattagtacgatttcctatgtgcatttttaccttaaaatatcaaaaactatgactttttactctttgatgacaaaaactgccctaaggatataatttagatgaggcttatcgagttcttcatgttttttagtaacttctagaatactttcagaagcaacagagtacagacatgcagtatatagtccatttacttctaatacacaggaattttaaaaaaatcatcattattaccgttcctctggtatgattaataatatgcctttatatttttctgcaattaatttgaaaatgttggtgacaaagaatgacactttgtatatactctttatatcatggtttgtcaggactgccactcagaaagtcctttaaggtggaaatgaaaaaaattctcatgtttcagggtgggactcattgatatcattatgtgtatatgatatatatcatgtataaatgtatttttcatgaaaaatttgtataaaataagtaagctttttttttttttttttgagatggagtctcgctctgtcacccagctggagtgcagtggtgtggtctcaacctcagcctcctgggttcaagcgattctcctgcctcagcctccagagtagctgggactacaggtgcgtgccaccatgcctgtacaaaaaatttttgtacaaaatacaaacaattttttgtatttttagtagagacggggtttcaccatgctagctaggatggtcctgatctcctgacctcatgatccgcccgcctcggcctcccaaagtgctgggattacaggcgtgagccaccgtggccggccataaggaagctttttaagaaattttaactcatcaatataagggtaattaaaattcagatctctctgaggtaaaatccattgtaacatttgtaactgctattactatgattatgactattttcaatttagtttgcatcagaaagtcatttttaatacattttttgatgaagaatggataaggctagttataaaactgctttatgtgcagtttatgtgctggatggtgacataaaatgtccctgaataaacgaacagcatcatagcctttcaacactgaatcagtgctggggaaggaggtgtgctggctgctgtcaaagaagacatggtggttgaagtcccgggttgtagtttctttccccctgctactggccccttgaatgtgaaaataacattcaagctagtccttatttttacttctttattttttttgagacggagtcttgctcagtcacccaggctggagtgcagtggcgcgatctcggctcactgcaagctccacctcctgggttcacgccgttctcctgcctcagcctcccgagtagctgggactacaggtgcccgccatcacgcccagctaatttttttttttgtatttttagtagagacggggtttcaccatgttggccagactggcctcgatctcctgacctcgtgatccacccgcctcggccttccaaagtgctgggattacaggcgtgagccaccgcgcccggctaagctagtccttattaagacacggtgagatatttgacactaattgactttctatttaattccaaaaaggacttgagtgggcctccatgatactagtatttttattagcgacgaatgttttttgaacaccagcatgtgcaaagtcctactctaagcaaggagaatcaactctgccttcacatctgatccattacattctatgaacccataccttatgcaatataagttaaccctttattttattattctcatatatggtccactagctgtcatcttagcaatcttttgtcctaaactaagtgtaaaattcatctagggcaaggtagatgtacatattcctccgaaaccttatcacagcactggccagctggaatttgttcagtgtttacattgggaatttcttcccatgcagaatattttatatgtaaaatctacttatcaatatattctaaaatcaaagcctatctacattcaagtatttttgttgttgttgttgggtggggatagggacaaaactgcattcactaagacaggcaatgagacagagtcaggctttgttaataattatttgggaaaaagctgtggctagaataatttgtcgagttttactttatatgtgtgtaaatgcatagttccattttaaacaatctagatataatggacttccattataacaccacactatgggctgattgttaaagggcaaaatttcggcataaaccagttttactttcttaactctaaaaggacatcattgtaggattcacagatgatcctcaggcatagcatcagcgaaggcacagatatatttagactttaataagtcccgcggctacctttaaagttttatagttatagagctttggttgacctcagaagctgagttccaccatgcacatgctggatggtgacataaaacatccctgaataaacgaacagcatcatagcctctcaatactgaatcagtgctggggaaggaggtgcactgtctgtgtcaaagaagacatggtggttcaagtcctgggttttagtttctttccccctgttgctggcccctgtggccagaggaccaggcctctccttttctgggaggtgcaggatggtgctgctgtcctgagaattcccctctgctccctgctgtcctagaagcttcctagtgagtcgacatcatggaaacttgtacagcctgaattcctatgatagttcaatttcgtattttttttgatattttaggtttttaagttacatttttacaaactaagaaatatttatgggccgggcacggtggctcatgcctgtaatcccagcacttagggaggtcgaggcaggtggatcacctgaggtcaggagttcgagaccaacctggccaacatggtgaaaccccctgtctgtactaaaaatacaaaattagctgggtgcggtggcgggcacctgtaatcccagctactcaggaggctgaggcaggagcatcactggaacccaggaggcagaggttgcagtgagccgagatcgccccattgcactccagcctgggcgacagagtgagactccatcttgaaaaaaaaaaaaaaagtatttatcacattattttctgaactatctgaacatacttgaccatgtaagagcatttctatcactgtacagcaaagcttctttcacaggaggccacaaaaagtccatgagccccaggaaattatctgcttacaattttttatgaacgtccgtatgtccatttgttttctggaggagagctctatctttcactgaattcctagtcctcagagggttgagaacgattgctctatacaatgacagaaccttcatttaagggaacacttaagtttctcttgtgtggcttcctgctaccatatccctgactgcaggtcttccagccttggtttgaatggtggttttctccttgtgtgagccagtagatgactgcgtccctgctatgtgggacagcctgtcctcctgttacactgttttaactgtcaaacgattctcccttatatagaccccaggaaatagtccatggtggaagctcttccaagtccgaacaagctgccctagtggaaaacctgcattcatgtcctccagtggcacaaacccccttgccctaagtagccattttctttttctttctactccaccacctcagacatctaagtgcccacaccaggctcagacacaggtggagacatggtcttggaatagcatggtgcccatttcctcccatgttgggtcctctgccccagtttctccctggggatagggtcatgagtgctgagcgctcccgcctcaccttgatgccgcatatctttctcctgtggttgtacttgccgcattgaggttgccatggaaatcacggtgagtaaattacttaccgagggatgtgccgtgctgcatgacaatgctggagttgagtgaggctgggagagaatatgccgagggggaaaacggcctctgatagtaactcatgggactcacggcacctcctgagtttccattcactgttatctggctctgagaaaagcgcaaaggcatcgagttaaattagcacatagttccctgtaaacatcattccattaggtgataataaaagacttccaatcacatgagagtaatcagctgccaagctcttatttattttgaaaactgatgtcagagggcatgctacattctttgccttctctctattcccttatttctgaaaatcactctcttgtgtatctgagggtccagggagtggttaggaagaatgaaagtggctgactagtgggcatgccactctgccaacagaggtgccaaatggtatcagtaggagtcagtaccaagtaaatgtggaggacgactttgctctgacagtcgtaacatcagcaatcagaacacggtggtgctgttccgcatgcagcattgacgtggatgtcctttgacatgaggcaagggattggttctcagacttagtcagggatatcttctagtgaatgaatgtttccagagctggtgaataacataaggaacctagttgtttggatgtatatatcatgaagcaacctattctagaaggatcaaatacctggtaaaggatcagagagacatgttcaaccactggcttctccctacttcagcctcattgagcacttcatgaatctctgtttgatttcttaattattcattgtttcgattgttccgtatctgactattttatatccccaatggtatctcaagcttcttgttgaagatggtcatatatatgcttctttaatattttgtataacatgcagcctagtgctgatgacagagtagatgttcaataggtatctattctgatggaactgaatcggcttagttcacagatatcgagctcaggactattaagcatgcctgtctacccacagcacagtactgatcattacagggcgcacacaatgcatgcaaataagatcaaacattagtaagaacgtttagttaaaattatagctaaatacacacaacacacataggcacacagataaagaagcataatttgtgaaacttttctacttattttaaaacaaaacaaacttctattccacaggcttgaaacatagatatagtaactgtgtatttctatgatttcactttaaagcaaatgggttttcaaatgacctagaataagtctaatttcattactgtataaccataccacttatgtccccaaatcaataaacatttcattacaagccttgtgcttattgattaaataattctctaagctgttagaaaaattacactcatatcataaccagccacatcttgaggacctgctccctggagagagctggacgttcaaataactgtgaggcacaggcctgcccaaatcttcagagcttttatgtacctctgatggatgatttgagaacactttcacctccttgcccaagttaagtttggtggatctttgtcaatatcattgtaatactattataacatgttataattaatgttaaaagctgaagaatccttcttattaaaaaccatcaggttaactatattgctaaacctacaaacttgctctgaatcctattttgatggtttcaataatattgactaggggttaaaaaagtaaacactgagagtagatttattcttttttttttttttttttttttttgagatggagtctcgctctgtcgcccaggctggagtgcagtggcgcagtctcggctcactgcaagctccgcctcccgggttcatgtcattctcctgcctcagcctcccgagtagttgggactacaggcgcccaccaccacgcccggctaattttttgtatttttagtagagacggggtttcaccatgttagccaggatggtctcgatctcctgacctcgtgatccacccacctcggcctcccaaagtgctgggattacaggcgtgagccaccgcgcccggcctagatttattcttttattgtgttcaaccaatcaggattttatgactaaaatactatcattagcattttagaaaatactgtattgttatagtgaattcattattaggaaaaacatgtcatgaataatctatttgcaattttaaactgataattgcaattaatttcccttacaagtagctctgctcgtgcccacaagactgtatataagacagttagtctcctgtaaagtcttaaaaacagaaaattgaacaggttagttggtagattgataccctctcactgccttctttttttggttaaaggtcctggtaaagttttaaaagctaagaaccattgaagcacagtagggcatgggaggaacccacacctgctgtgctcctggtgcccgtagttgggctggtcctctgtggcagggagggactcgctatggggttaggcctggaaaatgaggctccttctgtagccagtctctgaatggagcatttgaatgcaaagtgttagacacagccattgggggaataccaaatcccattaccaaaaaaagcatcttttactttatgtaaattgtagtgtcttaaaaaacatatggcttattataacatttctctgcgcataaaatttgcagacttatcagcttgatagaacataaaacaatgtagcacaaataaaattttgtctatgacagtgcttattcggaacttcattataatatcaatttaaaaaaaaaatctgatttttttgcctgaagctatgtgtctcttaaatggaagccattacttagacattatatgcaatatagaatctgtgccataaaattttgaaacattttagccattcacagatcatttattagggattgcttatcacatagatatatttaaataatatatgtatggaaaagatgtatatattgctataaatgaaagacaaattattgataaacaaaataaaaaatgtattcataaatttctgtcctgaaatggctcaggaagaataatttttaaaaatcgtacagctaaatttctgaaaggtagataggattatcgacatcattcactcctggacaatagatgagttcaaaagttgtagctgttagagaaggaggaacaagaaaaattagcctcatgcagtcagtaatcatttatgtgagaaaaaggatatagaaaagagtcacacaggacacattaatgtgagtctgtgagaaaaactgctaacatgtattaatactgggttaaaattttttgaaaaattttagactttatgatcacaacatattgtgatgtatacttagctaataaggcaaatcactgtagaacttaccagctacagtaacacgggaaaccgtaagtaactattttagagtaactataagtaattctaaaatgaatgaagagaatgaagtgactttttcagccttaagcaagcttataggatgactaatgatttccctgacagatggcatagaattggtttgggaatcaacacctatgtaaataaaaatgtcagccgaaaaatgagatggcacaacaaatcagtcctttcaaggaaacggtggaggcaaagaaaggcagaataattacatgagtggccgcaggggtggttaaggtggtgccatctgtcacagcagacctctgaccccaggtgggggagggtgtctcagaacggccagtggtgtcagagtcaccaatctgcagctcctccagcatggctgtggaggactcactctccgagcgggaggagtgctcggccagggaggagtctgttgtcagagagcctgtgtcgtggctgtggatgaggctttctggagctgggagcaggtgtttgtataagcaatgggaaaggctctggggattatgcaggcgtgaagaccccacaccatcggggggcggaaggctgagtgatgctgagctggtgccactgcctggtgagaaagtggctcggttcaaaggtaccacggaaggagggcacggaggagaagcttctggtgtggtttgtctgtgtgtctgtgaagcatttacctccaacacactggcaggtaagttctgatttccaagctgagtatgaggaaaaaataataagagataaattatccaattaacaaaagtacctctttttgcgatgtggcagagaaggcaaagcatcggttttatttgcaagcactttaaggagttacattcagatgggttaggtgccaaccacacagtgcagaaaaagtgtgaaaacaggaagaaagtgaatccagtcggtgtgttttgaaacaaggccggttttcacacagcactgcaatgtaattctggttaggggcttgagagtgttggcataacgaaactgtttcctcaggagttttagtttttgtatttgtgacaatgataagatatcagactatcggtcagcagaattggtttgtccttcactagaaaaatctaatagcataattgcctcccccttgccaaaatgtccccaaaacataaatctgtttgtcttattttttcctggtttatgaatctaaacactgataatactaaacacaactaagcagaaaagataaatggaaaagatgttttatttcctttccactaattaaatctgttctttgatttcactacaaaatacgaaaagaattggactttaaaatatcctagcaatgcaaatagaggtaccatgtgtgaaaatgaaaaccagccactgataatagttagaatgtaccctagttagttagaactatggttggcactaaatcttaggtaaaggagaaagaaactgaaggaaaaataaaagatttaacagctccaaggctatatatagcccaagaggctaaacatagcgaagggatgctctgtaggaggaagagagaagatgaccatttgaaattttacaaccacctgtggtagcctggatgacgtttgaccacacgtgacaaataggatgataagtactcaattcaacgtaagtgaataaaactccgaagcaacttttcttacttattttttctacctttcagaacagacactttttggaggggatgtttgggagaggaaatggttttaagatagatggccagaggtattgtgagatattagtacaaagatgggaatgaatgaaggagaactgtttacacttagaaatactgcctagtaaatgtttaagttaaacaatttggtgttctttggcagccataattttcataatgactgatgtcatgcacgttgttagcataataaaaaggttgcaataatttttttctcagacttttacttgaatacttttaaaaaatccatcatataaaaaggtctctctgaatcatagatcccttagaaatctgataaatgtgactgatccttcttttggggaaatgcacaaattcatacatacagaaagttctgcataaacttcagggggacagagacactctaaagcataaccttaatctaatgggttaagaaaccccaaccttggataaaaagacagattttcttgtcctaatcttacttaatatgattttttttcttgtttaaacatagtcattttaaatgtgatatatatatatatatatacgtatatatataatatatattttactgttcatggttgtttaaatctctagaaataactgacagaaatcttagttacccagaacttaaaatgttttggtggggatgcatccttattattactgagtgtttacaataattgcaatcttattggaggtgaaactttaatattatgaaattatcataattctaacttaatgtattaaaatgttgctataagtctgaatgtaattcagtataaagcagtctttggatagcgtcaatgaaatttcccctaataattcagctttactaaggatgtttccatgtaatacgaatctctttttagttttatttatgctaaatgaaaactatgaaataatacaaatcatacaaaaggatttgagttatctgctcatgagacttttccctttcaaattaaaagaaaaaaatctaatgactttaacccccattggactgacttgtccatatcctatgacttgaaacatgtcaaaagctaaagcgtattctaaaatcaccattgtcacgggtaatatgatcattagtttgcatagcactgtgtctggggatggtccttacccattcaattgttcttccaaatagaatgtccacagaaaacaaaattattccacctttcgaatttctttcaccacctcctgacatgctcctggttttgagtcttttaatgcacgtgtgtgtatgggtgtgtatgtgcgtgtgtgtgtttgtgagtgtaaggcatgaaatgcctcgtggtgagtcacatcacacttaaatttctacagataaaactcaataattcaacagttatactggtcacccacaaaaaagctttgacaagaccccaatcttcacatgaatggaatataccctgtagacccaaggggaaagaaagaccatgttacacgtgtttctcctgaggaaaatcagaagagcagcaggaaaggtatgaaaggggaagaaggcagtattttcccaatctggactacctcaaaaatagggaaaactggctttaaacaagtgtatttttttcttacttcatgagtggcaagtagatgactgcaggtaatcatcctaattgttttaggtctccttcttttcaagaccatggaaggctaaggtgtttgaatagggatcaagggtcaccaactttttgtgagtataaattgttttttctttccccaacccttgagctagcaggaagagggtaatgagaaacaccagctagcagccaggggctgcctggtcttctgcaaaggacagggacggtgcttaaaccttaatatgcttcatataccaagagagagcacctgcttactcaaactagcactgagcttcttcgtccaaatgactccaacccagaatgctaaagagagcctgtggatgagagtgctcaccaatcaacactggagctcctgaggaatgaaggggcacagagattcaagggagggtgagcttcagcagtggaaaaagtgtattgagttggatgaaggcattgcaaactcaagtgcccatcatgggtcaggaaagtatccaggatgtgcaaatcaagcccgtgttggatgacagggaatgatgggaccgatggcagaatgcggaagtcatgttccccctcaaggcgggcgtcattgacccatatcctttgccttgaaacacgatgaaaattaaagcttactgtctctaagaccaccatagtcatgggtaatatgacctttagttcgctcataagctcagtgacaacacatctatagtcataagcccctaagctgtcacttgctgacacagcagatgtggaagctggaggtggaagagggtagctgtggagcggggatgtgaagaaggagtgcatggccaggcctcaggagaggaggggaaagtgctcgttggggtgcaaaacttaaagagtgacaaaaaactcagtaattgagataaattctgtttcaatgcaatctttgaaagaaaatcaacatcaatgcaaaaaagcaaaaataccccatactgaacaaaaatgtcgaaaatataaatgaagaccagcgcatgccaagccataggaaaagagagtctgggtctggcgtttttaatgcaagaaaactcatcaataatattttcaaaatctacatttttgcttatttcagttttagttgagagaatagacatgtttgacaatttccaattaactgatggccatcttaaataatttgtaattaatttaaggtgaagtaaacatgtaatagggcaagcgcagtggctcacacctgtaatcccagcactttgggaggctgaggcgggcagatcacctgaggtcaggagttctagaccagcctggacaacatggtgaaaccccgtctctactaaaaatacaaaaattagccaggcgtgatggcaggtgcctgtaatcccagctactctggaggctgaggcaggagaattgcttgaacctgggaggtggaggttgcagtgggccgagatcacaccactgcactccagcctgggtgacagagcaagactctgtctcaaatttaaaaaaaaaaggtttattttgctttaaataaaatatttaagcttaaaataatgtgtgagtgttaataacgtgcgtttcaacttttcaaaaaaattctaatgacttaaacattctaggaaaaagctcattcccaatatatgaaaacaggtataaggaagcacagaatttccttccacctcaggttccagttggcttgacatggccctgaggtcaaggatcctaacatctctctcttaacacctttagtcattgagcttctaggcctcatttctcaaggaacataaggaatatatattaaatgtcaagcaaagaaatctgacaggcttttgttctcttttttccaatgatagtaatttacttgaaaagaaaatatctaggaaggggtttttttttttttggagtcttgctctcgacctccaaaagtgctgggattacaggcatgagccactgtgcccggctggaaggggttttaaaaaaaccaatctttacctcccatccacacatcctttagggaaaatgtgccccctcttttcatggcctgtcctggtggtatgaggagacctgcctggcagctgtgtctgttgccggatcatcattttgctggccacagctgattaggaagggggagtaactggactatgctgggccagtggggccctgcctccctcctgggaatttgaattacgtgacactgaatgcccctcaggtagctgtcgggtacccaaatgcaaggagtcagagagtatcatggaaacccatgggcaacttgaagtaacgacagagcagaaactaagagacagacagggaactatgcagttcctacgactgagaaggatggagggtagctgcctggccattgccccgtttccctaaggcctggctgtattgcctgcattgtaatgatgtgagattgtctgacagcctcataataaaaattattttaaccatatactccccacccaagagctgggtgacaagtgatctaaaattgtcacacagattgggcacactgacagcatgtggcatctgaatcaggggagtaaatatttctactgtactctgtggtattcagatcgggaatatggttttgcatctgggaaagtgtcatattttaagaacattatcaaaatatgggatttaaaaatcagcttgtgtgagagcatagaggtagcagaggctagtggctgagctgtggatcttgagtcagacagacttgggcaacttgtttaatttccttggcctcagttccttcatgtgtaaaatataggcatggataaaacccatctcttaaagcctgtaaaaattaagtagggcaatgtaaagtgcttagcacagtgcctggtgtgctgtaatagctctcaaaaaaaggagaatcatgttttacaaaattaaaatgctgggaaggaacaggaatgctctgcacaaagccagtagcagggtagggaagagaaggatcacgtgaacactgtcagatagaggcggaagaacattctgtctcttttgctctgtggataaccatgcagaagttaaggaaggcagatcatgacgtggtattagaaattctttccaataattcgatctcagaaatggccaagcactggactgctgccttggaatgtaactgagctcttcattaagtgtattcagaaaaggctggatgcccatctattgggagatgttgaagaggacgttttatttgtaaactcatgttggactcccaagtattctctaatgttcaattatttaaatacatgcatatgcatgcgcatgcacagacatcaaatggagaaattgccaaagacctgatcaactaatagcattacgagcccacagaaaggaagccatactaatggaagacatcaatgattggggccggtcttgatagcaatgttccagaaagtgcgttctgcagttctgcacctattatcccacactgctgacatgtctgcattactctgtcctccttagtatctacatactgatcccatggagcaaaagaaatgagtttcctctcccttctacatgacagtcgggcaagttcccctgtgagtccccagcatatgtgcagtggcagctgtgaaggtgaggctttggcaaatgattgattatgttatttcataacggacaggacaagcttatcttcctgaagcaaggaacatagcacagatgccatagaaactgtttgggggtgtagctttttgctggctttccaaagtgtctggcttataccttcacttacttgacattgagaacaatgtgacatttttagcaacaggatatctgatcacacagtgccataaggataacatgcctcatttctggtctgtttgtaggaggtcaattaaagcacatgccgtttagaaaacactatgaaaaattgtcaaatatgaagagaatttctaacagtgacctgtagttttcttcttaaattaatgagcagacattaataataacaaaactatgtaaataaaacttctgaaacactgaaatgtacttttcacatcttggtgtacttttatcgcttggacctgctaattcctgggagcctaattctttataatggagcacatatttggctgactcacagggtatagcttacagtgcttggcattggctgagacttgccagaatgcggagtgcaagtgtttaaaatggaaaggtcaccattgtgaaaggtcattacatggaaaatgagacttaaaaatgaagcatatcacaatcatcaagatgtagaaacaaaccaaatgtccattgatggacaaatagataaagacaacgtggtgtatacgcatactaggatactattcagccttaaaaaagatggatgtcctgccacatgctgtaacatggagcaatctggaggaccttataccaagtgaaggcctgtctcagaaggacaaatatctgagcagagagtagactggtggttgccaggcgcttggggaagggggatatgagttgctattcggtgggcataaagttttagttatgcaagatgaataaatcctagagatctgctgcactgcatggtgcctacagttaacaatactgcattgcacacttacaaatttgttaagaaggcagatctcatgttaaatgttcttaccaaaattttaaacagagaataaaaactgcaacagcttcatgctaccttttttaaaaagccttagaaaagaggacacgctatcttggaacaaactgaaagtctgttgaaataaacttttacctaccagtaaaaaaaatgaagtattgttgaaaataatatatttctttttcccaatcagatgcataatttggaaaaatattatttaatgatgatgacagctactgtatgttgaagaattaccatgaagcaggcaccatgccaagatccttatatgccttactcaaacctcccagcagttctatgaatggttgctatcattgtccctgttttatagatgagaaaactgctgctcggggagggtgaataactagatgaatggttttatgttaataagatcttgaaacagctgactgcccaaccactttcttcccagtctctctcatacccactccaagaaagcctccttccccactatggaatcaatggtaagttttcagatttcatttcaaacctgtctcatcaacagcatttgtgcggtgaaccatccctttctttccacacattttcctcacatggcttttaggatgccacattttcccagatttcctcctcccttagaggacactgctttcagtctcctccactgcttcttcctcttaatgttgagattcactcaggctcaactcttggtcctccccttttctctgtccttcccctgctgatctcactctgtctcatggccacaaaacccatcgactagccaatggctgatacctccaaccaggacctttcccctgaagtacaggctcttacatccaaatgctcacttgaccacttaatgtgggtgtctaagaaatgcctcaaacttcctgtttcccaaatggaacctctgaagtttccaccaacctgttccacccacagctgtccagtctcagctgatggcgatgctatcttccagttggagtcaaccttgacttttctcttcctcacatcccacatgcaatctgccaggaagtcctgtttgcttgactttcaaaatacattctcacagtctgatttctcaccacctcctctgctgccccctgctttgagccccatcatttcttacctaaaggactgcagtagttacctaactggtttgcctgatctcctccttgccccactatggtacgtttttcactgagctgccagaatgattttgttaaaatataagggaaataataatggtggtagcctcaacatcctccagtgacctccatttttattgagagtaaatgtcaaaatccttgcaatggcttataaggcctcctgtcatctggtctttgttacctctgacttcacttcctatcactctcacctcacttacttcctctccctccctcaggcttccttctggtcctcccacagccccagcatgatcaacctcaaagcctttacataagacattccctctgcctagaatattcttcctccttcaaagctgttctcttttcagtgaggtctattgatattgagttaccatacttgacatgatatctggtctccacatctctactttgcatggcataactcaatttccataatcttctaatatatgtaatttactccagttcttattaatgcttgctcctcctgccacacacagacaaattttaagcaggaatggtttcaaatccaactctgttactagaacagacttgacataggttaggcacccaataaatatttcttgaataaatagcagtgacaggatctcaaatcttaacttttagatggtgccgataccctggggataatataatcaaactaaccgtctctgcgcagcctggataaaaccatgcaaaacgaaaggtatcagcttgttttcaaacatcacaaaaccattctgaagaagcaaaccaggttggatgagtccaatgactgatatgtgttcctatgacttctcctacacctgcttcctggcgtgcccatcctgggacactggcgagtctgctcactgacactggcacgggcctgtctgtacagtcacagacggattttgctccctccgaccttcctggactcctgaacccgatcaagatgcatctgcctcagctcccaccatcatggcaccgtgtctcgtcactgctgagtaacgacttcacaacgagaagtagcactctttcagagtggtggccctgcagccagcctgccagggtgtgtattctgtttctgccttttgccagctgcatgaccctgggggagcaacttacttctgtgcctcagtttccttagccataaaataaggacagtagtaatacctactccatgagattgtggcaattattaataaacataaacaagctgcaacagtgcctgcatagagtaaggccttaatatttgttagctcctattaatgttattattattattatcatctgatttcataggtgctttcagaagatattaccttaattagaagaaattgctctactgaacgaattttgcacatcttgattggctgatggagaagatattttagtagaggtatgataataccagcttgtcctttaatcatttctgtttaaggctcgtctgctttatgagtgggtggggggatcttggtgtcaattagttatcttttggagattttctgtacagtttaaaagtatatctcctcgaggatatgttttggatgatctttattaacacagatacaaaaaggagtattatacaaattatttacttaggcaccactgttttcaatattaacactagcgctgttgctgctactattatatcttttattaacagctgtcattgagtgcttgctctagcctagtctatggtaattccctagtcttaccataacctataaattaagggttaattagtattctcatttctttgttcggactcacagaaaagtttagatgaatgtctcatcacatagtaaatgatgcctggattaaaatctacagcttatccttaaagtttgtgcttttagcactacattgttctatggagaagtcaaaaagagaagcacatttctcctgttaacagactaatacatgtaaacagaaggatgctatgagagaattctacacacatggaaagttttacttcctgaaagtctggataataaaagttggctaatacactttctgaaatgataaattaagttttagtgaaaatgaatattgagttgcaaagaaatagacattgcttaaaattaagataactattccctgccaaagcaaattataattgacaattatctgaagaggttttacacatgtaaataaagtaaatctaagtgcaaaaagatctaatatgaaaaatatttctttgaaacctaaacatgctttaagtcctgaagtagtctgcaatgtcttaaatgataactgacccctcaatgatttcccataaacatctagaagaaaaaaaaaaatttagaacatgatttctggatgaaagatctgtatatgcatatttacatttaaaaatacctagacatttgctgatgaatttagtagggttttaaattggaaaatggtttctttctcctttcccttcctgcttggaaactaagaaagcattaggtcatataagaagcccaaaccaaaggagttagggtctctacgatacgcatgtattaatacgaagagactgagaagcttaaggtaccactctgcagtctgaggactgagaggccgctgcaactgcagatttttgtctctcttgctgaagaggtatctttgcagtctctggagaaagctcaggtagctgtttgtggctttcaagatcctgtcctgaaaggggagctatctgaatggaaagagatgctgtgtgtgtctcaggcactggattaggggtcagtgagcggggccttttgagaaatgacggtacttcgacagatttggagaactgtggagtactaatggggctgctacttcctagatcctggttatgggttagtttcaaggtagaaatcctccgagtttgagaatcttgcctgtagtcctcttgtagaactggggtgttgatgttagcgaatggtgcaggatccgtgctggaagctgctggtagtggattagtgattttttgtgtatatgacatggttgtgttagattcttcagaatatacaattgtctgtctcgaatcttcattggaatacatagttccctgaagaggttttttgttagcaaagtactctgtactggagggaatttgtgtgttagttactaactggtctaaaatgacaccctttgtgtgactggttatcaaagagctatgaaagctctcttttctttctggtggagggggtgcctggattgacaatgggatccagagaaagaaataaagttgaaagaaaaacagagaaagtccaagttagtcatgaaagaaaccagtgtcaaccttgcctttacagaagtaaagcaatgccacaccttctgattatgctatccattttgttagctagattgagtgatcattttcattccatttagaatgcacttatgtttattatcaatgtttgcccttggggaaaaaagtgttgccagagaatacattataacatttgctccatctacattcagggaaattatgttaaaagtgaacatatgttctcttggcatattttattagactttgacatatatatatatagtttatttaatagcattgttttataacaattttcatgcttgtggcacaattttactaatatctccaacacagagcccttttagttaatataatagttgcatactcatagttattgaatacataatgtattgctgacctcatcagtttaaatccaaagcatcagctgtcagcttttaaagaattagaatatatcctagagattatgttaaaaaccgacatactttgataagcttaatcagaaacaaaaccaaaccaaacccttgtttgttaaaatttgttctccatgttgtaaatacaaacctggcaagcaaactaaatacaaaagcaaaaacatattaaaaataaaacgtattgaaatacgcacattaggaaagaggctgtaagcagtggtctaataatcatgccttaaaataatgcagtagccaagagtgtgcagggttacctgagttggtgatcttttatcttgtaggtttggtcgaacgcttctaaaaccttttgctgcaagagaggaatatgtagcatctccgttcagtgtctcctgattgccatcattgtaagatctccaagctttcattaagggaaaacaattggatacaaaaatatctacgttcacttaaacattttttataaaatttatttttatttccaaaatcatttttatttccaaaattgtagtgttcttactagaggtttaatttaatatgcataacagtacatgaaatttaaatttaacatgaagtcagcgatgtggctatgaatatgttttctaaaagtcacaaataatataataattattcagaatattttttctgtacctgagtctggtgactgagaatcacgccctgaaagaaaaaaaaatgttgaaattaagactaaggtgaaataaatgaacaacccagtaaaaataacatggcaaagaactatatgcattgtttttgcaaacattatttcagttttaaaatctgggtatgtcaaacatgccaaagggaggcttgtacatttatttttacttcaattagaatgtcattcattaaatatctataatatataaatatctatatagtaaacactcatttttcccctcaataatgttgcaacatgcaattttaatcttattatggcaaagatgaatatatgaatttctaaatatcaaattaaaggatcaaaagagatctggtttataaacagcactaactcaaactgccagatccttagcttccaatgccctgctgttgataagcatatttaactcctgtgttacagaactgtattctgtagttcgcatttttttttaccttaagaaactgtagacctgtctaccatatcatgtgacattttcaaattattctcgagactgagtttttttcctattgcaatataaaagtcattttatactcaaatatgaaaaaactgttacaacatgttccactgtctttcagctagtaagctgtggaaaataaatttcaggactaataaattgcttttggtaaggcagttggcaagttatcagtgatatatttgttatcaattttattgaagttatatattccaaaatcttctatatgcacatttgaggtaatcagtttgcacgtttaactcatgtgtattttaagtcatcagcttgtgttgcctggtttattaaagcacatggtcaactttacttagattcattaagctttaactttggaggtgatcctaggggttggatcattagcccaacctgctgtccagtcctggattccttctacgtgttccccaggaccattattagattcccatttcaattcataaaacaggaattttacatgctggaaaagtctttgtttttcttttagtgcttcagcacagttattttcaagtttaaacacatgaacttagaatgataaaaatgggctgagaaatgcgagcatctgatttttagataaaatatttgatatgggttctttccaaatcaaaggaaggaacacaaatgtgagtcagcacagagtacattagaatgattccagctcaggtgagctagagaagactaatgaattcccattctttatgatcattgataacttggtatggattttatctccaatgaatttaaaattggagtaataaaatgggtaccatagagaaaaattactttgaagaattatgcatgaaatgtttattggaccctacttctagaatttgtacaattttttgatttttattttattttttaaagatggggtcttgctattttgtccaggctgtccttgaaatagtgggctcaagagatcctacagcctcagtctgttggttagctgggactacaggtatgtgccactgggcctggcccttcttctaggatttgatggaagcagaaatgattgaaattcttaatcagctatatgatgaagataaagaaaaatacagtttgacaaaaaatacagagcaatcatcagaatgctgctttagggcactcaggagagagatttaataaccatgaggctgccatccactgtggacaatgaacaaattttgggatttgggaaaggacaacgaaaagcaaattttggaatttgggaaaaagcaataaaatagcccaatgctactttatgaaaagagaagcagcattaataacaatgattatattctgatttttttcttgaggatagggagtttcttttatgcttggtttggtaaaactgagataaaaaagaaggctgtgtgttagcgctggggacgaggtaatgggacccagaggcttggaggtgcaagggtgcaggtgcggtgagaaagaagaaggtgtactgggcgggtctgaaggacactagaaataaactccctctaaatgatagtctgtagggggcaggctctgtttcttcacgctggtcaccgtgttgaagatgaggagccccaggagacggtaagtgtgagaatcagaggacagtcactccaggctcaactgtgggtttcttcctgggacactgggcccagggatttccaaatgaatctgtccctgtgccactggaaacattagacagtaagaggggtgggctgttctgaagggtcttgcatcgcacagtggacacgagtgtgcagaattaagagaaaggagaaaatggccattgagtcgaacttcaggatgaaccagtattttaataaagcttatgttgatgattaaagtctgccttgaagtggctggtctctcaaggagactaaagtacattcatttctctttctttaaaataaatccaattacagatacttggaacacccagtcctgatttgctcttttattatagtcttctatgtggacactttttagcatagccctgcttttattttatccctgcaggaaagactaggagagggaggacacctgttctttggagcaggtaatagaaagtatcatggatccacatcaagtaaagagaatataggttagaaaaaaaaaaaaaagtcgcccaggtaaatggcttggcagatgtgtggggaaaatggatttccccagatctgcagcattattggtgcacattcacttgtgaaaaaaacacaaagctaggactaggggccagagtccttaatttctagtgttctttagtagacagtcactgcttcactgaaaatccacgaatgactaaatggtgtaagttttcccctttcctggctgttttgcatgtgaatattttaacaaatagggtcttgaagaatgaagagctccacgtgctcttaccagcccttttccttgtgtcgaggcacaaactggtgagtctctgtctgagattttgtgcaagacattcccggttccatgtcaggggtggaactggatgccctccatggccctttccactgttatcattctaacatgacagctttcgtgtagctgtgtttgtgatacgtgtcacatcgtaatctctactctcaggttttatttaaatcccttttaactgatatgctctattgacactatcactatatttttcttgaaaattattattttgatgcctataactcatttctttagaagactcaagtgctttttaagaattattttaaaatgttgattaaattcaggtcaactaattgagtgcctactgtgtttctatgtacaattataacccttttcatttattttcttcatttattctcatttattctgacaaatccttgtgagtctgggaaacgattaagctttcagagaggtaagaaatgacaaacaatttttcattggaaagaaaggaaatgagatctagacagactaattttcttaagggcatgaaacatgcaggtggtatcgacaagaccctgtctcttggcggagtggtccccatactgcggcattcctttaggctgacaaggggttttggtgaaataaaatgttttcaattgtttctcaatagtcattgtcttggttttggcataggtttaaaatatccgtgtgtgctctgatggattgtccagtgggaatttacttcttataaaaggaaaagagaaagacagactgactcaggggacaaataggtggtgactcagattgactgtctgatcagagaagggagtgaaaatggcttgggaccttttctggaggttttacataaaggctgttgtattttaacaatatcgaaggcaataaatatttatcaattcccttttgattcacatatagacactgtatcatataagttcttatgaaagctacatagaatgcagttgtgcatattaatgctaacttctttattcaaaaatataatggaagcttctttgaaaaagggggccaggtgtagtggctcaggcctgtaatcccagcactttcggaggctgaggcgggcggatcacttgaggtcaggagtttgagaccagcctggccaacatggtgaaaccaggtctctactaaaaaaaatacaaaaattagccaggcatggtggcaggcacctgtaatcgcagctactcaggagcctaaggcaggagaatgcttgaacctgggaggcagaggttgcagtgagccaagatcgtgccacagcactgcagcctgggcacagagcaagacccacccgtctcaaaaaaaaaaaaaaagaaaagaaaagaaaaagaaaaagggatcttactttacgtctaattgacacaaaagagggctgtttttaaacaattatgtccaaaattcagtggacttcattctctagaaatcatatgcctagtgatagaaaacttaaaatagcccaaagctacattgttattactgaagattatttcatattcctaaagtgtgaaatgttttttttttcttttttgctgttgtaattccgaagcattaaatcttttctatgaagtcgagttatatgaaattgcatgtagttcagtttcgactctccacatgggcactgtggaagcagtgtggcgttccctggtacgtgcgtcaaggttcacgtctgagtaggttggactgagatcctatttggttgaaatgtcaatgacattcagggtattggcattccaattacacgatggccctgaactcttacggttattgtcttacttgccttcattcctgtttctcatggtatccaaggtaaatacatctgtagtttttctaacacctttttatgttcatacgtgcatgagccactacatacaaatagagatttgtatagagatttttttttaaccaaaatgaggtcatactataaaccttgcaatgcatcttgcattttcttttaacttaatatataactgaactcactagcctggcatttaaacttggacgttgaaatccatttgtggattagaggtggtgaacggaagtgggattctgcatatggaagttcatttttttttctcaagaaaaactcagtagtttagaattaagtggctgtaaagcgaagaacaccctgagtatttaatcaacttctagatgtatgtgtgtagaagactgtgatatgcataatgagaattaaaattatttaaagatgccccatccctttctcacttctgctgtaagacccattaatcttataaataaaaaacaagcagtccccaaactgcagctaaccaaccagccaaccaaccaaccaacccaccaaccaacccatcaccaacaggtgtgggtctatttcagggtctggaggcactgggcttgctggcctccctttgaccttctaacagctgcaccccctcccagtgcagactgtgccttaggtactgtgcctaacttcggtactgtggcttaggtagtcacaacagagatttattaaaaagagaccacctgagtggatgctgaaatctcgcacccccagtgacttcctatctgtgggtacatgtgaatcttaattggtcaagattttggtatgtttaaatatatatagtagaagggtatttgctgattggattaaaggaaagcaaaggtctctttcaaaactaatgttctatcattctgttcacaacctttgacaaagaatccagttaatgaagattcagtttcctacaaatcccttttttcatcctgtacccctgtacccctaccccaaaagtttttaggttaaaaaaaaaaaccccaaaacctctgagttatcttaatgaaatattatgctacttaagttcatgagataacaaaaacgtgaatagttattaacactcgcagttactcaacctatttttggcaagtgactgctgtttttaattacacatttaaaatgtttcctacaagatctcattttcctttgctttttacgtttagaacaaaaacagtcagaagagctagaagccattcaagtgcgacattgtgtgagttagtgatattatacctgcagccaataggtttggagaactttgcactctcttcacagatgttagcgtaacagacatggcggcacgtttgcgagcacacccaccgctatctggaagcaaaaaaatgatatagcagaggccaaggcaacgggaaaagcacgtgcaatatcatgcgttttaagagaaatgtgccagacatccatgagaaagatgaacagttagaattagtaatcatggaatgcacctgccaatttcacaccaccctcaaactaaaacaaacaaaacgaaacaaaacaaaagaagaccagggatctgtcttagaaataggtatcactgttttagtgaaagcatggaagacttaatacttaacattttatggttttctttgtgaaaactcaggcacagaactcaactttgtttataccatttaaattcaatttatactaaatctataagcactggatctggcttttagagtcaaggattagctccatgtcaggattaaaggctatggtacaacatacttttaagttaatatcatttaagttttaccatcttctagctgttataattcccaaagagagcttgaataattcttgcagtaaaaattattagtgacacaggtatgatacatttttttaggattcatagaggaacacatggcatcatggaaagtccactcttcctgtagttagtgttagttatgcaaataactagccttattaaaataaaagtattgatatatatggtatcgaaatgaccatgtttaaagaaaggagtatattgcttttactttttaaatttttatttttagggccggagtcttgctccatcacccaggctggagtgcagtggtaccatcacagctcattgccatctcaacctcctgcgctcaagcaatcctcctgcctcagtctcctgagtagctaggaccacaggcacacaccggctaacgttttaactttttgtagagatgtggtcttgctgtgttccccaggctggtctcaaactccctggctcaagggctctttccgcctcggcctcccattacaagcatgagccaccgcacctggcctcatttattgcttttatacttttaacaatatgtgtactatgattcatatctttaaacttatgcaagtcataatgtgaaataaaatcagtgtaagttcatcagccattttaatgtgctatgagaagtttagacttctaaatttggaagagaagtcttttaaaattggaaggccaatgttctatttatgaccagattcaaattccattcttacattcctctgtaatatggcatggcaataaatagttttgctcattctcctcattctgcttattgagtaaaaccaaattaaattaaatctttttgaaagttataaaaaaagacaatataaccaccgatataataatataatcattatatattgtcacatttccatttttcctttttctttattttcataaggaaagtatcaagtttgtttattggacatgacagaatttagattggtaaagatgctcggaagtataatttgaaggaatttttcataaaatttataaatagtaagattaatagaacttaaaagcagtggagtgattcttacttcacttttttaaagtatatgtttaaagtaacaatttcttaatgtagaaaatcattaaaccagaaaaccaacttgaaagaatattaaaagaaaatgaaccaaataaatcaaaggttataattaagaacccaaagaaagtgacacaaatgggagaaacaactgaagattccttcaggaaaggctccaaaaggattttagcgaactcagcaaactgaaagtgcttagagacaagtgcgtctgataagatggaggtgatgttattgcttccaggagctggaaactggttgaaatggttgtgtagtcaaaggtgttgaaagtaaaaactgacatcactctaagagtgattttatttcctagttctgttaattctgaacatctcacaagcacataggtgaaaagagaaaattccagaatgagaagatccagggtcacaggttaaatctctggtgttcaaactgtgggctgcgatgccctgggctgcactggtgcattcatgagggtgttggggggtagttcctgtttttaaggaaaacacagtgctaactgttggacactcaatgaactacttgcttggggcagtgcctggtttcaacataatagacgcgctatattccttttgatgacatcatattttggaaaaactgggattttgatacttgctatgataaaaagcaagtaccatctgaagaacattttatttatttatgtttagagacagggtcttgctctgttgcccaggctggagtgtagtgatgcatttggaccttactgggctcaaactgatcctcctacctcagcttccctcatagctgggattacaggcacatgccaccacgcccagctaatttttaaaatttttacagggatagggtctcactatgttgcccaggcttgtctccaacacctggggtcaagcgatcctcctggctcagcctcccaaaatgctggaattacaggcgtgagccaccgtgactgtctggcctgtaaatcattttagatcagtaaatgagagtggtcatgtacaatcgaattctaaggtctgagaaatttttcagtgtgcaacaggcacacacataatattagtaagtaattcttgttataaagaaagaaataaaactattttctttcaatttatgtgtactgttctgtcaaatggcttctaagttgttagaacaaagtatttataaagtaattattaagttattaagttgttagcacctaactacttaataaatagaagtgttacatatttttgacctaggagcacagtgaagaaattactgagacattaaaggtcactgtaaaacaagaaagtttgggaatccttgggttagacaatttatgtattttaggaagctctaagtcttagatgaaataaatggaggctctgtctttaataaagtttaataaagggctgaattctaaaacttgaggcatttgtaaaattgctggaacagaatgatctattatattgtgtttctacttccttttgtattgatactttctgatactccttgaagatatttttaagatcttaaaacaaggatgctacctttcatgtgtcagtttatcctaaagaatcctaacgctggtcttgccttttgtcctcattaatgacctgcagccttgctaggctactcttcccctgagctgcaagattcctggaagctgttcctactgctggaaacccctcatatgggtaaattatagatggataattatttgatgtctttccttctctcctttcttcaatagctaagatatgcctaagaaagtaatgtgttaaacattctaaaagtggacatataacatgttttgtatatattttctacattgtttagacactttagtatgaaaaattaaccacattccccatggctagtttattatgcactgattaaaagcaaatacttaacttaaaagaatgctttttagccgtggtgaccaacacatgaagatttaaataggaatatatatttttaatgattgatatattggatagatatatctatcaataaagagatatattcctgtttaaatgaatattgatatatatatcaataaaactggcctgtattatttatctatatagattatctgcattgtctatccatatattatctgcattatctatctgtctattgatagatagataaatagatagatagatagatagatagatagacaaaaaagtcagaagagctagaagctattttggggatgagaaaaataacttgtggggccactttattcatctatctatctatctatcatcatctgtctatctgtagatagataatgcaggccagttttattgactagctctttaggaacaaattcctacttcattttgtaaacacagtaacaatgctttcaaattcctaaggcaatatatgtgtgtatatatatacatatatatttaaaagtggtatgtttttataaaaacattataattattattttggaattttgagcaaaagttttcagtcacttttgatcaattttatgcatatgtttgaataccatattttccaatcattatacattaagtggaagttcatccaaataagcaaaataatcctatacaaattgcatcccatccagagtcaagcttactccttagaaatgagaagatgctttagaaggttacatttatgctgctaagcagtaacttgggtcaagtaccttagtgacttaaacaaatttacaaatttgtatgtgcttattttgctatgagggattgaattatatgaataggaaggttaattattgagtgtactgcccatcaacacagcatattcagtatatcatgtatgcatatccctgtcataatagtgttataataaataggaaaatcagcactcagtaaaatgaggaatactgggagttatgatccacttaagtctacagggaaatgtcttggaaggatcaggaaatatcacttcctcatgtggaacttctgctggagtgactttgtagctccaaaacatggctgatgctagtccagctgtgggctctacattctatttgctttcttctgtctcctttacctgctaatattttctacttcattccccatgtctacttctgacatctccaatcatcaagttgcctttgtgtggtgcatatgcagggttataacttctcttgattgctgagccttccttgtgtgttttgactgtctccagtatcctcatcttgcctgttgtccacatgtctgcaaggtgactgcatccccaggagcccgcccgcacagccttctctgaggccactacggcacatggcacatgacgcaaggctctgcactcgacctggggattaggtattggtcctcgccagtggctgggtaatcctccttgtagcacttgatgcaacaagagacctcaaaaaggcaaccagctggacatgagagaatatcttgggccatcctttctactctgccatggcgcgacggctcaaacaactttccagtgatcacttgtggataggaaatggtatcgtttaaacacaagttacaaaatttcaacgagaaagttgtttcttgaattactttgtattgtatatttcaaggtggggggaaggcaaaattataagccaaattatttctactgtggaaaaaagttcatatgtacaaagcatgtatcatgaacacttttacagttaaaatgtagacaatacagtttagagacacagttgttaagttatttggagatactactctcacatctacacatataatgcttataacactatgggaattgtgactataggttaattaagctgattttgtataaaactttggcactctatctgctgacttcttcaacataaagagtttatagaacaggtaagtttgaatattttcttctagagcaacttgcctttgaatttagcctatttttaagtgagagatttcaaaagtacacaaacaaacgacatactacctcttcctattgtttataggagttagttttaacatgtgattagagaaaaagggagtaggagcaagtaatagaagagaaaattctatgtttggtggctataagagtggggcacaaatacaaagaaagaaagtaatgaatctatgctatgtatctaatcagaaactcagaatcacatttaggatcagaagagtgctaaactaatgatttagggccaacatgatttttagagagcaaggctaaaagagtttaaaactaacagacagcatacctgtgttcattttcaccttggagagtttgttattaaagtcttcagttttcctgtaggaaaaaaatggtgcataattgttcactagcatgtggaagaaaatatcatgaaagtgtgtcgcatttttgtttttgatgtacctgtaagttaatatcacattatcattagtcttatttaaatcagtgtttaataaggtaggaagaatttataattctgttcatgttaaactttaattattggtcccatgctcataaaacagacatattctgtttttatgcttttgtttaatggtgagcattaatggatgaaaatggagacgttttgtgcttgtttttctttttttctttctttttttttttgagacagagtccgccactgtcgcccaggccacagtgtagtggtgcgatcttggctcactgcaatctctgcctcctgggttcaagcgattcccctgcctcagcctcccaagtagctgggattacaggcacatgccaccacacccagctaatttttttctatttttaatagagacggggtttcactatgttggtcaggctactcttgaactcctgacgtcgtgatccacctgattcggcctcccagagtgctgggattacaggcgtgagccaccgtgcccggcctgtttgtttcttttttagagagagggttgtgctctgttacccaggctggagtgcagttggtgtgattgtagttcactgtggccttaatttcccgggctcaagccatcctcccacctcagcctctcaaggtgctgggattacaggtgtgaactaccgtgcctggttgagttttccttttaaaaaattaaatttcttttacaaatatttatacaaatggtttttgttctctaagcctgaaatgattgcctgttaagtgtcctcttccagagttttaaaagtgaccctggcactttaaaatcattgccttacatgtgcaggtcagttgactaccggggaatatgtaatgaatgtaacgcatattttcaggacactgtcaagaaagatgagattcatctttctcttttttaaagacacaggaaatagatggtcactacaaaatccatctctgcattagtattgaatgctgatttttcccagtgaaatgttggatgcaaagcaattgagattaattcgctagaaacggttggcagaaaggggttgtctcagaaaaaagtttttttttttgagatgagtctcgctctgtcgcccaggctggagtgcagtggtgcgatctcggctcactgcaagctctgcctcccgggctcacgccattcttctgcctcagcctcccaagtagctgggactacaggcacccgccaccacgctcggataatttctttttgcatttttagtagagacagggtttcaccatgttagccaggatggctacgatctcctgaccttgtgatccgcccgcctcggcctcccaaagaaaaaggttttaaatattgtgtatcgttttatgacatgtgagatgacttagttctttctctggcatattctcttagcccatttatggagtttcttatttacccataccctgaaaccaaagaggaaagacacgctgataaggtagcaaatctcctaagtccaagagctccctgcaagagctgtctgaccccggccacttggcctttgctcctgagtgggcctgttgttgagtatccacaagaacccccccgcacagcacaacacactcacagcttccaggcgcatcagtactgcaacatccgaacattttcaagaattttatttattccttttggatgaatgaggataaatttgaaatgaaatcattggcatgatcacctgtcaagaaagacttttgataaataaagattttttagtctctaaaaagagcagcaaatgagcttcctggctttcttgcctttgtctgccaaggttctcaccctcttctcccttctgaccatttcctctgctcaactcacaactattattttctttcaatgtggctattggagttcacctcttttggaaagcctggctttgttcattactgatgaaaaattataataataaaatcaaaatgtgaatattagctaaatataatggtacttctctcccagtggggggaaaatgatgaaagaaaataacattaaaaatacacttaagtcctatgaaatataattataaagcaagattttatatatagatatatatgtatagtgtaatcctcgttttgctatatacacatgtatatgtgcacacatacacacacacacgtatatttgcctagattgaattactaataccttaggactcaataaatgctaaattaatgaacatttaaaataggtaaaatcacagtactgataatcacctcagtatatgtttttagagctctacgctgaaaacaatatagacgatatccttactatatggtgtttaatttttgtgtggtctgtgttcagtgtcatatcgttgtccgtctgccctgggcatcattgcagtgtagggagcagggcaggagccatgcttagcgtggccaggctagaactgagtttccacagggttatggggaacttcactggggcatttcataggccaacagactctgaaaaatgattgagggaaattttatgatggtgaattttatctcctatttttcagtgtatgcaactaaacaggcacatttctgttttacttttttgttttgttcttctccagaattacacagaaaaaatgtggcgtatttctaaaaactcagcttggtagccttaagaccgcctgtattgagggataccgatgaagtcagggaagagggcagcggccagcacaggagctttgggaaagctccttcaaacgtatttagtttaatctctcggtagctcttggtagcaaaactcctaatatgttaaccttaaatggacaaaataaatggaaaagaaaagcctcaggggatgtctgtgactgagactgaggcaacttctaaaacaagaagggataaacaacctccagaaaatgaggattatgaggacctttcccaaattcgacttcttcattccttttgaaaccaggcaacgctgtgcttacaactgcttaaggttttaaaacggaatgaggaagacagtattcgggctagaataatagtgattgacaaagaaaacatcaaatacagaaggttaactctcagaatacaaaatctgctgacagacaataataatgtttttgtaccaagttagagaactagttatcaacacctattgtttgaattcaaatgccgatatttacagaatatctaacactcaaaaagtaaaataggattaacgagaacaaagaaaggcgccacaaatccttgaggttttcatctttaaagtgatgtatcctgttacttataaatgtaatttgtgaggctttttaacttcccattgttttagatgtcaaaatgtgaaatgactaacttcctaatcaagcaagacattttccaagtcgttaaaagaagaatcccagtgattgagctctcaagaagaacctgaaaccgaaaggcttcttgggtgactaataaaaatgcacgattctatttcccttatttgtgctaagtccattaacaaatccacgactgagaactctctttagacagttcaaactaaagcgaatctaatctcttttgttctgctctgaaaaagtgtccttgattgtacttacataacaagcacagattattctggaaagcatcaaattcctagagtctttgcatgctgctagacaacagcatctcaagtattctcttaacttggaattgaaccagggacgagactatgagaactgaccataacatggagactaccttgagccttagcagacaatccacggagcaaagaagtctccgaacatgaaggtgtcagcatgattttcaataggtgctaggggattgtgtttacttttgtcaaagtttcatataaaaagcaacttcatatgtgtcctaatttgtgacaacaatggattggttttacttatggattagagtagcctccactgtcaaaatacatatggcaatagattgtgttgattgttcatggaagggctgtaaacagcatgacttcgggtctatagtcttttaattttgcttgaatttcttttttttctttttctttttccttttctttcttttcttttcttttttttgagacggagtctcactctgccgcccaggctagagggcagtggcatgatctcggctcactacaacctccacctcctgggttcaaaggattctcctgcctcagccttctgagtagctggaattacaggcgtgcaccatcacgcctggctaatttttgtatttttagtagagacggggttttaccatgttggtcaggctggtctcaaactcctgaccttgtgatcctcccgcctcagcctcccaaagtgctgggattacagatgtgagccaccacgcctggccaattctgcttgaatttctttggattatcagacatctcatttttctcggaatcagagcaggctgtgttctcaatacgtataagagaatagaatgggtaatttaacttttgaaagaggatcctaaggagtttgatcctgcatgggcatgaacatgcctttgtgcctgttgtctcataattctgcttgaattgttttgattatcaggcatcccattctgaagagcagcagagacaaaatcctttccccagttttggctaagaattctatgtaggtcattttatttttgtagacctgaatttaagcaccaagaccatgtatgaaactacaggactgaattttagctcagttaatgggaggagttgcccaaaagattttccacagacgaaccttaagccaatacattgctactgttattttgaaattaacatattcacagttcatatattattcaaaaaaggacatattgatgtttaagtagtaggaaaacattgcaggatgttagtttttttttttaaagagatgtattttaaacatgaacataaaaatacaatcatattaaggttatgcaccagattttaacttgaatttacttatttattttgaaatgggatcatttgtagcactctctttggataaactgccctaagtgatcaatgtattaatgcatctctctctatctctgactgtggtaaaataagaagtattcataaatgccaagtgatttcacttttctattatagtcaaatgacttaattcaggttgacatttatcttcacctatctttcctatatgtcaacatgctgctttgaaatagtcacatgaaaactccaagtagtttgttttgtgagtttagaaactctcttctgactagtttctctaaattggctcagagactcctctgcctgagtgggtggcacacaagtcaacagtagcggcatgactgtccatgctcataagaacaccaagtacctcccagaactcctgtgctaacagtgcctgaaaatgttccttattattcaggagccgaattacccgcggcatctatttatctatgctgaggccagaacacattcaacatcatttctaggaataaggagacattattaccacaaataataaagaaataaatgaacatgaggccgttgataattttttatgagaatacgcggagtgttagttttaattagaccaaatgtcctgatatttggaaaaatttcctgaaaaaagagcactatatgtcttccaaggaaactagcaattttccttttgagactttacaatgtaagctgttcaaaatacttatcaattttccctaaagactttactgattagaagttgatcacctggtaaatgattccttctgatgttattccaaggtctcaaagttggtgaatcactcatttcactatttgctttaaatggtcatgtgacttaacattggtccagcaccttactttcttttttttctttaggtggaatctcactctgttgcccaggctggagtgcaatgatgcgatcttgcccactgcaacctctgcctcccggggtcaagtgattctcctgcctcagcctcccgagtagctgggattacaggcatgcaccaccatgccgtatttttagtagagacagggtttcaccatgttggccaggctggtctcgaactcctgacctcaagtgatccacccgcctcggcctcccaaagtgctaggattacaggtgtgagtcactgtgcctagccaccctactttcatggagttccttagttttatattgtaatcttagggatcattacggaacaacatctaagtattttcaagtgcatcttttttctaagactaagtcatttgttcaacttgatagtacagtattaggagaattccattggcttataatgtgcaaatcaaaagccaaaaaaatttctaatgaaaataattcagattctgactgaggatctcataagtcaggcaccttatcaaagagacatgtgaggaattaattagaatatccctataacacatgtataggcaaactgaatagcgttggaagaatgggtcaagaaataggcaaagcttgactcaaatcccagttctgcccatttctatgcatccgaacaatttataccaatgtcattatcatcgactcccccgctagacagcaaagcatccccaatctggcaaactggcattattcccattcactaatatttcaaatattttgaagcagatctttacctttgattgagtcttaagaagataatctagactttcctgaaaatacatggggcattattgtattgctttagattgaagcaagccatatggtttattagactgatttctatggattttcccgtctcccaattgtcccacacccagcttagcaacatgttggaattgaaaaggaattctactttccaggcagctttctttcttccttaaaaagatcctttatttagctaagattttcccccccacacattgccatgaacaagagaaaacctaagaaaatagttgaatcaaacccttgccttctagcccagctatagacaatgctactggatctaagggaaagtgacactataaaggttttgacgattagcttttttaaaaaaatcattctctttccctttgacagctgatagccgaaagcgatggctgaatggaaagagatgtctataaaatgtcacataacaaattgtgtgacaaattgcagagtgataacatcctgatggcagcctactcctgcttaattcaataagggaaagtgcctctgatttcccaccttgtactgagaagcacacatttctattttgaggagaaaagccttgatctttttaaagaaccattttttaaaattttatgctttgctaagtttctcactgcttttaattttaaaatcttccgttttaatttttatatattgaaatataaaaatcatctgatatcaaaagaattatgtaatctagtctagttttgcatgtctcatacttagactttaagtagaagcaagcatcaaaggctctggtagggattgagatcaaccaactcatttttagggttagacatttgaggataagataaatggatgccccaagcagatactcaaaagtagttcatctctcctgactcctagcaaataataggcatcctcctttaaggaatcttaaaacgtcatttgaaatcaagatcttggccaggcgcagtggctcacgcctgtaatcccagcactttgggaggccgaggcaggagggtcacttgaggtcaggagttcgagaccagcctggccaacatgacgaaacccctgcctctactaaaattcaaaaattagccgggcatggtggcacatgcctgtagtcccagctacgtgggaggctgaggcaggagaatggcttgaagctgggaggtggaggttgcagtgagtcgaaggttgcagtgagccgagatcgcaccattgcactccagcctgggtgacagagcaagactccatctcaaaaaaatgaaacaaaacaaaacaaaacacaaaacagaaaaacaacataggaaatcaagctctttccctttaaaatattacagtaccctgcttaattaagtactgaatcatatgaggcaggggttagggaaaagaacaaaatatgagaagacggtgtggtagaaggcaaaactgtttgataaataaaataagaactgttaacatagaaccatatgtttcttcctctaagactaataggaaaacagtggttgattatgacaaggattccttttgcccaatcacagcacaagtccaaatggaaagtgttaatcaggtctactaaacccaaagcatattagacctccttggtctaagcctagaccaatagccattgattttttttttctgaaatccttagaattttcagttagtaagtatatctattttaaattattttcatggtaatgttacgtggtgaaagtattacagtgaaataagcctgcttattgttaattcactgttcttaaaaagccacacttttcttctgattgaatacacctgtttcctgagcacctgaaataacatttatatactttagcaatgtcaaggtttgtcagaatttttgacagaatatactgtcagaattattacaaattcatgtttatatgtgtctcagatatgcaatggtgaaatcccacttgctatgtggaatttaaattttggggcaggggaaaatttgctctaatttgatcttatagtcttaaaatttaagtaatacattacttacaaagtttatccagaatgaaatgtaccttttttttttttttttttttgagacagagtctcgctctgttggccagggtggagtgcagtggtgcaatctcggctcaccgcagcctccacctcccaggttcgagcaattctcctgcctcatcctgcagagtagctggggttaccggtgtgtgccatcatgccaggctaattgtagtatttttagtagaaatggggtttcaccatgttggccacactggtctcgaactcttgacctcaggtaatctgcccgccttggtctcccaaagtgctgggattatgggtgtgagcctccatgcctggccagaatgtatcttaaattgtacatcttaaggcagtttgattcattttagaaaatttgaacgagaaaataataagccaatggaggaaaaatatcatctgaagaaattttgaatgcattaaaagttggaaacttttgatatttgtgttgaacagtggatagtttattacattattctttgggatctaataaaagtagacaataaagacagatatcttccattttaatggaaatgtattattcagaaatgtattattaatatttatatactgctgctccattgttattcagacatttgaaaaaattctttacatttctctatgtactaaatgtacaagtgttaagcagaatcataggtgaataaaaggtactcaatttgaggagtaccctgttccgactgtgtctgcaacatttttattttagggaaaaacaaagtggtgtgtttattgattctgcagaaggcatacacacgagaggggaataggtaataagtagaaagatgatcttgacaggctgaattaaatttggctaaactaaatttcatgattaggttgaagagactggcttttcaaaaatttatatggaataagtctaagggctttaatgcaattgttgaaaaatataattaaatcaatgtctaaatgaacagtggtttcatgaatcaaggaagattgggctccagctgcctcacttttaaagtgtccacatgagtctgtgcgtgagtcaggctggcatgaacttgagtctctaggcaggctttggaggctgtgctgggtggggggagggtcacagaacgatatggtagagacactatggtgagtttccaggtgactaccagcagcaacaggaaaagttactgacatgtacttgaggtttatttttttctttcatctcgtggaactcatcccagtggcccttagggttaatgctcttaaatataccaaatttatgctttaaattgacaagaagatgtataaataacagttgcagctagaagcttcaatattccctcaagatgtacctgaatttaagaaacataatatctaaataagactgtttctcagtgctgggtttttaaccatctggttcacaattgtcatcagaaagaatgaaaacaagtccatcctagaaataaggggtttaagacttcagaactgtacaacaaaatgggatgtggtgtctattgcccttttgttcagcaaaatgccaactcagatgacctcacttctagttcttaccccccacatatgttcccagcattcttcatttttcatacctaatatagtccttcatgctctgccactatttaaagctaaaactttcactcaatccaccaaaaataggcaagaaaaacaacatacaaatacaaatttatattccacagttacacagtggagaacagtgaagcttatttgaacaaagtttttgttgtttcataatactctaacttatttgacgtactggctaaaggtagaaatgatcagaacactttttgagattgttagttggcatattttaacatatgtagtgaaatcctactcagtctgatctttattagccatttctcccccttttatctacagaaataaactctcaacactctttcttttatcttggacttttgccactcttggaaaagcagaaaaatttccttttgacttcccaactacacgaactctttcagggcagcctggttttagctccagggtagtctgccatgatgctcagggccatggatcaccttacagatccaacctgggcctcttgttcgcatcgactctaccctgggactcagcctgttctccttcaggtccacaggtagagaatgtctgtgtggacatcttcatggacagagatacccactgacttctgatctgatacctactgacttcatttccatttcttcttttataatggagcgtaaaagcactttgtcatctgtgctgcagcatttggtaaaggaaatccagaacccacgctgggaccacatgcatttacattgattctagttaattatgtttgagtggagtgatcgcttttctatagtacatagaaaatgttaacatgaactattattattgggatgttggctgtctgccattcctaacacagagcagagggtaagaaaatgtcactcatattgggagagggcaaacaataatggatgggccaaaaagttagcaaatttctttcttttttttttttttagacggagtcttgctctgttgccaggctggagtgcaagtggcgtgatctcagctcactgcaacctctgtctcccaggttcaagtgattcccctgcctcagcctcctgagtagctgggactacaggcacgtgccagcacgcccagctaattttttgtattttagtagagacggggtttcaccatgttggccaggatggtctagatctcctgacctcctgatccacccacctcggcctcccaaagtgctaggattacaggtgtgagccactgtgctgggccgcaaatttcttttttgtgggagaagccactttagaagtatatatctacataccttgtctaagtcaatgtgttgctataaaggaatacctgaggctgggtaatctatacagaaaagagggttatttggctctcggttctgcagcctgcacgggacgcatggcactgacatttgcttgggttttagagaggcctcatgatgcttccactcctggtggaggggagaaggttaaagggagccggcgtgcagagatcccatggcgagagcagaagcaagagagagcaggaaggtgccaggctcttttcaacaatcagctctcaagggagctcccccaggaatgaatagagcaagaactcactcactctccctctgccagggaggacactaatctattcatgaagtatctggtcccaagactcaaacacctcccattaagccccatctccaattggggatcgaatttcaacatgagatttggaggaatcaaatatccagaccatagcacacatcaatagcgaggaagtggcagagtcagagttcaacaacctatgttttaggggacttccaggtatgtgctcttaatgttacatgactttttttttttttattgtactaaagtgggagtcggtgttaagccttgtgtgggaaggtatgcttgggcaaatcacttcacttcgatgagcctgagttttaaagtttataacatgaaagacttgatttaaaatataaaagcacataagggacttttatggtttgaaattttgctaaatctaggaaaggtatattcaaccaacaaacatttgttgacctttaatgtgcaaaccactatgctactgtcatgattgtacatatcaagcagaaactaactggaagccaatatttaatgactcattcacatattaaaattcagaaaaaggagatggttaaagacccgtgcttctgatagcatcatgatgagatggggtacatattaacacatgtccaagccaccatcctgacaaccaagctgtctccctctttgttgtctgctttacttaactccagatataagatctagagaattgtttatatattacatgtctttctatattatctccagtgccctacccttgagcttctcaattttagaatttgatcgttcctaaaatagaatccattttataaatctgcaccagaagaaacagacagaacttcagtccatcaattttcattaatttttaaagcttttttcatgagtagtgtggtaggtacattggaggtaacaagaatcattgattctttttttattctgttagaatttacagtagaggagaacttcaaaacaggtatctcaatcatggaggcagcttggcattccaaatattacgtttttgcatagctcctattttaaagagtaaaagtctattggcttttgaaggaaaaaaaactaaaagatctaagcagactgtactcctagccaatattctcatcacatttttcttactggctgaatcagtcatgccataacttgctaaatgacaatagcatgggaagtacaatgacaatttgagttatttttcatgtggatggttgttgttctgtgctttgattactgttgagaaatgtcggcatcaggctcacaaacaattgccaaggtcctatgacccacaaaaacttcaatcagcctgttcccatgttcagatgttttggaatttggatgtttactttacataaattatgatttaatattatggctatttgtaaggctactatgtgataattgtatcattaacttcaaatgattaagaaaagcaatctgaattagggagaagtgagttataaagtgcttgtgaaaaaaggcaacgtattttccttcaaaaatacagattaactctaggtcaaggcaataacacctaaaataaatcctccagggtcctagtttaatgaatacataagaatgatttgtacttctaacatcaattcatatggaatgaatgcttctaaaaaggtttattttgtgtagtataagtatgctagcactttgcttaagaatctagcttttaatattatcaaaagtaaagacagcctagactctcactgaattacctcaatttctaaattggtatgtctaagttacgattcagacataattcatatttatttcccatttcatgttggagtcaggatattcgcttctccccaaacctcaccccatttttccagtattcctcacctcagagaatgctatcattcattcattattttttacaattttatttatttatttttttgaaacagagtctcactctgtcgcccaggctggagtgcagtggcgtgatctcggctcactgcaacctctgcctcccaggttcaagctcttctcctgcctcagcctcctgagcagctgggatcgcaggcatgcaccatcacacctggctaatttttgcacttttagtagagatggggtttcaccatgttggctaggctagtctcgagttcctgacctcaggtgatccacccccctcggcctcccaaagtgctgggattacaggcgtgagccaccgcacctggcccattcattcattattcaattcattaatcaaaaagtttgagagcccattctactccacaaattaccctggatgttccctctccctcaactctccatgttttgagaaataagacaagaaacattcagctctgggaagggcagcatgcttctatctcagtcccacagttcatttgcccaagagacttgggcatgaaagataagcatttctagtccttttgattttgcacaggtcagatataggttaggcacaggttaacacagagtgggcagatgggagtctctgaccagctcatgcggtgcaggagttatactgttgcttcactttcccataacagcaatggatccgaaatggatgatgatgttccagtgtcacacaggtaggggcagcatggcagataaacgtgagagaaaaagcagtgtgtgcatgcacatgtgcacatacacaaacacatgtgcccatgcacaggcacacgtacacatgctgttgtgttccccacccagttgtctcaaaggccacgagtttgtggattttatcttcctagttcagtacaggactacccagaagttggtcgatattaaagcctcaaaggaatcataatatcacttttgtccagattttattttccaatcctctctttgttttatcaaaaacattttaggagtacattttttcagatggattatgtaaacactggacctgttcgttaaaaaaatttcttagagatcaagaccatcctggccaacatggtgaaaccccgtctctactaaaaatacaaaaattagctgggtgtggtggtgcgcacctgtagtcccagctacttgggaggctgaggcaggagaatcgcttgaaccgagaaagtggaagttgcagtgagccaaggtcgcgccactgtactccagcctggcgacagagcaagactccatctcaaaaaatatatataaaatcaaaaataaaaaaaaattccttaaagtttaatattgatatgttctatatgcaaacatgaatgggggttttccgttttttcactgctatacactcagcctctaacaatatctggtacatattatttacccagtgaatatttatagaaagaagatgtcctcatttacagacatgatggaatgactcccatcgtgaagtggtttgtcagggagagttagacaaaggggcttgaggattcccctcatttgccattacagtccaccccttggctcttctagtctattgagggcctttcttctgagttgctattggacatcttgaatgtaatggtgtccctagacaccagtttacattgtcttccagcatatgtcacttgaggaatctctagatgatttagaggtgtcaggctaacaaatccacactcattcctgaaaatccctggaaaatggcaaagataattgagctgatattttggcaattggcaggatgattttgtttgagtctgaagtgtattttaagaagttatttaggtttcctgaataccaacagtatcatgaaaatattatgcttgccacgttgatttaatcaatcaattctaaatcaccaaattatatcatacattttaaacaaaagcatttttactattgaaccctaaacatgaatgtgacttgtgatttttgtttttccaagagaagactaatacaaatattcattttagaaaaattctcagtacatgggctgtttgtatatatcttaccacttcatatcccaaccaaaatcagatccacaaacagcaagcaaacaaacccttgactcttttctcttttagttagttgtaatataacataagtgatattgattgtagcaatggagaatgattattgttactttgggggttgtgtctcaagtatacacaaatggataaaccacaatccttggtgcatgacaaggtcatgtacatccccctccctcctttccttccttctgtcactaaacatctacacaccaaccatctaaagccaaagatagaccttcgtaaggacctgtgtctatccagatgacttctgctgttataacatccctcagctccatgcatttgagtagccatcattctgaattccatgcttatcattctcttcctttcctgttcatataatttcattgtatttatatgtcttctaaaagcacatttattttagttgttttaatctttataatgatataatgctgcatataattacattgctaagattcatctatattgttggttatccctgtagtgtgttcacttggtctcctatataatatttaattttgtcaaaataccacattttgtacatccacttcctgttcaggggcatttgggttgcttctagatttttgctatattggagagttctgtcataaacacgtatgtacatgtttcttaatgcttttcttgtgaattaactgcttggcagataatttaaatgatatagctcctacttaaaaagtattttctatgtgccaaaaactgatctaagaatatttacagatattacatgtatattaattacatatgtgttacatatatattacatattacacatatattaattgacctgaggcctcacaacaaccaaacaagctaaatactattgttatcttattttactgcaaagaaacgccaaaccacagggaaggtacaaggtcacacagctattaagtagtgagtgaagcttgggaatgcaggcagtttggcttcagagtttttgtactataatgtctttcttggatctaaggacataaaggattgcaacagtttataacacataacttagttattgaccagaatttgagtgtgagtctgtcataatcaggattaatcaggtacagtacaccctgtaatgagcaatattggaaatgctcatgtatactataattactctaagacaaatgtcataaacatctttgttttttttttttatcatgggtacaaggcacataaatttatttcaataggacagctgctgcttttgatgcttgttctcacaattccgtggtggtagttgtatttgtttgttctcatgttcctaataaagacatacccaagactgggtaatttataaaggaaagagatttaattgactcacagttccacatggctggggaggcctcacaatcatggcagaaggcaaagggcatcttacatgacagcaggcaagagagcttgtgcaggggaattcccatttataaaaccatcagatctcatgagacttattcactaccacaagaacagcacgagaaagacgcaccccatgagtcacttacctcccaccggatccctcccatgacacgtgggattatgggagctacaattcaagatgagatttgggtggggacacagccaaaccttatcagtatttctctgtgtttctcacaaacatccctgagcactttattgttatcacccaccataggatggtcaggcccatctttcttccccttgaaggagcccaggcttctcctaggcttcagtgttaagggcacagtgggttctgggtgaccctcataaaatcagatcatgaatttaaggcagagccgacttgggctctcactctccaggggagatgttcttagatgaacaaaaattctccttagtcagaaaagcagcatcctcatcaatgtatggaattgtggcaaacatattaagcatgtcattccttaagttaatatctgtcactacataataactcacgataaataaatgtggtcaagaaactatattgtcacaggtacatgtaatagataaagacagggagcacaaccagcgtttgtttaactttgcaaggatcaaaccatcatcagaaccaccctttgtgtcttcattaattttttgttcatgctgattctgaatgtttagtctcaagaggaattatgagccatcagattggatgagtcaccttttagttataatcacaggagcattcaaaaatgaaatcactttattcagctggatgaaccttataaaaagtaaatgacttcatatacatttggcataaggctaatgagctatttttagtttttcctggaattatcttagcccttctttccgccctccgtgatgcctgcctccattttaccccttcccagtgctttcttggtcatgctaatcaaaaaggaaagggggaagaaacatgtggttttgataaccttcaaatcattaaggcaagggggaaaaggcccacaaaaggtggctctgaaacgtggagcgcctttccaagatccaaataaagtgttttctagagagtttcatgttatttttatcatgacttttataatctactactatcttttaaaatctgcattagaatattatttctggatctccaatctttatatctatttctacgtgggtatgactgtatgtgtccctcaaaaaatttcaattcagttcttgtgaaccagagaactcttcaaccttttctctttttttgagacggagtctcgctctgttgcccaggctggagtgcagtggcgggatctctgctcactgcaacctccgcctctcgggttcaagcgattctccctgcctcaacctcccaggtagctgggattacaggcatgcaccaccacacccagctaacttttgtattttttagtagagatggggttttgccatattggccaggctggtcttgaactcccgccttggcctcccaaagtgctgggattataggcatgagccgctgtgctggccaaatcttttttttttttttttttttagtaaaaggaaactaaagttacaataaagaaataaagaaacttacattttgttgacactaaatggcaggtttcatacaaagactaatcttttttattagggtaggaataattattggtgactttctctgccaattttccaagtgttggtaatacatgttgttactttttaaatgtgtttttgttacttttaaaatgaaatgaaaaagacatataaattatagcatacatgtctacccctacatttaaaacaatatattcctatgataaggcagaaaaattaacctacccttccctaacacaaacttccctttaatgcctgtggccatctgtagatcctgtcctctgttagcaaactccactcatttgctttttgaagttgagttcaagatcctcccatctcctcacctgccccgtcacccacatctctgcattactgtaggctcactgcatgtgcccttcatctgacattgaatctaggctgtcttgcaacatttctgatattactgccatttaatttaactttttatatgcattgccttttttttttttaagactagtcaagtgcagtagtgagaaggaagaaagagtggaacaaggagttcagctgtaattgactaaggtgactcactctgtggaccagcctgcattgcctttctggctacattggtaagtatgttaaggagagggacaaagtcacttgaagtttttggcctcggtttcctcatctgtaaaatgaagggaaccaggcctccgaatgttgttaatccaacacctataactctttttcccaaggttgaagatccccagtaatatttcagcttgctttcactcgatgttaatccaacacctataactcttttccccaagactgaagatccccagtaatatttcagctttgctttcactcagtgttccctgactcagagatctcaaaccctaagggagaggcagagtgtccttcagtcttgacgcctgggagctgtggatgcctcattgttgctcgtcttgcgacataaaataacagcatgctagtggccaaaaggcatgaagtgttcaaacttattcaaagttcaaagtgttcaaaccttttatgtacatgattctttaaaacgagggaaaagggaattgctctgttctcaatcgactgtgtctgagttcttaggatttatattagatccacactcccccccaaattttgaagatggaatgaatgtgttttctcctatatttaccactcaagttttttctttcctacatgctgactgtttgtgttatggtcattagattctagtactgaaggggttttggtttttgcctttgttctctgtgtgagctatgcagtggcttttgtgctgaaggagggagctcccgtctcatcagtttcagaacttgagtgatggattcgtcgtggctgctgatggtaacggtgggcactggccagcctgttgctcatgcagcgtgggaggtgagcgggcacagtgcccgtggagaggtggtgctgcctgatgagcttagggaaacccggtaaacaccgatgtgctctcccagatgcaaactgagtcacatccctgtcaggaaactgcaaataaatcgtgtgcaaaacggaacaaggatcctattaattaatttgggataactttattttattttttattttttttagagacagggtctctctccattgcccaggctggagtgccgtggtgtgattatggctcactgcagccttgactgcctggattcaagggaccctcccacctcagcctcttgagtagctgggagtacagatatacaccatcacactcagcaaatcttttcattttttttttgtagagctggggtcttgccttgttgcctgggctggtcttgaactcctggcctcccatctcagcctctcccatctcatcctcccatctcagcctctcaaagtgctgggatgacaggcatgagccactatgcctggccctgacatgagactcttaaccaggccattttacaaccaatttcatgcattctacaattaaacaagatagtaattgtgtaacagatctagacaactttttcatacagatatttattttcccaagttcaactagggctagagcggtttgtagaaatgtataggtctaaccaatgcttcagttcacatggtctcttgctgtacagcaacagccaggtgagttctaagtgtcaaagtgcccacaaaaactgcagtgtaagtgaagctaatctttggtgtctaacatatttttactgtgtattcacttcccttcatctttttgcattattttctgtctcaaagcaatctgttctacatccttccccatccaaattcccaacatatgttggggtttaggcaataatatttgaggcaatcgtagaggaatgtccaaatgtgtttgaatgaggggctgtttaacctcatgtagagctatttgaagattcagaaatgtacttctgaagcccgggtctgtctttaaaaggccagacttggtatatcagcacctattcagcacacgcacaagctgcccaacaccacactcagctgaccgtgctccccgccacctatcctctccactgatggagtttcatttttctatcaagagcatcaccattttgcttgtccagccccaaaacactgacatcatatttgactcataactcctcctactatcctcatgttggagcagatcctactgatatgaacagaagccagagaaattctaggcagaaaagggtgattccccagcaaaaccccaccctcaagctgaaaagcctgaaaccatggcccaaagtgagaacttgtatccctctttacccgctaaaatgttgcctttcctaaactacctataaccatgccccaccccatcctgtgcccataaaaaccccagacttagctggtaggtgggactacagatgaatgtcagagagaagcagcttgactttggagggacagcttgacggcgtaacttcggagaagaatccagccagagacagctggattcaaggggaagactacctacctgcccatcccctgttcagctccccttcccactgagagccactttatcggcaataaaatcccccacatttatcatccttcaatttgtttgtgcaacctcatttttcctggatgccaggcaagagctcagaagccaccagtgcaaatataaaaggctgtcacactggcctttgccctcgctggcgggggtagctgcctcatgcgaaaaggcagagggcccactaagctgttaacacttaagccgcccgtggacagcagagctagaacagcactgcaacacgccctctggggctttgggagtcacaggcacccccacctggatgctcgaacggggactgcatggagttcgctcctgccagtgccaaagcggccagcgggttccagcgctcatgcacgccagcttccactctgcttgctggtgcactccctcctgtgaggagttgagaggggcaggctgagtaaatgaggcacccccctcgcaagtgccgtgaaggggtcaggggaatatcctgcatcgctactgtctctttaaaatctctccagaacctgcacacctctcatcaccaccttctgtttaccacctaacaccttagtctagctttccagtaaccttatggtttttctcccttcctccattgacatcacctgcgttccactgttcccaaagtatccagagtgatgctcaaacatctgagagacatcaggcattctcctattcaaagccctccagtcacctcccatctcccctcctttgctggccggcagcatcctctgtgtcctgggccctcactgcacctctagctcatggctaccactcttcctctttgtcctccagcctctaatgaggctggctacctcgttaagccttggacactccaagcccacactgtcctctccctggagccccaggtctctccttgagttcttcagatttatgctccagcacctctgtatcagagacctttcctaactgccccatataaaatgcagtcctccatgtttcctttgtcttttaaaagtttttctgcagaacacttcttatcacctctcatcttacgtgtttgctttttatctctttcccaccacaaggattagctcagaagagcagagactttcatcaggagaacgtgattcagaggcaggaaatttaatcatggggtggaacctataaggacgttcagtccacgtactggcatcgtgtggctctacacagggtagttaggggaagggatgagtattacaagttgctgaaaacaatatatacttttttcctttagcaaatgcaaagaggtagtcagcttcaccacttaggcaaatgcagaaatattgctgctgtggaaaagggtgcaagagaaagtcagagtgaaacaaatcggtgctttataatttagtgagtagaatctgtaatcattactataatttaatcattactatcatttagtttcccactgtcatgatattgcagcctggtacacattaatattgccatatgttcatactgcacaccattatttgcctttgtcgttttgtgtgaaactagacaaacatcacaatctgactttggactctgaccattagcattgatttcaaacagtgctgaggcaattctgtgaaatatggaatcaccaccactacacaggatcttaaacttcaattctagaaatgggatggaacagctacccacctatccttaagtataatgaaaaaattactttcctggtgataacataaccttcattatttaagtggatatatggttgattttctatcttacatttaatttccttgggttttgttaaaattatgaatgatgaggcattgctttatcaaaataatacatttgcattttaacagattttcttccattctttctaaaggagtatctcaaataatgggaggagtcagcaggctagagtgtaggatattttgcagcagtgtcttgctttcagcttcacgtcatcccattgctccctcagccagcctctgaccctacacttggtctataccaggtttatatactgagtttcatggatacacttaggtggcattaagtagaataatggcagatgtaatgtttatataacttcacttaaatttagtttaggcttttttttttcacctcatcaacacagaaaacctataacctaaaatttgtgcagaaatgtgtttcacaacagcaattaggtatacaggtgtattaatctgttctcgcactgctaataaagacatacctgagactgggtaatttataaaggaaagaggtttaatggactcacagctccacatggctggggaggcctcaccgtcatggcagaaggcaaaggaggagcaaagtcatgtcttccatggtggcagacaagagagcatgtgcaggggaactctcctttataaaaccgtcagatctcgtagatgtattcactaccacgagaacagcttgagggaaaccacccccatgatccaattatctccacctggccccacccttgacacatggggattattacaattcaaggtgagatttgggtggggccacagagccaaaccatatcaacaggcatgctacctaaacctctcaaatcatttaaaagtttcacttatcttcagaacacatgagtctataaagaaataagcaactgtgttttgggttataagttaaaggcttgtaaatcattaaaaagaagaccactttaccatggcatttttcacgacagattttttaaaaatatcaacattttctcattaatctccatgaatttgtttgcaaagaataaatttacttaatcattagctttattctgcttttggatagcatgactaaataagttgcctaaactgaaagagtgatgttaagactaaaagtagaagttatcagtatttatgctgatgtaacaggcataaaatgggattatgccaggcaataaggcgaaaaagagatgatgtaacaaaattccttctattttgatattaatttagtctccagcaatttatagcttttctctccaagaaacaccactcctgtaccccaaggagatagtaaagttgagaaaagccctatgaaaaggccaaaggaacagacacgaaataaaaaataaaataaatatttagtttaaaaaataaaaagaaataatttaacctagaataattaagactaaagaaacatgagactgaaaatttaaaatcagaaaaaaactggtaaagttaactctatttttccctaagccctaacttaccaggattaaaagacactccattatatttcaaaattgtttttgatagaaatagattaaaaagtactttatgtagcgagtagaacatttctggaactcaacaacttgaaatacaacagaccaaaaatgtagacagaatctaaatcctttagaaatatgcaggagtgacagctccatccatgttttcctccctcgactacaagtggcttaaagacagaggtcataaaaaaagagtgaaaactactaaatgctcaatagataaataataaatcttaagtgcttaataaatgttgctggaatgtgtaacagaatattctgaaaggaaggctattcttaacagtcatgcccactgtgccatgtcctacaatgtgactgctggagagagattagaagtaacatctttttctatggcaagccacacagtcagagacctaagagaaagtagtcctcttcctcttctaataaatagaaatagacagttcctatatcatcagaggatttcatagaaaaagtatttcataacgaaggcttatgatcctgattatgggctacttttaagaactgtggcatcacctgctgctcaactcccagacagagatgggcgtggtctcccgtaacacctgctgctggggcaggctggcgaggtagtcaagagtgtagatgctggagccaagccagctttgtgaaaagcccattctaccatatccagatggatcacttcagaaagtgacttatcctctctctgaacctgcccacatttcctcctctagaaacagggataacaacggtgccaacctcctggggtggctgaaggacccagtggatgcgtatacacgaagcacttagaagtgagtctggcaggtactgccaaaaatgtgactcctgctgctattaaacaggggatgttgccttggcaccgacaggtgtgactagcggttgaaatatttcagatacggggccccttcttgccttggtccctcattcaaatgaattcacgaatcaggttttctcttgtataaatgagttttttttaagggcgtctactaaatcttggtttgaaggatgaattcttctgggctcacatttgcttctttactccacagatggtggagtaaaatctgtgttcattgcaccttccgctggtgctttaggctccaggagcagcagctccctggattgagtgggagccagttctgcctgactggtctcaccagcacaccagactgcgcaggcgggtcagaggcccacggggaggaaacatcagtggagggaggatgctgtgagcggtccacccctgcatgacagatgtccctttacagaaaagaagtgggaaacagactttggcaaagggaaacggcagagtagcaagatgattttgattactagtgacatttaattgcaattagatttttaaccacaaccaagaagatgataaagcttttccatgtattttccataaaactgtccgagcttaggacactttagtgctcattcttcctgcaacactacccaccacaggttcactgtattggaagtatactgagaagagctcgtggctggcgtgggagcgccgctgtcttcaaacctggaagtgaagtgcacccacacccagccacagcagtgattccccgggagcgaccttcagggagttgctaggagatggccgctctgtgtttcctttgattatagggcataaccctgccactgtcaaaatgccagaagaaaagggcagtgattgctggacataatttttttctgttacttcctgtgagatattgttttgcacaaagggaggagactaagggagccatggatatctctgtagcagaaacatggcaactattatctgaggaaggccgacatcctccaatagcgatcctgtgtgcaacgcgtattatttgcttcttcaaattgagtcgtatctttcagtaatttcttaagacgctagacggtattacacataggcatggggggtggcttgtggtttaaaagcagggcttacacatataggtagaagccgcatgtggtcaaaggagataaagtaccacaaactgaggagtgtagttagctgggcgccctggattgaggtaaagtagaaaaagactgtgatacttctgagcccaagacatttcactctgccacactatctcctgtatatgcagttattagatagacaattctttttccgtgacagccaatatcaggtagggcttaaaagtcacaatctgggtttacaacacaactcttctgcttattagccgcatgacctggggtgagttactttctctctctgtgccttggtttctacaactataaaaccgaaatacgttacagtaagcacttgataggatcaccgtgagaatggaatgaaatcatatatgtatggccgggcgcagtggctcacgcctgcaaccccgacactttgggaggtggaccacttgaggtcaggagttccagaacagcctggccaacatggtgcaaccccatctctactacaaatacaaaaattagctgggtgtggtggcgggcgcctataatcccagctactcgggaggctgaggcaggagaatcgcttgagcctgggagacaggcgctgtaggaagccaagatcgcgccattgcacttcagcctgggtgtcagagtgtctgtctcaaagaaaaaaaaaaagaaaatatgtaatatacttagaaaaatagctggcgcagaacaaatgattacagaaatatgagctatcattttcattattattattagcatcataaacattatttcgttgtgctctgaatgcagctgaacagtactcaagagtttcaggatcagttgtataaaattacaaaaaattagaaggtcacccatcttgagaaaagacaagtttgtataaacaggacaaactactgaaagcaggagagttcaaggaagccaagagaagctgagaaagttttcttaaatctgctgtcttgttggttgctgatcaccacctcattctccatgataggtgcacagttggcgtacaggttacctagggctggatactgattgagcatatcctgtgcacaaggacacctatgtttattccacttagaagtctgaggttgttctgaatgtcaagcaacaaaacaatgcacttctttgggagagctggggcattccagattctggtcattaactgggtgagtgtctttaggcatcattccacctttgtggacttctgctccctcgtttgcaaagtgagagagtcagacactcaggttatgttcccttaatctccacctttaaaaaaaataatgttctgatctaccttcataagagcagttgtgtgccttaattttctttgcaggtttgctctatgcagacctgtcatgtggaaactcagagttataaattagaaacaggtaaatgatttatttttgccctgcaaatgagtcacactctctacaagtggattattaaattccattaaataacaagcttgcccaataattctaaaatagaatctggttttaaaaaaaaatcggtgtacctgttctctgttgtataaagaaaggtatgtgatagcatcgttaaagtatatgttttagaaactactctggcaaataattttcttagagagaggttaccgagaaaagagaaaagaaaaatttagtttttctggcttggagaagcagcaagtaaaagtcacagctctggaaccaaagcaagaaagctccttgaagaatgaggtaatcagacttgccggtaggtactctcaaaccagcgtgaactgtacactgcaattaattattaaatgtgctcaggctaggtcaggctatactaacagaattcagacacgtttttctctccagcatttggttatcagttttgtgacatatagagtaacagttataaggatcagtttctgcaactccatccctcaacctacttttttattgtaaatagactgaatgtggggaaaaggcaaagagaaaaagtgctatgcttcaagaacatttgtcttgatattttggtggcaagcatcatcaaactaactatatttggctctgactagcttagcatgagatgttagtttttagccgcaaatgagtagcacttgacaaggtgagaaatcttccttcaattgttgaaatcatccaagacgtgtttctaatctacattttgaaaacaaaagccctagcataatgcaataggaattcttcttgcctgtataactggattctgctctagggtcttgtgggatggttattacacatggcagagaaagctacgtgtcctcttgcacccagtccctcttcttaatttataacggaagtttcagctgaacacatggctttagccaggctaagattacatttttcagtttcccttgttttatcaccaaattttgaccagtgggtgtgagaggaaatgctgtgtgcatcttccaagaggctgtggccttaaaggcaagaggtgccctctttgcttttccctttcctgctggctggaacgcagaactgatgtcaggagctggggcagccctcttgaccaccaagggaagccatgtttagcgctgagaaagacagagcaataaatggaaggagcccaggttcccagaattgtgaagcctccgtactagccttgcaccaccaatctgtacttttacatgagtgagcaatacacatcttttatgtttaacctctgttaatttgaatctctgtaacggcagctgaggttttatcgcaataaatgtattcccacagtcagaatccagacaatttcaatagttccattttatatttatgtataatcataagaagaaagtccccaattttacattaaactctgtattccttctaactgtcttgggttgagtgacacggcggctattgaacgtatttctgtggcactgtaacccagtagatcacacccatgcaattgctttctcttccttaggcccaggtcacttcacctgcacctctttaaagactgtatttcctttctgtgtccctccctccctctctccctttcttccttccttccatgtatctaagagattggcctgggcctccggtacccaggtgctctgccttgtgactccatcttatgtgaaaactgtgccaggtgctagaaaacagtttgcaaattatattttggtttggagaccttgaggatgcatttactgaattttttgactggtatttacatgatcatctcaaagaatgaattgcagttttttcacagtggaggtactgataattcaccccttgaaatgaggccgtgtgggatgagcaaccttgaaccaggaccttaaaagcttagattccagccacggctccgacacaaagtgacagccgcgtgaccgtaggcccatcgctctgtctccctgggcctcaatcttctcacccttgcattgggaatgatactaaagttcctcatccacctgcctcatgggattgctcagaggatagtgtgagacaatctaccacaaagtacaactgtgagccacttcctaactcctgctttcccacctattcttttttttttttttttttttttgagacagaatctcactctgtcgccctggctgtgatctggctcactgcaacctctgcctctcgggttcaagtgattctcctgcctcagcctcctgagtagttgggattataggtgcctgccaccacgcccagataatttttgtatttttagtagaaacggggttttgccatgttggccaggctggtctcaaactcctgaccttgggtgatccgcctgccttggcctcccaaagtgctaggattacaggcgtgagccagcatacccggtccccacctactctttaactatgacagatgtgaacgtttgatctctttgcagacaagatcagcacggtgactgggtctttgccctaccttcctaagcaaatgacagaactggtagcagaactggagcccctgaagcttctgcaggcaaacttcctggagcagcccaagaaagtcagagcccctccttttcgtcacattcagttggaattttggaaaccaagcataatggagaaataacttttttggtatagccggaagatgaacccttgggcacagtttcaaagtcaaatattttactgtaaagtggaagaagaaaatacccagatctttctgcatagtcaagtggcttatgttttgcacgcattggaaagaagggaaaacaaaagctgtcttagaagacgaaatcaatcacatgaggagtggcactgctccagagagctgaggtcttcctcttaggaattacagactttggttccgtataattaggccctgtgttgctcaacttccaaataatttagagagaattatcatgtgagagtgcacatatatacatttttttccaaaacaaccttctcaatatgtagcaaaatgtagtcaaggaagaaaaaaaatgagaagttctttagatttcagccaaaacaatcacttaagctccaagtcactatataaacaccattaatacctgttaaaaggtcgtgaattctgtaagagatgtttggaacaaacagtgcttcagaactacccacaaaaataaacaaaaaagagatcatattatgtcactgggtccagacaggatgatgaaacggctatgatcacgtataagctttatctatctttccagagaacagtgtcagggacatatgggttactttccaaattttgtttaaaaaatatgaaaaacatctgtgaaattctggtaagacaaaaagagtttctaattctttggatcgcaaaatgattcttcagttctaattagctatgataaattatgttaattctaaattattatcattcatgtgggcatttaatttaaaaagtggcattatttggaaaacagtctctgcaatttattctaatgtagtttaacacgaagcagctacattgcctttttggatattttcagaagtgtgaaaactgtgaatatcacttcaggctttgcagaatggtactctacaatgaatctgtgtctggcatctgattggtgataaaaaaaattattgggaatagattattagttattctgagacagaattttgagaaacttgttgaaagagtcttgtttgaagagcccataaggaacctcctccttcacacccatactctggctaagaatgttgactcttttttcttaattaaaggctgaatcactgataatattgttgatattaagtgcctactaaccagcagcatgagcttttaacacttttaatgtcacccaaaagcctacccaaagtgcccaggaaaataaacagttttctaagattcagtataattttattttgttttgtagctaaaatgcgccagagctgtattcatgtcatcacagtgggaagaaggcaaacatctgagaaattaataaatcccacagccgatctgagctgtcacccaaccccaaagggcctcagtatctgcatctgtatatggggataactcagttctccagagtttgtaacaggcctagcacagtgcctgcacatgtaagagctcagaaagttatttgtaaattagtaaattaatttataaaattgtaataaatcaataaccattaaaaaaaaataaaataaaataaatcccacagccactaaaagcatatcgtatttggggcacaactctggccatagaggcaagcacctgacataacacagatggcttcttgctggtagcatggtggcaacttcgctgaaaacacagagacaaggactgtttcactctgtctcccttaagaactttgaaaacagttttatgtctttggagaaggagcaccaatttagcttgcatcatggatcatatagaacagggtatgttttaatgtgctaaaacctaagcaatgtatttaacagagcaatctatttccatgaggttcgtgagaaaataattcagaggctctaagggaagttgggagaagaaaggacagcccgtaccagtgcactcaaatagccagaaagagcagagatgctgattgctccaagcagtagtctgagtcttattctattcatttccttagagtaatttccagtatttgttaaggcatacagaatttgggggcttgaggtagggagtgtgtcttatccatgcttggaaatgtaacagcttttgaagttttgtaatgtttcttttttaaagcaggcatctttctagttccactatctctgtggagttgaggaaagaaagtaattcatagacacagggcagcacgctgacctttcttcagtgaacgtcaaggtcctgggctcataagggaataaggaagaggaacctcagtatattaatccatgggctccagccacgtggcagctacatattttcaatcactttgcttacttcaaacttttcttggtgtgccatgtacattaagaacagataactaagaagcaacccttctcagtgtttttggcatctactgatcagcacctgacattccaagttatttcctcctctactcggcatgccgatttctgtactgttgaacagcaggaagtgctttcaagggtctaataaattagcctttcgttgtttcaacttccaagtgaagttaacaataaaagaagcttagtatgaaaaagatccagggtttcttaacctacctcttgtttcttattttctttcagtattggcttttttttgatgatgtttgggtgtttggggagtggaaacaccataaatttgatcttaagctgtgctgggacaacttttgcatgtttttattgaatacttgggatattccactgcccagagagttaaaaaaaaaaaaagacaaaaggatgagcagctagttaatagtcttcatagccaccagttatcctttaatctagtattttctagagtgctgtgatatttgcagaattaacccacaaaacagtatcctatgggccaaccggtgatgagactgagtttgcctttgagaactccggtgggtgttctaacctaactttcctacctctcttcactgtcatttatattgttgcctgaggactcttcctaatacctagccaaagtatggggggcctctgctgtctgagaggtcaacttctaacaatttagtgtgacctcaaggccaccccatgacctgactccattctcctttttcactctcgtcttcggccacctctctcaatttgccagactatctgctctccctggaatccaccatggacgctcatgctgtttcccgaatctggatgtagaatttccctgacctttttatttacaaaattctacccatctttcaagattttccttttcctgagttgattattctttgtttctgtgttctcaaaacactttccttgagcaatgctaaatactagtttccttcacgtctgtttctctcaccgcagcatctgtgagattaaggatagtgtctttttcaccatttatctctcactgctcctagttcagcaccttgcatatctttcatgctcagtgtacttaaaaacaaaagaatcatacataagacggtgttgccagtttatcatttaatgaagaggcttttttcttttatcaattatggtaaatctttgactagttcaaaaagggatttaggcagatctatttttgagcatttctcctgttaatatttatattgaacttcagccttttggggtcaacagctagaaaccatcacagcctgctataatccattagttacaaaaggatggaaattatcctgcaaaaagcgccaggctgcagaggttcttgtttggaattattacactgctgttggatattctaactacccacttgtgttcaaaggagaagcggcatttgagaaagcttctaaatgtgggttctgccacctaccatgtagaactctatgccagtgggtcaaacatacttgccgtctaatttagcatcccaatatagattctagcagagcttctttgacatagctaatctctctgagtttcaatttcctcacctataaacttgggagtaacgactttgtgtggcaagaaccccaagtaattaatcaaaattctaactttgtgcttggacatagggattgatcataaatgtgggctattattgtcttgatctttgtttttgctgttgttcatatagtacttattaatatggcttctaatttcaggtttgtcatttctgtcgttttaattttattttatcaaataaattatcataataatcttttcattggctctcctgtccctagttctccccctaatattgatctctctccttttaattccaagctgcaattgcaaggctaatattttgaaaggaacactgacttcacattatctattaataaattctaaaccaagcccaacacaacatgatcctaacctaattttcaagaatttattttccttctcagtttttttttgttttttagtcaaactgaactttttgttgctcctttttttgtacatttcatgttttagccttcatttgagtttaattagcacattttaaccagatgcctacattgtgtcagatattttctgggtagtaggagtgtcaggataatccaaaagaatccctgccttccaggagcccatgactggtgtggcgaggcaggtgtgattttgattcatcttttgtgagatgttttattcgttgagattacctctaattactcttaaaattacacacagttttagaagtccatctcaaaatagtcccctatgaaaaccacataaatccctctcactcatttaaactaatatagttccttttctgtgccacttcatcttgtcttactttatgttatttatgttggtgttttcttgagggcagggatcatgctttattcacatctgtgtctttcatcgtaccttatgtataacaggcttgcaataaatatgggttaaatatcaaaggaatgtaatagtacaatttgactttaaatagaataataaccaaagttttcagggaccatttttcaaaagacccattcccccaagatacttaacctacaatgcttactttgtataagctctgttacttaagctaacaaacaatagttctggaaacctcatatacagaaacataaggatatttagatgtataatatattatatatataatatattttgttacaccactagacttggcttgaatgaaccagaatattgcttgcttatttccttgatgttcttttcttacacggtttgttctacaaatgtataaatattaatatattagaaagttatagaaacagatgaaggaaaaatagacacaaatatagtatggaagcctggacataaaccagggatttcagaaatagaagctatggagatgcatccgggaggagggtctgttttagcacatttgggcatgcatctttaaataggagacacatttctggaaggaacatagggtcctgtgggtaaagtattgggttgccttgttttatatttacttgaggctattacagagaatcaactacagtgtaaagggagagcaaaaccaagcgagtttggatttagggacattaagtacgctttgaacagatcagaagccctggacagacgccaccacaaaagcagcagcatctggaagtacacgtgctcatctctttgtattgcttggtgtgatttccatggctactaaacgagtcattcacttcaacctacattgatgtgatcaaaatagtttcatcagagcaaattctcatcccctctgaagagtggacagattcttaaggattgtccacgtttgtattaacgaccctattgcttatgccgtcacaattacagctaaccagataggtgcagtcaatggattttgtcaatgatttaccttcaaagtaacaatactcacatacaagtagaagttaaaaggatttcaataaatttggtaattgactttttaactatacgtttgtgtcaggcatttatacttagcaaatcttatttatttcaatgtatttgattgttctgaaatcagtgacaggttaataactttgttatcagattactaaattaagcttttatcagatcatgtttacattaaaaaagaaaagcctgaagacattattaacttcatttcaacaagcttctgtaaataaataggctttcattaggaaaccagccctatttatcaaggttattaaaccattttgtaacaaaaagcatgatttacaaaaatgtcccatgattaggcttattttattttgatacgaccaggtttgctacacattttaacataaatcaagataaacagcttgttcagaaaaaataaagcttcagaaaaatgcaccttaatcactgttttgagttactgattaatgtttgtccctgaatctgctccagacagattttatgttttctttgatgactttcactggaatatggttggcttttatgattaaacccatccttatggtataatccttgactaggagttagacattgaaaaacacttaaaactatacatggtcaatttcttataattgatttttttcagtaaactcatggagaataacttttgtggtgattattagaatgttcaaaaacatatttctattgtgaaaacccagtgcttgctttctgagtctgcgggtctatccagcctgcccaagaactcgattcagctaaggttctcccttccattatggagcctggaaggttttatgcaaaaccagtgactgtgctccccgagaaagtccactgagtagcgtgctggacagaacctgaccaggactccatgctttcaagctctggttctaccgtctgttacttaggcaaatgttttcacctgactgtagggttgattaaggcttttggcttgccccaaaaacccctgtatttctggatgggaatcagttggaagtattttgctagggtcctgtctttgccattccatctagctctagtaatcttgatggctcttatctcttatgctctggatgaaaactggtaatacttctttctccatttgttttgtgtaagcatggtggtcggtaagatgatttctggtgaagcagcaaaaccacaggctcttgtttctaaatctggttaactgaatgccttctgtgttcacctgtcatcacaaaaggatgcgcaggagcactcattattttaatcggagtcgttcctaattctaaagttaatcatggcgattctcagatcagggagaaaattaattaagatgcaatgctattttcttctctcccagggtgacatctcccaggtttctcattaaatcgcccatttagtgtttggtttcagtgctttggagccaggcagaccagatgcaaaccccagctgcatgtgccatttgctccctgaggggcagagatgatggccttgctgccagtggcatctccagccctggaactgtgctgggtgcacacgaggagccaaatgcatgttttctgaggggagtaagtggaagaatgaatgaagtcagcccttccatctcttcttccttagctgtcaaataggatgacaaaatacctatttgccagtggttgttgtgaggattaaatcatagatgtaatgcatttagcacagtgaatgggcacatgagaagaattctataaatggcggttgttcatcttcctacaggaagggcagatctctgagtcatagaaattgcttcttatttcccactttcctttatttccttatgtggtgaagtataagttccactggtattcaacaagtaaaactcttgttcagggtaatgtgctactaacttttaagtctgcatattttaaaatgagagaaaatctagttttttcattaactttctactcatctctttctgggcccgctcagcaaatccccggtttcagaggactgccctgtaaggaactatagacagggtttccatccgtatttccattttctgaataagtaacaaggggaactagactctcagggcctcctctgcctgcttcgtccttatggagctgatgtggggagaacactcctcactgtccagtctagtgatgaccacagttctgtagccacgtggatctgtgtactcgaggtcagttagttccagaaaatcatccagtctaacatttgctcagattccctaatttctactctgtgaaagacaaggaatagtacagctcttcagtttcctgggggagtgcttcattacttttcctctttttctttctacttagtctaatgactcagattccagatggttctgcctaagtttagaattatcatgatctactttgtagagagaaaagaaaacatttcttgtacagtacaacttatgtaattttttttcagggaagtgagaaaaatataacacgcagtgtagaagaacttttggctctaacattagatatcaatgtttcgtattctgtcattggggtgtattgtaatttacttatttactgtctaattccttctgtagctagtgaagtttacattttcttttttctttttttttgagatggagtcttgctctatcgcccagactggagtgcagtagagccatctcggctcactgcaagctccgcctcccgggttcacgccattctcctgcctcagcctcccgagtagctgggactacaggtgcctgccacggcacctggctaattttttgtatttttagtagagacggggtttcactgtgttagccaggatggtctcgatctgtgaagtttacattttcaaagaatgttttaatgatatggaaaaatattctccaaacaatgatgtgcaagtacaaggtacaaaccaggaaagtgtaattctaattttttttttttaaaggtcaatatactttcttttttttttttttttttggaaaagaaatattcctaataattcatttaatcatctggagagtgggttgaagttttgtaaaatttaatttcttcattatagactgtattattttaataaaagcttttctttggtgtcacccattgtgtgcagcactgagctggggccctggagctctcactattgtccatctggccgcaccactgtcagcactgctttcaatgaactgtaacagaatactgatgactcagcatttctgctgctgacaggaagtccttgagcgagtctctttgtagttcctccaagaaaggatgctcaggcactccttgggtgaacagctgcaggccatggagaggacaaccgggttgcagtagtaagtttgcactgggctatcccagagctagaacaagggaacaggtcagcccctagagtcccagaggtcacagacttgggcaggtccaggcgttaaatgcagctgtgcctttggagctggacatccaggtacctggctgcctgctgggaacaggtgagtatgtatcagccattgtgaagcctcaaaaggctgcagcctgacgtagctgcagatcaggctgtacccaaattgcattgttactgatgaaataattttttaaaaaaccaatggtatctatttgagcattttcctcatggacaccattcaacagaatgctgttctcggggaacaaatgactcatgcaaatgactattttctaggtttttctcatggtcaagcagccatgatctttttatagctttattttattttaactcagtcccaatggttaatttaaatcctttctttctttcatcaatgatacaaagagctcactttactacagtctcatcttgacagagtcaaatgcagaggctgtaaggctgcccacctgaggaggaggaactggaacttaggaaaacagctcagatgcttcatgcaaatgaggaagctcaattggcttctattgaaaatacctcacgcatcattttctcttgtctctacttgccaaaatatttataaaatatctttgccctgccatacctaactaagcctcttggaatttattttttcagtgagattctctgatgcaataaccaagcactggcttttagaaagtgttctctccccctccctccctccctgcctgtctctctccctccctccctgcctgtctctctccctccctccctgcctatctctctccccctccctctctccctgcctctctccctccctccctgcctatctctctccttccctctctccctccctccctgcctatctctctctctccctccctgcctatctctctccctccctgcctatctctctccctccctatctctctccctccctccctgcctctctccctccctccctgcctgtctctctccctccctccctgcctgtctctctccctccctccctatctctctccctccctccccgcctgtctctctctcttcctccctgcctatctctttccctccctccctgcctgtctctctctttctctctctctctctctctctctctctctctctctatatatatatatatatatatatatatatatatatatatatatgtctgtttctctgtctcactctagatatacaatcaaatcagtgtgcagatggaggacaaagagtatcacaaaattattattgtaacttgtggataataaatttcaaaatctgatgtctgtgctccaatatctgacctccttttttgcaaaatatgcacatgtgaaacctgatttactactgaggaagttaaccctttccttttgaaagtaatgcatcagtagaagatggaaagttcagtggagatgggtgatcttctcaattatgtgcatgagaataagtaaactcccaggcattccgtcactctccaaagtcagaacaatcaagaggacacatcaggctttagaaaaactcattcccttggaagataatctcaatagcatgtgtgaataggaagagcatcaaagtgtgaccgagagagtgtcagagaagagtcacctattacaagcatgatcatagtacttaggaaaaagtaagttccaggcttatgtggatattcatatagatattttccagggttttagaggttcatgatttctcagggagaccaaagtgcctatgtgactgtgaggggttattagtcctctgggttctggctttactcagaaatagcctggaccacatgggtcagtcctgccccacagacattaggccccctcctggggcccctgcagagtgggtcagttctgcagatgtgggaagggatgagtgttgggtttgggaaccaaaggctgtgtgttgagcttacagtagacaatttggagctgcttcttgcttagagatgacccaatatccaaaagtagctattgcgggcaagtggtgttccccaaaaaggtatgttgaagtccttcctcacccccagtacctgtgagagcgatcttatttggaaacaggatctttacagatgtaatccagttaattgaggtcatactggagaaaagtgagccctaaatccaatgactggtattcttacatggagagagagatttggagacagatccatagaaagaacattgcgagacaatgcaggcagagatgggtgatgctgccataagccaaggactgccagcaaccaccagaagtgggaagaagtgaggaaggattcgctgctggagccttcacaggcaacccggccctgctgacaccttgatctcagacttctacacccccacgtagagtgtgagacaatagatttctgttgtttcaagccacccaattggttgcactttgttgcagcgctctagaaactgatacagtggctcaaacagagcctctaggtgtctcttcttttgcaatccaaagactgcaccagtgctacttgaaggggtaagagagctaaataaatttgcttttggggagatagatttgggtaagtttctccatgctgagttagatgagtgatatgtggtggtggtaaaatccagataacccttgagtgtgatgatttcagaaagagagagccaggaggcctgggagccagcaggccagcgggggtccgcccactggccccgaaacagcgaacagtgacattggagcaagggcccatcccgtgcttctctggagccccactgggcagagccaggtggagaagcaggaaactgcacattggtgggctggaggggcttggaggggctgagacaaggtgtgtgcttggggataagggcgttcctggtccccggtgaagcatcagtgaccaagaggcatcctctagaagaggtagacactacatgggaagggagaagcagcatgaaggaaggcgctttaggacaaggggatcagttacagtttcttcgccatgtgccttagacctacagcttgctattccactctgaaataaggcagagtgaagaattcaaaaacaatcactctgggagaaaaaagcgagttctcttgatatccttgctttctcctggcctcatttcctctgatgttcccctgccctcttgcaaatcaatcagcctaaatcaagggtgtctgtgcaggttctcaagacagacatgctgctgggagtggcacgtacgtgaacgtcaaggagatgtcagggcatgcgcatattctttggtgcccaccgtcttattttcttaacttactgggaaatctttttgttagagtgcacgcattaagtttcttcctggcctcatcagccccaaacccaggcagtggcgggcggtttcccgtgaggacagcgtaccttctgaagaaatgcacccagatcagaatggtatacgagtctgtcctattctcgctctagaaaagaaatgtcacaataaataggtgggtggggtctgccccacactccccaaaacaaccaaaacagcggcgagatcaaactgaggacaacgttatcatcatatattcttttctttacacagtttgatacctacctacttctcagaacaaacaccgcggaaaggaaactgggtggatacttactgtttttagtttgttacatactacaattagtcaccattagctaattatatagaaaaggggaaattggggctgttttacccagagttggttttaggtgggggtgaagcaggcagggtgatattggcagcctcatggttggttttgctgattcagttcctctttccttgccccctatttcatacaaaattcctctgacaaagcttcctgtgtggccactggtcagcattttaatagaatggaagggtgcagcacagcaaaggccatagtgttaatatccctcgcatctgccgttcccacctcctccttgcttttccagtcctttccaactctgcataggatgatggggagaggagggagctaggaagggtgagaggcaagcaaagtcatttccagcattttaaagtcagctctcccaaaatgctctctctctccatagccttctccctactggggcttcaaagccttccctctacctgaaaccactcagggtgcaaggaagcctcttcaggtccccctcatccttgatcattacaccagctcttgaggatcctttctttctctaaatttggcaacaatcttctgttgcagactcttttcactattggaattccctttcagggactgctctctacaacttatatggctgcagcagcagcttatctgaccatttaaggctctacactgtgcagacagaaaaggatcacactcctctctcagacacattataagaaattttatacaaggcctgtgcattttcaaaacacaggattgacctaatgagcaggaatttgagaccaggtaggaaaagagggtcatgggatgtggggagctgcctgggggctggtgggaacttgccaggggtcctcatatcccttcatgagacagttgcctaatcagcctatttcaagggatggccctgatttcacggtgaaaagcaaggcatgtttctgcagatacgtcagtgctctaacagcaacatgtcctctgctaggaggacatcctaggagattcgcttccattgaatcagagtaaactatttttttttttttttgcttcttggcagaatattatttgcagatatctgcaaatttggtaggaaagcttttttttctaaatggaactatcctgaaaacaaagggaaaaaagggcaaacacacacacactcacacacacaaacaaacacacacactcacatgcgagccttcccccaaatccttccaagtcttcattctatttaagctgttcataaataatatctgatgataatctcattgaaaatgcatctgtttttatgttaatttttgttaatttgacatccctagacgatatcatgaaaatatttactgtgtgtacgtttgtgtgtgtgtatgtgtgtgtgtgggtgcaattttgtccccttagtccatgatgaattaaaataagtagtttacctatagataactaaaattctatacatgtcttcatgaagtttaccttatttaaccgttgcaattaacacatatcccagaaaaatctttaaattttatttttaatattatcctaatgttgctgagttcccagcaacacaattatttattgcagccaacatctaccatgcttactattacagcaagctcttttccaagttcttatatcaataacacacaaggcagggcctgtgatatttcccatttgtggatggagaagcagagccgtggacaggtgccaagtcacccaggtctcaggggtggggtggggtctccccacagacagcctggctcagacacactctccactgccgcagcgcgagggacccttgtcatcatcccacagagtttgccttgtcattgcttctgaagtgcttagagactgtcaatgaaggagcaatctcaataaactttgtggttttgtcatcctcagaaatgaccaatcttcatgaaggtggtgttgtgcaagcctgggcttctattaaaataaaaaagtgtgctttgcacctaaggcaatggtgggattaaagcaagtagcaaattgatgttctcatttaaaagtcttgcctggtctgtgagtgccctgggcctgcaaaggtaaaagaagcctgaccacaaagcaactgggcattctggaggttactgggcagacctgagactccagagaaagtaggaagagaaggcagattgtcagttaatgatggcggtgttcgtttctgtttgtatacttttaacagtctaaaaatggggcttcggacacaatacctttcctaaatgaaaccagtgcctgcttcgttacaggcacaaggtatgtactgtgggtgacatccagcccccttcagttttccagagtctttcctggggtcttgcttggctcagggccactggaacacaacccacccgatgacaccagggtgtgtcgagcctgtggtcaaggttcacacgtctgtgtgtgccacaaccactgcagaggggaaagacatcatccacacaacatcccaccctcagcagggacttggaaaatcaggaacccgatagtccatagttggggagactgaaaggttccccaaacaagcaaggctgctccattttacctaacaataccatacctactggcacggtttctccctgtgccccattgctaacatttctccttcgagttggcatgccaaggaaagcacagtgaaaaatgtctgagttccgggttgctcttagcaacatccatgaatctgagtttctaacctccttccctatagaacagtgcctgaaggaagaactggcaatgctcactggtgtcagaattgcccacgatttttcccttttcagcaattatttaagtgctccaaaagcattgcttccttactgttttcaaggcaagatagaaggagaggttaatcttgcttagaatttcctctgctttcaagttccaggttgggggtataaagaggtttgatagaaaagaaccgcagcagcccaggcctggctgcaggagaaagcaaagtggctggggacagggggtgtggagagcaggtggtctcccgtctcctccatcagggtcaggaatgtgtctgctcctttactggaaccatcgccctccctggatggctgtaccgtttagggaggcctgtgctgacaatacaggtgcaattcaaaagaaattccattaaaataaagtgggcagtggggagaaacggggaattctgtcatgaaacataaaacctaaaatactgtctggtcaaaacctagacagcctgtgagacccatgagagctcggagaccctgctttcggagcataggtggggacccgaggggtggggccgtgagcagggtctcaggccagccgtggagaaggcggctgcctctgcggggatgggcaccgcagcgtggtgggcagatatgaggaaggcaaggactttcccattgaccatgcaaaaccttcacgaagtcagggtctgtccaccgtctaaagatcgagacctcatgttgagttctgaggtaaaatgggaaaacagttttaacagtgcagtgaagcttcctgccaataagcaaacctttccaccctccgctcagctacagaaacacatttgggagctccagggaggaggcggaggggcacaggcgctccccagtgtgggccacgctcaggtgtcccttcacaatggcagccacactgcttcgtgaaacggacacactacgggatggaaaacagtgagagggaagccacggcatcaagaagcaataatcacagaatgtttttgtgctgtccacgccttcctcaacatctgcctccacttccaagtcaatcgagacagcctgtttatgtggagctttgagatgacacatacactttactgaccctagaacaataccctttccacatctaaagcaattttcgtgtaaatgactgtgccattaaccttccagggtcattcaaatattttctgagaaattggctgctttcgggattttcttagaatgccatgtgtttcatttttgtgcagaacagatgacaggcgaggcattccaacaggacttcagttgatttaactaattcctgtcaggggaagtgaagtgttgggattcataaagccgatcccagcccggagattttccttttcccaaaacagaaaaaacaagacatgctgtgtggttttgcaaccgggcaagtttcgaaatatttttaagctttctactttgccaagtatttcataaaaaaactattttctttttgtttcgtgccaaaaaatgtcacccctaaatattttttcccatatctggtcacatgtccaggattttttcttttctaagaataaataatttttctgggttataaaaattccacttgctctatcagattaaacatatctttatatagaaaaagcatccgaaacattccccaagtgggtctaagggaggagtcttaatacaattttgttaaattaattttgattaaatattaggccttgaattctttttgtgactctcacaaagttcaggcttattttgttacactttcaagtctccctttttttcactctccacatactgtttccttttattagaaagcattcaagaagaattgattggtgtgtttgaccaaaataatatgttggaagtgataccagtgcaaggggaccctctgggttccattctctatttgcatagttagctggagttagaaggttcagctgtcagggattcaagaactctagcatcaaaaaagtgtgaacttgcaaatgagctgtcaaggttcatagcaagtgaataatgcagctgagagctgacttgtctccaccctggtgttctattgatcttgctgctggataaagcataggcacataggaacactgaaaaatagcaatttgtatgggttggactggtattttcttttttaccagttaaaatgttaattacattcacaaagtcaaaaagctgaataaatagtcttacagttggaaatatagggcaaaacaaaacacaggcttgaaaaagcaataatagctatacacctaaaatgtgaaaaatattcatagagaaatgaattgtagggcattaactcttgcaaaaccaccaaaggcctggtggaattaatatgctacagatttgaaacttaacattgggcaacttaaaatgcatgtatttgttattgatatttaactaatccttgtaagtaaatctactataagcgaaaagcattctaaattgatgttattgctagtttgcagggaaattctgaaagtctatgtgtttgttggtgcatgaggggatgtgcgtattgaggtgtgtgttcaggatgagggcttctggtcctttagaaatggttccctctaagcttcttggtttccaaatcttcatcactctttttaaaatctaaaaatgcaggtttactttatatggagagcacattgctatgaggagatgtgacatttcagaaagagcacatggcactgattctgaaatgctaccaagttgcttcagaatatacccaaattctctcaaagattaatgatacactaagaaactgaaggacacagcaaattattttgcttgtcttcaacccactgtcaccctgccacaaattgaacctaataaaatttccatccctctcccatcttatgatatgacccttccccctcatgcatggggaaattgttatttacattgtgaaaatatcaagcatctccaaacacttacgttttgtggagccgggtctcccatggtaaaatgagagcccaacacggtgagtttgcttcctaggaatggcaaatcagcatcgcgatgccctcaaaccagaaataatacccttcatttgctgcaactggttgagtatcagtgctataaaaaatagatgatggaaaaccggagcccttgacagaaatacaagtctgctgtgtgtggcttgtgcaggaatggagcagagagaagcggtggtcttgtctacacatcatacttgggcttcgcccatgctgacaagtggaagcacatgcacagtggacacacgctgtcaggacattcatccctgctggcacgtaaacggcagggagctaaactgctagaattcaagtggcacagaaacttgagcctatggaatatcactgtggagtgggcaggccaagttctttacagtgctctttgcttttgcaaagaggtaatttccaactcaagaatgctctgtggctttggcgtcaagaaagctgaaagtcagtgaaatagagccttgaaggtcatccaatctgcgctgcagcaggaagtgaattttgggagccccaaatgcaaaataggcagctcagcccaacattaactcagcccaacactaactcagcccaacattaactcagcccaatattaactcagcccaacactaactcagcccaacactaactcagcccaacattaactcagcccaacattaactcagcccaacactaactcagcccagcaccagctcagcccaacgctaactcagcccagcaccaactcagcccagcaccaactcagcccagcactaactcaacccagcactaactcagcccagcaccaactcagatcagcaccaactcgaaccagcactaactcggaccagcactaactcggaccagcactaactcaaaccagcaccaactcaaaccagcacaaactcagcccagcaccaactcagatcagcacgaactcaaaccagcactaactcggaccagcaccaactcaaaccagcaccaactcaaaccagcaccaactcagcctagcatgcactgattctctggcatagactcagactccaaaaatatgtcgagaaagtctaaccaaaatttgcaaaattaggacctgtggtcagtaccttgactaaatatgactctgtctatgaacacaagtaggcataatgtaacataagacagtaaagaggggcatcgttagaaacctttagcattatgtcagaaagggcaagaggactcaagtagaagaaaggcagagagaataacagagggacatgcatgaaaagtacttttttcttcttcagtcctgcaattgcattaggaacagaggtcaggcccaagagctgccctctcctcacttttctttctttcttttcttttttttttgtttttttttttttttttgagggggagtctcgctctgtcgcccaggctgaagtgcagtggcatgatctcggctcactgcaacctccacctcccaggttcaagagattctcctgcctcagtcaccggagctaatttttgtatttttagtacagatggagtttcaccatgttgaccaggctggtctcaaactcttgacctcaaatgcccgccttggcctcccaaagtgctgggattacaggcgtgagccaccgcacccggcctgtcctcactttttatcacatactcctgctcttgtggccctgcttgaacacagcaacagggtctacataaaataaattaaaatacatttaaaaaaaaattacctgctttacttctggtccatagcattggacatacccagccagaaatcatacactgggctggtttttgggagccaactcaaatgcttgtcctttgaggtaagtattagggtgctcgtggcctcccgccccacgggtccttcactcactgaccctgacctgtgctcactttgtctcaccacctacatttcccaacagttcatgtttgatacagctgctggtcctgccaaggctggaggccctccccatccgctgatttgcctttctctgaaatcggcatcttggctcctctgcattatttctgattggacttgtctctctggcttgttttctctgctaattctgatgaagacgataatctctagctctcaggggccagccctggctacacagtttgggggtagtgttcaaacaacccttgagaatcttatttttcaaggctgttggctggcactttagggctaaagcaagtggtgaattaaaacacaaaacaaaacaaagcaaaaaccacaggcctaaataaacatatgcacccaggagcatgactgtgcagacagactgcctggctttgaatctcattgccaccattgattggccacttaaccttgcatatcacaagatgggaataataaggcacctgcttcatagattgttcttttagtcttctatccgtttgttcattccttcagtaaatatccatcgagcacctactactgcccagacatacggatccagaaatgtccagcacagattaagaggccacagcctcgtggattttccattccagggcatttttcttcaaggatccaataagatatccccctaaactatacatcatagagcctttgacacagtaaacactcacatgccattagctgttatcacggtaacaataaaaataaacttttagcaaaggttttaactaaatgaggtgagaatcataaataaagatatatttgctatagtgaaaaggagagaaaatgtaggaaagtcaggcaagaggaatatttgccaaaatcattcatgaatctgacacattagattctgggcgtgtcctaagccttgacctgtgctacttgatgtgggatttgcacacctgggacacacgagcttctgaagttcagactgtctgcactctatctgacacactccacagctgcacaacttgcagcatgagtcagcaccatcctaacctctaaagagccccgcgggcacagcgaatgcacctcccagccctttggacgtggtggcgaccagctggtttcctggagaggcatctcctttacacccatctgtgaaagaaatctagatctaagccttagatctcaaggttagaaagggggtaaggttgaggttccggagtgctactctattagacacattgtcctttttaaattatatttttacaataatttccatttattattttttcgtggcatcctagtgaggcaggctagtttgacaacatgctgcttaggggaaatttgctgttaataagtcttttgagctcactaaattttggtgcagcatgaaaacccagactgttttcaactctctctctggcatacccgcttgattcctgatagggctattaattttgcgcagatttcccaatttgctccccatttgctacctgggatggtgaagaacagacaaatagcccttcggaagcaaaagcagtcccaaaccaggctgagtttcgtgatggcttcttccacattgtccttcattgctgaggatgaaaacatagagctaaaaactgtgatacacaatgatttatcacctcctttccatgtacacacctagtagtttagaactctgttagcttcaaaatctattcagtcacattgcattcccctccccaactcccacaaattctacatgaaagagggttcaggtagcaaatgagtggaaggacagggcaaactaagactctgatggtgagcccctcctcctcctgattcagatgatttcttcctcctcttcctcctcctcctcctcttctggttctttcttctccttcttcttcttattcctcttcctcctccttcttcctcttcttctatcttctttcctcctcctcctccttctattttctttcctcctcctcctcctctttctcctcctccttcttcttctccttctccttcttctattttctttcctcctcctcctctttctcctcctccttcttctccttctccttcttcttcctcccctcctcctcctcctgtccccctcacctttcccctttccctcctctcccatttccactttcttccccttcttcctccttctcccccttcctttcctcctcctcttccacttccccctttctcttctccccctcctcctccttttcctcttcttcctcctccttcccttctctctttttttgttatttgatctccaattttcacttcctaaaatttcatatggttggatgctattataattattcaattacacaatgattacatgtgggctggtggttttgaaacaatgtaccccattgtatgcattattgcattcatgtggaacttgaactgtaggaggtccatgcaggcttttccagggtccccaagagtactttgtgggttttggatccaggtttctgtttcactaaatcagcatattactctagtctacagtgtactgttgggctagaaatagtccattgactattttagactctgcatcacgaaacgagatctatggttttggttgaatttcatagaagaatattgataaattatcattgttcagatcattaatcttctttagctcaaatcaaacaatgaagtgatgttatcttgcaaaccatgcaggcaggtggtggcactaatgagcctgccacatcggattaatctttgaatgttcagaatctcagaatgagaactttccacaaattcaaaactgtttgatgaactgacaatgtccaagtccaccaaatggtccaacattcagagatgaaattatgtcatgacataagaagcctaatggaatgaatggccactatgcattaaagaccagaatgtgaaaacctggctcctaccattcagacttccctgaaattgtgaaacatgattttccccttcaccctagggaagaccctctggcaaaggcacattcactaagggtgagccttcttttggattgggggctcagaagagagagtcatattgaagtcgcccaaactgttctttgccctggctgcccgctgactttgttaggcagctggtgctaaggagagggtaaagaaaacagaagacacttgtgggccggctcagggatggacagtacctggccgctctccctgtgtgatgcaggtggcttgttctgaggtaggtgggcatacaggcagtgagtacatctccattgcagcgggggaaggtggatgtgggactaatcagggatggagagggagggatgctgcaaagatgcccgagcaggtgctgtcagtggggactagggaagcagtgtctctatccgagagtgcatgccggtggtaggggagcaccaacctgaacatggccagtaagaacacaaactagacctcccagattctcccgcaagtaaggagagatcagggactgttccaatttttggcgttcatattttttagacagttgtcttaaaaaaaatgcctgcttcacttgcgttaagaattaactaatcatggtccagacttatgctcaggtagacaaggaggactgaagccacagtgggctccttccaacctcacatcacatcttcctcatagcacctgtgcacccgaggtgcagatcctgatttgatggcgacctattacaaatttccttagactgcaagcaatcacactatacttaatagctatatttagtagaatacttagattaatacttggagagaatttaaatttaaatattatttccacagccaaaagacaaaacagcaatagacaaatgcattctctttttagttttcttcaacggatatatttcatttttaagcctatctaccccctcccccgatttgaagacatccctcgggctacgtggggaggaaagcctgtgtgactgatcgctgcagtgactgctcttggccatgactgttactgccattttggcctctctgaaaagtgaggcagcctaagcctcacagatatgtttcctggtcacatttttgttgtctctacagaaagagaagcaaacgatatcaccaaagtcctaactctatcctcccactctgtgaactacagaaaaggaagcagcagaagaaataatagagggaataacaaagtgacagaagcatagagggaaaagcagcaggtggcttttcatcaaggggcctttgggtaagatttacaggagacaatgttttctctgcgcctctgggacttgaaaggtcatggaaagaggactcactcgcgacagaattcaaacactcgtagttgtgtctcaaagtcctccgcggacatcaccagaaggcatggtttcaggggtgtttttcagaagggcgatggatttctttggatccacgtagtctctcttatctggttagagtttcttctttttctttttgttcttttttgacacagagtctcactctgtcgcccaggctgcagggcagtggcaccatcttggctcgctgcaacctccgcgtcctgggttcaagcaattctcctgcctcagcctcccgagtagctgggactagaggtgtgcaccaccatgcctggctaatttttgtatttttagtagagacagagtttcaccatgttggccaggctggttctcgaacttctgacctcaagtggtcctcctgcctcggcttcccagagtgctgggattacaggtgtgggccaccgcgcccggccttatctggttagagtttcttaggtgggaatggagttagcagtcccagaccaggccaagttaggacaagctgagaaatgcatcctgtggttgacacatggtgaggaatacccaagcaaaatactcttgtgtgaggcttagactctgtaagaatctaccactttatgaagagactttcttctcccatctaccagattttccaccaaatttgttgcagccttgttatgggctgaattgtgccctcttaaattcatgtatcgaaggactggccccctaggacctcagaatgtgcctgtgccctgtatttgaagacagggactttaaagaggggaaaagttaaactgaagtcattagggtgggccttaatccaatctagctggtgtccttaagaagagtgccgggcgcagtggctcacgcctatgatgccactgcactccagcctgggcaacagtgtgagacttgtctcgaaacaaaaaaggaggaaatttggacacacaaaaaagacaccagacaccagggatgcattcatagaggaaaggccatatgagatcacagcaagaaggtggccgtcggcaagacaaggaggaaggcttcagaagaaaccagacctgctctcaccttgatcttggacctcgagcctggagaactttgagaaataaatttctgccatcaaagccaccagtctgtggtactttgttatggaagcccaagcagactaatacaacctgcaggctttaaacgatgaacaagggatgtgactttattgtaggaccagtaatttgaatttcttgcaaacgcttgagtgtaagcattagtcaatagtcagtgatctgactggaaagaagcagagggcacaagttcatggcagtgtgctcaggggtacctggcccctctgtgaagagccccatagaagacaaggcacttgggccctgtctcaggggcagcacaagcttccaggacaccaccgtcactggtcacttgctgctccccactgtggccctggacagatgagtcaggcccatggtggtcagggcagtggtttctcctcgtcctcccccagcctgcactactccgtgcctggagctgtgaaaaattggcctttgctcgggcgcggtggctcacacctgtaatcccagcactttgggaggtcgaagtgggcacatcaggagctcgagaccagcctggccaacatggtgaaaccccgtctctaccgaaaatacaaaaaattagccgggcacggtggagggcgccggtaatcccagctacttgggaggctgaggcaggagaatcacttgaacccaggaggcggaggttgcagtgagctgagaccgtaacactgcactctagcctgggtaacagagtgagactcagtttcaaaaaaaaaacaaggtctttgctgcttccacagatgctcacatttctccctggctcattttaagctgtgctaaaatctggtaacaaagcttgcttttatttaaggtacattttgtaagttttcgggtggcccactgtaaggtagagagccctgctcttggtgacttgctttggaactagaaaattagcatctagctgtaccatatctgggcacatgactggggcttcatcaggtagggctgggctttcatgaagtaagttgcagctcagggcctcggcgtgcgaggagtgcagttgctgtgtgtgactggctctgtcaccaggagccccgcgtattcttcagggagaattttcaatcatgctggttttgatttaggcaatatggtcttgaaaatattttcatagtctagtctccatcaatcttattcttccacactgacatctgcttccagaatttggagtaaggcgagctgggaagtagggctctgaaatcttgaaggactgcctaagcccccccaccacacagaagcaaaagcagcctccacaggatgccagcttagcaagggaggcctcacgagcaattttaaggacctcagcactgatgacgagagatggtgtgttacggattttgcatctgcagttttgccattagtggcattttaggaataaataaggttgatatgttaactacctcaaaataattttcccattcaattagattttgttagtgaactcactcatcagtttggatagttcaagtagtatactgaaaaatgatagctaaacctggcttatgattagagctggtttacattttgccttcggcaagtggaggatttccctaggctgtttctggagcctcatttattgatgagcttctgtgccctactccaagaagcacctttccacctgagaatgaggggccccatttacaatattcttggatgaggacctggggaagaatgcaggagagccccaagctaagatggtattcaaactcagagcacggcagaaagttcccaaaaagatgttagaagtatggctcggcttgctgctgttttggcttttaaaaaaagattatagcaagaaccttttagggaactccacagccaccagtagggatcggcaggcacattgccccagctaaccactggagtggtgttcagggagggtttgggatgtggatgctgctccaagccatctgggagggagacaggtgcagggacagtcagcatgaaagcaactggggactgggattgccatagctcaacagcctgatgatggcctgaggttgttgccaagagcagctcctaggaactgctccttctctgagccaccctctgggaacagcagagctgtcagagaagatttaattgttttgatcttcctgccttcttgatatcccattgagagtcacccttcagggagaaggagatagagtcgtcattttgtattaagcaatgacaagaaagaaaaaaaacttttaagatgaaatcctgatgggattgaaaatcaattaatcaatcacacagacctctgattcctggtcattctggctcagaattacagacataagtgtgtgacactgtgttaccttagggtatatggacttttagaccagtagaattttatggagagaagaaacagtaaagatacattagttcaatgtatgcattagtgtttaaggtaataattttggtgcaaaagcagaatgggccagatagactagtttgccaggagtttatggatctaatgaaatagtttcagttgctcatttagagaaaacaaatgcagaaatagagaccacagctcttaatgcaaccaaagagagaaaatgcatgctgactaaacgtccacccattaggctccttattaacagaaatgagaagttattctttggggactgttgctctcctgctgctctgtcatggggctatggcttcattttccatctataaacaccaaacactggaaggttggttgctaagagaactcactggggaaacagttaactgttcaaatgtccccacttacgtggatatgtgcaaataccaccctctgttcagatctgcatgttgcagaaagacactacgtgcagtggactaaagctggacgccggagtgtcccacagacccaggttagcacccctgccctgccactcactagacatgtaactcacagcaagttcttaagaactctttcgaaactattcctcatgggcaaaaagaaaaggatggcaaagcatgattttttaagtgttcactgtgtataccaattatgaacaaattgtaaaatcctgcttcatttcatcaccatcaaaccataggcttaaatttgctcataatcccgacaacactgtgtgtttggaaacagtggaaacaggaagaactgagagcgggtctgcattcaggatccacgtggctccaatcataggtgtgaaaagactcacatattccgtagcatcataggacccatcagagtataacagctaagattattacacatgctgttccagtgtcccactcacactgcaccacagaaagctctgcagtggatcaattgctgctgtgcagtccccaacatccgatccttgctgaagtttattgattaagctggctaatacactccttacacagttatttggtaccatattgaaaatacattaattctaaaataacaaacaaacaataactttcaacctctattgctagtttgagaataaaatgctccctttggtgcagtgagtagtgctcatgagtgacagacaatttgaataagaaaactgggctcttgatttagatttttggctgtcaattacatttggaaagttgggggtaaggtacaagctgcttaggaacccttatttcttccccctgcccttttgatatcatttctctctcttctccttgaccttaggtgggtcaaggagttggaattcaaatcacatgagcaaatagcattcaaatgtacatgatatataaggcactttagcgatccaaaaaaaatttacaatatagtttctgtctcaaaaagtttattgccttgtttggggagacaaaacataccacacgaaaagttcatgatacaggatttaaacaagggctcaacaaatcatagaggaattgttatataacatgggttcttccattaaatggtaaaggaatgctcttagctctaaatactaaaaaaaaaaaaaaaaaaagagaaagagagagaaattcaggaactgtccaggtaggattgaggtaaaggacagggacgaaatgaactttttgagaagcatgtaggtggctaagtcagtttggatgttaggaactacactgagaatcaagagatgaggaagaccaagggcaaaccgaaacgagacaggctgagacaaagcgagatgagacaaagtgagaagagatgagacaaagcaagatgacagaagtttggtgatcatcttggacattttgctaaattaggtgaaaaaggagcaagaaacaggtatccttaggcaaaggcaacctctgaccaagcttgatgagggcagatgaggactgattctagcatgagagggaggtgcaggagaggcagctgcccagtaggtcctcagaagatggtgaaggcaccactccaaagagtgtagatacatactgaccacaacagagacagaatgtgtgtgtgtgcacacgtacacatgaacgaaagaggctagggcatcagaggggagaggaaatacagggagaagggaagtcaaggaaagatgcctgacattccacaggagaagcttctgcacaggagcagtggggataacaactccaagatgcactggagaggggtttttgctagagagtcagcatcgcaaacaagcagagtacctttgcattaaggtgcgatttaaaaatatgttattatctaggatagtggtgctcaaccatggcgattttgctccccagggaacatttgacaactgggagacagttttggttgccacagctggcagtggggatgggggtgctaactgccatcgtgtgggtagaggacagagacgctgctgaacacccagcagcacgcaagaagatcccacaacctggctccagatgtcaatggcaccaaggctgagaaaccaaatttagaggatcccagggaaaacagaaaagtatcttaaaaataaacattacccagtattgtacagttgacaaatgttaacattatgcatttattaaaaacaaatgtaagcaacatttattactgtagttagaattttaaaatatgtacatatactgcagcagacttttatttatttatttatttacttatatgagacagagtctcgctctgtcgcccaggctggagtgcagtggcacgatcttggctcactgcaagctccgcctcccgggttcgcgccattctcctgcctcagcctcccgagtagcttggactacaggcgcccgccaccacacccagctaattttttgtattttttagtagatatggggtttcaccgtgttggccaggatggtctcgatctcctgaccttgtgatctgcccgcctcggcctcccaaagtgctgggattacaggcgtgagccaccgtgcccagccctgcagcagacttttaaaaagatatattcagcttcatcacccttttcttaaaaaactgaaattacttctgtcaaaatcatgccgatggaaagcaatgacatgctaagcacagtcctttacagaaataattcagatagaataagtggaaaataaccttaaagaagattgaaagaagcgacaacttaatgaaacccagctactggttccattttctatttatccttccaaattgctaatgaattctgacccatttagtcatgcaaaatatatatcctgaagaatctgtatcccttttgaggtacttaatggatgtttagccggcaaggaaatatggcatgcctattattcacaatagttgatctttaaattgacattaatatgccacacttagagtactggggaaattctagccaaatatacaaagccgctgctactaagatgaaagacattccacaaggaggaaactgatctcagaaccagtgaccacggccatgagggcttcgtggctgctacagcacgttagccataaacaatttccatctgaggaagtgcattcagtgcagctgctgatgcatagtaaatatttgatcctaattggacctaatgatgaatttcaattctgtattcaccattcttttataggacaccaacccataaacacaaaaaataaaaaaggttttggggaacatttttcatttccttaagtcatttaataatgatgaattgcctgggaggctctttgaaaagatagatgcggctagaaagttactgggagaattagaaattgcataaggattcaatgcaaaatactttgtaaaaagaaattttaacttccttgtttaacttattttaattcattgagaaattaaaggtaaaatatactttataaaaatataatctggcaaactttaatttgggtaccaatttggaattcgattaaacaggttcaagtctatttttatagattataaaaatgctcctttcagataaagtaaaaaagataattttgttttgggagttaaaagaatcaatgtctgtgcatcctttagtctcaatagaataactcttattctatcagtaggcagaaatgtttaagcagcactgtccaaaagacatacatgtaatttaaatgcttttaaatggaatagaaaagtgaaattctctggtgttttttcttgtattctttcaaaatcatagcaccaatggatgtgagtttctaacattattcacctatctttttaaaaatttacccctgaatgcttatacactgctggtggagatgtaaattaggtcaaccattgtggaaagcatttggtgatttctgatagaacttaaaacagaactatcattgacccagtaatcccattattgggtctatacctaaaggaatataaatcattttatcataaagacacatgcacgcatatattcattgcagcatcattcacaatagcaaagacatggaatcaacataaatgctcatcaatggtagacttgataaagaagatatggtatatacacaccatggaataccatgcagccataaaaaaggacaagatgatgtcctttgcagcaacatggatggagctagaggtcattttctaagcaaactaacacaggagaagaaaaccaaattctacatgttctcaagtataagtgggagctaaacattgagtacatatggacacaaagaagggaataacaaacaccacagcctacttgagggtggaaggtgggaggaggtgagggttgaaaaactacctatcaagtactatgcttattacctgggtcatgaaataatctgcacacaaaccccccataacacacagtaacccccgtaacatgctatcaatctatctatataacaaacctgcacatgtacccctgaacttaaaataaaagttaaaagaataataaaaacagaaagtttacccttgataacacgttttatgtataatcactaaatctactaaggcacatttgcatattatattatagagtctgctagctctacagtttttccaactgtgtacagtcggccaactaccataacccacatcttccaaatcctagtggcttaacaatggaaaatggaatatccagtgcagctcagtggagtgtggggtggggggctgtgttccaaacagccatttagaaatgatgctccttgcagctattactccaccataccatggggtctcacagtccttcacatcccctgagtccagctgttagctgagaggagcgagaatgtacaggatcaggtatgggtttcatgaggcagacctggaagggcaatacatcacttctacgagccagaaattgtcacacgattccttccaactgcagaggaggctggggaatgtaatctacctgtgtgcccaggaggaagggaaatgggctttgtgaaaatgtgcagcattatctctgacaaactggcaggaaaaaacccactaatgtcatatctttatatacctgagagatgtatcatcaatgaccaattctctgcccttggcagaatgccgattggaaatatagctttggacagggccaatattaggctacgtcaagatgaccagcatgtgtcctggcaagctgacaacagactctgtcaaacagtcagcatggccagattaccctcctggtcttccaggcaatcatgctcctcttcccactttgggactgacacctttgcttcccatcgcaagcacagccaattcactgaaaagagttgactagtgtcacttgcattttcatctgaataagggaagagtcactgtcacttggaatgtgaccatagactccactatccttagactacatcaaaattatgctcctttaaactatttggaggtaaaagacacaagaaaataataggcaccagaagcatacacaaatgtgagatgtttggcatggaagacagttttctactcataaaatacacaacttgaaagttggtataaatatcagatcctgaatcctgccagccacatttttactggcaggcatagcaggagacagcacaatgaaaattctcatagaggttggaagtagcaacaagtcttgaaaactcatttgactatcaaggagggctagaccacacattaactcagaccacaaaggctaaaggtctcacttagactctcttatcactcagcatttagaaccagaagaataatcacattcattctttcaagactttccctttaactatacataagaaaggaaatgtctttacattcctcatatctcacttggcataaaatctaatgtttgttcatctcacttatcttaatcccatacctcctcatgtttattagaagaaaaaaatgtaactctgcatgtcagaaaacagatctgaagtaaatatcagttaaaatgcaaaacaaaaagcaaaagaggtctcagatttttacaaatgttgttttatagaaaccataaaattgaggtaacttgatttaaaacaagtgaagacatccaagaattttcatagtatgcaagtgatctggactggtggttggcagcattgacattaaatcagctgaattttcattgacagctcattagaaagatgttccaagaaaatcgaatacaagatgctcaacagaagctcttctctatgcagttcataactgttattttatgtccttacaagtcatgactcatattagaacacgtaactctgtaaaatttaaagatttttataaatcgcatgaaaaatttccccttagtatagctataattttgctgtttatgtcacatggatttttaattacattttccaaacacgaaggcagtcaatttgataaggagaatatttcacaaaattcactcttctgttctaggatcttggttctaggtaactcattctccagaaagaaatcatatcagtcagttcacaaaagaaaaaaatatttaagccacctaaaaactcaagtactattcattgttaattttgtctggatctttacattaccttaactatatggtcagtctataaaaatgtatctgtacatatgcttacaggtaatatgtaatataagtaacatccagggatggatcctgaagcgggcttccatttttttttggcatttgtattttaatgaaggttaataaaagccaaattacagccaactgttaaagctttttttttttttttttttaattctatggtataacaaaatcagttccaggtttttttctgaacaaatgatcctttggtctttcccgtggcatgctcctaaaacaactaaaacaaccctctacgtctaatcagtcacctaagatatcgagtggcaagtctttcacatttgctgcttataattcctgaatggtccatattgagtattttcatttctgggtaagggaaaaagcattttggtccattaattcacccgctcgctcctggaggacgttaaccaattctgctatcacaaagacgtgagtggcatcaatgtcttgcatgatgaacttcgcaggcttccatttttgttcactttgggatggttttcctgtcgaactgcgtggaaaagcaggaagcacactgtccactgtaggggttcctggtccagcagaagactttcagatattgtcaagtttagtccacttctttggatctcagtggcttttattctgacataagatatttagatgttgcaagcccctccaaggaacactattttataaacagaaacatccagttgtgtggccatttcataattagcttctgaaatggacaggaaatgcacctatgtgaaggaggcagagcagggcaaatgcctttactgcttttcaaattttgatttccgggtaggaaacacaactaaacctcctatcaatttttagtctttacctgtacatttctaacttttagagatttctgttaatgttcctttttcttgttaactttgtatttgatattcaagaaacgttagaaatgaatgcctgtataacataatttcaagatattaaaatagcatttatcattaaggccacttgctttataccaacatcacaattccattttaagagttattccatgtcctgggaaattaaatcactgtctcaactccttccaggtgacataagaagacatggaggcatgatggtctagcagagagaagcctaggtggtatggattgttccatgttgtggaacatattacagagacaagggtatacattagttcagcaatttcgagttcttaaaacatctgctttctctccagctagatctatacaactggatggagaagatcaggcttaggtgttctgtaaaatttaaaaatgagacccctaatggcagctttcctattttactcatatttttggaatattttcaagcaattgctgatacaatctggtgagccactgatggaattgagtgtaagaaatggaaactgctatggattgttaacatagagactgatgaccagattacaggtgcatatattttgtttatctagagttgtgtggaggctgctgttcagagcattgctgacaccagggcatgaaactagtgacacagttaatgaggctggtgatgaagaaactctcgggtcctaaccgataatttcacatacctagtaaatcagcattatttcatttgagttacacttgactttttaaaattaaatatcatgcgaaagactttccagaattacagcattccaccaaattgctctagccaggaccccattgaggtccatattgtaaaattatcaggttatatctaagccatcatctttcttgattgcacctccccctctgacatagtttcttctcttggctgtcagcacactgtgcccgcttgccttcctcctatctccctgggcatgccttctcagtttcattgatagggttctcctcctcctcctggcctctcaatcttggaggtttttagccttgaagtttcttagcctttttgtcctctttctgcactcactgcctcattcagtctcaaggctttaaacaccatggagacccagccatctcttgccgtctcctccatttccacccattccaggcaccttccttcctcacctggccgttgcaatagcttcctaattagtctccagcttccaccttccccttcttaccacctactcccttcagtgcaaaagcctcaacctctggcactcaccctttctttctcttggttgcagctatcctggcctccttgctgtgcctcatactggaaggccactcacactttagggcatttgcagaggcagtgccttctgcccccagatgggtaaccctatgggcaacccccttcaacttccttgctcaacatttgaaactccaagctgcactgtcctcaacacattctccagatcctctttaccctgctatgttttgagccccttttactctcttacctactgtataatctcctaacatgtttaccttttactgtgtgttctgcccatgggaatttaagctctgtgggggcagggatttttaccaaggttgttcactgatgtgtctcaagcgctcagaacagtcctttgcctttggacagtgctcggatttgcatgagtgaatgactgtgctctctccagagtgatgaggatgtcaggattgctaggtttagaaatgaagcacatcctatagtatgacagagcctgcagaggagataacagcttctcgcttaaagatatggagtaggcgttaaaaatgatttctgcccaatgtaagaggaggattttccaattaccaaccagaaggagttgcttgctcttgcctcagtgattctcacaataccatatgctatcaagttccattgccctctttgtacatgtgagggtaaggtgctccattggatgtatcttgaaacagaacagagtttgtgtatgtgaggggggtgtgtacctttttctaaggattgagctggatgacaaaggatattgcatatttaacgggtagggagaacgcaggtgcaacaattcacaaaaatctcataatagtgaatgatggtgaatgaatagagaagacctaagaaatctctcaaacgggtgagttctctaggaattgaaagggttttttttttttctgttacagttttaaaagaatgtggaaatggaataatttgatgatattaagctgtggttttgatgaatgctctaagaatcatccccagtgataaatattcaaagataaatggtgatgttttagatagaagtcaatcgttattctattgcctgtaacagggttccttagttataattctgttagttgctctcatggtcttatgttactaatatagtcattatttcaaagcttatcacattctgtaaaatcctgtagtcattagcaataatctaagccaacgttagcaatccattaaggttagacatttaacttctataaaatactctatgccacagcactttcatattcctatggggcaaatttccatcgtagactccacgttggctccttgaaatggtgtgtactcaaggatagcccagcttaggggactccaaatgccatttcaattttaactttatacaacagattctcgttctccatccatgcttagacttcccagctctcaggttcaactctcagatcaggaacaaccatatgtactatgttttgtttccatcgaattggcagtgactcattatttaattactctccatgtgttggccaaatatgaggaaagaatactctgaaaaattaacaaaatgtggctggcattacagccatgcagtgcctcatgcctgtaatccctgcactttgggaggctgaggcaggtggatcacctgaggtcagaagttcaagaccagcctggtcaacatggtgaaaccccatctctactaaatatacaaaaaattagctgagtgtggtggtgggcacctgtaataccagcttctcaggagactgaggcaggagaaccacttgaacctgggaggcggagattgcagtgagctgagatcgcgccattgcgctccagcctgggcaacaagagtgaaactttgtctcaaaaaaaaaaattaacaaaatgcatctgtataggcatcctatgtctgcataatgcgtctacacaggctttgggatgcagcagcattggatagaacaatactgatccctggcaaagatacaccacaaaaaagctcggctgcctttcacaaatacgagttcatgaacacgtccaggaagataaaagtgtgcagtgcattaaaaacacatttccttctcattagttgcatgaggatataaaaattaaatcaaatctgctttgttgccaatttcaagaatgtgactgaggacaaggagcagaagaaagcagtgtcaccaatcctactcggaataatctgtcaccatgttagcagagcagaaaacatttcattttaaatgattgctatttcagttacataataaaagttaatagatacaaccccaaacataagatttaattcattcagacacacatatacttgtgttagtctatgaaggaaatatatcttttatgtcaaaattatgtacttctttgaaatgtagttcaaagtgaagaagaaaactttaaacattttccttcacttttaactccttccatgccccaaagcaaacacctgaacatatgttaaaatacttgaattcatagctgccatcagtaatgtctttattcattcagagattttacttcaatatccctctgttagactttttcctgaatgttgatcttgaaaatctgtaccgaaagcttaagtttttctccaaagtcacattcaacttccatagatcatatcagaataatactcctttgatatttacatagaagcaaatacaacaatatctctataatccatggataatgtatatatgctactatagatagctctcattctgaagatatttttcccaaggcacaaaggccatcacataaattcacctgcatttttagagtggatgttcagggcgatgtcattggagaaaggctatgctcccagtgactgtcacggacaagtacagagtcttgagtaggctctcaacaaatgattgttgtgcttattaattgaagaagaatgatcttatatgtgaatcagaaaggaaggaaattaggagtaagtgacaacgaagcaagtgatttgtgaacattgtgtccgaaagagaatctgaggaaaagggtgttttgaggttagtagcagggctgacattgaatctgagttccatgcccagcagtgagccacaccctttccttactaaggaatctggaaatgttgccagccctgccttttatctttgaaaacacagggctatttatgtctaaacacaatgcactgaatttaccttcattggttgacacagttatctttcctgatcctcaaaacctcaacagacagcaaagtgcacaacttgctatgtaatagaagtttggtagatgggaagtctacatgcaaagctgatttattttggcaagataactcagccgcaaggggttacacggaaggcagagagaatggatgtaaagtgtagtcaggatactactgagaaatcctagtcaaggatgttgcaatagcctgtgaactaggaaaggagtgatattgaagacgtgtatgtaagtagaatcaatgagtagggactaagttggtatgaagaaaaattcgaatgcttgtctaagattctaattctcagtaactgggtggcaccatcgtcaagatccagccctgggaaggaagagcagggtgggagttggaaagtgagttttagacgcattgaatttgaggtactcagaagacattcaaagggaatgttcaccagcttcttggaaatgtgagtctggaactttcacaagagatcagggatagagattagggattatcgtgaaggaagaaacaggtgaactcagggaagattacagagatttagacgagagggacagaacccaagggagtaactttaaggttgggcaaaaaaaaaaaagggcacctgtaagtggaattcagaagatgtaatcagagagactgaaggtaaatcagaagcttccagtgtcacagaaggcaaaggggaacagatttcatgaagatgcgagagtcagcagcatgtaatgccagtaatctaaaagacttgtctccacatttgtttccaataccgctttatgttaattatgtaatatctggtttctcagctttagtaacaatgacatgagaaaattcaaaattattttttgtgtcatttctctcagtgtgtttattattatttaaatatatttatatgctttcatgaactttacttatgaacgagttaagaacatggcatcccaaaatacaccactctggcatattcagtatttttagttaaaggcacttaagaaaaaccaggtgaggtcgggcgtggtggcttatgcctgtaatcccagcactttgggaggctgaagcgggtggatcacctgaggtcaggagttcgagaccagcctggccaacatggtgaaatcccatctctactaaaaatacaaaaattagctgggtgtggtggcaggtgcctgtaatcccagctattcaggaggctgaggcaggagaatcacttgaacccgggaggcggaggttgcagtgagccgagattgcgccactgcactccagcctgggtgacagagagagactctctcaaaaacaaaaacaaaaacaaaaacaaaaagcaggtacaagaagatcactctgaccttccttctgtttctgaaaagcaggagatgacattcccatgtgaaaggtgtcctcccttggccaggtgggaggcatgattcctatgggcaaggaccagaagctgaggctgagggaaacctgtaccacctgctatactggcccttccttcccagccattctcctccaatcacctgccctggcccaagcccccgaccccccacctcatcacatttctgcaatttactgctctttgtctaattccttatataagtggtcaatacaaactgcatctttgggtcttcacaaattctgaaggttttcatgccacataaacttatattaaataaatgtatatgtttttctcctgtggatctgtcttatgtcaatttaattctcaggcacaacacccacgtgccccatcccctaacaaatcctaacagaggagaggtataattttgccttccttacacctagaaacatagaaaccatcttttctttgaatttaatgatttaaaattataaagacttttggcttgcactgaattttcagattacatgtgaaattacttgtaaagaaaaattattcaatattatccattttgtcaaaactcttaaaaagatagtgatgtctaccagctttcgcattttagcataattggaatgagtctatggataaaacaaatagaaaaaattggaataaaaatcctcaaaattaagcactggttcctgccaaatggtaatgaaaagtcactagctttttccaataacattaaggaagtataaatattattaaggaaaagctgtgtgtatataagcttttctgaataaattaaattacacgaaatatataagctacagaatgaagtctttatattaaaaacaggtagtcctattttgcctggtatcgtgtcaacaggaaactcaagcatatccagccatatcactgctctccatagtcctgtagcaactgagaggactgcttgtctgttttactcacttttcatacatttattacataaattctcttaaaacagaaatcctttcttctcaacctgttgacccaaaaccagtgttaaagaggttaagataatgtatacactgctagattcaaagcccattataaattttcataaaacataatgacaaactatttgataacttaaagagtaaatatcagatttataacaatgccatacaaaaagatacacactacaaaaaccatcttgaatgtaagtttacaaaagatgtttgtctgctaaggaactaaattcattttctctttgaattcaccatttatagaagttttgagccctagaccaaaaatatggaagtataggccaaacattatactatctgtgataaattttcagaaaatttgggctgctttaagtaatgtatttatgttttacatagttcctcaatgttagcagctgtgaaagatatttacaatttacttcctatgtagaatttatcttaaatttaagaaatagcaaatagagggaaagatgttttaatgcaggtctttattgagtcgttcaaatgatgaagagaataatataacaaatgtccatgtacccatcatttatcttaaaatagaagatactaattcaattaaagcctgctgcacatgtctctaattggaagtgccttcctacctccagaggtaaccattatctgaatgtaatatttatcagtccatatatttctttacattatgatgatgtaggtttttaatgaatactctttttaaggttaaagtaattccttcctttgtctggttgtgagtttttatcttgaaagcctgtgttgggtttcatcagtttttttttctgcactgattcagactgatctacagtcagaatgtaaagttttaaaccacaaaactcatatgattcatatatggtggtgaaatgccttcaataaataaatgaagcaatatgaaaagaccctcatgaaaatattttattcaatgaaaatgaaattgctttaggcattaaaagtagttatctatggtcacctaaaacactatttggttttactagtgaattcctcatttccttcctttctgatttatatgttagataattcttaaattaataagcacagctgagggttaaacataccaaatagtcttctgccaaatgtttttacacctgtggttttaagtattttagaatattgattagaaaaattatacatgtgaacataaaaaattatgatgtggacacaaatgatttttaacatcaaacgttttttaattttgatatccaaaatacataaaaaattgtaaggggataaaaatctcactgcaatcaagctttctcacctttgcataaaaattatcactttgatttcagacaagtttttacaagctgtggttattaagaggtggatctcaccatgtgagacaaaaaaacacgtgtgtgccaattctaaattaatttccaaatatgaaatacatccgttaattcttaaagatgctcaaacacaaaataaaatatattttgaatgtagacaagtaggcatcatcaatttttttaccacagaaaaaggtagtattttattactttttccacataaaagtctacctctgaatttaccttttcactcggcttttcatttttacttgtttttttagttttccatcataagccagtcttctattatatcaatacaaactttataaacttgtttacacttaatttttgtcttattctgccttgaataaaaatagtcatagtggatataaaaagaaaattctaatgatttaatttgatgtcagaaatacaatttttaaagaaaacatcgaatttctgctgctaagagatgtcactctgtaagttttctccaaaagggagtgttttactgccctttacaaacagagggaaaaaccattttctacttcagaatgaggcgtggatcccttagtctgacatctgacatccttcttgaatttgcactgaacctccatctttatctccaacaattcctggctgagtcccttcactatgggcctactcatagatgtgcacagaaatgaaccatctggtgtgccaggccacaccttccaacacttggctctgctgggaccacaaggatgggctttctcatctcaccgtacatttagatggccatattgggtttcggatagtctcccattcttaaccatggtcttcaacagtttttgttttaaaagtgaatactcttatggtaaaaaagataaatgtgaaatagaaaatactgtagatctacagatcaaagttatatttgaaaaccacatttaattgtatattcacatatttttgtaattcacaaaaaatatacccatctgtaacttttcaacattcttgagtgttttgaaaattaacaatttgttctaaaacttgagagttacatagttttgaaatatttcaaagttcagttcaaacacacacaaaactcctggataccacctggagctaaattcaataccaatcgaattttttaggtttgcaaaattgaactaaagaagtaccactgagttgagggcatgtcaagatctagcattaaaccaattcagatttgtacttggaccagcatattccaggggtcacagtagccaacatgcaatgccttaaaaatacatgctgtacgtgtgtttttctattaagctaaattcaatctctttttttttcaggcataaatttatttgagaacaagagaataatgtttctattctatcctttctaatatcaagctggtctttaaaattttttttaaactgtgtcaatttcctaactcgattcttttcggtatgccgacaggttatttcaaccagcctcgtcctaacatttggctcattatactattggcacattcatgtctttctctgtaatcttcacctcccgtgcttgtttttctctcagtgaagtacagaaagccaaaacttaggatttgaaatgtcgtcttcactgcctggaccaatggttttcttgttttattgaaaatgaaagagctggccgggcgcggtggctcaggcctgtaatcccagcactttgggaggccgaggcgggcggatcacgaggtcaggagatcgagaccagcctggctaacacacggtgaaaccccgtctctactaaaaatacaaaaaattagccgggcgtggtggcgggcgcctgtagttccagttactcgggaggctgaggcaggggaatggcgtgaacccgggaggcggagcttgcagtgagccgagatcgcgcccctgcactccagcctgggcgacagagtgagactctgtctcaaaaaaaaaaaaaaaaaaaagagaaagaaaatgaaagagctatgcatttggtgaaataataaaaacacaacctttcatctctgataatactgagcattaaataaaattataggtgcaattattttacaggtaagttttactttctaggacaaagtctagatacacagggcagtactgactgccccgaggcctcggtctctgcaccaattggtctcatcttatttcaagtgctctcgtctttgtcctcctcttctcagttacatctgtgtaacagggtctgtccagcgtttcatttctctaatcaccttgaacattgctcagcagtattactaacacatgagcctgatggtgagacttttgttctcaataaataaacacaaactcaatgcaccttcccaggggctttgcatgggacctaaatattctttgagtcctgagttttctctcctctgaatctttgctgtccatcaccttctgccatttgaataccctcttatccaaaccaaaatcctaattccagtacagcttttcctttgtgataataccactgattttctagtacaatatacgcccagctcccaattccagctctgagctcctagagttctgggggacttcacattgcccatcttcttttgcagagtgttatatccaggtgtatgtgcccagctctcctaccagactgttcatctgcctgtggcacggctccttgcacacagtacgtacaaggcttggtaacagaatcccatgttcattgaagggcctagactgatcacattttaaataatgcacaatgttctcacgtctatttaaggaagaaacaactgatttctatcttttaagattgcatttcaagaccatatcaaaggctttgaatctctcaccaagactaacaatgaaaaacaaatttggccaagtgcagtggctcacacctgtaatcccagcatcttggaaggccgaggtgggtggatcacttgaggtctggactatgagaccagcctggcagcctgggcaacatggcaaaaccccatctcttctaaaagcacaaaaattagcttgcgtggtgacacgtgcctgtaatcccagctactcaggagggtgaggcacgagaatcacttgaacctgggaggcggaggttgcagtgagccaagattgcaccacagcactccagcttgggcaacagagtgagactctgtctcaaaaaaaaaaaaacaaaaaaacaaaaaaaaatgcaaatttgatcatatttaattgaatttgtttcaaagtaagggaaaggggagtatgcaagggcgacatgtggcctgttcttctgaaaaagcaagaaaggttatctttatacaccagatcaaggtattgacagctacagagtgaaattccatacacaaaaagaaaattttcttcaagtgaaaaaagtaagtggccaataaggtcacattcaaaaattaaaaatggatgccctggtcttgattactgataccatttttcaataaaagtaaccagagctccttgaagaaataattgattttaggactaggacatgaaatgtacaaaatgatgcgggagcatcttgtagtaccagggaaaaaaaaaagtcaacccttagcatgaaggtgtaagtcaaaggcacatgggagactggagatgcattttggatttcagattttttcagattttggaatatttgcatatccatcctgcgtcatcttggggacaggacccagatccaaatgtgaaattcgcttatgttatatgtagtgtatccaaatagcctgaaggtaattttatacagcgtttttaataattttgtgcataaaatgaagtttgtgtacactgaaccgtcagaaagcaaaggcatcaatatctcagccacccacatggaaaatctggtgttgtttggcatcaccatcattcctgactgaatttatttgctaccaataagcaatcattttcctgctcttactcagacgtgagtacttaacagtagaaaatactactatttttgtttttgaaagagtcttgctcttgttgcccaggctggagtgcaatgacaccatctcggctcacggcaacctgtgcctcccgggttcaagcaattctcctgcctcagcctcctgagtagctgggattacaggcatgcaccaccatgcccggctaattttgtatttttaatagagatggggtttctccatgttggtcaggctagtctcgaactcccgacctcaggtgatccacccgccttggcctccgaaagtgctgggattgtaggcgtgagccactgtgcccagcctaatactactattttttaaacagtaaagatacatcctattaatacagtgaaaaataatgtgtttaggtaactgggcagcacaggaaaaagaccgttttcctttctcagctgttagacaacagcagcaacaaacaatgcaggctttcagttgccacctatgatgctgtgtttggagtaaagggcactgtacactgtattttttttcttttttaggtgataagaaacatctgaagcagttgacagatcatgaagcgggtcctctgagaaatgagaggcattctgccggatggcatttttttttttttttgagacgaagtctcaccctgtcacccaggctagagtgcagtggcacgatctcggctcactgcaacctccgcctcccagtttcaagtgattctcctgcctcagcctcccgagtaggatggcttttaaaatgttttctccagcgtcatctgcctcattaacagcgatttttgtcttagaagtctctctttgagtttctaaatggacatgactgcttattctgttaggaatgcactccactctagtccttcaattagcccatcacattgtcactgtggcatctgtatgcacattttctgccgtgttaatgtcatcttcattgtccaattgtggcatcatgttggtgctcaaaacgttgcagattttggaacattttggatttcggacttttagagtagagatgctcaggctctactacttcttatttcagagaaaaacataatatccaaataactaataaaaacttggttggagaatgcagacttctagaaatgactgtttaatctgcttatgataaataatcctctttgctctactgcaaaggggagactactgctgttactgttttgtgtcatcatgtcctgatcagacaaacactgatttaaaaaaaaaataaaacaagtacattgtatatgtaaatttagactgtaataatatatccttgagaaataaatattatatggactccatttttctctgacagtcaattaagcacaaaaagatttttaaagcactgatttttgcattcttaaatgacaaatgaagtcttcttgaaataagatttttaatgatttagagaaatatttgcacatacactagcttggtgttgattctcaatttttaatttttttttaatcctttccctggcattttcatcgtttccttttttttttttttttttttttgagacagagtttcactcttgttgcccaggctggagtgcaatggtgggatcttggctcactgcaccctccgcctcccaggttcaagctattctcccacttcagcctcccaagtagctgggattataggtgtgcaccaccatgcctggctaattttgcattttttttttttttttagtagagatggggtttcaccattttggtcaggctggtcttgaactcctgatctcaagtgatccacctgcctcggcctcccaacgtgctggggttataggcgtgagccaccacgccaagcctatccttcccctttttctgttttgttatggatgatgaatgtcttaaaactactgaactccttataccttgatatggttagtgagagcttccttgtgggatggttctgaatgattttctctagaacctccatttgaacatcttcctttcctctgctcactgtaccagtctggggctatcaaatcacatatgctgataaatgctacactatgactggtgaagccagtgctaaaaagcagcttctacatatggcacttccaaattgtgttattgctagcttttccagtgctttctctactagggcatccactgcatgtcacctgctaaaatgcaaaccacatctttaatgaaagtctgttttattgaatatataagtgactatgaaatttcaaaatgaaatttgatggcaatttaattttataataaatctatatctatgtatctcaccaaagatagcctaaatctttagtgaggccacacattcatttttatgaaaattcttcacatgagtttagaaatctcccaactaagaaaaggacaagtcagatcttagtgtcctgggtggcttagcatttcataactgccagagaaccatgaggaccttcctgggactgactcatgggagttatctgcaatgattttatgtttcccaatgggtcatattttcattggagattatttactatgcctggaatcctaatgcttggtgtctctaatgagaaaaataatacaaaaaaattcaatattcagccaacacaaatttatatgatctacaaaagaaaggaatgttttcagatcctgggcttgattatttttgttttcgatgtgacagatttgctgaacaaagcttacaaatctcccttttcctctctgctcgctactaccccgacccagaaaacacacacacaccccttcccaaccggggaccatctgaccgttcacacccacatcaactctgggtcgccatgcttttctgagggacattgccttcactgagagctcctttattctcagtataccttacattcccagccacagtactgaacttctcaatgcttgcaatgttcccttggagtatatcagttgagcaggcggaaaaaaaatatctggaagtttattatttttccaccaatatatttgacaccacctttggagagggaacaaaaggcatactgtcaagcggatagacctggacaaaatgttactgtttgttcctcacgagcacagaggtatatttaagcaaagaaaggcattccacggctctcccgggacttccttccttcagctgaattataccaacatgttcacaccactgagggccaggctgctggaatttaaaacgcagacctctatctgccagtgcttcgatcccacggctacaaacattcacattaggattgaacctggctttcaaacatcatgagataaatgggagtttactgggggaaaacgtgtgccctcatgaaactatagtagaagatgcggaaataggactgtccctgttcagcagattctatactaatacaataaagcctcaaagtcaccagaagtcacctggccttgggttatgtttcaaatccaggctcactgacattcatgaaacctttggcaacacaggccaagtttcgtgcaaggctgggtagaatacttctttcatgtggaagctgggtgaaactcggtggctttggctagctttcacctgaagtttcacattcaaacaatccaaagtttcaacgtaaaattcaggggtgaagagaaacagaaagaaaaaaaaaacaaaacaaaacagggggaaaatggcttgcctgggaatggaatgatcacctaccattctccaaaaagatttcatcctggtgccatttaattttgccgctggactatcacctctagcaatatatttgcactcagccctgcagaccaaggcttcccagtactaagggagagtgagtattctagctagacgcaccccatccccccaacaaagcccaggctcaaaataacgggaggatttaaaatggtaaccatacacataaatgcgatgattgacatgcttcttataatgtagatttgaaggggaaaagtggcaatgaaatgcccaggtttgggaaacttaaagattagactgaacatctctaggtttttctactataaatccaagttctggagattcgattgcatctgctcctaatccagggagatctctgccgtagctttctccacagctccgcccctttggagatttgtcctgtggccacttgcgtttgtccttcttagcaaggtgcagaggacggggcagactgcgtcagcgctgaggagctagcgtccttgactgggacttaaacagtctcctgacaggattaggctcattctactcctaaccttcaacagaacacgcagggaccgtttgccagggaacgtcaaactctgtatttggctgaggactgtgaaaataccttgtgcttggggtgggaaagaagaagggaacaaatgtcacacacacctgtgctttcttcacaatgaagagaatattccaaagctgattgaatggctagtaagtgctacattttgcccattttaggaaatacatttttaagaaatcccttatcccttacacagcagaagtttcactcgtaaaacagacttctggctactaaggttttttttttttttccagttttcttttgattctaattttctttttctttgttatttcttcccgtttttgttactcagacgatccttatgtggttaaaatgcatgctttcctttgatatgtgctctgtgataccaataaacttttctgaaaaaaaagtatttctgaactccaaagatttcagcatccatgtttttaaaaagcaccagttgggccccaaggcacacggagattctgaggcagcagggcagccagcgcggggctctgtgcactctcatttgctgcttgctcttacacatctgccagacaggggccatgaactgtcctgaagtctgtgttggggagaactttaccagagaacacttttcttacaattgggggtccctctagaagtgaaatctaagacagatcagtgaggaaaactaaagctccaataaattgtttaaaggaaatgctatgaaagcattaaaccaaaaggaaaaaaaaggagactttttactgagcatagtaaatagccacaatcaaagtaaatgctgtgtttgaagttaaagtccacagatcaaagtacttcgcaaaatgtcaagtgcaagcgtaacgagggggagaggggagccacagaaactgacccgaagtatcacattgtcacgttagagaaacctgccagcagatgtacccagcaaaagacagtcagcttagtaaggaatcctcaacactgtcccctaaaatgtgctaggaacatacaaaacaacaataacaaaaacaaaacccccagattcccccaaatcaaccactctaattccacacgagcaatgaacgaaacagtgatgaaaggagaacattatacaatacggctcgctcattgcccttaaagaacaattacttatatatattatctttactcaggtggatggttgcatctttttcctctttttttttttttaatgcccctggaaagttaaaaataaagcagtctaaacaacaaaaatatgatgtctgaaacatcctctcattgctctggcaatcaggcttaattagacctctgatccatggcttagtcatagtcaagcgtgtactgcaggtcactattatgagagctttaagcaaagtttaaaacttacagccacaaaaatgcccagatgctcctgctgtattctggaacaccgtgtttacctgaaaattgttcacaactccccttattattttcactataagtaagttattttaaagacattagttatgaacataccagaaaacaattaaataattccagaataaaaaatcttacctacaggcagctgagttcaacagttgctctatacagaggaagtaggagtcagtggccttttacatgtagagattgtttatttagccctttttaaaaggtcttgaactccagaggtttaagattaagtccaatccaagtgtctgaaggaaaaaaagcaagagagaggcaaatgagagagggaaagaatcccagctgctgggtggtgctactgttctgagagcatttgagctattttcagcattaacagcagccggggttgtctgcaaagggatgaaaatgccttgcccagatcgccaccccccactccaggggggagaaaacaccaaccaggaaacccacaacgacttggttcattgtgcaaatattcatttaaattttgaggaaaactgccagcaccattgaaaacaaaacaaacccaaagttgactggaatcttaaagaaacacagtgctcctcaagttttcaaaatgaattacctgattcactgaaaacgagatgtcctacttatgctttattgagaaggaggcttttcttctgatatttcctagggggtcttaagaaatagttgagagccctctggtagcagtatctgttgtcagtctattcttaagactgaagacaaatgatttcttaaaagagcccgcacctaaatttccagtttcatcaactatgctatttttgaaagctactgggttaagcgttgacatctcttatctattggcagagactggggaccattcagtgacatgaggcagacaaacagtgacccctgcttctgcctccacaggccaatgaagaaatcattctggttgggtcactggcaatgactgacaaactttgagccttcattttgtttctagaaataaaaattaagaagtcgtattcattcattcattcagcaaatatttatttggtgagcacttcagagcttactataagccaagcactctgggaatacagtggtgggcagaatgaagtgtccttgccttcaggggtttagagcacacagatgcagtgagaataaataaaaacagaatttttaaatattttccagactttttcacatgatgagactattcacatcatggcagctgaagactgagatctctttctattgtggatgaaggaagatactgtgtgtcatcagaccaacttcaggcttccattgagtcattgtgcctttacaccaccaccagggaggaaaattacttactttctaccaaggaagcagttaagtatgtttatgaacgctttcattccaatagatgaaatccctggtttttttcaaccccctactccccattacaaaaagaatgcttaagtagtcagaaagtactgctgagaggctttccatcgggagatgaaaagagagtcttcaacctgaattcagtataaaaaactgccggtggctcaggcccgtaatccagcactttgggaggctgaggcaggtggatcatgaggtcaggagatctagaccatcctggctaacatggtgaaaccccatctctaaaaaaaatgcaaaaaattagcaggatgtcgtggcacgcgcctgtagtcccagctacttgggaggctgaggcaggagaatcgcttgaagccgggaggtggaggttgcggtgagctgagatcgcaccagtgcactccagcctgggcaacagagtgagactccatctcaaaaaaaaaaaaaaaaaatgccctgatatattttataattaatgtgagggttggttgctagatgcttatatcaaattcaaattcaattctttctttgccattaaagaaagacactgaaatagattatggaaaatactgaggattatgccatgtgaaaaaaaagggttacatgactactacttcaagtactatttaaaaacagtgaaatcctttggctcaatagaccttatattaaaactgtatttcaaattaaaaaattataaattaactttgaaatctctaatctgaattttataaataagatcaactttgttttaaaaatgtataccaggctttaaaaaatgactctagaataaagcatttttcttttcacttattttaaatggttacattttactatgtcttaaatacctgccaatctaacatgggatatttgtttctcttggcctcaatgtggaatggtaattctactggtaataattggaagcctagctgcagacagacacattttttaattgtttttttctttttcctccttataatagtttataccaaaaaagggtataatgcatttaaatattggctttccttgagaagctatggcattaaggaaacaaagatcaacataacccactctcgtataaaacagggataataatgagttgtcatagggctcataggaataatgcacagaaaatgcttacctgggtaatgtctgacacacagcaagcatttggtgaaagtcagtaccatcatctctgctgtaagtgtaaagctttgctctccaaatatggtggctacatgtggctactgagctcaatgcggctagtcagaactgagatgtcatataagtgtaaaatgcatgctagattttgaggtctttatacaaaaaaaaaaggtgaatgatgagaaattactcagtgggtacgatgttcattattcaggtgatggacacattcattaaatccgtgactttaccactatgcagtccatccatgtaacaaaattctccttgtaccccacaaatttgtacaaataaaaatagattaatgttgtctcttcctaaaacatgtaaactatcatatcatttttatattgaccacacgttgaaaaaagaatgtaaattatgacattaatttttatattatgtgttgaaatgacagtattttggacatagtatgttaaataggatattttgctaaaattaatttcacttgtttcttttttactttttcaaatctgactgctagctaatttaaaattacctatgtgacttgcattctatttctactgggcagtgccatgcaggccaacggttctcaaaaggtagtgagcatcaatgacccagaagcttcgtaaaaacagattgctgggtccaccccagagcgtctgattcagtaggtctggcggggcctgaaattctgcatccctaacaaattcccgggtgattcttgacctcactttgaaaaccgctggtcttgggccttgcttcttaaaaaagtagtccacggaccaacattaacgtcatcacttaggatcttgttagaaacgcaaaacctcaggccccacccagacctactgagccagcatgtgcattttcacaacatccccaggctgcgtgtaaacatgttgaaacttgagagaaatgatatgaagtagtgtctgtcatccctgggtgaatataaggtaaacttttacaaacaccagtaccccggccccgcccctagagagtcagatttaatgactctggatgtgactcgagcatctgcatacgtgaacagctgattccagattaaagcaagcactgagtcccatcagactggatgtggaaaggccaggatctagatcatttgtacatcattaaggcatagttgacacagatcaaaccatattagagggtatttacatcccaaaagaggatcttgttaaccccaataactctacaattgttagaactggtgagaaagacccatattttggagtagagaggccttctgttattcgctccacctctgttccggccttaaataaacgagcacgccaactttaagagtgtgtctgaataacctcattagtttgccgaatgacttctcacattttcaggcggcacctgagcgttgtgtgtttcacagagcttggtaaaaataaaatcctcactgtaagagagaatctgggctcacgctggtaacatttaaaacttccaattctatatgcaaagaccatctgcagctttgcttctcactttcttggttgaacctttcagaaaacttttaaaagtgcataatacttaagagtagagtctggagtcagggtgcctgggttcgaatcctcatcctgccacttacgcgtggctgtggctgtaggtcacttacttagcctccccatacctcggtttcctcctctgtaatgagacctttttttattgggttgttgtgagggtgaaaattgttatttgaaacagccatggaaaaatctgctgctttgtaaattttatatgaatgttggttaaataatcaaaatatatttgaaaaactgtgcagatttccatatgtggctaaatttagtaatttttaaaagatactgtggtgatttccaaggactttcatgggcgtgagtttttgaacacatatatttagagggtttctctgagtgttgttttacatttttttcccaagacagcacagaattctcaattgattcctcatcgcttcctattatttgagaggatcccagtaggaaggaagtaaatgtagttttcccatgagtattgttttctagagaacattctttacccctgcagtcctttgaagagtgagttgtgctatagatgtttagagacctccctggtccctgtcattctagtggcattgtctagtatcccaggagaacaatgtgtcattctcttagtcaaatattttagtgcttagggcgaggcagcaagaccatctgaaacactggcgtgagtttcaaagacatattgaaacagcagtcagattctcctatagaaatcagctaatgctgactaaaagaagggatggggatgaacagggaagtgctgaagtcacgcacattgtaagcaaaatgaaggctagactaagtagagtaacatttttttttttttttttttttttttgagacggagttttgctcttgttgcccaggctggagtgcaatagcacaatctcggctcaccgcaacctctacctcccaggttcaagtaattctcctgcctcagcctcccgaatagctgggattacaggcatgcatcaccacacccggttaattttgtgtttttagtagagatggggtttttccatgttggtcaggctggtctcaagctcctgacctcaggtgatccacgcacctcagcctcccaaagtgctgggattacaggcgtgagccactgcacctggcctggagtaacaccttttatgcttgtctgcttcaaccacactcaatgaagtgaagcatatgcaagaaaaataaggatacctggtagctctgggcacgtagcaagcatccgtcgggtcatctacaggaacctcacccatggtatgccacctgctgaacaatgtaatgcatgcatcgggctggaaactaaagcccatacattgagtgactttagaccagtcatgcaagctccctacacttgtgtcctgaaaggcagatagaggcatgggactgcaactgccttactgactcttaaacctatgctttctcttgggcttatctggattacattcggcagtctgccatgatttacgcctttttgcagcactgtttgaaaggagtcaaatcatacgtccaatgacttctactgcctggttattgatgttaagtaaatactttttagtaggcgatttgtcatcacatgtgtcattttgccatctgggttgaggtttatcaagtgaggtgaaaatcttaacaaaaggttaaaggaccagtatcattgaaagagattatatagaaataacttcttaaaacctctgttagaagctcaattttctagttgaaactttgtttcatttatttatttttatttattcatttatttttgagatggagtttcactctgtcacccaggctggagtgcaatggggtgatctcggctcactgcaacctccacctcctgggttcaagcgattctcctgcctcagcctcccaagtaactgggattacagacatgcgccaccacacctggctaatttttgtatttttagtagagacgggtttcaccatgttggtcaggttggtctcgaactcctaacctcaggtgatcctcctgcctcagcctcccaaagtgctgaaattacaggcatgagccacggcgcccagcctgaaactttgttttaaactggctgcctgaattctttgtgtatttaaagagcacctctgctgtttatgtaaccatgacttagcttttcttgttatttctattccatttgaaattgagcatatgcaacagtcgctaaatctgctatgaaaattgtgaagccttctccatgtggcccactgaaggccctgcacgatctggtgttctgcagcatttctgcccagatctccaccaccttcctcccagtgccattgcctccagcctctctagcctcccttccattgcctcccgcctctccagcctcccttccattgcctccagcctctccagcctcccttccattgcctctggcccctccagcctcccttcccttgcctccggcccctccagcctcccttccattgcctccggcctctccagcgtcccttccattgcctccggcctctccagcctcccttccattgcctccggcctctccagcctcccttccattcctggactgtgcctcatccagggccctggcttgcctggctcaatgtgatgggaatgccttccctgcccagtggcgaatgccatgcagcctccagctttcacgtgtctcttcctcaggaaggacttccctgctccaccagcgtagccccgccaccccctttttttaactcgtaaagaatcaccttcctcattccttctaaattcaggttcagttgcttgaatttgttggagtaattgatcggagcccctctcctccactagcctatcagctcccgcttgcccctcacatgacttacattcctcccgcaggtactgcattctgcctggccctaagtaggggccaatacgtagttgctgaataagtaaatgattaaataagttctgccgaaggcattaagcaacacaagagtacattttttggttctatatttatcagaacttgtgaaataaaaagtatctgatcatgtaaaaagcaaaacattatgtattctaattaagcagctgtttccaaccaagacgattctctgaaacattgctttgtagctacatatttggtttagaagctgtcttaagaggcaggtgccacttgcttttcccttcaggatataatatgttctgttatcttaatttgcatttattctaaaatagatttcaataaaacaagttacttgcattcatatatcatattcctagacctttttcacaaccatgtgatactctactagggtagagtgaggtccctgataaacatttcttctgattagggttattgagagaattatgtatttgtctatatattgcctggcagttataccacctgaaaccatatgtgattatttataatgtagttttatgagcagacaggcagatataaagtaacacatcaaccatgccacctggtcaggccatagtcattccaatggtatgaaactctttcttgtggccatattatgcataagttataaacagacaatgaatggtcactgactgagaagactggagatttgcaatcttattttctggcaaatagccaagtcatgtcaacaggagagataaggagagttttgtgtgtcatacactgtagagcaggggtcaaagcctgggataggagagggcttggtcttcactgcatttatttgaaaggagctatggaaacttttcttctaccacttgggcacaggaaggcttgctatggcccaacaatgttttaaaatgtattctttacacatgtgtaaaacactctgaaatcatcaagatacagcatgaaacgtatcttttctgagacattaaaaaactgaataaattaatccaacaagccatggcacaattccataattactatgaccacagaagttaatttagcagggatagtacataatacacaccgtgctaggaaagtgtccttgaaactcatgacggtgaaggacgaattaagcccaatgaaggacagttgaccagcattcaagaggtagaaggaactatagattccttatatcaagtacatgagaaaaacttcctaaatgaatgaggctggaaacacaaaccctcagagactggacataggaatattttctgcgttgtctgtcttctaagcagactctctctctacttctacttctgtgttagcaacgactacagtgctgcagtaatatagatctcctcagttctcaggtggccaagtgaggccttgggaagctaaagttcctggactggccacctctggctgttagcaacctcattggtttacctctgtgcctgcaaatattcttgattttatgtatagtatattatagagaagtctggaagggaatgctttaaccagcaaagtcaatccattaaacaaaaaggtatgggagagacacgttaagagatcagtaaccatgttgtagtttaaaaaaaaaatgcgaagtctttgttcagaccctcggggtaagcagaagtagactggtctccagtggcaggcatgagagggaatatcctgcccgcagtgatggacattttggtttcaggcagagaggcaggaagctgccctctgaatcagagtaaatgctcacattttgaccttctagcaagggccctctttttcttggcaagaattccttcgaggatcattttcagtttgaggttctgtctgatgttttattttacaattaagtcactattcccatattcattactctgtaaaataagtcaagtaggtaagaggtgtggtagacacttccttctgcctcctgaggatccattttgcagccttcctcactacagaatcctgacagtacggccagttaacaactgacctgcctggattccttgcagtttctgaccaataagctaaaggcaaggcatcctgttgaaaatttcatatgcacagtaacgacactaacctcccgagaagagggcttccttgtccttttctttcttttttgagacggagtctggatctgtcgcccaggctagagtgcagtgacgggatctcagctcactgcaagctctgcctcccgggttcacaccattctcctgcctcagcctcccgagtagctgggactacaggcacctgccaccactcccggctaattttttgtattttagtagagacggcatttcactatgttggccaggatggtctcgatctcctgacctcgtgatccgcccacctcggcctcccaaagtgctgggattacaagcgtgagccaccgcgccaggctgtccttttctttctaaccttgttctgctcctctttttgtagactgaaatgcagatgtcattctgtgggggtgcatgctaacagagagatgatacagcgatggagagaggatagagaggaacctactctgggctacctgtccgtgggatttcttgttatttgaggcaaacccaacctggtgaaatgactgtattgaggtcatctgttccatgaaagctagaaacagaaacaaaacaatcatctaaaaacaaccttccttacattagaccggctgaacgacagcaataaactattaggcctgccattaagatattagttaaaaaatacttccagaagttttgaaagaacttctgggcatcaacaacgaatgcttacaacagttgtggcattaagtctccggcccattatcatttcctaatggagcaaaatctgccatgaaaaatgagccgacatgcctaacgccccgggagctgcatcatttgaatatttttgactctaaatatagtgaagtagttggctcttttttctaaaactacaatttactgatcagtgatatcaagagaaataagaacacagcagtgatcaacaggaaacacaaaacaggaacgcattgtttattctgttctcggtggacactgccagatcattgttcagagagctttcaacagggttgcttcgatggagtttagggagtttttaaatctaaattgaagatgaaatgtgtcctcgggacagaaaaagcaattttgaaaaggttattcaaggccataaggtattgactttgagcgtttaaaaaaaaaaacaaaaaacctgtaagaatcttactgtggtttcttaaaatggtgaatgctgtcagtcataatggaggggaaggtaggtttgattaggcggccggtgaattttcagagttaaacaaagttaaaaatacacaggcaacatgaaaattgttctaagcgttcctgtgtcatggtttctgattaagtatcatgaatggaagaaatgaatataaatcataacgattccgttttataacagacagtctcgtgtaaatattttgtctttctagtcacatgtgccaagagctgtgtgagagtgtaatgatggagagcgtggtctgtacttacccgccaccatcaaacccaactctattactgccagcttctgtggctgctacaatcttcttgggcttcagttctcttacccaccaaataggcactgtgtggcccttgactcataattgttgtgaggcttaaatgagttaacacatgcaaagctcttaaacaacagcaactcacaggaggccctccccacgtgttggctgaggctgtttccatcatcatcttaagagcatgggcttggagaatcaagagttctgagttaagtttctggtacttcctcgaattagctccctggtttgggcataatcgttgagcctcattttcctcatctgagcaatgggaatatcgttcattaccttaaagcattaagaagaggggtgaagaatataatgctggaaaaccacacctggcacactggaatcattagataccattttgtttacattacacggaaaaaaattatttgcaaattgatcttcaaaaatatagagacttttactttgctgttggggaaaatgaaatggattgggcacacctagatattgaatttaatttccttatcatttatttcagatagctcacattcaaagttttatgttttgggtttttttttctattttaattttaaacaagaatacatgggactgtcaaacaactggattaagaaaatccccatatctgagctaatcactttgtcctatgattgacataacagtctccttcgagcaacagcattaccactgcttcatttagtaagtagagaaggctaaagaggaaaggtagtggcgttaaaagaaatgacctggaagaaatagagaagaatggactttgtaaggccctgtgagagtctatcattcctctagcagggggaggagcagagttataatcctatctaccttgttacaaacaaatacacactaacttaacattgattgactatggttataatgaatggtaattgaagaagtatccctctatcacagcagtgattacattccaaggaaagaactgagggtttggaaccaggcacagctgatctcaaggcgtggcttctcccatggcaagccatgtcactttaggagagttacttaatctccctgagcctggatttccttatctataaatagcagacaggctgggcatcgtggctcacgcctgtaatcccagcattttgggaggccggggcgagcaaatcacttgaggtcaggagttcaagaccagcctggccaacatggtgacaccctgtctctactaaaaatacaaaaactagccgtgtgtggtggtgtgtacctgtaatcccagctacttgggaggctgaggcaggagaatttgcttgaactcgggaggtggagtttgcagtgagctgagatcatgccactgcactccaatctggatgttcatccatttttttttttttttttgaggctctgtctcaaaaaaaaaaaaaaatagcagacaaccccatctacctctctgggaggtttctgagaggattaaatgagactttgcatgaatattggctactccatcaagtggttgcagaggaggggttcagtaggctgttgttgctgtttacctctttttcctactacactgcaggctccttgaggataggattcctttaaaaacaaaatacaaccagttcccagcacagtggctggtcgctagaatgtactgagtgaatatacaccaaataaagcaagacagggatactttgaatggaaagatcaaacaacagcaataatgaatagcaggcttgacttgtttaagtgaaaatggttaagagagactggcgtggacaaactgaactgatgcattggggaacagattaagtaaaaagtacgtaaaagacaacatcttcttcacacacatatttagaagggaaagataagccgtaagggacagagaaactgttatacgacccgaggggattataaatagcatccttaaatggggctatttctatatagcctctctattttttactttgtagaaagattgaatgactttgacctatgatttctgagagctctgtctgatttcttttttaatttacaaaagtttttatataaaattcaggtcttctcatttctctctgagcctccctcctcccatctgtctccaccctatcctaagtgcctccactttgggtactcttgggttttatggctaaatccagcaacgcagattgtgggcgggcaggtttcccgtattgttcctaccgcccatttctctacagcatttcttaaatagggcctagtctggagactttcaggacgagtgttatagttctcacttttcatttaaccttgaatcatagctggaaagcacattacgaaacctaggtaatcatcccctacacattttgaaaatttgggagcagaagatgattttacaggtaaagccatgaccagcgccagggtctaagaaacattgttgcggcgaatgggcaggtgacatcacatggcgcaggcagcatgttccagatccagatctgagatgggagagggctttccacggggcctgccgggctgttccgtgagcaccagggctgctccagcgccagctgctgctttgttctgcctgggagcagctttgtcggagacttgctactcaaacccctcatgaactaaatgagctgttaatgctgttcgcaatcgtagactcattgaagtgtcaggtggtagcatcaatggagcaacagaaagaggttttcatagagaaagaaaagagataccgacagagaaaatggggtttgcaataatttcagtaagaatggattcagcgggggaaagaaattaataggctatatcctaaaaagaaaaacaaataaaatttggtgcttcaaagtttcaaattaggcacatttcagttgagtcatagccagacactcaagtacggcagtgtgatctcagaatcagtcaactatcaaaggagaatagcaccatttaagataattagaaaaatgacttcagaaatgagataatctcagagaggaattattcgtacaaggctcgctggtgaaacttctgaaaaagagaaccttgcagctgagttcactttatagcattatattagggtatacttatttggtgaattttataattataccctgtaatgaatcttacctgcaaagacagagaaagactcaattcaagccacccttctatttgcatatataacgttgggtaagagaagaaggaattggaaagctcttcaccaacggtgcccatcactgtggccaaacgtgggttctaaattgcagagcctccaccattctgcaacttgaactctgttttcgtgttacagattaagatctatccacttggcctattttaaaaacagttgcacacatttgaacacaccttcgagactccaaattggacttctgtaccaccttctattttcggtaaccacaagggtgctggaaattcaagtactaacaaacgccacgacctacaaacttaagaacatgagctggagaatacatgattcctgggccgcagaacacacctgcgctctggactccaattattctttggggcgtttgacttacagatcaaggaccaggtcaggtcatctttgtttgggatgtttatactcttttttgtgaagtcttcaacattgcattgctctttttcttaacactcaaaagtcagcttaagatccagtgttaaagcttatttttgtgtttctttgagattaatatgatatttccattttccatgagaaatgagactgccttccttctactcttaagcagtcctgtagagaactcctaatactcattcatctccactcaccttatccagattcgaattagctacaaaggtactcagggattctatgcaataattattcaaaataaagtcataacaattttattatttagcaaagtataatttatgaaataaatcatatttataagtataattaatatataattgtgtattagataatagagtaattgcttatcaaatatggaatatatttatatataatcaagaaattaaatataatttcttataatgtttaaatataaattattaaatataattttagcaaataaagtcataatttcattctatagtctcctctatttttatgtttaaatggatacattggtgtcctcagaatataccatttttttacaacagaatcattcaagagagacattataactttttaattctcttgatttttaatgcaatatttcattaaactccttttaagcattagaagtttttgaaaatgtgccaggtgaggtattgttaggtaattttgctgctattcttgcttcttgaccattttctcactgttttagtgcatttggaaatgagtttgaccctaagtttcttcctacctatataaatacttagaaactcttgtactgtttccaaatcaactggagcagtgcctccatgggctacatttgccgttatctgtttcactgagaaacaatatatctactgtagttaaaaagttcatgaatggtccttgctaatttctaggctgttgaaacatgtctctaatttcacagattttgaggaggcaagagatctggagttttatttctttttttttttaatagcatagtgttggatttattcaggatatgagaagacagtcatctgcgcacaacacatttgctatgaaaaaaaattgttaaactacacttatctccactcactgcttcagtggttatgttaactttgtcctgagagtagctagcattggggtaagatgtaaaacacaaaaataatgatgtattattcgatcagtctattaacccatactgattagtggccacactcaaaaagacatattgtagcgaaaacattcccaattctcactcacatgataaccaccctggctctacaagtacaatacgtgtatctttgccacttatctgttgaatgtgtactaatagcttcctccaatgaataaggactctaaacttcagggatcattacaaggtacctgaggagctgggcgactctacagttggaattattttcacattaaaagagccaagaaatctatgaactcatattttactcaatttatttgtgcagccatatataaatagatggtctattcatgtaaaagaaactattatttcaattctaagaatgttaacttcattattcataaactagtccattggtctgataagaaagcatctctcatctcacagacaaatactctaaaatatgtttatcactaaacaactggctttatttagggaacaattcaagattccctgatcacattttctgaaatgatccaattttgtcactcagcattgactctgtaccacagaaattgcattcctgttccacattgtgtcaatggaaaggaaggctgattttggtacttagctatgaatattccatactctctgttctctgaaaaatgtgaacattgagtagaaaatcatgagtatgggggaaaaataataaaatatatgaatgtgcttttaagagcatggcaatgtagtgaggcttattaaaatgccacttttcataaacaatttaaaaagtttctctaagtactaatttgggaaagtatgctaattttcaatacttaaaacctacatctgtttaaattagaatgagcacatttttgccacatgtcacattttattaccatgcaatggtaagtataaatttaccacctacataagaacaaaatatgggcaatacatttatgaatacattaaatgtttaagaaaaagcttttctgcacttcatatgatcttgttttgtttgtacagactcatgtttgtgagctgggcaagttagcttcagatataaggtatacatagaccttgggtgtggaaggtccaggagggccatgacttctgttttattcatatagcacagtgcctgccccatagaaaaaacctagctcacagtggagaaaagtgaatgatggaataatggacgtacaaagccagccaaggtgaggctgtacagtgtttatcataaacagtggatgttctgaagatgacctcttgacttgttttttatttttcttactctaagtgcctcgggtgaactctttcacctagcatgttaggactaatctgcaacgtggaatttattataaaagtgagtgctcatacttgatatttgtcacactagatactcttaaaaatgtgaaaaaaataagattgtttttcccccacaagtacatgccgtcagagtaaccattttcttctttagatcagagtgctaatagtcaacaaagggaaattgttcaacatgtacagagccccaagactctggattccttttaaactccatgtgaactgtatttggttccaaagtagagctaatcattcttaatccaggggtaaaaccaccactgccagtaaacagacaggccccctggcattgaagatcaagttggtgatgatcagttttctaatgggacagcttctaaataatgtcccaatttaaaattgatgcaaattttgataatggaaattgacaaaatgtttatattcagagggttaaaaatttgttttctattgcttagtcttgtggcatcctagttagatgtctaaacatgattggtgctacctaaatttcctttggccccattctagatacatctccttattttgaaattttcataacgttaagtagatttagaaaatatgggacggcgtggtggcttacgcctataatcccagcactcgggaggccaagatgggaggatcacctgaggtcaagagtttgaaaccagcctggccaatatggtgaaaccccgtctctactaaaaatacaaaaattagctgggtgtggtggcaggtgcctgtaatctcagctcctcaggaggttgaggcaggagaattgcttgaacccaggaggcagaggctgcagttagctgagatcatgccactgcactccgacctgggcgacagggtgcgactccatcgaaaagaaaagaaaagaaaagaaagaagagagagagagggagggagggaaggaaggaaggaaggaaggggaggagggaaggaaggaaggaaagaaaatatgaacaagcaaagagaagaaaataaatcttcagaaaaaaaattgttgacatcctagactgttttttttcttcctccctctttttattgtcgtgctatttctgatcttgaggatacggaaatttggtgttcacttataaataacggtttccatagagcccatgagcaaaaaatacagagagaatgataaaatgagaaatgtaacattttcttttggctgatctgtagttcccacaaatgggcagtctagaaaactgttgacagtgcagggtttggaatgtggccgactcaagctggaatcccactttccccacatgtgtgaccctgtgcaagttgtttaacttctctgcgcctgtttcctcttctgtaaaatgagaataatgtactcatcagagcgtttgtgtgaatagtcaatgagaggtatttaaagaatttggcacgctgcctgacacactgtgcattgaatgaatggtggccattattattatttataagaatacttactgttattttactttcttaactaaccctgcagatcgcaaagctccaataccatgtgatgtgaagactcattttagatcagcccaagaaaaacaccattaagcaggtaaatccaaattctgttgggaaaagatcatatgatgcattctcaagcaagtgcttcaggattgtggcactgcagtctctactagcctaggcagtggcaggatggctgttctttgggaataaggtctttagaaaacagtgagctcccacattctatcctgtcatcatttttgccgtgaatactccacataatttatctccagatgattagtttgccttagtgcaatgtaattaattgggaccagaagatacaagagtgtgtttgttatactctaatgaagtttctttgagttttaagttggacttcaacagttaaagaacaacatgatcacggaaagtcaaatggattgtatattaagaagatttttatttatttatctattatggaaatttatttttattctgtgtatttttttatttttgacccagttgagccttgtttggtcaatacctctgggagatcttgacaaaacaaagcgtgtctgggccaaagatttcctttccatctctggggattttttttattgatgatgaagttattatggactgagagccagttatgtgccaggccctgtgaggtatcctttgcacaaattacttcatataagagaacgactggtcctatgatctatgcacagcatccttcttttacagagaccaagcctgtggttgaaagatatggagtcacatggcagcggccacacctcctcgaaagctaaatccatgactgggccttggtccccgcaggctcctgcctggcctgccccttcctgtcctgcaaaattggaaggacattggtgcagaattggaggagccctgcctttgacaaggcacatacaaagggaaagtctgtcaaaaagcatttgttttactttcttttttaaaagaaaaaaaaatactgttatttactgacttttaaaactaagtgaccaaacattggtgacataaaattgtttcttaagtataacaaatgtcacttcaaattgttttttggattttaaaaataaccaggtaaagaaatgacgttagggtggggagagagggcagcagaaagagagtggagagatggagaaggaggaggagggaggaaatccaggcagtgggtggggcacggccccactgatgagtgtctgagccatgggcgcttggtgctattcagggaggcaaggtcctatgttcataaataatgtactacagggacagtttgaaagtgatcattaaatttacatttttaaggcaggggagttgcagtcacagccacaaatataaaaatctaaataaggtgtcttcaagcattgtcctgggacaagaactgcagatacatggcccagcctcaactctctagatatcctgctgatctcagggaattcagatggtgtttcctgggtccagttctcccccgccacccctctgaggaagcccaatctaaagcatccatgttggatgcttttaccatgacaaggtgtggagaaagaggaatttctataagtagaatgataatgaggagctgccagatttctagcaggctggggactcggtggttccccttgacatgatgcttctgggcatgactgaggtcctgggtgtgtgactgagggtcagggtgatggtgtctgagcatgattgaagtcctgcctatgtgaggaatgtgggaaggatataacaggactggtgcacccagacctctggcctggggagaagctgctttcacctccagccaggaagagtggctcccagcagcaataccccacagtaactcaaagtcattaatcatctcactaagtaaactgtgtttgattcacagtaggcaagagtgttcacagatgatgcctaaaaacacaagtagtgtgtataggcgggcttcatgagcttgcaaactgagcatgtgcacctgaccctgtgcttagaacggccaggtgttctgtttgataccctgctgtcatcatctataacttattcatcatacttttggaattgccttttcatcttgcgctgggccctgcaaatttatatagcagattcttgttgggtaaatttcaacagagataaacaaagtttccaaagtttctgagactccaatctcacatcctacaccctcaaaaatagaagaaagaggtcggggcagcttcggcaattccttcctctctcctgccactgggacaagctcacctctgctgcaccctccctgcctcagcaatctttgatctgtaccttcagagaaggtttttatcctagtccatccccagcagacacctcctgcccagcctctctctgaaggtctacatggcaaccacgggctacatgtggctcccgggcacctgccttgcttgcactgagatgtgttatcctgcaaaatacacacaagatgcgaaaaaaaagaatgtcaaggaaatcattactattttttatacttgttgaaatcatattttggctgtactaggttaaaaatattataaaagttggtgtcatctgtttccttttactttttaaaatgtggctgatagaacattaaaaattacataggtggcttctctttgctgctcaatatatttctattggtctagacattttttttaaaaccacatatccacctaagtgttccacctatatctccatctcagaaagtctcaaaccagtttcactatcttcttcccccaaaacactttttccatgtcttgttttcccaagacagaaacctggtgattaaaccatagcctgcttctactcccaaatgccagctgagaactgttggttctgtctccataatctctccacgccagcacttttcccccagccctactgtcctgtctcagctgagccattcatcttttcttcctggattactgtactgtcctcctacaggaaattcccttattttttttaaattttcttgtagagatgggatctcactgtgttgcccagggtggtctcaaactactgggctcaagtaatcctcctgcctctgcctctgaaagtgttgggattaacaggcatgagccaccccacctggccctatgtgaaattcttgaattcattcccaccctacctcagtggtgctctcacaacagagaaactatcttataaaggaaatcctatttcaccttcctgcttgaaatgtctcacagttgccctgccatctggctctggtctgcttgctcgattttactcactatctctccatatcgggcatcctgcattccagccataccaatggctcccagggccctgcagatttatatgaaatccatcgctccatgcctgggcgctgtggccacgctgctccctggtcacggtgaggctgggcatgcctgggcgctgtggccacgctgttccctggtcacggtggggctgggcatgcctgggcgctgtggccacgctgttccctggtcacggtggggctgggcatgcctgggcgctgtggccacgctgttccctggtcacggtggggctgggcatgcctgggctctgtggccacgctgttccctggtcacggtggggctgggcatgcctgggctctgtggccacgctgttccctggtcacggtggggctgggcatgcctgggctctgtggccacgctgttccctggtcacggtggggctgggcatgcctgggctctgtggccacgctgttccctggtcacggtggggctgggcatgcctgggctctgtggccacgctgttccctggtcacggtgaggctgggcatgcctgggcgctgtggccacgctgttccctggtcacggtagggctgggcatgcctgggctctgtggccacgctattattccctggtcacagtggggctgggcagcttccagagcgaatgtggacatattcttaggccccacctcacgcacttcttcagagaaacctcagaggctcctccacaagccacgggtacccccagatttccctcactctatgcatcccatgcgcctctagcaacgcaggaccacactcgagtagagctgtctgtgccgaagactgtttggcagacactgtttcagatgcgttccagacacttaggagagcgactgacacagagcagggcttgactgattacatccctcgctcatttctcccggccccgtcaccttagttcatgcccaagttttcctcttgtcgaattcatcgacactatcatttcgtaatcttttcttgtgcccttcatttaatttgatactgttaccagttatatatttttcacccacaaatatgatcattacttttcctctgtaaagaagctccaatggttctctctctttctctctttttctttccctaaagaattaacccaaactacttaacatgatgatgatcctgatgctgatgacaaaaataggcatgggtggccattcattctgcctctgacgtgccaggcgctatgccggtcattttgcagtaatctcatttaatcctaatgataatactcagatgtaagtgctattatctcttccccctaagtagggaaataggggtcaggaaaagcccaggagcctgttccccaagaccaagttagcactacagagctgggaatgaattccaactttatgtgactgcaaagctcttccatgcccccacaccaccccacgcccggttctccctactgttcctacattccagacgcaccatccagcctgcaatgtgctttcacaccatgttcacctgcagacaatgctttctccatctaatgcccctgccttcaccatgcacacactgaagttgcctagaagggtcagtcacactctactctgtgccttccttctgcctcggcacttgtgatgctgcgggattatcagtttcccctccctcatcccaaagactgaacagtcaccaagagtagcaagtcgactagtcaccactgaacatacgcagcctggagaatcagaggtgcacggtgtgtgccttttacatgaactcatgcatacaccaagaatgatagtaatgcctgctcacatttgtttagcatctcccacatgccagacctcaccctacacaattagaatacataatccattcaatcctcccaccactctttaggataatgtatcatcttaatccttatttattttttccagaataaacttgtgattctaacaacttcaacataaaataaataacttttgctcaatatcaaactctataaaatcactaaaattggcccaatatcctgggttttttaacttgcattatttcttcctgataatgacatttaggccagtcaaatcctgtattaccgttttaaacaaagaaaaaaagattatgagttgcttttaaaattcacgtgtgacaagcagaaaaaactcgtggaggcagtttcaacatttaacctaagtgtacttagcaactacacttaatagctttttaaaaagcctcgtttttaaaaaaagtggatctttctttgcagagtgacttaaaatacatcatcatagtcttattaattaaacatgttcttatcagaaaaaagcgtctcgaaagctagtatatatgcttaattaagctgtatgcaaccatcagtccatatcttgaattaggctacatgtgaggccctgatttgccccattctttctgctacccagaacagcactgctcactgcctaccagtgtttccagcaaagatataaagttctacatgtctaaacgtttttgccctgatatcaaaagcaaagcaaaacaggtcttctccattcccattttggttaacagcatcaccatctgcccactggcctgatccacccagaagcctgtcttcttttttgaacttgaaatactcatgtgctttatttgtataaattcccattattccctcactgctccaaaaatagagaagaaagtaacataaatgtactgacatcaatttgagaactagaacatgttaccttcccgaagtatccatcttggatatagggaaggagacttagcctcataaaagcacatgaaggaatgctcagaggaaatactctaaacctagttttctggaattggtaagcagaagctctggagtcagttacaggttgtgagccttccaccaagaagagccacctaacataccaaaaaaataagcatgagattcacttaaagtttgacaaatttagcaactcctttccattgtctgcattttagagaacctattgatgctgttgtaacagctacagagaatcgtgagatgcccagtgacattggctatagtggtagcaaaccgggtagtgggaagttttctaacaaatactatgtaaaaggagaagcctgagtcttttaacaccacagatcaaacactgcaaatggtaggacgagcattagagtcccgctgaggtcgctgagacttacacttcacacgaattgtagtggtgcctagatctccctgaagagtggcagaagcagccgcccatcccttaaactacacatgtacctggcttctcaagactccagagtttacttagagatgagtaactagagcacaggaatttggaagagagtctttctataaactcccaggaacaaccaacaccagtagtggctgacgtctgtgagaccttctttgcgtcagatgcagtgctctcatcaacatccaacacacgtgcctttaatgcctgggactatggcgacactcatttagatgagggaactgtggcatagagggtttcgtacctcggcttacttcactgcaatcggctttctaaaccagaactcccacccgacaatgtgtgagtccaaagtccatgtttctaggtgcagtggctcactcctataatcccatcactttgggaggctgaggcagacggatcacttaaggccaggagttcgagaccagcctggccaacatggtgaaacccgtctctgctaaaaatactattagctgagcatggtggtgcacgcctgtaatcctagctgctcaggaggctgaggcaggagaattgcttgaacctggggaggcagaggttgcagtgagccaagatcatgccactgcacttcagcctggatgacagagcaagactccatctcaaaacacaaaaaatacaaaaagtccatgcttctaaccactagcaatcaccctataacatattcccctcaatgaaaaagactgaatccaagaaatctcacctgcgtcagactttctaagtcatagagatttatagtaataattttaaatgagtctttgactttcagacccagcgtatgaaggaggagagtgtgagtcagtgccgttcctgggcgtccgctgggaacttccctgactgtccttctggctctcaggagtggagctcacttgctcaattcattccagtgtcccagaggtcacagtctcccctctgtgagctgggctgtcctcggtccctgggcctatctctttgctgtcctccctgggatcttgcccctggggtagccctgcttcccttgcagctttcttctctgctgctggtgccttccccagggctgtgcatgggcttagctctttcttcatttctctccctctctcctcttttcttcctgctgtcttagctgggccccctccatccttttatttcctaattgtacctgttgcttccatacccttaaaagcatactccattttctccctagatgtattgaggtataattgacaaagctgcagacatttaaggtgaaccacgggctgctttgatacaggcatgcactgtgcactgatcaccacaatcaagttagtgatcacttcttatcttttttgtggatggtaagaacatttggatctactcccctagcaagctgcaagtgtgcaatgtggttttattcactacagtcaccacgctgcatgagatcctcagaacttatttgtcctataactgaaagtctgtgccctttgacctcattttcctccccccaccaattcctggcaaccaccattcgactctgtttctatgagttcaacatttagactccacatataagtgagattgtacagtatttgtctttctctgtctgacttgtttcacttaccataatgtcctcatatgtatgctgttgcaaatggcaggattttcttcttttttagggctgaataatatcccattgtgtgtatatacaccacattttctttatccattcatccatggacaggtccttaggttgtttccatatttattcctttcctttgtatgtatatccagaagtggagttgctagatcatatggtagttctggttgtaatttttgaggaaactctgcacaattttttacaatgtctgtaccaatttacattcccatcaacagcttacaagggttcccttttctccacatcctcaccaacactcgttatcttttgactttttggtgatagccatcctaacaggtgtgaggtggtgtctcactgtggttttgacttgcctttccatgatgcttagtgatgttgagcacgtttccatacgtctgtttgccatttgtatgtcttctttggaaaactatctatgctggccctttgcccattttttaactgaatcatctctctctctctctctctctctctgtgtgtgatgctcttgagttgtaaacacatttcttaatctttccatgtgctttaatctcagcactttagcaactgtcaagaacaaagttcttttcaaaaagttcatctcaaagttggccactgactcgtaacaggtaaaacccaatgagcacttccctgagcctcagtttcttcttttctcatgtgaaacagtgatgatagtgcatacctcccagggctgttgagccagactcaacaatttacatgaaagcactgagggggtgccaaatacatgtgagtggtataaaacaattcttgatgctacaaagcttgcttttccacactattgtcaaaatcccaccttgttcgagccccaattaaaataccattttctctaatccatctttcccgatcctctaacaaacttcaattctctgagcaatttattatcatcttctggaactccattgcttaagacgatcaaagagtttctttattgtataagttacttctgcgcatgtcttttgaaggaataaataaatgcattgattatatctgccttatagcactccatcaccttctatcttaaattacagtaactagcgttcctgtcttcctgcactaaattgtaagctctttcaatggcttcctggcttattctctcatcttttcctccggtccttgatggatgtataataaatgaatgagtaaattatatgaaaatgcaagtatgatttttttaatatacagttacaacttcgacatccacagttgggtctgaccacttgttaagttgtacccagaacttaggtctttctcgctctccacgttccctatcaaggccatcttttcaataccaaacaaattagaaagaatacaatcagctaacttacactaacatactaacaaatgggacaacagtcttcaaggtctggaagaggagagcagagaactcatcattgcctgctcaagcccatctaccaggaggggaaactccagatactgtgggccacttggcacttaggaactcatggtactgatctgtatattgggcagatatagttttttggtgatagtcttaaaaatcatgtgtcacctgtcatgacacttgccagatgaaattctgattttatttcccaagagaatgcactgacaaattaataatctgacctttaaacgggtgatatttctccatgtcaatcaacaagaggccattctgttttgttgaccagataaaatactctttcactctctgaggggttagcgagagtgcatgcagatttctccaatgctttgcttttggttggaagcagaaacatttaaatttcaaggcaacacttttcctaattcctactgaactcaaaagctctagtggttcagtgatcccattggtaacaaatacttagagggccagagtccttctgggtcctatccttacgctcctgttctctcctcctctcaggccttttctgcaccatgcaaacccagcacctcttctcacaggctgggctaaaggcagaatgcaataccatgactgaggagcctgggaatgaggcaattcattaacagaacattccccaggaaacataattttctgatcataatctctttgttcctgacagttgcaaaattaaataccagagccaaaaaaaagtgaggcaccgttttaagggtatgttttcctaattcgatcttcaaaggaagcacaagcttagggttcgaaatcattatgatgtaatattatgccacataataatacatagatccaatcattttaccagataaccgtcaatataaagcactgacaggacatttgggacttcgggtcaacaggaaggtggtttttcaaactaaactatattatttatggctttgattgtcatttacttttacaacataagggtgatggtaattctgctcttctgccaataaatctaaaaattaattgaaaatgtagtcaaaatccttggcacactttagaaggaagatttttttaattaaaaaagccatattaatcattatataaatgagttatattagtcctgtaaaattaaatctatggtggaaaggaagtcagtgagtgatataatcggatttcagaacacatatcatataaaaagttatgtttctaaataaagtgagtgtgaaagaattcaggatatattatcagtcatctgagttactgccctaagacagcccttctcccaaaacagatatggtttctctgacaaagaagataagtgtgccttctcatatttttattattttcttaactgtcagacataactcatatgtagttaagttgctcagaaggttaaattcggaggaaaaattctacaagtggtttaaatgagccaaatcatttttggttgcgtcatgtttcctccgttgaaaaagtctcgatgacttaaaaaggattgctttgatacttagcttagtgttttacccaaaaagcatactgaccaaaaacaaacaaacaaaaaacccataacaaaacaaacatttaaagatatgtagaccagatcagttttctcctgatgaaagtcacatggaaccacacgcaggttaccttgctttcagcaggtccctttccttgggtgtgaattttatttgttacaataaccgacttggcctagttactcagccatccttcgttcactcttggtagtggacatggcaagatggtgggtaaaaacacgtaaacaagactgctctctcgtggaggtcactttcacatggaaagactggacacgtcaaaacacttcattaacatgatataaaaataatacaacatgtaaagtggtatcggcgcatctaagacaaagcgattcaatgttaaatccctctttgggaaataatttaagattgcagaaaatgtttctgagaaattccaatgtaaacgtccttaaaagtccctactttttagtatttggtattatacttatagattttgtgattttccagatttttcattaaaagttaatatgcataaaactcttgggatggtagcaagtacagagtgaaatctatataaattattattattatcaatatcttttggagtgaacaaattgaacattttttgaataatcttttgcgtagttgactgaatactagttaataggtttctattgttttcttgagttaaatcagaagcagatattttgattgactgtgtaaggtcttgcagcttctatggttttttttaacttgaaaaggtcttcccagactgatacctctttctgtcttgaactctctgttcaactatattctaaagccttaaaatgaagatcttcaattttataactctggatttaaacttttctttcttattcttttttattttacaaaagaaaattttaactctttaggttgattatatttcttgatgaatgtgactgtaccaagaggctttaaaaaaattgagattagaaatcagtttttcttatcttctgaattattcaccatatgatgtgttgcatttgagctttatctatgcttctggtaatatttctgtcttatataattgttaaagtataatgcttctcaccaggaagactatatatatatatatgtttaataatagcctttttaaattttcatgtgttttttcttctcctttgttttctgatttttaaaaaatcagaaaaatgtctgaattgtcactttatctgtagattcaaagagcactttctaatcatgtgttggcattagcacaacaccggggaagatctgattgctgtaagccgttcattcattcagcaaatactgactgaatatgcagtatgttgacctgtttgctgagggcctctctgttccggctgccattctaaagcgagtcaagttttccctgtaacttttattctgcagaagtaacctgtacctttttccattctcttgccattcaccactctcctgacctccctttgcgtaaactggtttaagcctggcgctctaggtccatccaacaacaccggtctattcacactgtagcagagcaaccaagcagttatacaattttcatcttaactactagtaatactatgctataaaaattttgaaacctagattttgagatattgagcaaactaaaatatgtagtatttactatagtgcaagaatacgtctgacgggttaaatgcacgcgttttggaaagtgctcaaacccttcaccagatgacacagttatagcacaacaacagctgaggttattgttatctaatctcctttccctcgttaactttagcacagagaactgaaataattgggtgtgaaggcatcttgataatctaccaaaaaggctcatttttaagcagccaagcgttgctctcttaaacttttgttgtttagtagcataaagtgtaggcaacctgtatgaagtataaatatctggtattaaaaagacccagtgaggcagaagtcgctgactcctctcaataggtggaagaggattctccatgcagccgaaggcttaatgaagcacatttccaccagccaggctgctgcctctgtggtgttacctcttcagaggactcagtgcctctgagaagctggctgtcctcagcgagaagtaagtacagggacttctgtttagaggagactagaatgaatatttatactaataaattttctccaacatagccaaaatctcatttgaatatgtttttctttctgtgcatttaaaacacttgccattcttcatggcatcccatgcttgtactcttagaggatcttcacgagtggcacagctcttggctagaatcctatttttttttttttttttttttttttttttttttttttttgagacggagtctcgctctgtcgcccaggctggagtgcagtggcgggatctcggctcactgcaagctcctcctcccgggttcacgccattctcctgcctcagcctcccgagtagctgggactacaggcgcccgccactacgcccggctaattttttgtattttttagtagagacggggtttcaccgttttagccgggatggtctcgatctcctgacctcgtgatccgcccgcctcggcctcccaaagtgctgggattacaggcgtgagccaccgcgcccggcctagaatcctgtttttgctatagtttgttggactccttgcggctaatccttgcagctatattagtctctgagggatgctgaattgaatagaacatcagaagatttggagcctgacgggtttatgttgcccctgtcctcaaattcaactattccagaaaaaatgtactaggacaaggaacctgaaaagaagaactatttctaacaatggattggatgaactctcccattcaaagcagaggatataattcattataagacttgtaatttactttaaccactgggaaaacatctcagagggaagagagaaaaactgaatttctgattaaatttaaaaaatcaaaaatttaataagtaggcaaccgtataaatgaacagaaaaaaacaaaatatcaccgaaactttcagataatgttctttgttaaaaataagtttccctaaattataatatgaatatataaagagaaattagaaaatataatgagaacattaccaggcctttttgttttctttcttttttattgtgtttttgtttttttgaggtgggaaaatctttgaaagtaagacccttgattggattcaggaaagtgaaagctttctgaatttttgctcaaataatgcttctctaaggtacagaatttaatgctgaatttatgtctacctcacctgtatagggaagaggaaaccactgcttttttggccaaaattcctacttggtaaactagtatatttccgttttgaagaccaaggtgcagtgaagtgtggtggagttccatatggatctgttatgctgcaaacaccaaagtaaaaacccgtctttgctggttccccgtcatttattcagcaaatatcatcttaattgaacttaagctgaaacgtgagttcttatttgccaatactcagaactcaacagttgcagaagtgtttccttttaactgcatgtccatgtcttgagtttttcagaaataatacagaaaaacatattttgaaaacatatttatctgtatttttccacgtgacagtggcagtttaggatttaacaggcatatccataattaaattgttagtttgaggaacttccagaaaattatctaatgcaatcatatatcacaagtcttctttataaaatacaagtgcaactcatttcattatgctatccatgtagttagacataactgagacctttaaaaatattataaatgacttaaaatagaaaatgttagaaacagtacaggcatattacaaaatcatggtttctgaaatctaattactatatgcaatttaaaataattaaacatgattagtctttaagatgaatagaaccaattccaactttagctattatttaattatagcatgctgtacattaaaatcagctggaagatagccaaaataagctttaaaggacagcatgataattaagaattgctatttatcttacttttattagaaaactcaatgctggaatgaatgcaataatgtcaagaaatatgaatttaaataatttcctaaatattttactttctaatcccaaatatcaggatattttaaacttcctcatcaattctactttatatacaaaaattcatacagtattaattagaacttttgctttcaacacagatatcttaaagacaaggaattatgtatttataacttcttaataaaactatgggtacattcttatttttgattgtggcagttttttcataaaaaggctactgaaatcaggcttatttaaaaaatactaataatgttatctaatatagaacagagggtaggaagtctctgtaaacaaacctatatctatatcaagagtgattctaagagaatattctctcccttacccaggtactcaagttgtagggtaacataactagtgtaacgtaactagtgatttccagtcaccttttaggtttacttaggaacattaaaagaaatgctgccattgtagacttcatttcaattatttaatctctttccagttcacgacctttactttcttctggtttcagcaagaaaaacaacttcataagtgtcttacattataatcggctactaatcatcatcaactcaacattagttttaaacagtctgattccataacaaatttgtaatagggatattttctatacattttataatagccatggatagaaaaatagtattatttatatactaaaacattcaagttgttttgtttaaaacatacattgtaaaattttccctcgggaaatttggatttattataggacagttgtagcttttatgaaattgggatcctgaagccatattttcaaatcagaaaaatgaaagcctcattgttgtttttcaaatgttttaagtttccttgataaaaggcagtattaggacttctatttctaggtcaagtctatatttacagtaactaataggaaaatattgaagtctgaggttaccagtacaatgtctgaatgcaaaattctggacactggacaaagtactttagaatcagaggccagcaaagctctggaaggctgtgaacagggacaaatgcaatatggttcagcagacagaaagtcagaagtaagattcagatgtagccaagcagggtgggggacagtgaggggggatgtctagctggacttgaagggcgtatgaaagcagctgtccttgcaggggagatttaaaggaaatgactcttcagggggcactgcatttgcaaaaaaaaaaaaaaaaaaaaaaaaaaatctgatatagtatgttttggaaattccaaaatatttgatattgccagcagaagagttggaaagtggcagaaaataagggtctaaaaatagccataagcgaaagtgcaaagtcttgaaggatagagattatgtctctgaacctggttctcaaaattgttgaattattaactatggagatgcgctgtacagaattgaacttaaaatggtcatctgtgtatagcatgtcatcttaaaaggttactaaaataggaaagaacttgcacaggtataaagtgtgtgccattcctcccgtgggctaagggtcttgtctcacttggtgccactatcaatgcaacaggcacagcagtcgggtgtgccctggatatttctacacctcattcttctaaaagctcccccaagaaaaattaataggaaatcaggtgcttgctgcaggtctttgcactgtgtcaattctaagaaatcctttggcagtgtaaagctttgaaggaaattaaattggagagagattttctctacctttcattcagctcatatagaatcccttacttagctgatatttttgctcatagaattggactcagaactaagtctgttcatttagctttcctttgaatgttaaacataatgaagtacaaggccgtcacctcaccattttatcccctacaacccgcataggcgtacacttatcaccaaacgtttgcacatgtttggctccactgagattcttagtctctatctttatattttgactattttgacatttagaacaaaagtttggaaaactattctcctactgctttagcattctcttatcttagggcttatgaacattgctacatctctgaaacaggcggttcctgcccatatctatcagtgaaaattatacttaaaattctgaagagactcatgtcatccagattttggaggaaaaaggtagcaaataaaaatatacttcttagaagtagatctcagttactacttattttaaatttcacagtagattccatcttttgtagataggggttttgttcaaagtttttgaccaaacatttttattaaatattttcaatagtattataagtgatctgacatttttggtaacaaaacaaccaaagaactgacttgagtaaagctgaaatgttgctgaaccagaatctaatccttactccgtcattttcttaccagggattttgatttgactgaccagtttcaatccacagtaacagctttgttcctaagagactataaatcaaggaaatactcactaccaggcaattcctcctgcaattcggggtctgtgctgttattatgaagcaactgacagcaaacatttgctgcaagtatgagcgcagatttggatgaggtgtgcggtgtttttggtttcactctttatctctgaaacctatctgcttgtgagaaaaattgtgcaagaaaagaagttttactgccacatacctcagctgtcctagaactcaatgcagaggcttcgcttcctttctttccttggattctgagccgggggagcacaatgggggtcttgtgctctgggccagcaaggcatgcagatactcggaaaggaggtgtgaacggcttccaatacctacactgtttgctttacaactaccccaactaaatcaaacaggacaccaagacactcagtccagggtaagcaagtacaaaatccactggctattatgacccacatagagaacagaattcttcaatttaagtgtgtacatagctgtgttaagagttaaataaatcatttacgaggcttaaaaagaaatgcttctcatgtagttctttttcatgtagttctctgaatacaagtcaaagtgcaggtcacgaaagaatccattgttcacaagcgagaaatgttgttggctgtgaggacggttcagaacaagccatcgtagtctgctcaaacagtaaatattggttttaaaaccccaaagcatatcggtcatgttttttatcttccaattgctagaaccaaaattcactgaaacaactctatgtctctgatactattttctagaaatgtgtgtgtatgcgtgtgtgtatgtgtctgtgtatgtttgtttggtaaatccaaatcacacaatcaacgtaaatctttcaggctaagttttgccccagttatttttatgctgtgctttcaaaaaggtcaaaaaagcttacctctgtcagtgtactgggacgctcaggaagccccttctccgcctcggcctcagcgtgcagacatatgccctgggagcccacaatctgttaacaggaagcaggtaaacccgagagcgtccgcctgcgttccagtccagtgcccgtcccagcacacacctgctttttcagacctgccgctcatatgccacagccacgcacaggaccagcgttagcagagtgcaacaccctccgtttggatccctcgttttcagggtaagcagctagggagctgctgagataatattgcagggaaagcttgccttcccaagacaaaaacctttgctgctgcctgatagcagatatgcagcattatcactctgcattccacattctccaatcagctaattggaacggcagtcaacagcctgtccaaaaggcagcttgcaggcctgcgtggctgtgatcattgtatactaacatgcccattgcttctctcttccctgaagagatgtataaaagaggcttcttccagggcgaagctcagcagaatatgccacactgttttccataagtaaaatggctggtcctctcagctctgctgcagacagctcattgggttccactggcttttcgtagccatagcaacaaccaacagacagacttagcaagcatggctgatcatgtgcagcacactcacacagcttgttaatttcttttcatcaaactcatcatttttttgaggagggtagcttctgttatctttctacacatttcaccgatagtgcaagtgctccgatttttctgctctcctgaagaactcttttttatatgagccggggctatgtatgaaatcgaggaagtgaagccctattagtggctatccaggttaataacatgcaaatcacttaagagaccctaactggaagcattgtcaaaacaagccccaccttccagtcatagaatgagtgcagagagctgcaaacgggagagttacactttttgtttttaaatgataatcttagagccacttaattgaaacaaaaccctgtgaattgctatatagggtcagaataataactaaatcaggtagactattttaataagatctttaaatatccatttacttatggctcaacttatctgattactttaagatgctttttatgcaatttaaaatagaatttttaaaaaatcctattgcttctacggcagaaaatgattctttaactcaatcttatttgtaaattaaaaattctttttaaaaaatccgcacctaattaaaaattctttgactttaaacattaccttcaaggcaagaatagttttacttcctcagtaaaatggatcacattccacccgtccataacatttcacctcctctgggaatctaccatgattaatgccatgaacaacgtaaatcttctgcagaacccccaggcttttcttctttttcaggactctatcaccagtcatattctatctgatatatttccaaggcactgtcccatttatttttgtttctagcaatctgtttcaaatagttatgttaacactttggacttgtaaatatagatgttctatttgctaagtagtcattgatttaggattccgtcagtattgcgtttccctacccatgttaacactcctgccttcagtattaattcccaaattttgactgcataggaatcctgtggatgtagatttggggatgcccgctccccttcctccccaaccggattcacattaggtaggtctgagccacccagggtcagcgtatccatggaggacaagtgggtggcgctttcctgcttgggagagtcctcaccgcttcagatcgcctccagccagcctaccttttctcactgaagttcccttccctgaagttattttgcatttgctgttgctgagcgtgcccctgccttcgccctcagcctcccattctactattcactgcccacgtttcagaatcctgcattacacaccatttccttgccctgcagatgctgctactattaaaaaccttctcaatctgactgctcctcgccccagcacctttaacctccatcccaatctgcctcctcttttatcttccaacacctggcccaaatggaccacctcactcatgactctcccaggtggggtctgagcgacctcttctgcgactcccctgtaccggggtccacctctgctattacaggccttgtcacgccctgggacttcttagcagttctccttttatgtctgactcccagactgttctatcaactctctggaagccaatctggtccatgtcttctttgccctccatgcttggaatattctaatttctcaatgcctctaaatgaggacctacgacactgtatgaatagggactgatgactggctggtgtgaaatctgtgttttaatttacttttcaacatcacacatttgttgactcatcacttcagaagaacttcagtgattttgacaaaatgctggcatgttacaaaaggatatcaagaaaactctaggtgcacttgatgttttagggtggcttttcttttcattgtatctctgaaaatgtctttataccctcacacttgattgattggttggcaaggcataagaatctctggccgtggctcacacctttattcccagcactttgggaggctgaggcaggtggatcacttgagcccaggatttgagaccagtctaggcaacagactgcatctctacaaaaaaaaaaaaaatcaaacaaacaaacaattagccaggcatggtggtgcacgcctgtggtcccagctactcgggaggctgaggaaggaggaatgtttgagcctgggaggtcgaggctgcagtgagctgtgatcacatgactgcattccagcttggcaacagagggagactctgtctctgtttttagtagcaaaacaaacaaacaaacaaacaaacaaatatctgaagtcattttcctttggaatttcaaaggccttcatccttcttcttgtatctcctcctcccctatacctccaattcctgctcctccaaagagaactggaagtcccccagtttgcactgaaccggaactgggaagctggcaggaactgagatgaatccctttcccctctttgccccgtggcacgtctcccggcatctctactggccttcacacatcactctgctgccagtctgttcttccaaggctcttggctccttcgcctgctcgaagcccctcccttgtaacttggtgcactgaggcccattggcattgctctgacctcaggccctgccctagcccaggtccctgacgtttattctccttccaaacgtgtttgttttaaaatgtgctagatacagatttccaagagacaaatctgatttttccagcccatctttctgagtcaagtgagataccacctatgtggccagcagctttatacatgggctgccctgtgccttggtccaatcagctatgacaaggacacttggcattatctagttttaaaattttgctaatataataggtgcagagtaatggcccattattgtttgaatgtgtgtttctctaattactgacaaattgaacatcttttcattgttgatggttttcagggttccctcttctgtaaattttctgttcatagcttttgcctgttttctctattgagattgttgtcttagtgtggaattttaaacaacgtggtcataaaggtattttttatatatatttaaacattataattaaatttgttatattattaaaggttattaagatatccactaacatataaagggaaccctataattcacactgctagttgttttggtttttattatgaaatgaaaatacagaatgtgtgtgaaaatctccattcagaaattatgttcagtatgaaagcgtagaataccacaccataatatgattttctaagacaaatatttgtttagaaggattttcaaacaaatatattatcatcaaagaatacatatacacacacatatatatgctctaatagtatacgcacacacatatatatggagagagagagagagctatctatctatctagcttctattttaagttataccgtatgcacacctacacatcaatcaatctacctatctatcatctgtgtatcatctatggaaggcaaacacaaatgtgcaaaatgctaacacctgatgaatcttaaatgagaatattttcagtttattttactattctttgcacttttctataagtttgatttgttttcaagatacaaagttttaaaaaatgaaataaaatgagaataaaaatagtgtttagaatagacacagagttaaggttaagattagttgatgaagacataactatttatcagagttgaaactaaagaagttaataagttatggagtaactaaagtgattactaccattactgttactctgaggaggctactctggtagagagtattggaaacattttgcactttcttgaaacaagtttgctatttccctacatttactgcttccctgtattctgatcttaaaccatttatcctctggttcgtattttgaaatccttattagtctgtttccttaattcaacaaaatcatcactgcttgaagcaataggttcttctctagtcacatcttctgctgcagactccacagctgggacccaccaaaggatctggtccctggcacaacaaagaaacacgtcatatgacttaacttagagactggaattgaagcatggtttatgaggtagcaaagacttttgtaaagcttagattgaattttctaattcctaaaacaaataaaatagaatatcccaaaggttattccaaaaccttgcatatttagttactctcacaatgacgtgaacaatgtcaaaataggacattgatgggaaatgtgacaactgacttaggaggaggattgaagtatctcagtcaaacaaattggatttatttctatgattccaaccccaagaaatatatgctggaaagcagactgacccacaggctactaatcaaatgcgttcatatcccctgaagaagtatgaccctgatcagtatccagaatgacttttataaatcagaggtgcccaaaaccaaaacaaacccagcagagttgagggtttttggaaattcacttatcaaatgaatttaaaatgagaaaatgattatagaagaacaaaaccttgccagagagcaaatgataagaacgtaaacatcagcaataaaaaaccgttcaacaaactggagagaaagccaaacctattaacacaaaaacactgtgtgtagcccattagttgttcctagaaccccctagaaattctgtatactctctaggttaagaggaataaggaaaatgtggcaagaggtacaggaagaagtttcagctagtcctaagtctggagagcccggtctttactggctaataataacaacattgttttaaatatttcaggtttatcaagctttgggtttgcaaatgactatgattgcagcagcttacaggaactactttatcgtaaaatgtgtgttaatatgtgtcagtaccaggtggggaaaaaataatggtgttatccaataataacaaaagaaaaaaaaaaccacccacaattaaccccctcccacagccctgttaaccagtcccaaacatataaatacatcttgctgtagctagagaaaagtactcctggcttttattaaacctgcagtggggagagattctgcaagcaatacagaaaaggctgcacttgctcccaaggaatttgactgtttatacttcataatgataagcttaaaaagcgacctggaaagagagggctggctgctttcatgctcctgtgaggggccacactttgttcttggagaggcactctgaccacattaatagagtgtagctcccatgacctttcccacttagcattgtgtcctgtggcagcagtggcccccaggtacttccgggcaacgtgccaccctacccagtgcagaaaaagcactgggctctgccgtcacggcattgttgaattagtaacgaaacgcaccaggctcagcaaacaaaacctggcaagaaggattttaaaacaaatgcttctggtttcacctgagccactgaaacaaattagaaggtgctgggtgaaactgggcagcttccgtaaactctgaagaagatcatgctaaagccctcagctgccaaatgtgcaaatctcaaaagaagtgaaaattagagggtcaccttgtgtcttctagaagtgcttctgaaatacatgttcagtaagattcattggtcaagataataagatgggcccaagtgatgtattaatacaatcaggtacacgttttaggatccaacggtccaacaacaagtggaaaatactgttgaaaaataaaaatccccaatccgcactggaaatagtagatgttcagttaaaggcctgacagtgacagcacgtgcaggtaggaaaaataaactatgcgtgcttgcagaatattggatgggagctataacccagaatggtaattattttactaagcctacccaggtcagaattcagtgcctatgtgtttgtttgtttgtttgtttttgagatggagtctcgctctgtcgtccaggctggagtgcaatggcacaatcttggctcactgcaatctccgcctcctgggttcaagcgattctcctgcctcagcctcccgagtagctgggattacaggtgtccgccaccacaccaggctaattttttgtatttttagtagaaacggagtttcaccatgttagccaggatggtctccatctcctgaccttgtgatccacctgccttgccctcccaaagtgctgggattacaggcatgagccaccgtgcccagcagcctatatttttaaaagtcagactctggcatcctaattgccagatcattgccttgaactgagaacattcttctggacatttcctgcatcaaaggaagactatttgaaacattccttgtgagaggtcaggagatcgagaccatcctggctaacacggtgaaaccctatctctactaaaaatacaaaaaattagctgggcctggtggtgggcgcctgtagtcccagctacttgggaggctgaggcaggagaatggcatgaacccaggaggcggaggttgcagtgagccgagatcgtgccactgcactccagcctgggtgacagagcgagactctgtctcaaaaaaaaaaaagaaaagaaacattccttgtgaggtttaaagtagcatgacaaatcattccacaaccaactttcctataggcataaaggtagattttaaaaaatttatctgagagctgatacctgacctgcatcttgaaggacccattattctcttggcatgtggactctttcctatatctttccttcattaaagacatggtttgcttccaacaattggaagcaaactcaagttgtgtttcaatttttggtaacacatgagaaagtcttatcacaggatcaggattggctgcataggagagaaagctcaaataacagggcttacaagagacagagctatatttttctctcacttgaaggattgagaaataaggagttctaggctagtagaaaattggcctcatgattattaggactctagctcctaccctctgttctgtcatcttttgaaactggtttctatcctcaagaatcctcgtggtccagaatggctacttgtgctccagccatcaggtccatgttccaggcaagaagaggagagggagagccaaggggcacattttccgcttgagttggcctctttgaaggagcttttccccacctcccacccagcacttctgctgatatctcattgcatcctgagtgataagtaagtctcaaaaacgtggtcttttcagccggacgccttttggtcccaggtaaaccagtgttctactactgagaaacaaattgataatagggagtggatagacaacaagctgcctctgccagctcatgtcagcctgggtacaaagaaagtactatctcatttctggacattgtcagtgagcctttattcctggctggtcacctgtcagtgcagggatcacccaggctgactcggtgggttgcggaagcacccttccttcattcctgcctgggggtgtccttgcctatccagccactgtgcttaactcctcagcacagactcaaagcattgccatctctccttatactggtttcatatcaatatctcaaagtatacttgttcattcactgtggaacaaataaataaatggtgtggattcaaatattctgcaatttgttagctgtgtgatatgcaaattgcctaacctctttgtgcttctgtttcctcataagaaaggatgataatattatctaattctgagggcggttgtggcaattaaatccattaattagcataaaagggtattaggtattatcttgaattttgtatctttgatttatggtgcggcactgggtgggcacggacctccgggaccttccaataccgtgggaaacatcagctggacgtggaccagagcgtcaaaaagcaacacaaatgcatgtgttcatcaaaagaatggtccagacggtgagggccgtgggcttcagcaaaggagaaacaggcactagtgtcatcagtgggaacttatcgcaggctccctgcaacctcacctggacagcgcggcgctgtgtgaacagccagcaggaggccttttcgcttctgcctcctgctttccttcccggctgatgtcctcccctcccctttaatttaaattggcaccagtttcctattctctcggcagccctagttctttccctcatttaaccttttcatagaatctagtggggactttatcgaccagatgccaaggggctgccagggcagggctggccttcagaggaggggcatggtgtgcccaagtcctgcagttggggaaggagtagggagctgagaccacagagggacagggacagaggctagggagcagcgtgcgcggacaccttgcctgcggggaaggcctacggaggccttgcagacagcgtctcagccgacacacagggccctttaagaaaagaggcaccgtgttctttaagagttctgtagcagagtcctggcagtcccgggacttcacacgctgcacatttacttgtgcttttatttacttaatctctgtctgtcccgcgagattataaactgcaggacggcagagatcatttctgttttgttttgaccctgcttccagggctcagtatcgtacctgggctgtggaggatacagaaatgccgaatgaacaaatgaacggatgactgggccacatgggtcccaggtgaatgaattctatctgccccttaaggccatcccttgattcaatccgacaaacatttcttcaacctgaactaacccaagaagatccgcatcaagggtcagattactaaagcactgcccaccttctgggtgggtgaacgtgagggaacaaatagtgatgttccagtgtgatttgcccacgcccggggggcaaggggagcagagggaacaaatgaaccgtcccgcgcctcaccaaggggccacacgcgagctaagtggctgaagaggagttcgcctgcctgggaagccagggacaggacttccaggtggaggaagtggcagctgtgactgagaggtggagtggcacagaagcctgtgttgtggcaggaagcagaggcgaggtggacagggtggaagggtcactgtttgtcaaacaccttgtttttcgtggtaagaactttgggccttatcttcctggaaataacaagccaccattgagttgtttttatgtttgtttctttttttgagatggagtctcgctctgtctcctaggctgcagtgcagtggctccatctcagctcactgccacctccacctcctgggttcaagggattctcctgcctcagcctcccgagtagctgggattacaggtgcccgccaccacacccagctaatttttgtatttttagtagagacggggtttcgccatgttgaccaggctggtctcgaactcctgacctcaggtgatctgcccgcctcagcctcccaaagtgttgggattacaagcgtgcaccaccacactcagccccaccatagagtcataaaaagaacacagatgtgatcattcttgcattttagaataggagctctaggacccatttacctgggaaatacattttaatggagtcattcacatggtttgatgttttggtcgcttttattagtcgtcattattacgaaacatgtctcgaacaccttcttctgtgcaaggtattcatattagttgcccgaggagatatcaacaaaatgaaggacccataaattataagacataccactattttatgttccaccaaaaaggaaaaaaactgctgccaatgaaattgtaacacgatgttattttttgagtcttattattatttgttggaagagatgtttcaaatgtattgagattaaatttcatcctctatcactctgtgtatagaaaaaagaaagaagtgaaattagttggctacaatattcttaaaattcttcacctgcagtattcagctcttctgaatgacattactatttagggtttgacagtcatcctttatctagtgtttccccagttgggtgtgcatcagcattaccaggaaaagtggaggaaatggaggcccgggccacatgccgttccaacaggcctggagctctgtattccttgttggtaaccaaaagatcctgagacccccaaagaggaggaaacgctgcccagcacatcaggagagatggcacagcagcgcttctgaagtgagtgcccgcttctgttttcagtattttttgtattcggtgagttttcacagacatgcatatgacaaggttgacacaactgccatgtgcctggcagagacattgtttctgggatattagaaaagacatacgatgggaactttacaaaatatgcaagaagtatatgaatgataataacttgacttctatgaacaggaactaagtagattgtggcacagccacgccatgggagatgctcagtgttgaaaagtcattatgtagaatgatattttccacagggtgttccaggacaggctattctacaggggcaccacaggcaaaacaaggttgggagatcctgcaaaccatgccccttgcctagagtttcagagtgcgctcagcattctgagagttctgagaacgccgggagtataaagattttacattttaagctagaattttccaattatggcattaaagaaagaaaaggaaaataaaaactcgagaccccaattcacgatgccaaaggaaaaaattaagctgaaagctgagtcatgcaggaagctgcctttcctttttgttcctaagcagaagctacagatagaaggtttgatatctccacaggtagctactctgtgtttgccttatcttatgtaaagtgccgttttacggagtgtcagaggaatacgtactgactcttcccctgcccgctcctttcctcttgcaacaagtggattcagtgatgtgaccataccttccttctttcccctccggcctccttttcccctttatgtaccgaagtcctcaaaatcatctttggagaaaggcatgtctctcaggcatgtccttaaccttggcaaaataagcttctaaattgattgagacctgtctcagatgctttttggtttacaatgttcacattatattttaaataaacagcaacaacaataagcccataaaaatgtatggtggcaccattccatttttgtaagtaaaattttggatatatagtcataggaaaaagacaggaggtacactcaacaataacaatgtttaataacgagggattgagttatgtataaattttcttttgtttatttgtatattctttagtaaattgacacattttctgaaagaaaatggttattaaaaatagcaatagtaaactgactttatgaaaagtcagagaaagatttgagttttcctgatatgttctgtggaggaagctttgatgaatattaaaaaaaattcagtgagaagatggagacttgttttatgaaacttctcaatttccacgagacaggaaaaaaagtgttattagtcacacatcacagtcagaggaaagaagaacagaataaattgggcatcatgtgtaatttttctgtggtctttttcaaggccgtgcatgcatgaaatagaacattttaaatcaacaagtcaggctggtttgtctgcggttcgataaaaaggccaagcagagaagcccgctgattggatctcagaaattcgtgaagctactaagggaagtcaccttaaagatagcagctgataccgtatcttagggtaggaatacctcttacaagttaggtcatcttgggcagcctacttaactctcagggtcctcatttttttgtatcaaaatggccatggttactgcatttgctccctggaggtgtcgtagcaaagtaccccaaaccgggtggcttcaaacaacagacatttttctcacagtactggaggccagaagtcagcagatgaggtgtgggcagccccatcctctctctgaaggctccagggaggatctttccttgcctctcgctactcctggctgctgccagcaatcttggtgtttcctgacctggcttgtggcagtgtaaccccaatctctgcctccatctgcacacacatcttccctgtgtgtgtctgtgtacagatttctcttttcttataaggacaggagtcattgaatgagggcccaccttaatccctatgaccccatcttgccttgttacatctgcaatgaccctatttccaaataaagtcgcattcacaagtcctggggttaggacttcaaagtatcttttgaggggacacaattcaacccataacagttatggtgttacagctataatcctttctgggaaaaaagctgttgttccctatgcagttgggtctgtgaaaaaccaactcagggacaactcaactgaactcaattcatacatcgaggaattcccaggatgctggtggaaaagatcaattaaactgcatctctggatgcttttttttttctttttactgaattggcagaaagactcctctgctagatttagagtgaatctaccattataaaattgaatcaacaacaaaaagggataggtgtgatatgttgaaaagattctaccaaatctcctctagactgattgctctttttagaagaatcttccagggtaacatctcccaacccacactctcatgccaaagtgcatcctggccccacacgggtggcaggcgggctgatccctacacatggtttctgagattgatcagggggcttccaggttctcttcagccatcagtttctgagaggaacacctgggatttcattgcatctccaaatacaggcactgcttcttaattcaggctctccgagattctgcaccctcccctgggtataggtcaggtcctagtagcagcttcagaccaccagtaatctaaagcagttactgcagctttcaaaggcctaaaatctcagagaattattaggcacatggggaatatctttatttgttcattttgttctgttttttgtttttttttttactgtactgagtatcatttataatttcaaaacagtgcaataacagtcaatgtaatttattagcagattaccatgtgccaggcactagctacaagttttagaaatattaaatctcttccttatagaaaacctgccaaacaggaattatttttatttgacaggtgagaaaataggcttaaaaaatgtatgacttccaaggttaaagaatcacctgattttaatactatgcagaatttcttacttcagcactgttttaatgaattgtctgtaaatgtagaaactcctgtttgttttatttggatcagattcctgaaagtcgatcagaaggaaatggtgatgttcccagcatttctgttatttttctttttgccattgatctaggataaatcattttgatcacttttgttgcagtttctgtatctcagaatactggtattatattttttgttgttctcaggtcctgtgcacaggcctgtgggaggggagaaaacattatcatgatctagaggctagattactttattagcagcaataccacttgaacatctaactacagagtcactcctgaggttaatgaaataatttttgtttccagatgttctttacattgggcctaagtccactgtgaagaaaagaagaatggttttgattttctcggttgcgatgacctagctggctcaagacttcctcactcggtggctatagactatcttcacctgaaactcctacaaagtgaaacatcccaggtcactccaggaagtctttctgcggttaaacaagctggcctgaaagcatttaaagtccatggcttaccaagccaaacaagaactccattcaagcaaaatctaagtggagaagcatcgtttcagtcagccacattttaatcagcgacacctcatgaaatgtggactcagacaaaatattttaaaattcattttgccacatcaatgcatttatatcataagcaatatccctcagaggtcatgtgctctgcagaagtagggggattttctccacagtttttcttcatattgaggacttggtggaaatgttttcactcagagtggcccctcaggcaccctcacctagctgaggtgcctatgctcatcgaccactactacctgttcttcaagctaccctggtctacgatcaccacaaatccaggacctgagcagagcctatcagcatgtcatggaaatctttctggagttttcttataaatcttttcttttttctttgccctgtgcattattcataaacaagtcatcctagtctctaaacagaacaagttggtcctgtgagctactgaggatatgcgaatgtactgcaagacacacttcacaatgtgtgaaattatgattaccttgcaaaatcaggaccatcaatatatactgttttttctcttttttcacctaattcactgggtcagtaggaaaaaaatggaaggataagaggccaatgaaatcacactaatttattcaacaaatgtttttcctgacttctgtgatgtatagggcactgtagtcaggtgaaataacagtaaaatgggaatcagaagacaggatttactataaaattgatccctaattatgtgaccatgagcaaattcctgactttatgtccctcggttcttttatttgtagattgggagtgatttaagcatctgcccactcacaaactattatgaggatcaaatgaatctttttacttgtgagataaaggacaatgcaagtgacatgcagtggttttccttctccactgctaccactgtaccccacccctgactacgtcatcatcatcatcaccatcaccaccatcatcaccaccatcaccatcatcatcatcaccatcatcatcaccatcatcaccatcatcatcaccatcatcgccatcatcatcaccatcatcatcatcatcaccattgccatcatcatcatcaccatcatcaccatcatcagaatcaccatcatcatcatcatcaccatcatcaccatcatcaccatcatcatcatcaccatcaccaccatcatcatcaccatcatcaccatcatcaccatcatcatcaccatcatcatcatcaccatcatcaccatcatcaccatcatcatcatcatcatcatcatcatcatcatcatcatcatcatcatcatcatcatcatcatcatcatcatcatcatcatcatcatcatcatcatcaccatcatcatcatcaccatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcatcaccatcaccatcatcatcatcatcatcatcatcatcatcattgtcatcatcatcatcatcatcaccaccatcatcatcaccaccatcatcatcatcaccatcatcatcaccatcaccatcatcaccatcatcatcaccatcatcaccatcatcaccatcatcatcaccatcaccatcatcatcgtcaccatcatcgtcatcatcaccatcatcaccgtcaccatcatcatcatcatcgtcaccatcatcagcgtcaccatcatcatcatcgtcaccatcatcagcgtcaccatcatcatcataccatcatcatcatcatcaccatcatcaccatcatcatcatcatcatcgtcaccatcatcatcatctcatcaccatcatcatcatcatcaccatcatcatcatcgtcaccatcatcatcatctcatcaccatcatcaccatcatcatcctctgcattaggtttgttctctaaaaacacggtaaggaggggatttactgaaggggctttggggatgtgtccttagttatcatatctgtaagggagcaggagaggaaaaattggacaaagggagaaagtaaactttgataaatcttcagcagaggccacaggatgctatggtgctgagataacaccttctagttgccccaaaggaagacaaggagcctggaccttgggagccctgcatccacccactgcctgcaggctgcccacactaggagacgcagaaccagaggaggccattcttggagacagactcacttgtgagccctcagcaatgcacactctgggagctgggtgagtggacaccttagttctgaaagggagagatgagggattgtagcatccactaaaatcatcattatcatcatcatcattatcatgggcttgaaatggccttcaagaaatccttgaaggctcctggtcatttcgtttctataatacaacaaagaaagaaaagacagagtttccctgacaggtagcacaaaattaaaaatattagagcttaacctcagggaaggcagggaaccatggctcgcccaccgatcacagcaacacgagatcctaaatgtcccaagtggcagacactgtacatcaattccatatcaaacatccctcctccccacatcaattgcccctctactgccattccttttattgaatgatagattcccagggtggaaaagggctttgcaggtcaggcgattcaagtcactatccagccacactccaagatgggccatcccctgtggtggaggcaactacagtttcaagcatcctgttcttttccagagacttctccaagtgtggctggaatctgccttctcacagcttttaccattattggtcccattgctatgttatgggacaacacagatcagatttaatccatcctccatatgtgacacatacatattttggaactgcgctttttttgaaatgtgctcagtttccaaaacttgttccttttcaaagccaaaacctggcctcaatccttggaatatcttcttttcctcttcaattgcgaagattgctccaagttttttctaatccatgtaaaacaggatggggcaatcatcatactcttgctgttgggcccctctatacatgtggtctaatattaaaatactggactctcagctccatgggtaaacggtgtgatgtggttggcaaatcaagctctgtttttaagccatatcttccctatccttgtactaatgcagctggcttttttgaacagtagcatagtatctatgagatctgtgtgaaatgcagattccagctattgagatcttggtgtatactaatcttttttcaggattttttttcagtaccattaatgtgattacatacacacaaagtgaacagaaatattggccagaacaatagaaagtagaaaagagagaaagaatgagacagagagagaaaagctctgttattcccatccccatccccgttcccactagacacacagacacacaaaccaagagatgacattaaaggaataaatgaggcagagtgagcatctctccagaaggtagaagaatgagttttcttttaagttttgctcttaatttctggcacatagtcattatttattaaatgggaacacctactcggtacttacacatcaagctaaaacatccatgaaaaattatttcataatgtcacaatatattttttcataaattcttaattccagccatctgctctatacaacccatggttgctaatttctctacccaacttctttagtgctaccaaaaatgcatggctcaaaataaataattggatttttcagatttaaatcttcagctcaaatgactttactgaattaggagaaagaagagtatgggaaggatacctaacactcctgcattctctatatattaattaaattaaaaatttaaatttccactataattttcccaagagttccaggccccaggtatgatatagtgttaagaggcacagttgtaatcgcatgccatttgattatacatttgtactggtgatttttccaagtcaaacggtgacttcttcacatttttttctttgatttccctgattactattattaacctagatgtagcacattgaatggtgcttaggaaaatagtgagaaaatgcacattctggttggccctctagatgctctcaaatcatagtttggagaatgagccactaagctattggaattttcccaatgaatggatttgcaagatgaccatatagaggtctgaaacccagcacacataggtgctgtgaggtgggtcagcacatttttgccacctagctctttgaatcacccactatctgattttgagtctgcaaatagaaaatggttatggaaggaagcagctgaacaaatatcatcataaacgctgaagaagtaggagcatatcttttgtgtgttggaagaggcccccttttgatctctgaagtgcaaccaaattaagaaagggagtggcttcttcggggaaagtaaaagctcatggccaaaggatcaagaacattttctcaggatagagacttgctagttccattgcttcttttttcaagtgtaacccaaatgtcttgggttggtgctgtttgttgaagtaacatggttaattatttacctttctcaccatttggctaagattcttttcttatcaaattgccctgtctgaacccaaaacaaacaccctcctgagggcggttagccatcaccttaagctgggtttgtgtgagggtggctggacatttttctactatttttctcacggcctctgttgtttccagtagccattctgctagaaaggcccagagctaacttgtgctactatatgggtacttagggtttgctgtgacttggttcttttttatttttttagacctgctctttataactcttccttatttgggcgctattctaattcctccattcaacacggtgtttcagatttcactagagaaagtagccttttatcttctcaaggtttttctgccatttgaacttttgatcgtacacttgatcgtacactctaaaatggacccaacatggtcatctagaactgggatgatttagtcattaaaaataattagacagcaaaagggatattttgggctcttctcttctttcctccaagactcctacaggagcagattgctctggccaaatgtggcagaagaagagcgggtaggtggggtggcttcaatccacagaggctctgttgctgcagcaactttcagtctaaattccatgcccagacgaggcagctattcttagccttgactttggaaatagttttctcccttcttcaagtacatcactcttgaccttttatctttactttaaaggtcttgtgcagctgaatcctttatttgtttcctcaaatcatttttaggaacaaggaagatgttagaataggaaaggaataacaaatggatagggccctgaggggttaaatcacctggccagatcacacattgagtaagcagcacctgctctccttcagtgagtccggcattccatgaagggttactaagtttttattatgccgcaggtatgtggacgggtgttggccatggagtggtaaccaagacagagtcctttccctcagggagcttacagtggagactgaaggacagttctcttgactcctaaagttctattctttccactacactctgagatgttaccagtgctttaaaaaatacatttcctatttttccaaataggactgaactgaggcaaaactgtgaagtcaacaagacctcaatgctgtcatctctaaagtggaactaatactagcaccttattaaaatggtgaaagattaaatgaagtaactccttcaaagggcttagcatagtgtctggcacatactaactgttcaataaatgttaaatagtattaccagtattgtgttctctggttttaatatgatcaatccttttattgaagagaagcaatttcaatatatttgaaacttacgaatattagttctttgaatattaacacttggtaaggcagcagctttcagtctttgcacttatgccatgatagatggtttccctaaattaagctgaatcatgttataggtagacattcccttgtctggaatcttttctaggcactagttaagatttaaaatcatctaactttatgtaaaaaccccatctgatgctgttacatatctataaaaaagattgtattattttcttagattttaagattctacctttgcttaaaagccttagagtattaaatagccttaaatcaaaaatttaccctgaccaactataataagattatgtttacttactttacttctatctatcttggctggttaaaaataaactccacattttgacttagaagtcaatgattttgatttgtgtcaaatgagagtatgggagaatttggtcaccatggacgtggtttggtcacaatttgttttggttattataggttaaagcagaatccagtgatagctgatgaaacagaattattccttttcttaatttcagtttcttatatcttaaagttactctcatcccaagcttaaaattggtctaggatgtgcacagttgtaacttttttctgaagatttatttaaaagcacatttggttaccagcagtctatgaaaccttccttgtaataattcaatttgctcaaagttctcctgtggaaaaaagtgtatatgtatcttccccataaaggactttgagagaacagtaacctactttcacagcataggttggagaccgtttctgaacaagataaaactatcattcatgattagtccgaattcaggggtaatgctgaggtctaatattttttgaaacttatgtttacatccttgataaaattcttttcttctagtgatggcagaaacctaaagcagttttgatattctaaggtctttcctatctagctgttacagagtattaaaagcactactgtacatagttggaacatttttgttatcacattttcttcatatgtggtcttaaaatggctaattccaaagaacaaaagataagttatccatggaaaatgaagtcatgattttatctgtaccaccccatctgactataactaccatgcacattgtgtccaagtaatgtgaacatgtctggttggcacagctacaatagcagggctgataagtaactgatcagcttatccacagcattcctttcatgggaggtcactgtcccctttgtttctaaaagtccagcaaagcttaagcattccagaacctggtaattcaaattaattacatggtatcatgtacatggctcctgggattatcaccttgtaatactgtggcttctatgcttttaagtttgcctaattaaatcctttcaaatgaaaccagttaagcaattagtgctactacactatgtaattaatatatgccttaaacacactttttaaatggaatggtttgaaaaagaaatactttggataatagattactacaatacacaaaatacaaaaggattatcagtttttaaaattacataactatgggattcatcatatttctccatatgaaaaatgggaattatagtatcaaattcatagggttttataaggatttacacaggacatttaattcaattaaatttaatgtttagttttcaattaatatttcatattcattctcaactaatctttatttcagttaatacaaaaatgaaaatgtaataaaatgcaacactacaatcatagtggaaataattcgtttcatatattgcattcaaaagcacttgatgtttttgcgtcatataaatagtgtctatcttcctcattggactgacagctccaggagtctgattcctggaacataacatatgctccacaaagagttctagaattaaccaatgggcagtatgaacataaattatgacattggaaatgccaattaatagatatccagatgataaaataatgtttaaacagccttcaaatgtatgcttcataagtaaacacaaagtataaaatatatacacctgtattagtcaattctcgtgctgctgtagagaggtttaattggcttgtggttccacaggctgtacaggaagcatgatgctggcatctgcttctggggaggattcagacaacctacactcatggtggaaggcaaaggatcttgttaaaccatagaatccgcccccgtgagccaattacctcccaccaggctccacctccaacattgaggattacaattcaagatgagatttgggctgggacagatccaaaccatatgaacacttaggacacattaattagataagacacatactttatggtgtattgttagcatgtacacgtttctatcatgtgcttaagagcaaaaaaaaatataccctacctactcttgaaaagtttacattcatgtagagaagaaaacaatagttaaattgttctcaaatgaggcagaatgtaatcagtgctccacgtatacccttctaccagccgtatagaggagcaactagatcatgaaatgagaactactcttcttgtttccaaaatagtgaatgtaaatatttctatttaaaataattaattcctaggttgggccttatacattttaaaactcaaaagtgatttttaattaatattatagaatatcagtatacatttgatttgatttgtacataataaaaaataatcacgttttgctagcccctacactattgtttttcaaagcatattccaaagatgtttataagtcataaaatgcacctaacatgcaaagttataaaataaccaaaaagcgtttctgatatggcttggatctgtgtgttgccacccaaatctcatgttgaattgtaatcccccgtgttagaggtgggactggtgggaggtgactggatcaccagaggtggacttccccttgctgttctcgtgaaagtgagtgagttccctggagatctggttatttaaaagtgtgcggcagctccccccaatctctccctaagtcttgctcctgcctgtaagatacctgctctccctttgccttccgccatgagtaaaagcttcctgaagcctccgcagaagcagattcttccacacttcctgtacagcctgtggaactgtgagccaattaaacctcttttcttgataaattacccatcctcaggtatttctttatagcaatgcaagaatgaactaatacagtctccaaaaacaatttttaatcattttatgagaaaggaagtaaaccatagaatttaaaatttaaaatgttgcttaatcacagaaactaaattaaagaacatttcaattctaacggtgttcaaaattttattgtcttgtttagtggaagatggaatgaaaccatattatctcacattcaggtgaacttatgacattttttcccctgaggaatctagattacaatggaaaaataatttgtcaacagaacattagaatgtgcttacgtaagtaaaaattccagtgacaattcatttgcgcactgttcaaaaaaggtgatcacgatggaaagattttaaattttgttgtttgtatttttgccaattttgaaaggatttttttttttttttttttttgcaccagcagtgttcagctattggggactaagtattaggaaacctttagccagtttatctcctctcagcaaccaacatgatgggactggagccaacactcatagttttgaaaacctcccttgaaggtgggagacttactttcccaagatgaggagtgtctgaggaggctcaacccggcctgtttccctgaagaagtcccataaaccgtctattacagatgtgaaggagaatatcaagcctgttgacatgataatccagcttattgctgctcttcttgttcccaaaatagtgaatgtaaatattcatttattattaaatatcacttattattaaataagtgaatattcacttaataaatattattatttataataatattgctggggaacccaaatacgaatgtaataaacgatgacccagagctccagtgtggtgctgattaaaaggtttaggtgaagagctacagatgtctacttgggactcagatcaagaaccgatttctcatttgcttaaaaaagaagaatcatggagcgttttacagaagcagttgggaagtgaatgtgtgagcatcatactgacctgctgaggctaactgaaagctttccctgtcacactgtctcactgtacccttccacacggctttactttctgctcaaagcagcagctactctgccattgctctcatcagagtagacagataaaaggtcagtttataggagaggtcaggtgggacacagacaaagacaatagtgattagaaggacaaacagcagaaaagtctttcataatagtttagtaaaagcaatttaaataacaacaaacaatatttactaagtgattataatgtacacaccaccaagtgctttagggaaatcgctcatttctttttcacaatgaacctatgaattgggcatgaattttatccccgtgtcacaccgagcctcagaaagtttcataatttgccaaggtcacacaaatagaaagtggcggggtctctattcaaacccagctcatgaggcaccagagcttgacactacactgtgtaactataatgtcagtcacacccaaggatcaaatacctcttgtccacattatttatagaaaaatgttcttttgaattttaacacttaaaagtgtagagacaaagaaattatgcgagaacttggagtgtaacaaaaggtgcatttttgctaaaaactggctctgtgatctagggagagtcacccatgacctcttgactccagagtcctcagttcacaaagatagctaagctgcctcgaattctaaagttgtatggtgtttctgttcacacagcacttgaacatctacttactgcccttcacttatggatatttaattatgagtgaagggttttgaagagagactttatattattcacattatacctcttgcctctgcataggacctcacattcagttctaatctttatacgcaccagaaacaaaattacataaatctaagtaaacttgctcctatcaaatgtgctccggaaaattgccaagtttatatggatttttaaattttacatcaaacagatcctatcaactatttgtccctagaaaaaaaaaagatgaaaggccagaactgcctacaagttgcaatgtcattgactttccagcaagcattgcagctgtcctgggaaaactgaacctgaaatatgtttttgaaactgctgaatttcagcttctagtgtttttcacattttagaaacagggaaactattagctttaaaatgcttgtatttaatagtttttttcttaagcatttcaaaaaccccaggtgaaaagctaagtatgagaaaggttctcatgcaatcgttaatcaaatgcaactaggttggaagaagatacatgcttattgctttgcggaagtggcttttgttctaactgaataggttgaggtagattattcctatttaaacttagaaacggaacctctaatacaattgttaacattcctgcagtgaggtcgtttcatacaaatgtaactgtgacaggctgagatattccttttgcaaagcctataatctctatgtagttaatcagcataaagtattaaaatcataaatatgaaaagaatctcaaaagaaaaatgatttaaattactctaagactatacagactatccccaaaggcataatttctttaatagaaaaaaaaaaaacccacattgctttgagaacaaaaaagattctggattcttttgtagggctgcttgggccagtcccacctcttccacttgaagttttttgtttgtttgcttttctttgaatgtggagaaagtctctagcagccttccatttcctctggtctgaaagtctgtgtccctactgaagttctacagcttcttttataacatttcccatttgacactaattccaacagatgatgcttttctaagtttgtgttgtttataatttacagcacctggttgtagccagagtcccttgcatctccccagcagggtgtgcgggacccatactacctgcacccaggcctggctggccccgcccacaggccttagcttcctgcccagcttcccggctgcagtgggcctagctataacttgctctgttcccatggctgtgaagccatggccgcagcctctgccatctcatctcctcacgctgtgggttgcctctagctcccctgggggcttgggcaggccaccatcatgccaggggcgtcagaaccctggaaattctccaccctcctcaactcacggatgcgctggttgccccaagggctgtctggggggctcacggaggagagcctggaggagagggggaattgacactggccctcagagaggacacagagggcagagccagcagattcgagatgcagtagttccattagggcctcactcccatgtgacacaacagccgcccaaaagctcttgagaaactaagggcagctcagtgatgtgtcaccttgcatttgctttgccttttttcctgccttgtcttcagtctcctttcactcttgcatcctgggatggcatgtccgctatctcctcgcatacagtattagcatgtaagctttgcctctgcctcgggctctctgtcctagggaaaccagttaagtcctagttaagtaacagtaacaatccagatttcactctcaccactttgacatggaacctcctgtctctgatagcagccaagagggtcagaatcaccagaaggtatcacgtatgctcacaaagacgtgtgctcagccaccacagggttctcacggtgtttatttctatgttgtttctttgtccttccagcaggcaccgctgctttccatggggcataaactggacatctctttctcaccctgcctttgaggcactgactcttcaaggccccaacactgcacgatgttattttgcaaggaaggggagaacactgctctttctcataacatgcagtctgtcctcagaaagatccagtaacggtgggacttatgctccccattgtgaaaaagaattttaaacttgcagaggggagctaagtcagaagacaaatgcaaatggcaaacactcggggtaacttggatacaagcctctgacttaacctcagccgctggcttggagcagagaaagagggcatggagaagatgagtaagattctaagaatttccaaatgagtcattagaccaggactgaaacagtttgagaacactgcgctgggattcctcaggctattttacccaggactcatttccttactgcagttctgaagacaatgaccctggccccaggggtcggtccagtaggagggctgcaagggatcttttctgctgcatttacaacatccacgtattctgcagtcagagttcccaagaacaagccggagcacactgagcgctccctagggaggaggcctggggagagcttaagagaggaatgtactccaagctttatgtgcttgtaatttgtttatagtgctgtaaagagttgtttttcgatgggactgtcttctgagtcctgtacaataaaggacatacgtataaaactctaaaatgtaaattaaaagctgaaccaccataaaataaaggcagtttgtacaaactgaaatattcagtgctttgggtctgggtgaggtggaacaagaaaccctaggtaaattgtagcagcgttagatgtttggcctgtttaaagaaggatccttagagggatggagtcataaacacagggcacactggcctcagaacagaactgagagggctccagtaagcagagtggagacataaagcatcctgccatgtgcttacgatgtaggatatcgtcagcctctcagcatgagtcttaccctgtggaagaaagaagtggaaagagaggagaggagcatctctgagcagcacagctccacgcagagtttcaccccagtgcttctctgtgaggtgtaaatacagctctacagcctgggaggactggcagaggtcaccagtagcaaagagtgatagcgagattccacggtcatttgtggatgaacaggggttgttcattttaagaatattgtttgggtaaacaaacaaaagtcaattttcccgtgttatggaaatgctctgagaaaggcaacctcacacaaatgggtcaaagagaatgccaaggtatggaatgcctgcttgtttgcagaccaaaaatatctctcattcatacaagatagaatctagctggattttggtgtggttctttcataagcatctctcttgtgtggccgactgctcctattcagatgaataactatgctagtatcttgcatagctgatccatgaccctgctactaatttcctctaaacctgtctgtagaatatctgagtggttcaaaacccttttagttccattccaatcttcttcttctatcaaatccaactaggcaggaggaaacaagatgtgtgactcttggaaaaaaaaataccagcgatgatctctgagacctgtgaagtactggccctctttcaaatacaattcgatttctttctcacacccagcctttaaaaaataattagggggatctaatgcacattgtacttctgtgtgcatgtatttattcattcattcaaccattgctctgtgctttgtattgcaggcacttgataccgagatgaaggcaacagaatccagctctggaagatgttcactcactaggagggaggcagacccatagactgactcatatcatcagaacagaatcaccaaggagagatgctccaaactcagtttgggtgggggtgttagcagaggggcaagagggaggggagggagagggcgtaaagcaaagtgtcctggggcaggtagcacctgagccatgtcttaaaaaataagcaagtcaggtggaagagggcaggaagcttagaaggcaacgtgggtgagacgaagcaaagcaaagaggtcaacaaatgtgtggcgtgcggcattgcggaagaacaaagatgttaaaggccaggcctttctccctcagctatggaacctgaactccccttgtgggtgatgacaagcattgatgactctaagctgggtaataacacagtcagaggagtacttctggtagattattttaagaaaacaaggctgaagaaaagcacaacagttagttgttgccaaaaacaatgagggcctaagtggaggcaaaggttggggggagattagtggaggtgagacattcagatatttgagggaaatgttgggtaaaatcgattgcacttgctcgtgtattagaggtgggtgagttcctgggctggattgtcagcgtttcaatacctttcttcccttctatactctcctctgtattgaaggtgccagagccccagattattcacttactagccagcaggatctcatgttaggttcctcccatggaggtccccaagaaagatgcggaagacagaagaaaaggaaacttattattttgcagcaacagtgagtaggtgcatgggttttggcagatggcaaatgaggttttgccaggagcttctgcacaatctcctgagaatctctggtgctgtaaacaggtgagacctttggtaaaagtccctcagaattcctgcaatttgtttcccgaaagactagcagtggcttctctgacttttgcttctttaaggcttttaattgattctataatttcccagttctctgtactaaattctttcttgcttaaaatatctacagtgctttctattttactgaccaaacactgttggaatcaactgatacccaggtttctggcttaggtgaccaggtggacggtgaattagaaaattaattcattcattcagcattcatgatttactgaacatctactccgtgctcagggagtgctataggcaccagacacagggactcctatcaaaatgaccaatgctcctgccctcaaggagcttatctcctagaaggagaaataagtgatataagaaactaataattaaataatgtcatttcagatgataatgttaggaataaaatgacagaagaccatatgaaagacgatgtgtaggtggtagagtggtcctcttagactgaatagagaaaatcttactaaggaggccacatgtgagcctaaatgacctaagtgtccaaaaagctctagtcatgtaaagatctacttttggtttaaagtgagaacaaacttggttggctcaagaaagagactggaggtccatgtgactagagcagagtggacaagaaggaaagtgtcagaagatgagacctgagagttaactaaaagtcagagcatgcaggccttcttagccatggtaaggagttacctacctgatctcatgaccttactgtaaacctacagtgttgaagactggacaccccatgaaagttatatcgtacattaaaaggtacactggggctaaggggcaacttgatcagatttgtgttgaaaaatagtcactagagaaaccagcccatggaagcaaacagagaaggtaggagtgatggagtaaatattaaaaatattaaatttggccgggtgcagtggcccatgcctgtaatcccagcactctgggaggccaaggtaggcggatcatgagttcaggagatcgagaccattttggccaacatggtgaaaccctgtctctactaaaatacaaaaaattagccaggcatggtagtatatgcctgtagtaccagctactcaggaggctgaggcaagggaatcgcttgggcccaggaggcggaggttgcagtgagccaagatcacaccactgtactccagcctggcgacagagaaagactgtctaaaaaaaaaaaaaaaaaaattaaatttaacatgcttctaggacaggcagctggcaggcaattagataaataagactgctggagaaggtctgggactgaatatggaattaggagtccgtacatgggtgacactgggtacaccatgagtatatgcaataacacagggagtgtgggtagaaagaacagagcactgagttatggaagactttgtagaacaactaccctgaaaggcagctgcaggaaaaggcccccacaaaaggaggatgattcaatgggaatccggagagtgtggggtcacaaaagtctaggtagtttcactaagagaaagcaaaacagcagttaacacaggactgagattgggaacaaggaaaaggtatccactttcaccattcctattcattattgtattggaggttctagctgtagcaattagatttaaaaaacccaggatatatatagaataaaagagaaataaaacggtttttattcatagatgacaaaattgtctacatagaaaatctcaaagatatgcaaacaagctactagaattaataaaggagcttaacaagattgcaggatataagtaaatatagaaaaatcaataattccatatggtagaaataaacaatagaaaatgaagattaataagcaataccatttgcagtagcactgaaaaaatacttagaaataaatctaacaagatacatgtaagctttgtatgctgaaaactataaattattagttataactataaattattaatgaaactaagtaagacctgaaagatggagagatatatcatgttcatggatgagaaaactcagttgtgttaagatatccattctctccaaatagatcttagattcagtgcaataaatcccaattaaaattcaatttccatcaaaatcccagcaagctattttttgaaatgggaaattttattctaaatttgtatgaaaaatcaaagaaagtagaatagcctaagcaatgttgagaaagaagacaaagttggaggccttacctacctgatttcatgacctcactgtaaacctacagtgttgaagactgtacactctatgagtatatgagataacacatcccttccttggaggaaggcagttcacatagatcagtgggagagaacagaacccacaccttcaacacaagtgctaaggcaattcaatggagaaaggacagtcttgctaaacaaagactggaaccatatgtgtaaaaatgaacactgataaatacactggaccctatacaaaaagattaacttggaatgggtcatagagctaaatgtaaaactcaaaactataaagctaacaacagaaagacaaagaacccaattcaaaaatgggcaaagggctcaaagagacatttctctaaagaggatatgcgaatgatcggcagacacacgaaaagatgcccaacagcgttggtcaccagtgaaatgcaaaacacacccacaataagagagcacttcacacccatgagaatgacaataacaacaacaacagcaaaaccagaaaataacagatgttgctaaggatgtgaagaaacttgaatactcatatacggctggagggatgtgaaacggtacagctactgtggaaaacagtttcatgattccacaataaattaaacacagaattgtcatatgacccagaaattctactcctgtgtaaaaagtgaacacagatcttcaaacaaaacttgtacaccgatgctcacagcggcattatttacaagagccaaaaggtagaaacaaaccaaatgcccaccaattaatgaatgaataaagaaaagatggcatattcatacattgaaatattattaagccataaaagggaatgaagtactgatacatgctccaagatgtagaaaccttgagaacttatgctaaatgaaagagtgagacacgaaagactatatgtaacacgattccattccatttatacgaaacactcagaagaggcaaatccatacaggcaggaagtaaattagtgcctgcctggggctggcgaaagagaagaatggggattggctgcttagtgggtatggggtttttagggatgatgaaaatgcttttttttttttttggacagggtcttgctctgtcacccaggctggagtgcagcagggtgatcatgactcactgcagcctcatcctcctgggctcaaatgattctcccacctcagcccccctagtacctgggactactagtggacaccaccaccccccagctaattttttatttttaattttttgtagagacagagtcccacgaggttgcccaggttggtctccaacttcccggctcaagcgatcctcccaccttggcctcccaaagtgctggtgttacaggtgtgagccactgtgcctggccatgaaaatgtttttgaagtagatagtgatgttggttttgcaatattgtgaaggtagtgaatatcactgaattacatactttaaagtggttaaaatggtaattttaatattatgtgcattttgcaacaataaaaaaatctgtaaaccttatagaagaaaacaaaggagaaagtctttgtaaatttgggttagaaaaaatgctttatattgcacacaaattgcacaagccataaaaggaaaaattaacacactggacttgatcacagttaaaatactctgctaaataaaagggaaaccacagaaagggagaaaatattcacaaaatatgtatctgataataggctggtatacagaatatataaagaatgtacacaactcaacaataataaaacaaacaacccaatttaaaaaaagaagcaaaaaaataggcaaaagttttgaacaggtactttaaccaaagaggagatgcagatctaaatatggacatgataaatgctcagtaccattaatcattaggaaaatgcaaatgaaaactattacacacctttcaactggccaaaatataaacaaaacaaaatctgacaatatcaaatgctgacaaggatgtggagcaacaggagctctcattcactgctagtggtgatgcaaaatagtacagactccttggaagatcgtttctgatactgttaaacataaacttcatgccacctggcagtcccaactccttggcatttatccaagagaaatgaaaacatatgttcatacaaaaacctgaaagtgaatatttatagaggctatattcatggtcactaaaacctggaaacaacacaaatgtccatcacctggagagtggatacagaaacgatggtacatccatacaacagaatgttactcagcaacaaaaaggaaaaggccactgatagttgcaacaaatggacgcctctcaaatgcatcatgccagtgaaagaagccagacccaaaagactaagtattgcatgtttccactaataatacattctggaaaaataaaactatagggacagaaagcagatcagggtttgccaggggctggggtcagaaagaaaatcaactgaatggggccaaggaccctttttgaagagatgaaaattttctacacattgatgtgttggaagttctgtaatttgatacatttttcaaaattcatttatctgtactcctaaaaaaggtgaatactgtatataaattatactttcataaacctgactttaaaacatgactgagactatcacttggttaaggctaaccaaaagggctttggcaatcctattgggaacaatttcactggtaaagcctgaagcgagactgagataatagcgtacatttattcaatgaggtagaaagcaaggcagagaataggaagcgggtgcttctgctgagtgctccattaatcaagttaaactgttatttctttccccctaggcttgtaattcaaaccagggaaagtttgggagagagggggaagggggagaatggagttatgattcagaatctccaagggcatttgtgtttgaaaattttatttatgatatttaaatttagagaaaaatccctatttgtcaaataaaaactagggaaaggaaagaatgataacacctttggtagatgaggatatccagaataaaaacatgactcactggggccatgctccctggggattctttggtgtggcgggagtggcgatagagacaagattttttataataaaacatggcaaaggataaaacaattagataacttctgtccccaaaacttacacttatcttgtgtttaataacagattcagtgttgatagagtctgagagtattcccatcataatgtaagtctgctccagtggactttttaccactttgtgtttgagcctcaattagtaggaaacaatctgttctaagataagaaatcaaaatctaattttgttatttctccctagtgagtggacactttctttgggattggagaaaagggactgaattggtttccctttaaaatgccttcagtatcttttggattggtgcaccaaattctcactctgcccagtgtggaggtgactgctgagtgccgaaatgccaggaccagaaaatcaagctgaacacatgcgtcaatggtgaacaattatagctcagaatccatcctcgcaggatctggggtccctgtgattgtatcatccagacatacatcctcctctcctcccaactgcagcaagtccaagccagatctcgcaggatgagtaagcgacatatggcatgtgtgaaattccactccaccctgttgcccttcccagagctgctgtagacggcagcaacgattatagcaaccttgactccataaggaatgtgacaatttaaaccctgcagactgtttagcaatgagttattccaagcagtaagttgtaccctagagccctggaatgaactgaagaagcactgggctcacatcttaggagatctgttcatcaggtagaaactggcttcatcggcaaggattgagatttttctgctatcgtttttgatggctagtctcatcaaagagcaaacagcatgtctcagattacagctatcagtcctttggcattccgcaggcttctcacattcatgccgagtcgcagggctgacctggcctgaattgtgggatctgaactctcccagaaatttaagaacccccaaatttgtccccaggtcatggtttgggattggggccacccagaaaattcgacagactcagagactccttgagaatgatgctttaagctgcagtctcagataccccgaaattatatgagtacagtggaatggaggcagagaaggggatgcgcggtgatgactttttcataaaggccctaggatccaggtcaagtctgtagtggtccccatgatgattctgggcttcaagggtattctggggaaagccaacctgcagggattcctgagtgcctttaaccacagaacccctaatatcatggaataaaagagaagtaaaagttattggacaaggaatggtaacttttagttcatgaaatcctttgtgacacaccatctcaacttttgctttggcaaattttttttccatgtcaacaactgctgtgactgattttgaaaccaggaaatcaacttgaatgcaaataaaaattcaaatggatgcaaatttatgaaaggtaaacttttaaaaaagtcttagaaaaactgtcacacaaatgaagattctagtattctagtggttcagaattaagtccaggttttaaatgttctttataaggatatctctttttttttttttttttttttttttttttttttttttttttaagaggcagggtctccatacattgctcaggctagactcaaactcttgggctcaatggatccccctacctcagcctcccaagtagctgggactacaggcagccaccaccatacctgtctaggacatttcttgacatagtttgagccttttatctgacggttaagtctgctgggttcagtactgtttcatttctatagataatatatcctaaacattttcaagttacttgagattattagatgcagtgagatgaaccaaactaaaatatctcttgtagccctttcactagctgtggcttatttatattaaagaagcacacagtagtgacacatctgtgacacagggacttgacagctgctaggtggtacgaaaaggttggttgttttgtttattttggacaatgcccatcaatcacgagaatgatgttagaaccacctcttatatagctggcccttactgaaacaagcactgttgttccaggaccctgtcagattagggctccatcagactgaaagagtagctttttcctgctcagggtctaataaagctcctggcatcttggcacacccttgttgaccctgttgccattctagagagcagacactacccagtggagccaccagagcttccccaaacccactgcgaattccgacttgagacactgcaaggctcagcccattgtattttgaagtaggattttccttaatgaaaaaagtctttttcattatttctgtccaatcgacagataaagaatttatgaattccaagtcacaaactgggttagattgtcgcctgccactcttcctctccctgccatttttttttttttgagattctgagaattttcccattataaaataagtccactccagtgcagataattcctcactcacatgctctgaaattcttgcttctgcctaaaccctgtcctgtctctgtgattactcttttagacataatctttgtggcttcaccccttgttgcagaataagacagtagcccagcaggccacactctcacaggggcaggcctgggactttgcctataaaatagaaaatcagctgcccattttttcaattccaatgaatgtgtaactatcaaagagcttattccatctggtcctgttcacagaagactgagagacgacagacaggaatgttgatggccaaaccacttaatttctattgagtctaaaaaagaaatgaagaacagttctaggctgccagaaaacagaagataagcatatggttgttaaaattacaagaacaactggggcagaggagacaagctgcttgcaatggcgtaaggatttctacgttgcgttttgatccacacccaccctggcaatgactgctattgcataagccttcaattcttcaggcctgtgcagatactgatttagaattggtctctggcttgttatgaaacgaagctctttcatggcacaaatgtggagcagaggcgaacctggtttgaagatgcctatgagacctatattctcatcctgcccctcgggcatgagtcaccacttccccctaaaatatggaaaaatgctaaagtgactttcatgtgggatgtacaattggtaatgactgagttgggaaaaacacacaactccctgaactatccacatgccatgagttctcaaggcagtcttgctgagatattataggaagtctaacattctgctgacttgtcccatatgtcgagagtctaacaattttacaaacaagttgttagagggaaagaggacagtgtcttcatggttgtcagagagacccaagcaaatgacagcatgtagctccttggtatcctggcatcactggccttggaaaattttgctgcaatgatagctctgttctcctacatcaaaatagggacttaatgaatttgatttgtgagtgctattaaaaacccatcttctcttctttgaacaagtaagcctggtcaactgcctgtgctgaaaaccactgaagtgtgtatatcatatgttttacaagactctagttctattgagtcgggttgaaatatgcttaagagcatgtgatggttaattttaatgcatcaacttgactgggctatgggatgcccagatagctggtgaaacgtgatttctgagtgtgtctgtgagggtgtttctggaagagatgagcatttgaattgatagacttgaataaaaaagatccaccttacccagggtgtgtgggcatcatctcatctgttgagggcctgaatagaatgaaaaggcacacgagggtaaattcactccctctcaggttgaattgggacacctatctatctcccgccctcagatgttggtgcttctggttcttgggctctcagactcagactgagacaccaacggctttcctggttctccagcttgcagacagcagatcgtgggatttcctggctgccataatcacatgaagcaatttctataataaatctccatatttatgtataaaacatatattctctggggaccctcggctgataccaggtgcacttgttaaaaatcatttagagtggagaagatgagtagcttatctttcatattttgcctctgacatggctattgttaaactcggaaaacctgtatcttcccagacatgaagaaattcaccttcaactaccacaaagaccatgatttggtgtttacaagtttatttagaaacaggtattttttaaagtggttccatattcttttacgttcctttaaggaaatataataatatgattataaaggaaaggtggattgactcacggtcatctctatgagacaggaataagcaaggggttgcacttacaagctgtccttttgggatttttttaaaatcatattcacatatatatatattacatcgtgtaaaagacttgtgatggttaatactgagtgccaacttgattggcttgaagaatgcaaagtgttaatcctgggtgtgtctgtgagggtgttgccaaaggagattaacatttgagtcagtgggctgggaaggcagacccacccttaatctgggtgggcaccatctaatcagctgccagcacggccagaataaaaagcaggcagaggaatgtgaaaagactagactggcttagcctcccagccttcatctttctcccatgctagatgcttcctgccctcgaacatcagactccaagtccttcagttttgagactcagactggctctccttacccctcaagcttacagacagcctattgtggggccttgtgactgtgtaaattaatacttaataaactcccatatatgtatcctattagttctgtccctctacagaaccctgactaatataagactgtagagaaaaacttcatgtatgtaacagggacccttgcataacatagagcttagcttataccagaagataattgtttgatgaatgaacaaatcctttcagggtacaataattcaaagcttttaatacgtttagcatagcaacaaaaatccatggagtcaacacagctacaggcagccgatccctgtaaacatccccagggcactctctaaaactgtaaattcggctcctattttttacattctaacacaccctctgttaaggccactaagtcactcatctctcaggcaggatgaaacagaaaatagcttaaggactagcgctttcagcccattgctgtaggttcaccaacctcaatgctacctcttattctagactggtatctgcagagtgagatactattctctctagtcccagatcatatgcttcttccataggtataggtaaggtcaccaaccaaaaaatggagtccatactctgacaaatacaatcatattcatgggaacattttaatttgagtctatcctagaaaactcaggtcatttggttgttttgtagtgttatgttccacggttttgatatggctgtagctttctagagatttccttgaatgataggaaaaattttaaagagaaaaactgatttccacattcgagttgcacttcagatggaatttgtgggctgccaaattctagcctctgcggtaggttattctgctcacagctctttctaatattcagtagagcgggcttctcaagtccacccacgaccccaagagtagaggcatgtggactgaaaccatggtgtctgggaagagttggcacacaatgtttttgtggtttctctttttgtttacttgaattaacataaaaacagtgctttaaatcatttaccaccacgcaaatcaccacttgaggatgctgggtctctgtttgaccccttggtcctggtgttcactctccctttgtgcctgccaccctgcaggggtcctgaggaaatcatgaaggtcactacactttaaatataagtgatgggagtgggttagtggaaataaactcccacaaatatacaggagatgagtatgtgtatgtacagcatgtaaaataccttctccctgcacatgtctagtggtgaccctgagctggcttctcagtgccatccttaacttgaagaaaaaggggaaggaaatgataatatatgcttggagtttcagataaataatagcgaccatcacaaccatctggggagtgaggtatgatgaggcttattttatggatgaaacatcaaagctaaaagaaataaaaccacttctacaatgttttataggacaaagtatgtatccttttccaaatacatatatatataagcaggaagtatgctatctttgaggtattctttaaggcatgatctcggcttcttctagttcgttcatatacagaatttctacgacaccccaaatgcaccccaagaaatgtacttgggatagctattcacacgggggccaattagggcagctggataatgctttctttcttgtgagtataaaaaggagaacatgagagggatacaccaatgaggtacaccttctgcccagttttggggagaaatatgcaaacttatttttaatgtgagctataagtgcaaactttgtttctctatattgtatttgtaaaagttctcaaacattctcccagatatgtgtatatggtattataaaagaaatgcataaaatattatgcctcagacttggagtagaaacatggcgagtgttccaaaataatttttttaaatggagctgattgtctaagaacctggaatgagttttgaggaagaaacagagggaaaatcatttttgtatttactaaaatgaaggcaaaactatgaagtctttgtgtctgggacttttggtaaagctttcagtgaacaccaaatggatgaaggaaataaagatgtgttattcacatgttactctggttacttataggagtcagagtttaagaatagtctctgaaatgaaatactccatacgtgaatcatccattacagtcttcaaacaggttctatactaaagagtgtgacaagcgtttctttaaagaatgaacaatcaggtgtcatggaagtacagaggggagtggttgaggaagtcagcccagaggaagcagcacctgagctgagctctggaggtggtgagtgatgggtcagcaagggggtggcggagtggacattctaggcagggacaaattcacaggaaatatgaaaaagactaacagtaataattgttcatttttaagcttggctacgaaatgcagtggtcccatttgaactaaaatctaactctaagaggtcactgaagtagaaaaatggaacttcttcaccacatcttcttcttgaggggaagtaagcctgtcctcgtatcattagactggcccagtgacatgctcctggctacagctcactgtctcagggaacggcagatgtctgaagccaggcaaggaacacagttggtgtaattcacatatgggatattcttagcattgaatactgttttctttcagtcgcttagggtatagtatggttctttgtcaaaagatgacaaagcgctgccttggttattcagtttgtgaaatgaatcacaatgctttaatagaatgaaatctgtctactgtgaatctgcatttgaagttaagagattctactctcaaagtgtttctcttaatgggaaagatgcccaactagcaattcttgtggaggctacagaaatccccacaagaaagaggaatgaagaagctgcacaaagagaaatagagaagagagagagagagagagagagagagagagagccttagttagtttactgagagagaacgtgctagtccctgattccaaatgcatccttgcccttgagtgctgtgaaactctcctgtaacattaaaatgctttccactagaattagtgggtttctaagacttaaaataagagcattttatatacacacatttatatgaagacatcataaagacaataatctcgttatatatttatatacacacttaaatgacataataataaagaccagtctaatggtttatttgcctctgtagaaaccatcagagactattagtttctccaagcattaattgctttgtctggtccagggcatagtttttccttgaaatacagtcttacattctcctcaggattttaggagctattgctgttttcaggttagtaagtgaggccttcccctctgaaggcgtcaggtttatgaagagttcatttgaagctgtgcatagggtaaatttaccttcaactacacaactcaggtgtgagacgtagataaagcttctgctccagtacatacgtggacacacacattcatctattttggggctccacttaatgtatcaatgtttatgagtgtacctcagaacagcacatagcagacatagcaaacataagcactttacaccgagaacactagattttattaaccacttgaaatccctggagggaaatgtcatttcattaggaggctccttggctgctaatcaagggcttttcatttccttaagtacattgatctggtaacaaattttcttctctgaaaaaccattcgggaaagcattttctaaaagcaaagtaagaaaggtctatttatctttggtaaatacaaacactgaagaatcaccaggaattaagacagaatagaaaccatgtgtctgtaccctcataagatactgggactcccaccaaatccatcatataacttattacgcaccaaagtcttccttcaccaccacacatcctatctaagatgtttgctgttgtcatttacatctgggaccctagttagcatgaagatgccatgttcttttagttacttgaagtaaactatggtaagttgtcaaaagatgacaaggcactgccttggctgttaggtttatggaatgaatcactgtgtttaataaaattaaatgtgcctttgggattctcagcacatagcacaataaatgttaagtcaggtataaactgacattttggattacaacactgttgtattttccactcaaatttagctgtttctgaaaatgtatatgattcaaacaaacacaggagttcaaatcagtgcatttctcacattccgttctgttattcatttagtccaatgttcaatttaaagcatgcatcttaactaggatgttcctagtttacagtaagcagtgtcatgcagtagaaagatcatgggtttcatgatcaggccagattctaatttcattcttcccacacagctctatgtgaccagggcgagtttcttaactcattgagtttttgcttccttttaggtaaaaccccaagaataccatctgactgccatccaaaattatagcaaataataaataagattaagaattaatatgcctacacctctgcctggcatgtaggagacacacaatagaagtcacttcttccctgaaactcccacatttatgaccccactatcttgcctacagctaaatcctttgtgagctttataaatctctagatttttgatagcattaaagcatctccagtaactttttttaaaaaaggatcataagttaaaatattctattttcctttactatggctatggtttgaaatatgccccaaatttaatgtggtggaaatttaacccccaaattcatatgttgatggcatttggagatggggcctttgggaagtatattagttcattctcaggttgctataaggaaatactcaagactaggtaatttataaaggaaagaggtttaaattgacttacagttctgcctggctggggaggcctcaggaaacttagaatcatcatagaagatgaaggagaagcaaggcacatctcacaaggtggcaggagagagcgtgtaagagaaagcgagggagtaccacactgaaatcatcagctctcatgagaactccctcactatcatgagaaaagcttgggggaaactgccccatgatctaatcacctcccaccaagtcccttcctcaacacatagggattataattcaagatgagatttgggttttggacacagagccagaccataacaggaagtaactaggattatataaggtcgttagtatggggctcccatgatgatggactggtggctgttgcaggaagtcagggaccctgaatggagagacctgctgaacccgcagcagaagaacataaattgtgaagatttaatggacattgttcccaaaatgaatacttttataatttcttatgcctgtctttactgcagtatctgaacataaattgtgaagatttcatggacacttatcacttccccaatcaatactcttataatttcttatgcctgtctttactttaatctcttaatcccatcatcttcgtaagctgaggatgtatgtcacctcaggaccctgtgatgattgtgttaactgtacaaattgtttgtaaaacatgtgtgtttgaacaatatgaaatctgattgtaaaacatgggtgtttgaacaatatgaaatcagtgcaccctgaaaaagaacagaataacagtgattttcagggaacaaggaaagataaccataaggtctgactgcctgtggggttggacagaatagagccatattttccttcttgcagaaagcaagtaggagaaatatcactgaattcttttcccagcaaggaataaccatggggaaggaatgcattcctgtggggaggtctatgaatggccgctctgggagtgtctgtcttatacggttgagataagggatgaaatacgccctggtctcctgcagtgccctcaggcctactaggattgggaaattccagcccggtgaattctagtcagaccagttgtctgctctcaaaccctgtttcctgttaagatgtttatcaagacagtgcatgcccagcaggacatggaccctcatcagtaattctaattttgcccttgccttgtgatcttgctctgcctttgccttgtgatcttttattgccctttgaagtatgtgatctctgtgacctactccctgttcatacatcccctcccttttcaaaatccctaataaaaactcgctggttttgcagctcgaggtctccatcacggtcctatcaatatgcgatggcacccctggaggcccagctgtaaaatttctctctttgtactctttctctctatttctcagaccggctgacacttagggaaaatagaaaagaacctacgttgaaatattgggggctggttcccccagtagttggctttataggaagaggaagagagacttgagctccaaagctcttgctttctcaccatgtaaagaagaaggccctcaccagtcttggacttcccagcccccagaactgtgagctaaataaacctcaattctttataaatcattctgtcttggtattctattagaacaacagaaaacaaactaagataaccacttaattttgtatttttaaatctcactttttctcccctttctcccttatgcagcagaaaaaaatcatggtaaaataagatgcttagcacatgttgggtatttcagattgccatttgccacatttcctttccaccaggtgccttttagctgaggttgccataagcactgacatctcttaagcaagttcatagtgggccactaagggagagacacagacaaggcttaaagaaacccacatcacctaccatgatgattaagatcaaaatctacttttaaacataaaactgaacacgttttaactaaagaattaattggcttcatgaacattatctttgtaataatttgagaaaatctaaaaggtatggaaaaaatgtgacaacttttcattttctttccttgtgacaacttcatttatttcttgcagtaaaagcaaaatcaggctaagaacatcaacaggagtctggagatttgcaacagtctctattgatgccttgaaattactgattatttattagttcctgtaaaacctttgaaattttctcatttttgagattgtagtccacttacacaatataatgagtatatacaaggttttggtgaacccaaaaggctagtcgaaaacaagcatgagaaaaatgttgcaggaaattgccaagaaaacaacaacatacttggcttgttggaggttaaggagtctattgtttgtaaggaggtttctgctgggtctttaaaaacatatactaatggccataacgggacttatttcagtcggaaaacttgaagacaaagaattcattctgtgaatggactgtgactttcttgggattccttagggtagaaaataaacactttcagtggttatttttcccatgagacaaaactgaaatatttcagcagagcataccttatcctcccagctgctcctccacgctgtgcctgcctctctcttatctcttaatccacttccctcacaccctgcgtttcccacactctgtgcagttcctcaaagtgctgggcgattttacaactccagcctttgccagtctcgcttccttgctaggaacgtctgttctcctctgcaagatcactcttccctaaagcattcctgactccctcattctcatggaaaattgaccactctctcttgtttgggcccccatgattccccataaatatgtgtattctagaccctatgatacatattgtttttgctggtttatgtacccatctcctttagtagtttgtaagcctcctgaggtcagggatcatttttaagtcacctttgtttctcaccgcccagggcacaatgggtgacctataaaagatggtgaataaatgggagcatatggcagaggcaatagaaacttggagctacagggaatgcataatcaacaaaaaactaaggtgctgatggcaattagttccaaaagcaggtgcttagagacaatgaacaggtaaagaagcaaacactgtgagtcatgcagagagatgaatggtaagtaaacatgacactaagtatttaaatttttaacaatatgctcaagatccttccataatttattattaacatatttttcctttttaacattggaggttgcttaaaggtggtccatacataaaaggtcacttgtaattgtataagcaggtgcaggttccagaaaactttccactacatacgaaaaaggatcacacaaaatataatgagcaaatggagatggagaagagcaagagaaagaaaactggctcatttattcgggaagcaactgttgaaccctataagtctcaaagactgcaccagctactggatgaataaggttgatatggtttttcttcctaacaagcttgcattccagagcagaggatgatggtaaataaacaaacaagtaaacaaattaatagttgacaatttcgataatgagtgccatgcagacaataaagagagcacgtgacaaagcagtgcctgagggctggctttagcttggctggttagaaagggcctcacatggaactggcactcacgctgaagccccattcaacagaagagttgtgggagcatctgcgagaagaatgttcttggtgttggtgaaaagggtcaaactctgtaaaatatttggagaggcttgttctgagccaaatgtgaggaccataatccataacacagcctcagggggtcctgaggacatgtacccaaggtggctgggctacagcttggttttatacattttagggagacataagacatcaatcaagacatataaggtgtactttggttcagtctggaaaggtgggacaactcgaaggtgggaggcttccaggtggattcaaagactttctgattggcagttggttgaaaaagttaggttattatctaaacacctggactcaatagaaaggagggtctgggtgaagataagaggtcgtggaaaccaaggtgaagcctccagtagcaagcttcagagacagtaggtggtaaatgttccttatcagacttaaaaagatgccagactcttagcttattctctcttggatcatggaaagggaaaggggttctctgtagaatgcagactttccccatgagacagctttgctgggccatttcaaaagatgtcaaagaaatacattttggggtaaaatacttcaacttctttcagggcctgctgtctatcttgttggcatcattgctataaacagtctgttttgtcggcagatttctgttttaatgttcatgctggtcagtgcctgaactccaaaggtaggagggtataaggagggatgttcaacttccacttcccactgtggcctgaacgaatgttttcaggtttctttggaatgcccttggctgaaggtgaaggtttctttggaatgtccttcgctgaaaatggggggtggggtccatcagtcgggtggggggcttagaattttatttttggtttacatgagcatacggaatgtgtgagtctgtgcagtcagaatgtgttttgagtgcttgagagaccaaaaggaagctagtgtaggtgggaggacaggaaggattcaaatgatgaggctggaggaggagaaagaaggcaggcagctaacagagtgctttagaggtcccagagaggaatctggatcttattccagatgcattttaattaaaggggtggaaaaagatctgacttctatttttttttttttctttctttttttgagatggaatctcactctgttgccaggctggagtgcagtggtgcgatcttggcttactgcaacctctgccacccaggttcaagcgatcctcctgcctcagcctcccaagtagctgggattacaggcacctgccactgtgcctggctaatttttgtagttttaacagaaatggggtttttggccaggctggttttgaactcctgacctcatgatccacttgcctcagtctcccaaagtgctgggattacaggcgtgagccactgcgcccagccctgacttctattttatagacaacactttgcctgctgtgtggatacttgatactagggggcaactggaagctgggcaaggctggcaatagtccggatgagagatgacggtggcatgaacaaggtgctgggagcagggaggagagcattacaaccacagcaactaccggagtagagagtatgcagaggaagaaaatttccagaaacactatacaaattgaataaaaaacagtgtatgtatatgtgtgtgtgtgtgtgcttgcaagtgcaaaagagagagagaagcattactaagagcaacagcaacagggggacccagtaggtgttgggccgtgactacagatccggtgtgaaggtgccaggctttgcagcttcaaactgcacacaggcagattctgcagggccttgagccttgtaggacatggtatggggtttcagtgatgtgaaaagcaatgaagaatggctactgacaggttgtagaggcatgagagcgacaggatatatttgactttgagcaaattgcatttattttacagtaaggactgtgaactggtgggtcccaagatgggagtccaggctcgccatgatggcatggctgccaagggaatttctcctcctaaacacaaggtccacttagatccctctggtggctgagatcactgcttaccttgcggtgcacttaactaagcccttgacttctttacaaaactcttagctcactgaaggcagccactgcctgtgatgtatttttcaaacagttaatagtatttcacacacaatatgcaagaaatacatatttcctggatgaatgttccacgttacatgatcatttttgccctggtgtgaggaagcttgcctcttcttcctctgcccttcaacctcaggtccccctcttgtttcccctccactgagggtggtggtggggctgtcttccctcctcaaatacacctgacacctctggattggtggttaagcctgaacataattacagttgggcagctggtacaatttgttagtacccatccgccttctcttgtagagcccctgggactcttgtagtcaaacctgctcacgggtctagtgcctacctctatgccccctcatccctgcctgtgccaatgcactgcacgccaggccagtggagaggtgggacacggaaggaatcttgagaagctctcaagaaccttaaattattatgttaaggtataccatgctaattagactaaaggcacgtccctccacctggatttgcatttttacattaggggaaacacggcattaaacatttttaaagagcagtggcctagaataggaatgatgggatctgccttctttcaacaatgtgtataatatagacctttattgagtgcctgtgtgtgccaggcaatgtcgggtactgaggttgaaaaagagataaaaatgatatgcagtcctataaggatattttaattcagttagggagacaggtacatggatggatcattacagtactgtgcaacgtcctatgcttatttccttctggaatttatcactatctccaattcaatatactcacagctttaattcataaacaaaagaccacatgtttaatatactgtcttcttatttgtttagaattgagttatttcacagattagtttagaaataccagtgctattgcataggattattttcattattcagttttcaagttttttatcttgccagggtctttaaattcatttatcatccttcttcttgtttagaattaaacctccagttttaatggtatttttatgatttctaagcagacatactcagaaactgtaattggagtgtggacctaggtggaagatgtgtgtcacctccaaagtgtgaaaaatcagcttgtccatttttacatttttattaatctatcaaatgctatgattgtgaattaaatataacctcttcattataagcctttaattttctccccattttagtgttgtttgtacaatttagaaagggctatatttaacaatatggggttctttaattttttagctatgaaataaagcataaaaagaagataaaggtctctacaggaacacagattattatttacaaagattaaccacaagctttccatgttttccatcctatttattgtggtctgcaagataaggtgaagtatgcaatggctaactcttgtgttatagttaattttaactctcttatcaataagcagatgccttttcaagttataaaaagtgtgccattattactatcaactggagagaatgaggtcattgttctcattatactataaaaagccggagtgtaacagaagggcaaaaacatacctcaagaaaaacactcatgccaccaacaaaatacctttgaagcaaagaatatcacattgaattttccccacaactaaacattagattcaaagaaagagattaaaagccctgaaaagaagtggtctcttagaattaaaggaccacgtttatttttgtgatgctccgtttattacttgtacagtaagacttttacatgctgatttgtaaacttttctataaagcaaaaaactaggatagaaacatccagctgaaacttactattacatttgaagatttgaaatcatcaccactatcactatatttgcttcatcaaatttaattttaaagatttgggaagtggaggcaggcaaagaattatttaacagtttactaagagaaaacgccttggtaagagcaaatagatcactgaacggccgggtgcggtggctcacgcctataatcccagcactttgggaggccaaggcagtcagattgcttgaggtcaggagttcgagaccagcctggccaacatggtgaaaccctgtctctactaaaaacacaaaaaattacccgggcatggtgtcaggtgcccgtaataacaactacttgggaggccgaggtaagagaattgcttgaacccaggaggcagaatttgcagtgagctgagacgaagccactgcactccagcctgggcgatagagtgagactctgtctcaaaaaaaaaagaaaaagaaaagcatatcctggacggtgggttgtgtgtactgagaatgggggaaggatgaacgggaggggcggacagcagaagaggaggagccgatgctttgggctcaatctttacctgccccgcctggtccatattcttgctaccttcccagctcccaaaatgaaagctcagtttcgacattaccatgggcatctttctgttgcgttttcctgtctttgatatggctgccaagatggagtaatttagagttccctttattattcaaagagaatagttcacataagtttagttatcaacctccaactcaagtgacggaaacgttaagaggtgcggtgacaacagcgcaccgcggccccctgcacaggaacaaggggcgggaatttcagggactccactgtggctgctgcatctacctgctggcttccactccttgccccactcccccatcctcatcaacacccactaatttaactctattggaaatcatcctcctggttgaagtgtcatatgcaaacctcagacctaaaatcagcagatgtattattaccggtctcccttgagaactggttaaaaaacaacaacaaaaataagaacaaaacctgaaagacttaggagatctataggctttaacgggtattaagttctggaatgggaacacggaaacgtacagaacaccatttcaagaacatccttcctaaaggaatgagttcatccactcaggacattttcaaggcactcttagcctaacttttagacgtttccttccactttaagcacgttatatttttctttagtcctcgataatgtgacctctggttctggtctcagagaacgctagtcaagctgtggcaccatcgggttttaaagtctgctcccaattttttatcagatactgtactatgaaaattctagctctttcttgataaacatgccttttaatttatcttacacaaggtgctgagatttttcttttaatgataaaacagggttggctctgaaataccaactgtccacaaactggtttcaaatggcatgatgtaactaggctttttgccatgggtctctgtgaactctcgcccaggaaatgcaggttttgatatgtacaaattgccaaaggaaattccagaaggcctagaaagcctaaaaaatgcagccatatttaagagtgttttctgttttctaattcttgcattggtttctgtggttaaaagattcctgtcaccagccagttgtcattgtaagatactgattaccaaggagtggccggggttgctagcgttccctgagtaccagtgctgagattaaatgtgccagtgttcccagcctctcagcaaacaaaccaagcgcagtgtttaccaggaagctgaaatggagaacctgtcccaaatcagacttaatttcatttaattcacttaccctaattgttagtaagaagactgaatttaaattaaacactttgccttggaactgggttttacttaaatagaactgtccctcctatggaaaacaagtatacactcacatgcatattgcacttaatgcacattcaattttgtaagggacatgagccccattcaagagcgtcatgtttcttcctcctgtttcttgttccatcctatacagtggaggtaataacggattcgcttgctttagttcaaatcattagaaagaattatttctaggcaaaacagagacagtttcacctcatttctcttttttctccatctcaaaattgacagttctaatctacataacaaattatactttatgacaagctacttgtttcctatcttgaatattgtcttgaaacctcagtaaaactcgtagattactgccaccttgcaatttattttatcactattgctaccatatcctgaattgccagcaccaataaatgtacatttcttaatacaaattgcttgtttcagtgtgcattctatgcccaagcattggcattacagaacaagggaataaaggcaggactctgagttatgagaaaataacacagtgctctaatgaggagagatctccttcaggagtaacgcaatgtatactaaaatattaaaggtttattttattttattttattatttatttatttattttgagatggagtctcactctttcacccaggctggagtgtggtggcgccagcttggctcactgcaacccccgcctcccaggttcaagcgattctcctgcctcagcctcctgagtagctgggattataggcatgcaccaccacactcggctaatttttgtatttttagtagagatggggtttcaccatgttgatcaggctggtctcgaactcctggcctcgtgatccgcccgcctcagcctcccaaagtgctgggattagaggcatgagccaccgcgcctggccagaaggtttattttaaagatgaaaatagaacttcctattagcaaagggctaaataacttttagctactttaggctttgagttatgacaagatgatccctcttcacctgatatgaaaacaggcacgagtagagagaaaatgcaccagggtggacggacttcctgtcatgtctgcaagatctatgtttgcatatcttttatttcattttcatctataatacagtaggtggacaatcttagtccaagaagtcagagggaggaatgatcacatttcttgtttaagtcagctcaaatttgagttcaaccattggactgacaggaaatgaaacccaaatcatccctgcttgcttgcttccttgagctctattcctgtcatgcaaaggtcctgacaccggtctaggctaggattgaagggaggtcccaggcattaggacagatgtagtccattatcgactctctctaaattaccttcaggtctggggactctactgcttgttgccatacttggctctgggagtccccagagaggctggggcacctacacctcgagggggcaccgtctctaggggcattacacagctaaccctcaggggtcccaccaactattcatagcacaaatagtgtcccagctctatctcatctgttagaaaatctctccctcttgaggcctttaaaggccaagtcctttcttcccttccttcgggacattccctaatctcagttcatttcagcctccataaaagacaataagtgcctctaacttccaacaggaatttagttagaggggtagagtaacaaatagaaattaaaagcttctactttcctttctcttttcttttctttttttctttctttttttttttttttgaggcagagtctcactctgtcacccaggctggagtgcagtggcacgatcttggctcactgcaacttccgcctcccgggttcaagcgattctcctgcctcagcttcccgagtagctgggattacaggcgtgtgccaccatgcccagctaattttttgtattttcagtagagacagggtttcactatgttagccaggatggtctcaatctcctgatctcgtgatccacccacctcggcctcccaaagtgctgggattacaggcatgagccaccgtgcccagccgaaagcttctactttctaaaagacaccccagctcctaaaatttcaagaaggagggattagtgctaggttgaggggcgtggagggaaaaaacgaagacgacacagacaaatgaatattttagtaaattgcctcaccactatttaatatcatgagtgttggctaagcaccacgttttttgtgccaccaccggttgtaatttttttcatgttgtgccctctctgtaaagcctgtttaggggaatagagaaaagctaaaggtgttcggcaaaacagtgacagggacgctgtctccatcaccaggggcaagtcatgctgtgtcaatattctaccaaagagtattatttttgaatcagtagagaaaaatcccttgtctcaggcagtggttggacactttgtcagctataaatcacatgttcgttaagttagcacagaatattccactttaaatacagggtaatgaagacaaacagaatcccaggggttcaacctggaggagaaacaatgctgattttatggagcatatgagaaatacacaatcgcagcaaacttctgaacgcttggactgttggccaagaacttgcctttggtggtgagcaagtgaaaactgaccagaactctgcctagtgtggaagaggagagtaccacatcaacaaaccaggcactggaatgggcaggtggttttctattccaaacagcaaactctaagaatagcgatcttataaataattgagagaaaatattttcttaatctttctgactcactggagaactgcattgtgacactttttcttaatctttctgactcactggagaactgcattgtgacactttttcaggtaggaaatgtattcagttggtaggaggaactggaataactgcaggttaaacaaatacaaggtttatttttttctactgaaaacagtagatataggcagatcaagacttttctgaagggcccactgtatgacccctgtctcagtctccttctgtctttatgctgctaccctgggcatatgccctcatacttggctcctaccagatggctgctgcaccctcagctcccacacgcacattctagcaagaagcagcagccaacaggtcaagagcaataaggcagatgcgaacatttcttgaagcctcactcattcaccaagctggctgaaacagatgctggaaaatgtagttgtcacttgtgcatgttgtcatttctgatgcaaatggggttctcttactaagaaaggaaatttgagtttgggtaggcaagtggagtgtctgccagagtcaccaggcagggagcaaagtctcatagacaaatccatggaattgggaatcactgagcctcatttctgctttgactctgcagatttagcaaattccccagctgcaaaaggaaaattctttttctaattccaggagaatggatttctcgaggaataatttaaaggtgtcagttaatttattaacattttcttcaaataaaatattcccataagatgcaaccgttcttttatgtatataagtttaaagaggataaaaagttgaaaaatctttcttaattgtttactgagggagtaagactttcaaccaactgtactgtaaattagaaataaaataattataacaactaaccactacagtaatttacactgttaacactgcattttcaaacttattgggccattgtatgctctaaacttctgcttttatctgccttttaagtgaggaaaatgttattgtcgttatctagagctcacagattgagatctactgcaaataaacatgaatgaaaagttgggttccctgcgtaggggaattgcagaattcgtgaaatcttcaggagacgagacactgcagtctgacataacacagcctgacccaaggggtcgcacagaagactgtgagctctgagccctgcatctcttcttttcatgacccaatgcgggcatcccaactacccagacaaaggaggcttatttgaaataattggcagtcacagccacgttttcagtgttatgtttcaaactgtttgtctctgatcctgtttgaactttgatgacaatatctgtgtctctaatgagaccgaactgctgtcagcatctgaaaacgctgcccagctcgtgtctgaggttggcacgttggacggatgctgcgctcgttcctcagggggaaccatgcggctccggctttgctctctcaggcagcttctgcagtgagtgcgcaggtcgtgagggctgcccggtgaatcctgggactgggccttgggagagttttcagaatccacctttggtgaggtgatgtgatgggaaggagcccactgctgtgcttttacagacccagtgtcaatcaaggattccttttttttctaaataattccatgaacattaaggaaagaagccacattcattcatttcaactttctgaacacctgctatgcctccatcactgtgcgaggatttgaggagacagggttagatggcattggtcactctctttagcttctctccatatgcacaatagtgattactggaccctcgggcaagtttcagggagtcagatgaaataacttcccaaatacaaagttaatgcaactatcaaaaagcaattagtatgcacctttgaatcaataaaaccacacagagtctattcccctgtaatcaaaacaatgtttatgtctcgtctttaaatagtgtacatgtcaggcacttgacaaatatattttaaaagtgaattttgttttttttgtaccttaacaaaaagttagccaggtgaaatcctttttcattcttaacagtgtatttcaaaatattcacgtttccgagaataccgaggacatgaagctcagaaaaacactaagcccatgaaacaaagaatccttagagcgaaaatacaaatcagcaaaagatggattttacaaatggaaacactaagagagcttaggtaactacaagtgctatgaggaatgcctgggccctccagaaagcccagcacagcttccctttacttacatataatgcctagcgaaggaataaaattcagggatgctgtaattagtggatgctaaaacccacactcacaagaaaaatacaagagcggaaatgctaaaattctcaagacatgcaggcagtggtttcctgctgaaagaggttttgcagttcttcctttccttgccttcactaatgaggaaatgtcctctatgacagcaagtctttctctctccacccaaaggctgttctgtagctgaccggcatattgcaggtcctgtgaaaggtggagatcgtttcatctgagtcactcttgcttggaaatacacctgttccctaatgtgcagcccctcggtattgtgctggctttctagatctgagtttacatttccctgtgcagaataccttgacaaatggcagctttctgtgactgatgacagtgcctggtttgtatgagatgtgacttccttctctcaggactgtcatccatctctaatgtcatactgctcatcaaagcaaaccatacagactttctttggaaaacactgaaattggcatgcatttacttttaaacatttattttctctttttaaaaactttacgtgtgtaaatttaggaggtaaaagtgttatattaaaaaatacaatggatttgaaaaatacatcaatttgtcatcatgctctagcctcattttcatgttctgaaggcacccttaatagaaactctgattttgtttgtatctggggagaaatccaggggaaagaagagaaattccatgaatcctcctacaggcaacttttatcagaggcgtgtaacatacagtgaatgcagttaatttgggcaactggtgcatgatttatagctttgaggatctaatctaatctgggtcattcctcttattagaggtgtgaccctgggcaaaccacacgcatagccttagcttccattttcctccatctgtacaagggggatactaacacctccttggcagagctgtgggaatttcacaagatgcacgtgccaacatctgtgcgcgtggaatgcactaaatatcagtaaatgaccagtgatgatgacaacgaagaatgatgatatttatcaataacaatcactttcaaggaaaatattttcattgtgttttgaattatttagactctccataccaaaaaaggccacaagaaattgcttatcttttatctaagtttttctaagccaccagagcctaaaatcaaaatgatttatagattaatttcaggaagagaaaaagagaaatgtggttggggagagggagaaagagggagggaggatcttttcttcctttctcctgagcttccatcttgtcccacagaggtgggtacctcaggcctttctcccatgcaatgctgggaagggaggaaccctctacacctcccattattttcaggaggacagcggctgctgtgactgatctcaccttcacattcattggtgaccactagaggtgggagtcgctgggatatttttagcataggctggatgacacctccatggcaggtacgtcagccacctctgctttagtcaccagcatagggctgtgcttagcagagagcctagcatagagaggatgcttattaaatattgggtaaaagaataaaatgataaataagggccactataaaatgaatgttacacaaaaacgtgttttccccaacaactcacccagatgaagacttacagagcagcccagctactcctccccatatagaattcctcatctggtatgttgcaatgacttttatttttaaactgttcttgaatcttttctgacacaccgtttgcatctcagaagtgtatataggtcttttaccttatgtggacttacggagatggagcaagagaaacctgttcttaatgatgcccgcttctatttttccttcccctgagtgctagctgccaatagatcctgccttactacttgaattcccactgattccaatacaaatccagcaggataagaaatgtcttaatattatagcacaagctacctatatttttgacagctttagttgtgtttccaactttgaaaattgataagcatgaaccaggaaagacagtttgaaattctaattcaaaatctagggaaatgcatatctatttttctttgctgctaagagctgatcaaaagggtagatcaatcatgtaacagcgattacaatctctgcttctacataaaaaatgaatactttagagaaagactggggtttgatgcaactctacgctcataatttaccctgcatactgtccaaaactataatttttaaattatatatttcctagaataatgtgtaagaaatggctttttaagccaaaatatgttaactattctattaaagaggactattgtatgcagacataaaaatataacatgaacatttatattattgtaaataattatgccaatataaactaaataatgtgatttcccccttattttaattaaataaaatataaacgtctaactttttgctttgctagcttatatcaaacattaattttaatattaaaatagtatgttaactttcatcagtaactgaagagcatcctgtaacccttttatcctgcaatttcacttactctttattctgaagtagtcttagacatgtgcacaaatttatctacaaggatgtccatcatattgttgttaataataatgaaaaaataaaattatctgaacaaataagagattgaactacggtttgctgaggcgctggaacatagtgttgtgccaaaaataatgctgttgaaaaatatttattaatatggaaaatgtggctaccttatttcaagtataaaatactcgctgtgatcccaatatttctgtgaaaaacaggcatgcataactcgaggagaaaagatcaaaaaagatataacccaatggttttatgaaggcggtgaaattacagagaatctgttcattggaatgcaagctttctgagggtaagagttcgggtcagtcttgttcagcacctggaacaggcctggttcaaaaataagggccccaaagatgcatgctgaatgacttaattttcttatttttcatacttatgatttccaaatttctgttgtaattgacaaaatgcatttttaaggtcctaatcaagctaagaagcagctttagggccaaggcgttttctaatgccatttcccacacacattccattctctactgatacttttagatagtttcataaggaagctaactgtaaataaactctgctgtatctttatgtatttcatcattgtgttcagttacttgctgacactaaccttccattagttgtccttggctggaattgtgtgagtgaccttgctcctaacataggaacgaggccatttattttatcccaaagttaaagcactattattggttttaccttaccctgattttttttttttttgcatgctacagtatattgtgtttggcacaatgcttcacatatgtgaatatttatattttaaaaatccggactctttttatttttattatggaatatctggctgaatgggatcagatttcctcatgaaagtataggggtgactcagagaaactgtgaggcagtcatttggaaattccctggaagttctaataccaggaagtatgtcctcaactacttgttttatagaacatccaaatctgagggtaaaactttcctggttaaaaataaggcaagaacaaataaataaaatagtaaggaataaatgcaagatatctattggatgacatagtaaatatagttaataacaatttgcaaattgcaaacagagtacattttaagtgttctcaccacaaaaaaataagcacatgaggtgatacatatgttcattagcttgaggtggccatcccacaatgtttatatatttcaaaacatcatgttagtataccataaatatatttggttttcatttatcaactaaaaaaattaattaaaaacaacaaaaaataaaaccaaaaacgtctcccggaggcagggatttagtccctgtggccaattcccatcgctctgtaactgagtgagtctgcataggaagtatgtttgttgaagcatatagttgtagagagtgacttttcattttacagtgcttagttttaaaaaattatgcacataatctatgactaaattttctctgttaaagtttcaggcaacgcagatgtgaagagaataaatatgaaagtctccctcctggccctggcttgcagccctctgctccctttagaggtaaaccctggaaagtgctttgcatatgtctttccaggactgatcaggtccatgcttacgtgcatatgtaactacacatgacacacatatacagtgttgcttggcttatcataaaaggcgttctagagtctgtattgtcttttgacttggtgttttttcaggtaataacatgacttccaagactttttccccctcattacactcaaatattattatttttaaaagtaccataatatggaattgttgtattttaattaatcaccttccccctgactcatagtcattgtattcctttcagtttctctcaataacaaactcttctctgtgttttgtacccttctccatacaacttttgacgcgagtgtaaagtacttctctattgcagaatactagaagaattgcaagctttaggatttaaatttttttgtttttttttgagatggagtcccactgtcacccaggctggagtgcagtggcacgatctcagccctttgcaacccccactgcccaagttcaagcgattttcctgcctcagcctcctgagtagctgggattacaggcatgtgccacctcacctggctaatttttgtatttttagtagagatggagtttaactatattggccaggctgatctcgagctcctgaccttaggtgatccacctgcctcagtctcccaaagtgctgggattacaggcgtgagccaccatacctggcctagttttaaatattttgaactttgatctttactgataaaatgcctcacccccaaaatgggatttactaatgtatacttccaccaagactggaaggaattagctgtccctagctgaataagtccctggtgcactttgttttatcactaagcacttttaatcctatgcttgaaagaaaagcattggtttaagatgcccgccaagtgtctttaagagaaaagttaccactggtgagcttttggatttacctccatgtctgaatgagccctctttttctgcccatgtgtcttatgtaccataattcaaattatggcagaacttggaagtagaaagtagaggtctatctaactactattggcttatttaaatgcacataataattcagttaaaataaaaatcccaggttaagtgctaagccacgtaggatgctggaatgagaggtatacattagcatgattgtgaagtatatgataaaactattcatggccccacaaaccaaactttaagaatcagaaaatgtgttgataaggttaaaataacaagatattctcttagttaattgcttttagtcatggttgtagcttaagcctttttctgattttgaaatgcagtttctcttggatgatgaggccataagtcagagatctgcttcaataaaagaataaaattatccataataacctctggatcatgaaggatagaaacataattacatttcctttaaaaatagcttgctggaggcacaaataaacagcagccataataatgtcgtatattaatataaccatccagaaaagaaccagaaagacaaaacctattattataatttaccatctattaaacatattagctataaaattaaaggctgatcttaaaaaacattaaaggttgttttttttaaaagagccaaagtaagcaaaaaaaagagatttgtttaataaggttgcttttctcaagaaattaatgcagttatgtaacaattcaaatgcatttgcaaactataccaaacttcaatgttctctaactattcagagtacacaagcaatcagcatcacatatatttgatttaatcattgaaaatacagctatttattttaaatcataaaatgaaaaaagttggataatcatatactgaaaagatagaattctgtgataattgctcattaaaaatagaaattaggccaggcatggtggctcacacctataatcccatcacttggggaggccaagacaggtagatcacctgaggtcaggagtttgagaccagcctggccaacatggtgacaccccgtctgtactaaaaaaaatacaaaaaattaaccagcgtggtggtggacatctgtaatcccagctacttgggtggctgaggcaggataattgcttgaacccaggaggtggaaattgcagagagccgagatagcatcactgcactccagcctgggtgacagagtgagactctgtcaaaaaacaaaaaaaaaaaagaaagaaagaagaaagaaaagaaagaaagaaagaaaaataaagcaactctttacccaaaaaaacaaaaataaacagtatcctaaaaggcataacattacaatatttccagttaaaatcaggaactaggcagaaacatgttccacggctgttaaaagccttgaggattttagtacatatgattaaggtaaaatctaatttcataagcattgaaaaagaaaagagccaattatctcctattgctgtgatactattttgtacctggcaaaacaagtgattctagctaaagagaaactgagagaattaaaaaaagaatttgcaggtataccagataagtgtttttgaataggttttctctattttggcaattaagtaagagtggaaacgtgaaaaagtaagcattaacatgatctgaaaagcaatacattttgtacaatatccatatatgaggatcactataaaatcttatttaaagacctaaaagcaaagcaagtgtgtgattcaagcccacctctccgcacttcacctcgtccctccgccttatttccccatcttggtaaatgacacctccatctaccaatttattgagtcagaagcccaggagccgtacctggcgcctcgctttccccatccccatatccaagccctcagcatgtcctgtggactttgccgctaaggacctgctgaatagaacgatcgcccatcacctccaatgccaagcctccactcaagcggatctggtctctgtcctggaccccgggattccttcctgactgggacccgctgacactcttgctcttctgcattgcgctttccacccagcacccagggaactccacacctcacatctgattctatcactccccagtggagagcccgattgctgctgcctgcagttacagcacaattccagtgcctcgcctcagcctacacgacctgggctctgctccctcccagcagcgtccccgtccaccctccccactttccgtgtgtggcagtaggcccatcttcctgtcccttggttagaccaagctcacgtggctgccagagcttcccatcaacgcagcagctagttcagcaccaactctccagtcgctttctatccgttactcggctttgtttttgtttgtttgtttgtttgtttttaattattatactttaagttctagggtacatgtgcacaacgtgcaggtttgttacatatgtatacatgtgccatgttggtgtgctgcacccattaactcgccatttacattaggtatatctcctaatgctatccctcccccccccccaccccacgacaggccccggtgtgtgatgttccccttcctgtgtccatgtgttctcattgttcaattcccacctatgagtgagaacatgcggtgtttggttttctgtccttgcaatagtttgctgagaatgatggtttccagcttcatccatgtccctacaaaggacatgaactcatcattttttatggctgcatagtattccatggtgtatatgtgccacattttcttaatccagtctatcattgatggacattcgggttggttccaagtctttgctattgtgaatagtgctgcaataaacatacgtgtgcatgtgtctttatagcagcatgatttatagtcctttgagtatatacccagtaatgggatagctgggtcaaatggtatttctagttctagatccctgaggaatcgccacaatgacttccacaatggttgaaccagtttacagtcccaccaacagtgtaaaagtgttcctatttctccacatcctctccagcacctgttgtttcctgactttttaatgatcgccattctaacaggtgtgagatggtatctcattgcggttttgatttgcatttctctgatggctttgtttttctcatgaggatgcacaactctctgagcttctatctgttcacaggtgaaacaccctcatgcacactggagcatcagcacggtgagggcagggcgtccacgtgtctttgtgccctgcttgaccccgtgctgggaccttctacgagagccacggtgacacgtacagcagatttccgggacacggcagttgtgaaaataaaagaacgaaagaatgaacaaaaggaaagtgaacacttccccattttatagattggagagttgaggtttggcgagtgatgtgaattatccatgattacgtagctgaggtttggccaagtgcagactccagatggttctgtctagttctgcctcccagggctttcccctgtgcaggctgcctcgaccctgcctgactgccgcctgtgtctgaatctctcagagccgtctgtcttaaacaggaagagacggcctttatatactgttttcaaggcaacccactcccatttaatgttagtctagatggttgcaggtgtattttgttatgctggcttctggtttactctgcatagtcggggagcatgagaggggtgatatggttagcaaatgcctttgaattgttacataactacattgattccttgaaaaaagccatcttattaaaacaaaacaaggaatattatgccttgttgaagctgacctatcaaaatgtaaaagaaataaagtaatgaatggtgtcttggaaaaaacagtgttttgttattgtgtcagttatacctaaagacaaagaatgtcttgaaagcatatttttaaatcaagaaatgttaaacactgaaaactattacaaaatcttctacaaaagtagcaatatagtattcatcaataactaggatacttttaagtttctccttgatattttctcacccctttccatcaacaaacattgtgcttaggaccagtggcctttcctctcctgccaggctttcaaagtacggaaaagcaaacagaacagaacactcgaatttcagctcataggctggaagcaaatagactgtggtcagacaagggctgacaggttcggagtgattttcctcatttgtgatagcaactaagagatctgggaagtattgtctgtggtaggcataagcaggatgaaaatggcatggtagctatgtagacacagcactgaggtggaggagaaggatgaagaacagaagaggggatggggagaaaaaagtgaagaaaaagagaaaggaaggaaggatgatacaggaagggaaaggaagaaaagaggaaggaagttgctgagcaaaagcttggatttaaaaactagtaaaattttattagcatcatgcaaggacttagtaatgtaatatcattgaaacaaggtcaaacatggttaaataataaaactaggggagattgtagagttaaggaaattgagaaattaaataatagccctttacagaacaatacattagagacagcaatcaacatatgagagtgaaagcatgggaaaggagattaaagaaatggaagctagacaacaatgatccaaataaataatatttctcaaagaagaaactattatagcaccaaaccttctttttataagaattttgtaccaaggataattctctgaaataacagaaagtgctccaggaaaagtgggtacagaataattgacaccaaaatactttctttcaaaattacttgacatcaagcatgaagaaagaattttcagacattcagacaagaaaaaagaaaggcatctacaagtggtgaaaaatttaggctaaccataaatctctagagaattcagggactatagcacgaattatttttgagaaaaaatgccaacaacttctgacgatgaaatccggtgaaatatgttattcatccaagcaaaaatgccaggaatggagaagcagtggtgagagaatgggtgtgaggattgattctttctttaatttgaaactaaaactaaattattgtgggaatttctgttacagaatttaaggtgttataatcctggcaaaataaacataacaatgtaaccaaagcattaggaggtaggggaagaaaaaagaagaagtataaaattgttaatgttgtttatctttcatatgattgagtttatcaataatatctaaatttgaaacagaggtacaaaaacttaatgagtataattccttaattattttcaaaatctttgtttcattattttaatatgatctcttagacactaatatttcatttgataaagtaacatttatctgtttttctttatttggtttctttaatagcacttttcccttgcattaatgcaaaattatatttggtatcttttgaaaattaaactgatgaaaaagaaacaacagtcatattgattgggaaagaaggaaaaggtgttctattcaaagataatatgattgtctgcatagaaaatctcaaagaatctaccaaaaactactggaactaatgagtgggtctagaaggttgcaatatacaaggtcaatatacaaaagtccattgtatttctatacaccagcaatgaataataggaactttatttgaaaaagtattatgtaaaacaacattgaaaacaaaattcttagtaaaatctaacaaaatatgtaaagatttttatgcagaatactataaaacactgataaaagaaattaaataagatctgtatgagtagaaagatgtactatgttcatggatcagaagactcaatattgttaagatgccaattcttcctaaactgacctgtagactcaatgtaattccagtgaaaattccagcagcattctttttgtaaatatcggcaagttgattctaaaatttatatgaaaaagtagaagactagaattgtccaaacaaattcttaaaagactaacaacatggagaacccacactacataattttgagacttaccataggactgtgataataaaatactgtggtatagctgaaaggatatgaacacaggccaaaagaacaggatagagagtccaaaaaaggcccacacatctatgccaattgattattgacaaagacaagaaaggatagttttttcaacacataattctggagcttgtggttatctataaatcaaaacacaaacatctcagcttatacacaaatgaactcaagtggatcatagaaatacatgtacatcttaaaaatataaaacttaaagaagaaaatacagaaaaaaatttcacgaccttagattagaaaaatatttattagaagcagtatctaaagcacaatccataaaagaaaaaaattgataaactgaacttttccaaaattaaaaacttctctactgtggaagatactgctaagagaatagaaaggcaagccacagacagggaaaaatttttgcaaaatacttatcaggagaagaacttatatttaaaccataaaaagaacttttaaatgcattaataaaaactcaattcaatttttaaaatggtatagagatttgaatagattttttcacaaaagaatatatattattgacaaacaaagcacagaaaaaagatgcttaagtcattaggaaaatatgaattaaaaccacaatgaggtaccactacattattttaaaacctgacagtatcaatgccggtggggatgaggtgaaactagaattctcataacactgcttgtgggaatgcaaaatggtgcagccactttgggaaacaatttgccagttccttatggtgttaaacacaatcccactgctcgatttttatccaagagaaatgaaaacctacatccacacaaagtcctgtgtacaaatgttcaaagcagctttatttataatagctgaaactagaaacaactcaaatgtcctttgactggtgaatacacaaacaaaatgtggtacatttgtataatgaaatagtattcatcaacaacaacaaaaaattaacaaattaaattatccgggtgtggtggcatgtgcctgtagtcccagctactcaggctgaagtgggaggtcacttgagcccagaagttcaaggctgcagtgagctatgatcatgccactgtatgccagcctggatgacagagcaagaccgtatatctaaaaataatttttttaactaacaaatgatcattacacacaatatcgtggaggactctcaaaagcattttgctaagcgaaagatatcagtcacgtaagtccacatactgtatgatgttatccataagactttctggaaaaagcaaaaccccagagacagaagtccgatcagttttcatcaggaggtgggggaggaagaaggttcaaggtaccttccaaagggaacttcacggggtggaggtaatattctgtatctggattgtggtgaagtttacatgactgtatttgtcaaaactcatagagctatatatctaaaatggttgaattttattgtacataaattatacctcaataaacctgactataaaattaaattggcatgtttatagatcctatatatgggaattgttcccatttatcatttctatctggatattcttatagacataaatattaatctttaaatctttgttaatacaaatgttaacatgtatcagttaacattcctgatgtttatagtagggtgattgggactttgagtgacattttgaattcttcttcatgcatttctgtatttcttgatttttaaaataagcatgtgctgttttttaaaataaaaaagttttatttttgctaagggctcaaaataaaggctccaaaaaataaaggattagtaagatctgaacaaaagaaatccggaatggcaatgagggcccagcagagctgagtagaggtgagaatatgatttccatcaacttggcctttctgggtttcaggactggatctgagcaggcagttgaccactgacctatcatctagactatggtttcctcagtaaaggaccactttcctacaatgatctctcaactgcctttagttcttgactcctaagaggtttccaacacacagacttatatggagtcggtgtattcccggaatgctcagacagtagggagtttctttagatagttctcgtattgtattggcatactcctctttcagttcttgggagaatttactacatactttatgcaatgattttagtaatcaagttacagtcatactgctgatttccctacagaaagtcaggcagccgaagtggtggcacggcataaattgatacatgaaatccaccatctgttctcaatgtacgcagcggctcctccacacctgcctggacttatcttgagaaggagagcaacaagaagaaaaaaaaatcaaaatgtttaattaatgttgctgggaaagaaggtgcaatccagcaaaactgaagttacagatactcataagctcacaggcctcttcttcaaagctgttaaggcgtaagctagaagtaagtggtctttgtagccctctgatggctcgttggggatgggaaagttagcaaatcctcttatgtgaactgcagagcccaagggcgaggaaaagcccgctcttgtgctttcacatttctgcccttgaaatacgacatagcacccccgggcacctgctgtcttttcattttctcacactgctgaataaataagcattttagggaaagccaagaacataatgaaggcttaactcagagtgcagaagtgtctagggatgcccactacagctcagaggccaaatgtcaccaagatcacttccatacacatagactccattcactttttgaggtcacctgcattgccaatgacagctcaaaagcgtaacatttcacagtttctttctcatgatctccttaggcctactaactacacatataaactcaaatgataaaaggatgaactagctatttttataatctctcattttactcttcaaagtgtttaggcaagaataaaatatataacaatgcataaatgaacctgaacacttggctctttaagattcctctagaatatccttggcatctctgtagagaaaaaaggtagcatgaaaagaagccaaatcgtgcttcacacacgcccactccacttcccatgacactctgggcacatctttttagaaaatacgaattcggtcttattcatttaagcttccataaagtaagtaatgcatgatttttaaactttctgttttgatgcgtaggtgccaacaggcaactttctcaggttgtcaccctatttaaaagttccgagaaaatccacagcattagacatgtctcttgtaagttactgcgccccttagtaaaccacatgacaagctggtaaatacaagtattcacaagcaaatacgatgtgttacaggtgaacatagcaagcccctgggcgattggggaaaacgatggactgactgagaaagcatttaggcatagtgacttgttcccggactgtccagagaggtttaaattccttgctagaaactcttatgaaaggaaatgtgaggtgggcggcagaaaggctaaggtgttctaggctgcaataagaaaagtatacaatccacccagtgcggtggctcacgcctgtaatcccagcacttcaggaggccgaggtgggcagattacaaggtcaggagattgaggccagcctggctaacacagtgaaaccccatctctactaaaaatacaaaaaattagccgggcatggtggcggttgcctttagtcccagttactcaggaggctgaggcaggaaaattgcttgaacctgggaggcggaggttgcagtgagccaagatcataccactgcactccagcctgggcaacagagcaagactctgtctcaaaaaaaaaaaaaaaaaaagaaaagaaaaaaaaaagaaaagaaaacaacgtggcctgtggcctggtctggttctgctctgctatccacggctcaggtcaatctggaacatgggattccgtgtgggaaagtacatgctaaaaggaaattagaagatctgtaccaagaaaagaatagcagcaccatgagagaaccgggacttgggagacgtaaaggatgacagaagaggtctgatcatttagcctggaacagactcagtgcaagaaaggacaatatcacccttttcaaatatttgaaaagctgggctttgaagcgatttgtttggtttgccccaaagggtataacttagaccaaatggtcagaaactacagagaaacagatttcagctcagtaaagggaaggaccttccagcgggcagcgatagaatggccaaagaggaaggaccttccagccagtttgaagacagaataggctgccttgagaggtgaggctggctttgcagcacacttgagttgcacaaacagcctgggcagctgtctgcggggaagccggaaaaggcatttagtaggtagaagtaaaagagggtccacgagcccatataataaacttggctgttgagtgagaatctggcacccacctacataggcgctcacagttcaattgatgatggaaataatatcacatttctttctgttagtagaaccctacatgggccgggtagaagagaaggtgctctgtgtatggaggaagtctttgagcaagcgaaattacagtgtttgaagaaacacacttccctcttttatacagttccgaaactgttataaagatttggttgtttgaagggttgaaaaactactgcttcgttaagaaccacgctgtggcttcaggaaaaggaaaaatcaaaacttgcgggcatcgcagaccgtggcatttattattcaatggtttgacactggaaatgcatataccatgcagcctgcagatttatagactgcagattttgtggtatgttaaaaatatttttttgcaagtgatttgaagtatgctatttatgatatttcagcaaaatgagctactgtaacctaagttaaacaagttattcaatagtttcaagcagcaaactataacctagcaagactttggaagctgaggggtggtagcaccctcctactataggaaactattcttcaattatttgtaattattattattagaatcatttcatatcttctggagagttattaagaagatggggttgctgatcttcttaataacaaattatccaatttattatctgtaattttgttcctcaaaactttcccccttaagttgttgttggatagaaaaggttgcttttttgtttgactttttactaaattatcatggattctcacatagtatatatatatgtgtgtgtgtgtgtgtgtgtgtgtgtgtgtgtacattgaactcatatcttttcattataattattggaagcataaactgtatgaaacctgacattctatattattattattattattattttgctttctggcattcaatatattgcctgtcccaatttatttattctgagttttcattgcatttatcatactctgtaaaatgctcgtgctagtaatggctcccaaagatacatctatatacaaatccccagaatctgtgaatgttaccttatttgaaaacatggtctttggagaatgtgattatcctggattatctggatgggctctaaatgcaatcacatgtgtccctagaaacgaggggtggtggggggttggagagagacacacagaggagaaggcaatgtggagatggaggcagagacttgagtgatggggccacaagccaaggcatgctggtagccaccaaaatttggaagaagcaaagattaaatttcccctagggcctccagagggagtgtaaccccacctccatcttggttttgaatttctggactccagaaatgtgtgagaataatttcttttactttttcatccagttcatggtaacttgttacagcaaccatatgaaacaaatagtgttctttcttctagagtttgttttcctaccttctcccaactctaaattgctcacacaatgtttgggaatttccttccccatctctaggttctaaaatcctgccagtgcttccaggcttagcttcacatggtgtggccccagcagcctgctgtgtccaccccaacccgcatgactgggagtcactcaactcctcctctgaacactcaacacagggaaagccccggagtcctcattgtctcatctgaaaaccctctcatgattgtttgcaaactgcatgagataaactgaaaatatttagcattgtattcagggcagagtaggtgttcggcccacctgtcgccttccaaattgccagtgcatagctgtatctctttcccagcacacactccagcaggcgactgctgtcattatgccttgtgaggcgatcggggctgagtgagcttcctaagcttccctctttttcacctaacacctttgctttctatcatcccttttctgttttacttttatcttagaggaagagggttttttcttccattccaaggttaaactttccaactaggttttaatgttcatcattggcgcctcctctggagcctctagccattttctccttctggaaaacatctcaatcaatccctctctgtttgcactttcttctaaactgaaaaacagaatgaggtgcaacaatgttaaaatagagaaagaaaatgcaattgctccctttctctcccaccctacttgattttttccacagtcatttttttttttaagactgcttccgatgcctcaccattcacgcattctaaatcatttctaacctggtctccgtgttcacctctgctattttttttcaaattcattagtgatttcatagttatgaagtccagttactgcttctgggacatgatgctgttgcacctaactctgctgtggcctgcatattggatatctctgcttcgattcaaaatgtttaaaatcggtatcattccccgatctccaatttatcttttcatgttcctctcagtctctcacttgggtaccaagtgttcatctttgctttttccccttctttccacccaatctgtgcttctgtcctcctcctccgcctgacagttttacgccctgaacatctatataatttattgttactgttactccattggatataatgaggctctcatcactcacttgccacctgagctattgcagtttcctcctgacactcattccacctcctgccttccttcattccactcactcccccacaattctgccagaataattttttttcttttttttctttgagacacagtttcactctgtcccccaggctggagtgcaatggtgcgatctcaactcactgcaacctctgcctcccaagttcaagcaattttcctgcctcagcctcccaagtagctgggattacaggcatgtgccaccatgcccagctaatttttgtatttttagtagagatagggttttgccatgttggccaggctggtcttgaactcctgacctcaagtgatccacccacctcagcctcccaaagttctgggattacaggtgtgagccaccgcacctggaccagattaatttttaagtgtatttattaatatatcacttttttgtataaaatccttttgtggctacccattttctattgaatcaagtatattccattcaatttacttcagttgtcattgcaaagctctttacagtacagaagtcaccgtggctaacatctatggaattctggtatgttctggggactctgaagcacttacagatgttatctcctcttatcctgacaagaagactgtgtggcaggctcagtactgtttgagtgtcacagtgagaatccagaggtttagccaggattagaactgtgtgtctctatctctacagcctaatgagagagcccacaagagaatctttaaggccgcctccactcacacccgcttccggactcccccacagtctcaccctgacggcttcatgacgtgatcacgctccactcagtggtctcacctctgcctgctgaggccagatgctttctggtgccctgctcagaccccttctaacagcacagtgtgtgtttctcttgctccttcacagctgtatgcactcaggagcatggggacaccctcctttcatcttggtgtcctcttcaacatcctagcacatgggcctgaacgtaggagtggctccatatgtgtggaattccaatgcctaggttttctgccttgctagaaaacaggctttttaagggtaggacaaaactataagaaacatttgtatgttttatagtattgaacatgttgcattatacagagctgatagtaaatattgaatgaatgaatgaacgaatgaatgaaataaaagaaagggaatcacttaagctgtgtgggtttcttcagctataaaataaaggcgtcaggacagactgcctctgagattcctttcagatctaaaatgttatgagtttcagattctgcttattctttgttttttaattctgcttattctttgttttttaattctgcttattctaatacttttttattttgtgtcagtaaacaaaaaagtaagtggactttagcatctgtgaaattaaacccaagaagccatcataatgaaatcacctttgcaaaaatagtaacagtgagaaaattattgcagtgaaagagaacgtatctaaacaatccccactttgcctttaacctccaaaccgcctttagtcattcctgggcatgacagcctttcccaaacctacacggcctttgcaaaactaatacaagaacacaggttaggagaatgagggacctgaattatgttaaggaacagacgtacacaattatcagccattatcctagaggaaacaagatttcaacgtgctcaattatttctgcagatagcaacactattgtgtactagaacctaagactggccttttgaaatgtcttttcaggtttttgcacttctgaccaccaatggctccactcggacccaccaaccagctatgaggcctcactcacaaggagaccccctggcctgtcaaactatccttgaaaaaccctagtctccaaattttggcagagattgatttgagcaataactctatctcctacgtgctgtggccagtcttgtgccaattaaactattgcaatgccatagtctcagtgaattggttttgtctgtgtagtgggcaagaagagcccatcaggtggttacaataacttttttgtttttttgagacagagtcttgctctgtctccaggttgggagtgcagtggcgcgatcttggctcactgcaacatccacctcccgggttcaagggattcccctgcctcagcctcgtgaacagctagtgttataggcacacaccaccacacccagctaattttttgtattttagtagagaaggggtttcaccatcttggccaggatggtctcgatctcctgacctcgtgatccgcctgcctcggtctcccaaagtatttttccattttatataaaatgttagattgggtgctaagttaatttcttctcctcctgcttatactagaaatctttgagcatcaaagtaaactcaagaatttcaattgctttaagaaactaacctgagtgtacagaagaataaagaggttaaagaaaatatccagctatgaaggaacttgggagttgttaatgttctagaattgcatcatgtatctttaaggggcaaaggagagacataatttaaaacatccactagagagctctgcaacatttcctttttgcaaacattaatccatgttaattattccccagagcaatgtcagcattcccatagattcgattctactgataaggactttgattatgcacccatgttcacagcaaccttattcacaatagccaaaaggtggaaacaactcaagggtccatggacaagtgaatgggtaaacaaaacgtggtgcatacatatcgcagaatattatttaaccttaagaaggaaggaaatcctggcacatgtcgcaacatggatgaattttgtggacagtgtgcatggtgaagtaagccagacacagaaggaaaaatcctgtatgattccaatcataatgaagtacctggagaagtcaaactcgcagagacagaaagtagaatggtggttgccagaggctagggtgaggtggccagttattgtttaatgggtacacagtattagttttggaagatgaaaaaattttgcagatggatggcagagacggtagcccaagaatgtgaatacacttaaggccttatggctgtacacttaaaaatggctaaaatggtcaattttatgttatttagaaaatgagaatggggagaaaccttgagcaagtgaacaagaaaattatagccttgaaaaaaacaagaatagggaactacataatatattcttctgtgatttgaacactccgattactattgagagctagtgaaattactggtcttgaattttctaaggatgctagctgtggaggagaaggaagaaagagataatcaggcacagagtaggggaaggcactggggttgctatgctgtggaatgaggaggaagaaagaagagacagaaaggccttatcatactaggaaatggattgtcttctgctgccctgtattccagagtgatgtgtggtgagagggcttgacatgggatcataacatctgcgagtgtgagcctggggtaggcgggatgcatgggctgcaatacaccagacagcaccactgccgcgctggagcaaaggctctgggagctgcttcctgggctggagcccacccactagcagggctggagcttgtcaaacttcattattctccaagatactgggagacccgggcccttcagcacctcactcatggatgttaaatctggaatagatagcgtagaggtgaagggaattttcttccctccagcttctgaaggtttgataatttgagtccataaaacaaactgacaatagacaggttaacagccagaagggcatgtgaatttattaacatgcccatggacatgggagtcccacaaacatgagactcaaaaaagggtcagctgactgaagtttttagactatcttccattccaggcgatggaaggaacaggggctaggggttccccgggggaggaggcaacaaggttatgggagagtgaaggcaggtaagcctggtgagcaaacggtgtcttgttatgtggataaaactctcctataaccctggagctgccctcaggaagagcagatgggaatggggtaaaagtctctatcagaccttcagcagcgtcagactttagcctttttttcccatgagttaacctttcctagatccggatgaggaagacaagggtgcctcggagcctgtctgcatggtctgtctacctcccgaatgcagattttccctacagatgcaaatctgcctcacaaaggacagcttttcagagctattcctgtgttctccagcccctctgaataccgatctcgaaatatgccaaagaagcatattttagggtaaaatattccggtttctttcaatagaaccacagaaatatgcatgttttaaaagagcaaagacattatgggaacatattgaaggaaaaatatgaaaaagacaagagcaaaaggatcaaacacagaagaaaatgttggcaggtgttggggaaaagtgggcgtgagactcaccaggtgcttcatggcccccagggaacttgcagaacatcaaaattagattttgactgattttccaacaaattggttggcttcagaagtaaaaaaaaaaataaacagagatagtcatttttattagtagtaatcatcaaaaataaaaatcgatttgaaaatttctgtgtaggttttcagttttacagacataatctccagttccttttaagaatggtctgaacccagagcccctctgtccataccaattacatcacatgttacactgaagacttgaccagccgtgtcacaagcacccagatgtcttacctcgcaaggcaccagtgcctccctgtaattgctgcactgtcagaatcaatatctctctggggtctgcttttgaggttcagccaatcagctccattgcgctgacacagctcagcttatgccaaagagagctgccacctcagtccccacaaaagaacaaaacacaccatcatcccagatgatgcaacccactccctcagcaaacatcactgtgacttgaaaatcacagactctcagagaatgaaggaggcctggagaccagctcctcggagcctagcactttcctgaagcacagacaggaggggcatgatcacacggggagccagtgactgagccggggatgcctcctgacaccccggctgggcccatgtccatgctgccatgtatggccaggcatcagtgttttaatgaccccttcatctgatcacatggctttgcacacttactttaattttagacttgaaaacatgtgatttactagttgtgtgcttctaagaatccatgacacagacaagaaagaagaatgaattaggacgataggcccaccgggggccaaaattctcattctcagcctacctctcttatgagtgacagggcaagccctgatgccactgaagcaacagcagtgaactaagtcagggccaaggtacagaggacttgttttggtgtcacagcacctcctgaactccttgtctgtatgtttgcgtaattccctaccatccaaacttctactctattgatccatcccaacacagaatccaagaagaccaggtaagtcttcccttgtcctcataaccgaagctcgacttaggttcagatctccagtgggaatgaataagccaaggaggtgagggcagtggaggaaagtggcagcggcgtgagcatccgttctgctgcagcagatgcagcggtcatggcgcccgggcgacacctggtgctgcatggcagtggcatcacccccgccaggatcccgggtgcaccgggcccagtgcccggctgccttcttgctcagagtcaggtctcagtgtctgtggtcctagacagtactttctgctgattggcccggacaggtcagctgagaatgaaggactagggttcttctctgagaactttgcctcaacaataagaaacttgaagaacagtgactttgtcacactgtaacattaacaatttctttttcagagaagtaaaatgtgggcaaattatagttttcctgaaagaatttaattttcaaataattctggccaatcccttcattgttttcttttgaaaatattattatcggaaaagtttggtcccaaattctcagcacagaatttcatttggattaaaattagccagagagaatgatcagtaaggaccaggaaaagggagtgtatgagagtgatggagtttgaaatctcattgagtagaaatcccattgaccacaattatccagctctgaacaaggatcaaatgctcataggccaaaaaaagctccggattaggccaaagaatctcacttaaccaacttgtatataacaaatactccagtggattccacagcaatttcattttggaatttgtcatgggaaataggtaggaaagacagactgaaatggattcatgcataaagaaatgcacttaaagaaaaggggtaatttttggcattgacgggttctgaattagatacaaatcctcagagaaaggatttagacatgttggccaggcgagatggctgacgcctgtaatgccagcactttgggaggccgaggcaggtggatcacctgagatcaggagttcaagaccagcctgaccaacatggtgaaaccccgtctctactaaaaatgcaaaaattagctgggtttgttggtgcacgcctgtaatcccagctacacgggaggctgaggcaggagaatcccctgaatccgggaggcagaggttgcagtgagccaagatcgcgccactgcactccaacctgggtgacaagagcaaagctctgtctcaaaataaataaataaacaaacagctagtaactgggttttgacatatggaaattccttacttcttatttcaattcactgctcttttctaaacacagaactactgtgtagtgtaacaggatgattggcagggggtgctctgtggcccctggtgtgtgcccctaacaaagagccatgtcctctgcagagagttcttggtggaggaggctccactgggaaaagccaagccactgggtggtgcgttgccctcaagtttcccagtgatgccagtgatacctgccctaaattacaaatgctgcttacacatggccaaaaaaaaaaaaaaaagcacatgtcagtgattggttgtattacaaagcacgtcagtgattggttgtattactgagctactggaaaagctgcagcatctgcagcaattgcggaggctcaggaaacagtaccccagatgacagcctcagaagcaagagcttctctctgctcacttctgccttccggttcctcagcccaattctcccctgaggccagatatagaaaccagaatccctcttcctccaggaccgtcacagtaaccacaacccctttgccccagagccagccttaaaacctaaaagtattactctaactttcgctccgcctttctgggtaagaactggcgataaagacactctctgacccaccttgtttgagtgtaggtatgagatccgattccagagagggccccaccccacaccagaaggaaggaaagctgaccagagaggccagcaagaatctggacagacaggccttgctgggtgtccccactcagtctattcgcattagaccacaccctttcgtccaatcctatgcctacacagctgcccatactttgttaaacctaagcataaaaatggacagtttcccctgtatctttgggtcttcaatctgaaggctcctatgtacacattaagaaaatttgtacatcttttctcaaatgaatctgccttttgtgagttgatttttcagcgaaccttcagagggtgaagggaaaatttctcctaggccctgacacaaccataactactgcagtctgaaacaggtatgctccacagcctacaacaggtatagaaagtcacggaacacagatggctaaggttcaaaccagcacgagagggcgttcaaaaagctaaggagttaggctgggtgcagtggctcacgcctgtaatcccagcactttgggaggccgaggcaggcagattacctgaggtcaggagttcaagaccagcctggccaacatggtgaaaccctgtctccactcaaaaaaaaaaatttagcaggatgtggtggcaggtgcctgtaatcccagctactagggaggctgagacacaagaatcatttgaacccaggaagcaaaggttgcagtgagccaagatcatgccactgcactctagcctgggcaacagagcaagaccccgtctcaaacaaacaaaaaagctcaggagttggatagctccacagcaggggctaacattccatctaagcaaagtgactataatccaaccactttttgacgtctaaataaacttgtgcctttaatgactgttttctgattgacatcccattactgcctgaaggcaaaacaagctgaaagggcaagattgtgtgatagccaaagaaactcattcacatattaagccattgacaattttaagacatattctaaatggatcattctagcaattaagtggaggggaaatgaacggtaggggacataagcagggaaactagaaagaaagtttgacagttgatgtcaaaaataagaaaggctcaaactagcaccatgtctgtaaggaagaaaagaaagggaaaatttcccaaacatatatttagaagttaaatcaatcacactctattcactggacgatgaaagactgggtgaggaaaataaaaacatcaagaatcattgctcgtgtttttggaggcagtgttgcttggggttagtcagtaacgggtggcaaaataagaacaaaataatgactaccaaaacgcaaatgaaactaactagcggctacgttgatttgcatctcagccttattgcttgtctttacctctgggaaaaaaattgaagaagtaatagaaataaaatgcagagtggtatggagagggcgtcagtttagcaggaggtaatacccaaatctttagaaaaagcagagaatgttatttggataccgtgagcttcactgtagaggccaaggcatggtgagatttaataaaggtgcacagagcataaatctaaaaggcgattatgctagtataacccacacgatattgtggatgacgtgtttaatggcaacatcctgatccactcttgcctaggggatgttaatggaactacacaaaacctatcatgctttggttcaatgagagatttttttttttaagctcatacttcaagcaaggaacctaaaatctcttccatgatcacagtgtgcagaggcaatactaattttcagagcagcctgatctggaacaaaggagacaggaatcagggcagcctctgacagagtgctcacaggagaaagagatggtgctgcccggtacagcccctcccagcattcacaggcaatggctggaggtaagaagcaccaggtccggtctagataacagcatttgggacacacagcggataatccaagctgggacaggcagaggctactccttagtcagatggttaaggtctcgaagaattggtgactgtcatcaggacccgttctctgtgtttaagtgtgcacagggatttggacatattttttattttagagtgtagattctgtcgttctcgaaaatctttttcattttgtgaagtagcgagtttatttttattttttttaagagacagggtctcactctttcacccagggtggaatgcggtggcgtgatcatggatccctgcagcctcctgggtttaagcgatcctcccccctcagcctccccagaggctgggaccctgacaggcatactcagcactgagtttaaacccacctaacaaccaactacgcaacatgcccaggcactcccagagccaagattgtctagttgagtcaagggcttgatatccagagttggaaaaataaagagctctccttaacaaattgtatctgaataagtagacttgtgtttgggggagccaagtgttacagtagagcccaacgagtattataccttcaggcttcgcacgttctttacagtcataagcactcagcaaatggttaccatactggacgccatggaagacttattagaagggggtaaagttggaaatatgaaaatgagttaggctgtggccacagcctggaggaaaacaggtaagggttgatctaagatagaggcaacggcactagaaaggaggagacagctgcacatggtggcacacatctgtagtctcaactactaaggaggctgaggaaggaagatctctgagcccaggagtttcagattgtcgtgtgctatgatcacacctgtgaatagccactgcactccagctcaggcaatatagtaagaacccatctctaaaaataaaaagaagaaggggaagaaaggagaagatagctaaaagaaatttagaggcagacaatcgttcataagtaaaaaggcagtgaagtacataggacaaataagttactatacttgagagtaaaatattaaattggctagatcctaacttgtgagaaataatagagctacccgttccatactgacacccagcagtgaaccacacagcctttaggttaacaacgggactttctccagtcaagtacaagtcccagttctcttatcaaagagaactcaacttggatttatatgaagatcaaagaagccagctctgtaagtcatacctaaaaacattccatgcataaaataatgaagactactaggttatagagatggttatttgcaaagtgatagaatcccatttctcattaattgtgaaataatttaggacaaaaccaagaacagatgaaaacaggttatatagagagagaaaaaaaattcaaaaaatatagcaaaggcagtgataccaagacaaatgtgaattacatacccaatatttttctatttgcaaaatgtgtgattagatgagttggaagaaactgcctacaatttactgaaatactttgtgtatttgtacgtatgagtgggagagagagagggagggagagggagacagggaaacagagagagagagagacagagagaattatatttcagaccaagaatctgattcagtcactaaaactacagactgcttttaatctacagcccaaggatagtccaaaaggcagtgcaattatcaagttgtctaaaacattgtttatggacagctatctctttctgtgtaaagactgacctcattttgcacatatctaacatttgcaatctcaattgcatgaaacaaggtagataaactaggttgcatttatttcttttcctaaagaattagcaccagtattttgttagtcagttttaaattatgatgccatttacaaaattcaatttatatctatcttttcggaatacatatactgtgtagactatgtttccaaatttgatttttctccttgccttacccaaaatgttgaagaagaattttttttttttaattgagatggagtttcactcttgttgcccaggctggagtgcaatggcacaatctcggctcaccgaaacctctacctcctgggttcaagcgatctcctgcctcagcctcatgagtggctgggattacaggcatgtgccaccacggtcggctaattttttgtatttttagtagaaacggggtttctccatggtggtcaggctaatctcaaactcccaacctcaggtgatgcgcccgcctcggcctcctaaggtgctgagattacaggtgtgagctaccacgcctggccgaagaggaaaatttataataaaataaacttatggcagaaatattttaaaaatatcaaggggctgtttgggggttattctatatttatactaatcacccaaatactcatgtctatagagcttttaacaattggaatttcttacaatgaattataatatctttgattagcatacaaagataaatttatatttgctaaattattctcattaaggcaaatgttgaaataattatcagggtttcgaacaatgaattacaagctccttagcagagcaaaatatatgtgaatttactggacaagtcttatgaagacaagtactgaaactaacaagctattaaagctaaagttaagttggtcagaaaattcatgtaaccaaatcatttgaaacctgagttttgtggttaaaaagcaggctttctgttaatttaatttaacttaatttctgttgagtcttctgttttataaaatatgaaatagcagccccttagtaaaaataaagtatagaaatcataagaaagatctactataaaaaaggctattaagtagattattgataaatcagaactattacttgattagtttgttctcttctttgtgaattacagcaggaaatagtattttaaaagcatattagtatacttctatccattcttcaaaatctgggttaaaaatgtttcttgtgatatcactgctgaagaaaatatcactttgaaatattacttttttaaagttcagtttctgagtcctacttttaatacttgaagacacaatgacaattttaaattttttatttatatattttctagtatattaggatgagtaagaattaattaaaatattagaggctgtagggtctaaaatagttattaaggacaatatggaaagaccatctttcagaaggctgaaattgaaaaggaagcaattccagctgtgcagttggagagtaaatggcctgtgaagtaactgaaccaagttcctcaacatcttaaggtgagggcattttcaaattgtgaaaaatccttattatgaaattagagttttattacatgaatcttttgatcagttgtcatcttgggaagactaacttcaataattggtctggagagaggatggggcaaaaacttacatggggaattctatagcctctgtgtgaggaagaggttagagataaaaatggtgtttttacttaaaaaaaaaaaaaaaagaaaaagaaaggagcaacatgcatgttcagtcctgattgctttctggatcttgctaaagctgctagaacatttcctgtgttatcgattttgtatattacctcagttcacctctgctgacagcagttggtttagctgcactgggattcatccaatattcccaaccgtgatgttaattctatggcaaagtaaataaaagctctgttctgacgtcataatcgctgagttggaacctggctttgccacaggcatgccttcacagaagtcacttaactaagtctaggttcctcatctgtgaactgagaaaactaaaagcactgattccatggggtgctgtgagtattaagtccatggaaggttctcagggggtgccttcccggagcaaaatatgcatgtaacaaatatcagccatcattatttctactaaagcactgaaagaaacacaactaaaagacctaaaacacagctttatattttatagtgattttgggggggcatgccataggaaatgatttgatatctgtagattttaaagtcaaaatgtttcatggctaattgagaaaaatcttgggctctttaagattagtgtgaggtttagagataataaatgtaaagcatgtgacatagtgcctgacagatactcagtaagttgtaggaggttctattattaccaatatcatcatgattcatacatttcttttctctccactttggcttgacatgtggatacatgaggccagtaggaagaagtcacccatgactatctggaacaacattgtggggaaggccaagtttctggtcagtacagagccttcaaaattcctttcccctcaaaaagaggggtccctctgatacctgcttgtctagctctcccccctgccaccgccagatatgtttttttggaatgcattcgttaaataatgaaataattgagttccatgtattctcttcaggctatgtctttgcatttggactgataattcattaagccaggataacgatggaatggcctatgtgggtagctgtaaggaccctgtgatgatctttccgagtttcagattgcacgataaccttgaaacttacaaacctggctttggttgtaaaggattcatgttcaagggaactactgaatggaagttatcaaaagtattaaaatcaacagagcatgcagagaactacaggataattactgtggcattctgttaagatcatacttgacttagaaaactagtggcctgtagattcggtcttatttgccctccaagaatacttatacagcaaaaatacccattcctctggaaatttactctcttggcaattgcataattattattattttttaatctagaaaccaccgtacattcatttaaaactactttgagataggaattttacttacctgagaactgtggtctcttatcatgacttcagttttctaaatttaacttatggatgtataatcttattaattaactgtgaacatggtttctgagagaaaaagacctgcctaatgtctaccacccttacagtataagagcagcaggatcttcgtctgtgtgcgggaaggaacgtcacaggattgggactatgtatttgtgcactttagaaatggggacagaggctgggaggaagatctaagttcattgaaggtgtgtcccaccttactccaggggtagtggatggacttgaaagctggacagaagaatcatcttactgggtggcagtggcctcttcaggctttggactgtggagagacacctgcctctctgtaagaacggtaaaaagcctccctgcctgtggtacttggcctgtatgtaatatctcaaaggcggttaggaacaggaagaaagttcctctgacttggtgtttccctgaaatgctgattagataaataacagtgcatgccgcacaatgacaaaagcaacttataaacatcaagggttatgtgaggcaaccgtacatctgattttggtattgtggtatttgatatttcaagagactaaaataaaagagaaagtataaaaataagcagtttcccagggagttatggcaaagctcaggacatcaaacgagactgaaccaagtgagaagtgcaactacctccaagggtaaaagaaataggccgggcgcagtggctcatgcctgtaatcccagcactttgggaggctgaggcaggtggatcacctgaggtcgggggttcgagaccagcctgaccaacatggagaaaccttgtctctactaaaaatacaaaattagccaggcgtggtggcgcatgcctatagtcccagctactcgggaagctgaggcaggacaatcgcttgaacctgggaggcagaggttgcagtgagccaagattgcaccactgcactccagcctgggcaacaagagtgaaactctgtcaaaaaaaaaaaagaaagaaagaaagaaagaaacagtgccagcctaccagaccatctgaagtagtctgtcttactccagtggagcaggcttccccaagctgggggccaaaaaaccccagggaaacacagggttcatcaaataatggctaaagtgagctcatttttatatctatacaaatataaacatatacaatacatgtaaatgtacagatttgtgtatgtaacaatcatttaagggtgtatggaaaactacttaaatatactatttatggtagtgttttatcttctcaagagatactaaaagctgtattatttttatacagaggtctactaaaatgttttggctctgaaaaatgactctcacttgcaaatgctggaatttagagcaaaacagtattcccttcctaaaacaaacataacagtcataacggtattccatttctgaagcataatgatacacctatcaaaatggttaacatttgagtttgaattaggttgtcattgtttcttctctctctttaatacattttaaaatatgtttttctacaggtgcggtcttactaagttgcccaggctggtcttgtactcttggcctcaagcaatcctcccacctcagcctcccaaagcactgggattacacacatgagctactaggcccggcctcttctgtctttttgtaggtgtgtttatgaactaagtagtgacccaatatgaatttccaagtcaaagggaacaactgcaagacaaataaggtagtcagggcccttcaaacaaaaataagtgccctgctgtcatgagaatcaacacaatctcctctgggcccagcaaagagaggaccctctgcctccttctcatactctgtgtgagcaccaagtgaccatccaaactattttagggcagtgctcaactggggcaggtcacaccatgtggtccactcccattttttttttgagacggagtctcgctctgtggcccaggctggagtgcagtggcacaatctcagctcactgcaacctccgcctcctgggttcaagtgattctcctgcctcagcctcctgagtagctgggactactggcatgcaccaccatgcctgggtaatttcgtatttttagtagagacagggtttctccttgttgctcaggctggtctcaaactcctgacctcaggtgatctgcctgcctcatcctcccaaagtgctgggattataggcctgagccaccacgcctggcctgtttatttttataagtaatgatttgctttatgcatctccagatttaatatgccactctatccaaaactgggaaaattttatttatttctcaaagttttttaaataaaccctctctacagacattaggaagttaattagagatacttaagatatttgggtcaaaaccaaaacatttaaaatcatttttagcaggaccaacttttggtatgaaataaacacatactgaaatcatctgtaaatttactattcataaacatagcttaagaaaatacctaacgcagcactctacaatgcagtgcccgtgaatgaataaatgaatgacacctgcccactgtttatatgattccatacgtatctcggactatatgcatgactctaatacatgtgaatatggtattctatctatacgaaaagacaaagatctttcttctaataaatgaatcttttgctcattataccccaagtccccatttgggagaagtgatatttagggaggaattattgggaagaggccgggcgcagtgcctcacgcctgtaatcccagcactttgggaggccaaggcaggcggatcacctgaggtcaggagttcaagaccagcttggccaacatggcgaaaccccgtgtctactaaaaataaaattaaaaaaagaaattagcagggtgtggtggtgcgagcctgtaatcccagctactcaggaggctgaggcaggagaccagcttgaaccttggaggcagaggttgcagtgagctgagatggtgccactgcactccagcctgggtgacagagcaaaactccatcataacaaaaaaaaaaaaaaaagaggaatgattgggaagatttgttgtccatctattccatcatatgctcacttgtcttgttggttgaagtcgaaccatggaatagaggatgttcggccaaatttccttgctaccctgctagtctgtctgtccaccttaaatgttttcgctgggttaccttttggtattataatgttagcttttatagtaagaaactcgtttagagcactttaatgtaaaattccatataagaaatttattttagagctatgaggtagaaaaagctcggttctcctgaggaggtgttatttaccgtctttataacataattgtcatgtttccattttaactttggccatgaagaaacacattttgtggcctggatgtttatgtttagctgtttttctggagagctttgcttcttgcctctttttattttgtttcttgatgatggatattttctttaaaatcacatattatccttatgtataatgtgattttagtttccgaggttttattggtaagttaagctacctcagttctttagtggaaaatacaaggatatagatgttattataggtatagatacggaactcttagctaagcacatgcactctctctccctccttccctctctccttcctgtgcgtgtatttaaattgcacaattcagtttaagtcatttccaatcttctccttgtacaaatgtgcctttggtttttaaagattcattagacctatgctttgtcttggtaaacataaccatatacacaattgtctgcctttaagagaattgaaacaatcccagaattgtgttcccaacatagcttagtataaggtgtaattaaacatttaaggacatttgagaggcaactgtggaaaaccgacctggagaggtcatcgggcagagccatgctgagctcctcaccactaccatgcacattctcccaaaacaagcgcattctcaggatattgcttttgctttcttcttcttgatgagctgcttcacacacattctattctcaagaaccaacttcctacctgacctggctcccatctaacttaataaaaagaaaacctgttttttatttcatctatagataaattatggtctgaaatgaactactagtgaacccatgcaaaggctatatatatatatatatatatatatatatatatatatatatatatttgtatacacacaaatatatatatatacacatatatatacatgtatatatatgttagtaaatggccactcgaggtatagaaagtcacccaaagacatcacaaaaactatttaaatatttgaaatataattgaaacaggcctattctcaatgaaaaaaaaaagtgccacgttccctctgacttctgattgctaaatcaaaacgcttagaaagggtttgttggaaaatgaatctgtctgtcgagtaaactcagagaagcgctcaaagggatcgccgagtaatgattctgaagctgtactgtgtttcctcaggagacaatcttctagacctctgaaatgaatgagtccttaaccaaatgaatttttgtaaatatttctataaactagtaaaaacttttagagcaaaggagttcatctcaggagagtaagatataggagacccacaatgatggaggctctgttctatcaagacacaaaacagataggttgagccataaaacatgaaaccataaggctctaaaatataacccttgcataacatataaaaatatatgaatatatgcattatacatgtactttatatacatgtatttttatataatacatatataaaaataaattttgtatatttatataaattcaacaatcccactactgggtttctacccaaaggaaaagaaaaaataaatttggtatatttgtatgaatccaacaatcccaccactgggtttctacccataggaaaagaagtcgttatatcaaaaagacatctgcactcatgtgtttactgtagcagtactcacaatggcaaagatatggaatcaacctaagtgtccatcaacagatgactgaataaagaaaatgtggtatatatacaatggaatcctattcagccataaaaaatgaaattatgttttttgcagcataatgaatggaactggaggtcattaccttaagtgaaacaactcaaaacgtcaaatactttatgttctcacttgtaagtgggagctaaataatgtgtaagcatagacgtagaatgacaagcattggagactcagaagggctaggggtatgtggggagggggtggatgatgaaagatgacttaatggggacaatgtacattatctgggtgatggatctaccaaaagcccagacttcaccgctacacaatatatccacatgacaaaattacactcgtacttcttaaatttatataaattaagataaataaataaaagggtaaaaaaaagaaaaaataaagtcattgcattaaaaatctttcaagcattgctttatcatcgcataaatgtagccaaagattctgaagaattatgagggcttctgtgaagacattgtttcactgccactcaatataacttgtgaaaactttggtcaagaactctaaactaggaaaacatgcaaagaaatgttcactcatagcaatatttgacacagttgatttttctgctgcatttctttttctacaaagagaaatattattcaaagagaaaaaatttgccaggcatggtggcaggtgcctgtaatcccagctactcaggaggatgaggcaggagaattgcttgaacccgggaggcggaggttgaagtgagctgagatcgctccactgcactccagcttgggtgacagagctagactccatctcagaaaaaaaaaaaaaaaaaaagaaaagaaatatattcccttcaatgtcatgcctggctgtgtgtctgacactgttcaagatctaatgaaaggaaatgttaagacacacctagtatgtgattcagcccaaattccagccaggccaaggtggctctgcaactgtgctctttgccacaaatgaccctgtgtcctgcagaataaaggacactacaagtaatagcactggagtacaatgtgtgccctatgcatatatttataaaatgctatggttcccactgacgagaagggcctggccacaccctactccattttcaatgcgtttcctgtgtttctatctcttactgaaaagaaatgctgattttgtaacaaagaagccttgctatccttcaaaacccctttatgaagttgacttcattttatcctctccatttccatcaatactcccaactctggagactttctccccattcctctcctgtcctcccttctctcttgcctcatattcagaacacagatagagcttgaagatcatggcttctggtatgaaacttttattattcatttatgtgtttgtttgttttttgagtctgggtctcactctctttcccaggctggcgttcagtggctcaatcatggctcactgcaggctcagcctccttagctcaacctcctcccacctcagcctccttagctcaaccgcctcccacctcagcctcctgagtcgccgagatggcaggcatgagccagcacatctgactgcaacttttattctataacctaaatcctgtgggtatacaaagatgcagatataaacaggtatcacagactgtattatatatgagaaataaaatatttataatttctctacatcagtaaatcagaatttaacattatccaaattcccttccagacttttctcaggtgcgtggtttcagagtaggactcgtttcttatatacaatgcggtgtttgattttttaaaaaaaaaaaacttcccttggaaaatactaaaactattatgcattgagtcatttaatattcagaataacctcacaaagcaggtgttaacaacttccattttaccctttataaaataaagactctagagagattagataagtagcttgtccaagtttacaaacaagtttatgccctttctactgagctacatttcctttattgtcttataacataaacttatctcatatgtctgataaaaactgtccaagaggcttcaaaattatgatgattttcttttcttttcgagacagagtctcgctctgtcacccaggctggagtgcagtggcatgatcatggctcactgcagccttgacctcctgggttcaagtgatcttcttgcctcagcctcctgagtagctggagctacaggtgtgcaccaccatgcctggctaattttttttattttttgtataggtggagtctcactatattgctcaggctggtcttgaactcctgggctcagtcttcccaccccagcctctcaaagtcctgggattataagcatgagccaccacgcccagcctgattttctccttgagtgcgcaagtttccctcttggtggatacacttaaccgcactttaatggttctaagatacacattttaacatctaagtcgggatgtatctcaagatcaaggacaactgacatttgctgtcacgttggccaggtggcagcggtgacagactggtcactgcctgcaggggcttaatatggttatagtttcagtggcacaactgggcaactgtaactcatttatgtcaggtccacagatgacaaggatctcttgcagaaaaaatagaagacctggctgggttctgaaaacctcttattgacacattattagatcaagaagcaattagcatcaacattcacagaacagtttgtgagcaacttgcaggaagatcccagagatggctgcagggcacagataagaaatgccacatcactagtgctctccatggcacagagaaatacttatggaaaaacatggactttgatgattcacaattgaaaagtgactcagaagagctggactttgtaggagaaaaacattgaaaataatctaaccaattatttcacttatttttcattttcatgtatgcacaaaatgcatgtttaaataaccctaaaaaactctttcagtaagtgtagtttttaattagcagtgcttctttcttttctcagtggtgtgtagctagcctcgtacaggtgacaaaatataggtaatttatttgaagcatctcttattgtttggcactcattattttcaaatgtttgctattaaagatagataatgctaggccgggcatggtggctcatgcctgtaatcgcagcactttggaaggccgaggcgggtggatcatctgaggtcaggagttcgagaccagcctggccaacatggtgaaaccccgtctctactaaaaatacaaaaattagctggctgtggtggtgggcacctgtaatcccagctactcaggtggctgaggcaggagaatcgcttgcacccaggaggtggaggttgcagtgagccgagatcatgccactgcactgcagcctgggcaacaagaacgaaactccatctcaaaaaaaaaaaaaaaaaaaaaaaaaagagtttctattttgtcatagtaggagaaaagggaaagggtattcaaaacaagaagctgtcactaaacaaaaaatcataattaccttgagatcctggcagcttctttgttagccctccatttcaccatgctaattataaagaaaagtaaacttacattttttgctctggagaacatcaagcaaaatatttgatctgctgtctaagcacctgatggtatgaacaattggaactgttagacaacaaacaatagcattaaacactcaccttcccgtttcgaatgttacataataaacagccggatactgctgacattaacacccattattgtgctgcattagttttatgggtgcaataaacactcctggatgatgaacattttgtaattcaaagaatgactcatggaaaatagttttcatttgctaaagtgctgcagggttgcattaaaaaatgtcttgctgtgctgaaattgattccatctgaacggcagttcaaaagctaccagcaactttaaaaatgcacaaggatgttttgcttctttcatctatttgggaaaacagaagcaaccaaatataataatgttcctgggacccactgcatggttatgtcctgttacataaacaagcattatataaaacagagtcatgattagcctatctttttatggaacaaataaacattaaccaaataaaaccagtttttaccagatggcatccaataaaatattaccattgaggctcattctgtccaaacctttaaaaaatgttaccataccttgatttaggttgacctgacagaccaacatctgaacttttaaaaaagattttaccaaaggattcgctgagtgattctttcgagacgagtctaaaccaatacaatcaaatagaattcagttcaaactgactgttttctctgatcgcaatgattgtgttaaacggtaagactgaagaagtcacttcctattaaacattttctcatttcgtttcttcttggggatttaattaaaccagattctgaagaggatggtgactagttggttattgttagcaagacaggagttagagcaaatgacattgtaacaccaggaatgtctctctttgagattttaaaactagaagagattctcattattctggattttaggatgtatgaatgactcttcaaagactcattcattgcaatggtttagtctgaatgtaatcccaggaaaataaatttgtttttgagctctgaagatccaatatctaaaatgttgatgtagaaaacataatttaatctttataacatccccatgtgggacatggttagctctagatcactctgaattttaatccagtagtgcttcataagaccatacacctttctgaagggtttcagagcacaaaccttcaaatatgttcagttattgacacacaaagcttaaaaataagaaattttgagtaccaaaacaagtatgttttaaagtactcactcttcagtctgaaattccatgattctatacctgggttattttcactgtggacaataactagcttgctctagctttgccaatgttgccacaaccatctataaacaaactcaaaaactgaaaaatagaaaacaacactatatttttcattttttctctaggaaagttagaaataagtatattttctctcctttcaagttctgaaacaaaaaccccactaatcgtgtatacttgcactgactcttgcctcagtaaatctcagttaagtaatttgttacagtagcatttcctcattctggtataatttttatgtacagactgttttcattatttcaccctcataaaaatatacttttataatctagcctacagagttgctactcaatcatgtttcataacaagttctataggtacataccggaatgttattcaccattggcttagaatttaacagtttataaaggtgcaaatatctgggatttggggctgaaaggtactattatgttattaccgtgaacgcacgttcattgtaaatactgtggtaacccaggcctgaaagaatctatgaagttaacattatgcattttttgggttttgaggtttctgaaatgcatccatcactcctgaccaattgacgtttacaaataccacgaggcctgaccatcaggcagctttgttttcattccctgcacggcccttgccctcttcctgtctcggcatctttatctaacctctgtaaccagtcacaactcatttattatcatctgaaaaatagtgctgaaatgtttatacacaatcaatttgtaattaataggaaatgactttatggggtcgtttgatccctgctggtgggagaaagcctgggttatgtctaatggattttttccatctccttcagtggtgacgtgtggcaaatggattgtaaatgaagatagactgtgtaatgaatgacgacactaaagactaatgtgaaggactttagggaaaacaaaaggctttcatctgaaaggatgatctgtggaccaaggtcactcataccactcactgctcattttctcatgttattttaaaacttttttcggcctttatactgctttcagcagcatttgtgtgtaagaagtggacgatgactttaataaagagacccgaatggaactgaatggagcatttgtttttgaagcaacttttactgtcctcagttttatctcatagaagcctccctccaagggcactgccatagactcacatgtttcctctaatgccttgaaaagcattttcctaaaatgaaggtcttgggaacattttacctgttggccagaaacctaaatagtaatcagctctgaaggtcattctgatggcatggaaaaagcattgtgctctagaggaaaaagctaactacgagggtagcctggggaggaccaggagagtacatacaaacaggttttgctgcagtcacactgcagacgtttgacatctatttttctgcttttcctttctacatttctctcatttccttccctctttccttctcttttgtcctttcttcctttctcccaaaaatatttattgggaattccctatgtgctacacttgtactggtaagaagaaaattaacaggtccttctgccccccacccccagcattaagtttaatgaaggagagatattaatactcactctactgaatgtatgattgcaaagcaagataagtgctctggattaaaggaacgtagctctctaagaaggttaagtaacacaaaaaaacctaaccctggtaattttgaagatttgggatcttgcaataagaaggtttgtaggtgaagtaatatttgacctggaaactgaagactgtggtgttaaccagacataaggaggctggaggaagaagcagcataagcaaagggcccgtggtcatcaacgatctgtatgaacttgtataggaagaaagcagagagggaaatggcaggtggataagtaaggagaagcgagatcacaatagggtcaagtgggtcaggaagatactgaagggtttccaactggaggaaattagagggccactcagggtgcagtatgagtcatggaccggagggaaacaagaatggatgcaagaagactgaattaggaggaatttcagagtccaggtagaagatggtggactttgatccaaaatcattgaaactaagaaaaccaggggcctcagatgttctttggtctgttttcatctaaaaactattgtatggatatggctgtcccaccaggcagcaaccagaagttagaggtgggagcatggcttgcagagttattctggacatgtcagtctcagtgcctgtcacgcccacagttgcttttgagtgcaaaccacccagtcacctgcctgtgaagcatagtgagccaattcattactaatgattatcacagaatcgatcacattagccaactgactcaatagctggattcttgaagtggcctggtataaaaagaggactggtttgtgaatagagaatttgacgcccaagatacgacactcccagcacattcattttcaacagtgcttctcaatggtggcaattttacttcccaggggacattttctgtgtctggagacatttttgattgtcacaactagggaggtgagaactggcacctggtctgtagaggagagcgatgctattaaacatgctacagtgcacaggcagcccccacctcccccaacaaagaattatgtggccccaaatagtaacagtgcacaggttgactatacaactcgtcaaatccttagaatctgcaaagggctgtcttttcgtatgctaatgagctgactcatggctggcagctcccaggtagctacaggatggggctgggtaccagaaagaccaagccaggattagagggttgggacttttggccccaccccaacctcatgggagggtagaggggctgaaggttaagtggatcaccaatggccaatggtttaattaatcacgcctatctaacaaatactctataaagtccctgaggacagggtttgggaagcttctggagagctgaatacatggagtttcctggagggcggtgtggcagggaaggcacagaagctccgcaccccttccctcataccctgccctgtgcgtctcttcatctgtatcctttgtatccttttcatttctttgaaacagggtctaactctgttgcccaggctggagtgcagtggcacgatctcagctcactgtaacctccgcctcccgggctcaagggatcctctcacctcagcctcctgagtagctgggactataggtgcaagccaccatgcctagctcatcttttgtgttttttatagagacaaggtttcgccatgttgtccaggctggtattgaactcctgtcctcgagggatccacctgcctcggcctcccaacctgctgggattataggcatgagccaccactgctggcccataatatcctttataataaaacagcaaatgtttccctgagtcatgtgagccactctagtaaattaatcaaacctaagaagggggacatgggaaccccagctatagccagccggtcagaagcacaggttattcaacctggggtttgcgactggtatcaaaaattggggagaggcagacttgggactgaaccttcaacctgcgggatctgacactattttcaggtagacagcatcagaatggtactgaactgggggacaccctactggtgtctgctgcttgatgagtggggaaaacctccctgacatttggtcactgaagtcttctgtgttgattgtcgtggtgtgagagcagaggaaaaacagtttgtgttttttccactcagattgagaaaccctgactgtcaacgatagaacgggtcaagacttccatgtattatgaatatggcagacaaaataaaattcttagtttcataacggaaataaaggagaaatgtgatgttccgggaaagcagctgagacacattctaacagtatagcttatttgcaatacattgggtatttactcaaccagtgtttactaggcatcaaacaaactcaaaatacttgttagaaaaaaagacaatacctaagatgttttcacagattcactaatcaccaacatttctttgaatgtaaaaaatcttataaaggttgtttgcagaaattaaattagtaatttcccaaatttgacatgctatttgattctgttagcagataatacaactaacttttttttgttcgtacgttttcatggttacagagctggagaaagaaacgttatgtatgagaaaatactttggtttaaattgtttacgagtaatttctctcatactgatgtgctaaatggcttctctttgtccctccaggtcactctccatcttttccgccagtgcccaactgactgatctttacagatggtgtcaacagatgcatctaccctctggcttcaagttgagttggccaatgaagggtgagagaaaactgaagtagggttctttattcacccagcccttccccaagaggtcaccacggcctcacggtggcccccatggctcatattagagagacatttgcgtagctctgtttccactcacctcttccagcctagggtgggagcagagcccctacaatagctcttgcatttgccttatatcacggtcacagcaccgaaaatagtctcattattaaactctcactgaagaagtgttctaattgaattggactattctgtgctgagagcctaatgagtagaacttctctaatgatgatgtagatgttcatgaagatttacagtttccacgtatgttcacccagtacatcacaatggatgcacaaatgatctgtataatatatacatgtaactggaatgagtccacagatgcagcatttgatgtacaaaaatcttcacaaaaccaaagcatagggcagaagaaaagctttgtaactctttaaattatagatgattccaggcatcagtgtagtatttgcatagctctcttagaacaagggacactgggaactcaggaagaatcagaactcttttcatgaatttctttagtgcagtcaagtttcctcttttatgaaccagcatagttaacccatcttctaaagaattcgttcattaccacttacatagttcaatccccagcttgcttggagattgaaaaatatctctaagatacttgattacataagtgttctgcctagaaatcccaaaactcttactctttttgctgtcataggaggcgctgcggaaagtacatgacatttgcagttgtgggcgactgtgctgtgggatgaaaccaggctcctcatcaagatgaacatagattcaagtctccatcttagccatttcctagttctgtgattataaataaactccttgacttttctgagccttagtttcatgatctctgtaatgagaataatattatctcttcccaagcatttgataataattaagtgaggtgatataaactgcctagaccagtttttgactgtagaggtttttctttctttctttctttactctaatttcacctctggaaaagcagtcaaaatgagaaaagtcaaacccgcatcagaaaagaagcaacttgacacacacatgcaattaacccacttcaccaggatatgtcaccaaattgacatcaccagaaatagctgatacaatggtttgcttcaccgtttatcagtaatctcttatcttctctttcctttttacttcgctcatatcttattgtcctgctgtcatcttttcatgccatgcatctctgggacacccagcctgaagtggcatatatttgatgctcaataatacatggcagatgacataagatattggctttgcaaaatctaccgctgttctgaactatcatacaaaacaattagttgttagtatgccatctttcttattaatcttcctcaataatatgaataatcttaatatttccatttaagaaaaatgcaagctatatgttattctcatttgacaaaaaaattattctaagaggaaacattggaaaatgagtttcaaaatagtggtacacaaatttgattctatgtcaaatggttttaaatataaaagtagcataatcatcaggagaggactttaaaattcactctttctacagatcttgaatggccagataaaaatcagaactccaaccagttcccaccatctctgatgtgagctcctattttgtgtgccggatgactcagtggacgccagcagcagatcaatttaccgtagcacaaggtgtctctgtcccaaggtttgtgtacttgcatttgcggcaagtccagtcatatattacacatctcctctggctgtaactggagaccgtcaaggtacaatagtgctgaaagaagtgtacttttccagccagggaatttgtaacagatcctgcttcatcttgcatcgccatacaaagtacctccattccatccttcctaaaagtgcttcagtgactgaaagtggaaaaagtggagcagaatagagcttgtatgcctcagagattccagccatccaacagtcctaactcaatgtaatttaaatcttgcatgtttttacttttaaaaaaatttggcaactctaaaaaagtttaccagaaaatagtgtatctgcgaattttcactagtttccttcaagaagctaggattttcgtagactgaatacattaaatattgagatttaataaaattaattttgctgatacaaaggaaaagtgaaagaaaaagtgagacagaatactacaattctctctttcagtgataagtaaatggtaacaaaagtcatctgtacaaattcacagaatatgatgtcataaagatgggtcatcaaaatgcttttcagtgatccattcaataagatgtcccatcatgagggtttgagtagcgaataggaaaggaagttgtgaggcttcctccttcgatgggagcccctcagcacctgagaggcagagggctgggcggggaatgctgatactttccttgtcaattacgaggctggcttccccttcatgattaaagagcagaaaggggcaaatcagatagctcatggcttaagtcgtttgcattatgtgtaggtttcaattttccatggttcccattctcgtagacgttagacagctacgctttaatcttttccttggcagctttaatctctctccactcagccatttctaaattggggataacatcaataccgtaaggattagctaagcatatctgtaagtacgtgacaatcactgtaggctgttttttataacgtgacttcaaaaccgaatctgttacggagttgctcaagttaaccatctcccgataatgagttgtttatggaggtgaagatgaacaacccagatgctttgcaatggtggcgttagaaaaatattttattaaatttttccctattatcctggaggaatatgtcacacaacaaaatatggagagagaggaagagaaaaaaaaagaaatggaaagtattttaattgatcaggagttcaagactagcctggctgatacaacaagaccctgtctctgaaaaaacaaagaaggacgaagtagaaagtatatttctgagaagatacaggttatagagatcctcagttcacaaagcaatggatatttacttttccactatacagccctatcagccgaccacaacgctggtttgctatttttagccagttcttttctgcaggatgtctgcaagccttccgggatttcaaagcgatccttccagtcttcttcaaaaggagtagtcttgcattccccaacatttccagtatcaacactcttcagcaccttcacctccagagattcctttattcagactgccctgctattggagctgcctgttacaggaacactgccaatcacgtaagccacacaattgttaaaacactggctcacattgggaaaacaggagttgttcatttcatggaaagcattcttcatctgatgaatggatttggttatcaacatagtcctttcattggtgagcccctgatttatttacacttgccacagctctaatcaggcacatggtagctgtgtatggtgaagcactggctttcaggagaattcttttagctttaacagtcgtggttagcataactatgtggttatcttctactgtaaaaaataattctaggacataaatttgattaacttctggaaggttgttgataacagtggtcctctccccttcctctctctgtcccagcccctcattggagtgcatcactcagaatgatttctagtgcactaagggagaacacactgggcagagcagccctgggtcttggctctggctttggcactgagcaagtctctgaaccctccccatccctgatccttcatggaaggttccttccagctcttataactcacattcataggaacgaatcatggaattgagcctcagaaatgaatcctatttcaggaacttttctcatttcttctggaacgcatcaggtttgcataacctatgttttttattgagagtgatatgacattctgctttccttcttgttttatcatttgtaattaatgacagctattggcccaatttctccttcatgaaattacagcgattatcatttcctttccattttcttagaaaatcttttgtagactttctgtatttcttaacattcagcaattgttatagttcgcagagtgctttatggattacagaatggtttcatttagcttttcctttaaaaattgacatgctcatatggcagatattattattctcatttctaggggaggagaggaagacctaggaaatatagtaacccagtttagtttccttgctagtaaactgagggaactgaaactgaaaattcatatcgtttgactcctaactcaagtagttaggactgtcaagttagatacaaaccctgaacgaagctttctaagaggcctttgggaaagctatttaatctctctgagcttcagttctctcctctgtagaatgggaagaatactggctaagtgtcagtgaggttaagagcattaaaggggataatctgtatggggggagccccacacagagtccagcagataatgagcagacactccacaaaggtgagtgtcttgtcccatcttcttctatagtcttccttgtctctgttgtggtcaaccttggatctatgctgcttatgctggaaaagtacgccctgcctcctttcctgagtaacttattctttgggatcagtcatataatacttaaaaagaattattttagagatggggtcttgctttgtcacccaggctggagtgcagtggtgccatcattactcactgctcctgggctcaagtgatcctcctgcctcagcctcctgagcagctgggactgcagacatgccaccatgcttggctaagtttcttttttttaattttttttttttgtagagacaggactttggtatgttgcccaggctggtctccagctcctggcctcaagcaatcttcctgcctctgcctcccaaagctctgggatttgtgaaccaccgtgcctggccaatttttctatagacctttgtataccaaatttgtgaaactccacttgcaatctgattggcaatgagcattcgtttgcacgtgatgattactctggaagtgtaagctctaccccctacatttgtaaatgaaaaagacacaaaaggagagaaacacttctacacgacctccttccttagatacagtatcagggttctaacattaacttcttacatttaaaaaaaaattctgaaatttatttaaaagaactaaagaagaaaaatatgtctcttatttccttggatactttcctgaatactaaaatcagttaattttcaagacaagaattgttaaaagacgctcaatcaataaatgaccattcctttgcgatgtgtattactccactagaatggaagcagcatgaaagcagatatctgtctcatctgttttgctctttatctccaggtggtacagcagagccaggaacccaggaggtcacagtcaatatttgtgacatgaatgaatgagtgaaatgagtacatgaacaggttgagtggtctgtgagtgtgaggatagatatacagaggtacagaagatgctctcctgccttcagggagcttgcagtcagcctcaagagacacaatttacaagaaaagacgagtagtccacactgccagggagtgagtgggtggtgtccattagagcacaaggagggagcctgccttagaagtttggggaagcaaaagttcaccgtggggccagaaacctcacttcgttataggagttaataagaaattattttaggcagatacgaaaaagggtccttgccaagtttttgtttcttttaaagtagctcaagaaacatttcttgcctagcagaaaagcccccaccggcaagctttgatatgcaaatgtacgccattagaaactgggtccacccaaacaaggcaatacccgctgtcttttcctggtgcccacaagtgcctggcaacatggctgccccacataaccccacgtgtgtagaacatcatggcgccctgcatttgcatattaaaagactagggtgggagggccagttatttcacgggctatgtgaatgacatgcctggtcaaaccaatcccctgtgccctatgcaaatcagacaccgcctcctccagactcctcatataagcagccactttgctgccgcacagcgagttttctctttgttccaatccccactccctccgtctctatactggggagctgttttcttcttccttccttctttcttgcctattaaacttttcgctccatgaaaccactccatgtgtgtccgtgtcattaatcctatcggcgtgagaccaagaaccctggtgttcctccagtcatccgagtcgtatcaacttgttcccaccccaaaaatcactctgacaaggcttttcagtgaatacacgcagcattaaaacaatggccatattcaagccaaaaagttgccactgattgagtttatatgaatgttgagaccaaaaacacaaaaacagcttgccatgatataagacaatggttttgtttgcatctatgacattctcattgttatattattacttaatattctgataaactgtgtgatttgctgaggccactttggactttttccctaaaacagtcattcttctttttgagaatatatcctctaatgccactggtccttaaatatgtacatgtacagctgggtttaaaattgataaacgcattgtcttagagtcctagccctagaggcagaataggatgtggtgggtggtcagaattataattagtgcaagaaagggacacattttacaaaatagcacattttttttctaattttaaggatgaaagtactcaatggataactgaaaaacacagaaatatatttttaaaacgcatctccccccagagagaaccattataacttttgcttgcattcttagtgtcatagtcgcatattcaaaatatgtatgagacgcgtatatttgttcatgtctatttaaaaagatacattttggaaatatatgatgatgactgttaaatgtcagacattatttactcactctacacatttcgctgagtgacaactgtcagcatctgcactgtatcggtaggcatgggggaggtggctggagaagaaagcacacaagattacctcctctcagagttacgatcccatgggtcaagcaggtattaggcccaaatgaaattttaattacaaaacatatatgcaatatagagtccgggtgcagggtgacagggcgctataagaaagaactaactagggactcaatccatatcacagagcatagaagtctcctctggcaagacaggacttaagctgagaggtcaaagataagaaggcaatttctttgatggaagggaggagcgctgtgtgggagcgaaggattccagacacagggaacagcacacacagactcggaggagccacactacccttcctggagtgcagacagcgaggtggagagtaagctgaaacagagctggagagcaaggactgcgctataaccgcgctatgtgccaggcttgggatctcacgtgaaacaaatggaggacctgatggcttttaagcacaggagtgggcgtggtctaatttgcattttgaaaatgactgccctggctgcaatgccaagagggccgtggtaagaggctacagcatagtttccaggcaagaaggcatggtctctcgaactagcgtggtggcggcacgggtagaggaaagtggatgagtttaggctgagtcctggaggcggtgccttgtcgcctacagactatggggctgtattagggagacaaaaaaggagataggggaattggacaatttttggtatctggcatgatcatctcggaggtgatggaaacactcatatataaatgatgggaggacatctagttggaaagcgtttcgttttggacgtgttgatttgaaatgttcaagttgtggttttgttttttttttaatggcaatgtagaattctattataaaagccaatttttaaaacacaagtatactacttctggagcacagtttgtttatattttatattagtataatttaaatattgttctgataaacatccttatagatttacctttgcccatatctctgtttacttaggaaacatgcgaggttaattgacatatttaaaagctttttgatgtggcacaaggatctttatttctaagaaagtgactttcatcatcactttagagcacacgggctccccttacagactcatccattgctgaccctgacattaattctatcaactaatcctaatcacaaataagcaatccttaaccagcagaagaaacctaggatagctctatataagccacaagccaaggaaaagttgaacaaagaggattttacggttctttactttcctccttcttattgaactgccatgctattataaaatcaagtcaattttatatgtgatatatatgaaatatgataccacatattatataatatatattacacattgtcatatatatgtgaatattatatgtatataaaatatattcttacatacaacaatacatttacatacataaggtatacatattatatataatattatacatattatatatgtgtatatataatttttgtttggttttcctaacttataaaaaaattttgagcactcagtccttttttttattttttattttactttaagttctgggatacatgtgcagaacatgtaggtttggtacataagtatacacatgccatggcggtttgctgcacctatcaatctgtcacctaggttttaagccccacatgcattaggtatttgtcctaatgctctccctccccttgccccccaccccctgacaggcccctgtgtgatattccactccccgtgtccatgtatgctcattgttcaactcccagttatgagtgaggacatgtggtatttggttttctgttcctgtgttagtttgctgagagagcactcagttcttaaccaaaggctcctaattaagtattagtcaaaattccattacatcttaatttgaaaactacatatatttagttacaaaataaaagcccaattacttcaattacctatattgatgaaataaagttaagtttatatgtcatttctactattctttccttaagtggtttaatttgtcaaatatgtcatcttttcccaaaaatgaatcttgattaattttgacagtttttcttttcaaagcccttataggtactgttgttatatggtgaacactcaagggatacacaagtcctatcattttcatcaccaacacggacttctgatttgttttatttgatatgtcaccttgttgatttaacataaattgttttattttcttaatttctgaaaaatactcatattgctggtttgttttcactgaaggcctcctgtccattttttcccttctgctttatcaaaaaggactgaggtctcaaatgacccatgagaatatttaagtcacttatagagggcaagaagaagcatagaaaaaaaaatatttctggctgggggcagtggctcacacctgtaatttcatcactttgggggaccaaagtggaaggattccttgagccaaggagttcaataccagcctgggcaacatagagagatcctgtctctataaaaaataaaaattatttgggagtggtggtatgtgcctgtggtcccagctcattgggaggctgaggcgggaggatcacttgagcccaggagtctgaggctgcagtgagctatgaccctgttgttgcactccagcctgagtggcagagcaagaccccatctcaaaaagaaaaaaagaaaacatatttcttctttgtctaactccctgaacaaagagaaaaactactttatagacaggtcttgagcactgcgggagagtcaggcacgtggggccccagtatctcatggatttcatgtataagaagcttcttcttcttttttttgagacggagttttgctctgttgcccaggctggagtgcagtggcgcgatcttggctcactgcaagctctgcctcctgggttcatgccattctcctgcctcatcctcccgagtagctgggactacaggcgcctgccaccacgcctggctaattattttgtatttttagtagagacggggtttcaccgtgttagccaggatggtcttgatctcctgacctcgtgatccgcccacctcggcctcctaaagtgctgggattccaggcgtgagccaccgcgcctggccaagaaggttcttctttccagctttcttcagggatcatgcaggtatcttcaaagtctaagatgctaggaagtcatgggcactgtgttgaaatagagggcgtatgccttacataaacacatccaaactcttatggtaacaaactgtgctggccaaaggaaaaactactgtcattcaggccacgagtttgcaactcctggtttatcacaattatagtgatattcctttaaactaaacatttggatgtaatctttttccacctatagaaagagaaatcacccttataacagtggttttaaaactttagtttacacaagaatcctatgacgagcttgttaccactgtgggttcctgggcagcacctcacaagatttctgggtctgcaagtctgggataaacatctctgagacaggtgacccaggcttccacaagcgctgaaggaatttggattcattccaaccagttaacactcagagggtgtcaatccagttctgagaaacttcaagaaatcaacctcacatgatgtagaaagattcaatctgtaaatcatcatagctcttctttccaaagtcttttataattgagtttaaagcagagtacaagcaaatatctcatttgtatgatccatcaaaggtcaattgttttcattatgatagcaaagaggttttatttgttgttttttgttgggttttttttttttttttgagacagagtctcactctgttgctagactggagtgcagtggtgcaatctcgactcactgactcactggaacctccgcctcccgggttcaagagattctcctgcctcagcctcccgaatagctgggactacaggcatgcaccaccacgcccagctgatttttgtatttttagtagagttggggtttcaccatgttggccaggatggtctcgatctcttgacctcgtgatccacctgccttggcccctcaaagtgctgggattacaggcatgagccactgtgcctggccgcaaagagatttttaaaagcctgattttgggcgtgtgtgacactatgggttgaatctcatattctgctattgacggggatgaacttgggcagtttatttcactctcaagcctcagctcagccatggataaaatggagataagaaaagaaatgactgcacgatgtggttgtgaggagtcaatgaggcaatgtacagaaagcacttaccatgcatggcacacacgagggcagaacaaatgtgtgttatctttgtcactacttttctacaagaatcagaacaggatgctaacaacatatgaaactgataattctgcacttgttttcagggatattttaaatggtcacctcctcatcccccaaacataacaagaaaaccccatagaattacagtttttattactttatgttagtgaataaaacttgtatctctattataacactaggatagaggtttttttgttttgttttgttttgttttgtttgagatggagtctcactgtctcccaggctggagtgcagtggtgcgatctcggctcactgcaagctccaccacccgggttcacgctattctcctgcctcagcctcccgagtagctgggactacaggcgaccgccaccaccacgcccggctaattttttgtattttttagtacagacagggtttcaccgtgttagccaggatggtctcgatctcctgacctcgtgatccgcctgcctcggcctcccaaagtgctgggattacaggtgtgagccactgctcccggccctggatagagttttaaactgggggattttgaatcctttcagctctctctgttttgataagatatttctccttatcactatcttatgttattctgaaggtgtaactcatgaaatatgatctgtcccctcctccaatgctatccacttgtttccaagcaatgaaaaatcatagtttctatattcttcttataaaataaaaagaagcagaattctgtgatggaaaaagtaataatgacttgtatacgaattctgtggatttttacttctcccttaattaatgcatcaatgctacatatttttataaaacactaagtccctgtgaaatgtatgtgcctctaaaaactcaatgcattgatatacctaccctattgaaatggataatttcattaatagtaagttagagaatgctgattaaatgaagaaaacacatgaatatatttaaagtgatgatatcttcactttttatggtataattataagtatatgaacaattctacacagaattacatacattatgatcacattagataatttatcattatgattcatcatttttatgctaaacagagaaggaaaaaggaagcaagacaataaggagggtatgggggaaaatgagaaggaagaggagaatccatctactagcaaatgtttattgaccaactactatatactcatgatttcaggagccaaggagaaaagttttaccttggaaaagcttatggtctaattataataactcttttactgctagagaaaaaaatattcatgacacttgttaaggacacacagattttatgaggggggacaccacaaggaggtttgtagttgggaagagtgactgagctcaactccaactacaaggacgagcggagactgatggccaagaagcaggctgcgggtgagcagatggaaaattactaagtgggaacatcaaggccgggggttattactaggctgactcaaaaataatcttgttgaaggcaggccagggtgataagataccaaggctaggggatgaggcatttgatcaggtaccaagggggatcagaccccaagtgcaggggactttcattaaactgacgcagcaggattcttgctgaaattagactaaatgggccaaggacagaccagagtgaggttagggagagagtcactgtcaatacaaaaaataaagaaaagaaagaaagaaaaagacaggagaggcagagacagacagacacacacacatgcacacatgcagaaagagaagaaagataacaaggacatgtaagtaaatggtctagcctctaagtttacaggagttaagagaaagtgagtaaaagtgtgtggaaaagaattcttatatgagattgccctagagtacatcttaagggaagaacctgtctctctctctctctctctctctctatatatatatatatagatagatatagatatagatacagatatatatttagtgtgtgtgtttattatatatttatttatatatgtgtgtgtttattatatacacataataaacacacaccttggtaaaccacttggaggaaggggccccaagatcatgaggaaatgagctgactcagaagcagctgaacagcaatgcttgcgggattaggaggcatttgtcagaggggcagctacgaagggggcagtggagggaaaaaaggatggatcccctgatatactgaagaaatcttgcaaaggacagtggagggtagagagtagggtgttaagtcaacttttaataaccacacacggttttgacatgtccactgctgcttgtctgcaagcagaagtggcgtgattcgatgatagtcttacttctggatggcaaggatgattttttggccagacaatactgttatcattaacaacaacaaaatccccacacattaagtactgggttggctgaaaacagacctataccaaatcaacacctcaccattaaggagctaagcctaccgcacggcattttctctttagccagagccaagattttatgagaaaatatgaagagaacagagagttgccggaatgcaatgtcactgcattgcagggctgtatttgttggcaagcatctgagaccagcctctgcaaactgctgtaggcagggcctggcctaaagcggatgagcccccctggggctcggttgccctggccacaccatgatccttctctatgacttaccctctgaagaaaacacagcttttcctagcagctaaaaaacagtttctctagacttttatcttccatgataaatgcagatgtttaagggtcattttgtaaattatccttctacaatgttttcagttctcaataatcaactacttgatactcacgagaaaagcagaattcttcttaagccttctgattcaaaatgcttctcctaaaaatgtcttcctctgctaataaagtgtttcacatcattacaacacggagaaaacatgtagatcccaggcagtccaggctatgatgaatatctccagcttttcagaaagacaaagttgattccacatcactgtgactcctaatgaccagttgtctcaagggaggtctgagtcacagtcccagcagtgtctccaaaggcagtacggtgctcatggataattacagtttcatatgttggtaaaaacacaatccacccagtgatctcatgtctactcgaacgttacagcagttctagagtatcgctgtagaatcatcgtgaactgtggtattttgcagtaaccattaaagtacaacagtgtttgaatcatctgtgggtctattcgtctgcttgggctgtgataacaaagtaccacagacaggatggcttaaacatcctgtgagaaatgcatcctgtgagaaatgcattatctcacagttctgaaggctggaagcctgagatcaaggttatagcagactggttccttctgaggctgtgcgggagagtctgttgcttgcctttccccttgctggccgtctttggcttccttggcttgtagacgcatcacctggatctctgccttcatctttgcacggtattccccttgcgcgtgtgtccatgtccaaacttcccctttttataaacaaggacaccacttatattggatcaaatgcccaccccactccaaaatgacctaatcttacctaatctgttaatttaccagccactcatttcccaaaaaaagtcacatacgtaggtactggaggttaagacttcagaatatgaattggaaaggaaacagaatttagccaatatcagtggcatttcagtgaaagtaggccacctgatatgaagacccttcttgaaaagattacagagcttaggaacataagttgacctccaactggctttaaagtctctctatagatggcctgctaagctgcacactttccagagactgtggttttgttctcaatcaaaagtctttccttcaaagcatttttccccataggaaaaaataaaatctttagggaagacacatccgtcaacttttcccagtaggtttcatttaaagtccctctctggttggcacttttgctgactgatttctcttttaaccctcatgtcttttcccgcatgccattgttggataatatagcaattcgaacactgtttgaataacaatctagaggacaagagcctttcctgctttcattcatttattcattccacagatgattttcagaaccgctcttcatggcgtgacctctgtaagcccttcaggataaaacatgaataaggcactgtccctgccacgcaaaggcttgcactcaccagtgaaacagaatgaagacacccttctagaataaaggcatccaatttgcttttgtttagaaaactctcacccttccacaaagcaatatgagattttacatattaaagaacaaaaaaattttggtcaatcacggtggctcacacctgtaatcccagcactttgggaggccgagacaggtggatcacctgaggtcaggagttcgacaccagcctggccaacatgaggaaaccccagctctactaaaaatacaaaaaacaacaacaacaacaacaacaaattagccagacatggtggcgggcccctgtaattccagctacgtgggaggttgaggcaagagaatcgcttgaacccgggaggcggaggctgcagtgagctgaggttgcaccactggactccagcctgggcaacagtgagactccatctcaaaaaaaaaaaaaaaatgagagagaaatcaaggcagttgctgacattcaactctaatcagatactcaagacggggtctgtctttctaaacactgttctgtggccccctctgtgcatccctagactgctcaaggagaagatgcttgatcatggctcttcgggatagtttgttactgagtcaggtcgcttctccataatttgcactttaggtgttttggatagtaccttctatgtatgaaatatgttctgcctttctgttccaagtcaaatcattacagatatcaaaatcagccaacaatcaaggctaatgtagctctttccccagttcttaagaaaaatccaaagaaacacagtttgtacccacaaaccaataggcaatgtatcagttagtaaaacccgatccaaattcaataactgagaagtttttctggtccttaaggcacaaggggttcaatcccaagtatctactatttccacaagcttctgtcccaccataaaggggctgagtctcagctatcaataccacattttaaatttattattttatgcttaaatatcacttatctgtaacaagaaactcaaaactaagccatgggagataacacgtttaagagactccttgacttttgcatcagttttctctgcccccataagcttgttgagatataaagcaagataatggcaaacacaaaaatgtctctcactatgtcccagcactattccaagtgctatagcaatattaagacattagatcattagaacaaactccaccaaaaggccaacattttaccatgagtagccattgttagtacccaagaactagttctttagacataccaactttaactagggtattgatagggctaattatcaccaatttgaagctgtccagttaaaacctagaacggtgggctgtttttgagatatgtatatgggtggaaaacatgatttactctccacagagacaccaataatcaatcagagccgtagttggtaacacagagcatcatgggagaatgtggaaaagagacacaggctgcctttgaaaattaagtgggagagtagtgaacaggtatgttttctttttctttgtgacatggtctcactgtcacccaggctggagtgcattggtatgatctcggctcactgcagcctctttctcccaggctcaagtgattctcctgcctcagcctcctgagtagttgggattacaggtgtgcaccaccatgcctggctaagttttgtgttttttgtaaagatgaggtttcaccatgttgcatgttggacaggctggtcctgaactcctgagctcaagtgattagcccgactcggcctcccaaactactgagatgacaggcgtgagccattgcacctggccaacggtaagttttcaatgaggagacacgtgctattcaaacttagtcccatatttagttgtgcgaagagaagtaaatataaagccttcacaagaaaagcaccaaggcacatggtttatcctggctctggttggctccagtttcacccaccctccatccctgcaacaaatatttattgatggccaactgagagtgggcagtatcctcagttccaaaactacaaaggctgaatgcagttgcacataggcaatgggtactgaaaccatcaattacacaaagttataaagtacgtatgggaactcacaaacaggatatttaggagaaggaggtggtgggaagctttcaagacagagaattgaatgttcataagtgtgacatattcagaaattaatttttaaagtaaatttcctcaaatctaatctaaattttaattctgaattcttcaagctgacccttgccaccattgataatagtgtgataaccataaatcccatatttctgatcattcccagttttgagtattctgtctctttgtcaagtcacatgtcccaattttagggctagaaaacatggtcatcacgttgattagaaatgcaatttacagaagatttccctttccgtctgcttctaagactatgcaagagtctcctttcacctcccacactcagcttctgctctcactaccaacagcacagcatgcacggcacggcacagcatggcacgggctgtcagtttcactgaaggtggaaattcctcaagaatgcctaattagaatgttttaaaaaataaattcagcttcttagacagtaagaggactaccttctaaaagattacatagcacagttattttaattccaaatgtaattgaaattccactcagaattgtcttcttgaatgacaagtcattctatttcaacaatgacattgactgattttaattatgacatggtttcctgtcagcctggtgcttgaacccgattttaaggaaaactcattcatctcgtgcttctgccagtgagtgagtgagtgagtgagtgagtgagtgcttcacgagaactggaggagcatgtttcctacgctttgagaaatacatgtgaccttttgaaaagtatatcaagttctgcattgtactagcagtctcaccgtgggtgaggcaatttcttgaaacttctgtttatttactcttacagtgagataggttcaatttttcttaacagagctattgttagggtgaaatgaagtagctgcttagccatgtatctgaatccaagatttttgctctttattgacaccataatgcctcaatcttaaggttgatgggcactaaagtgcttaacttcagaagtggagaactccatatttcctgagcccaggaacaaatgcactaaatccttcgtcaaaaagtacctctaggtctgtcctcctgccccaaagtgatgaaagatgcatttagcagggctctacatccttggttcagtcctcctacaggctcctgattcgaaagctcaccaagtgatgcctcattaaaaccactttattttagctggaagtggaggggagggggaaatgaggaatgaggaagcaatgaacacagaatgatgtgaagagggatgctgcctcagcagggaccggcatccagccccacaggtgctgtgctgtggagtcggctccagcatctactcctttctgtgctatgtaagtggagaattacacatctcttcagagttggaatatcttctcctctctgccccttcaaactcagtgtcatctttggaaatagcagctcacaccactactgctgttcagagactgtcagtggctgcctgcctcctaggttttagagaaatcattctttttttttttttttttttgagatggggtcttgctctgtcacccaggctggagtgcagtggcatgatctcggcccactgcaacccccacctcccggttcaagtgattctcctgtgagtagctgggattacaggcacctgccaccatgtccagctaatttttgtattttttgtagcgatgaggcttcaccaggttggccaggctagtctcgaacttcggacctcaggtcatccacccgcctcggcctcccaaagtgctgagattacaggcgtgagccaccacgcctgaccaagaaattattcttaacattttgtagttcagatattcttttgataatctaggggaacctaggatcctctcacccagaaaaatgtagacacatacacacacacacacacacacacacacacacacacacacacacccttttattctagttccatgctctaaaacttgtccacaaactccagactgaacaacttgctcaggaagatcagaactcaaacttcttatcctgcgtgtcaaagctctctgtaatctcaccattcatcacccaagacttgaccatttctgagatcccagtggaaagcatccactctgataattatctctgatcattccaggcaacttatcctagtatctacactctggttacgttccacctccccgagaaccccagtgcaccaaccctatgagtttcccgcctgtcagcaccactccccacaactgctttcccccccagcagcctggaggccagaacccaccagtgcaaatgtcccttcatattctgccttcatcccctgctcctctattctccccctgtacacatgcctggcaatacaccagtctgtttacattcaaccctctaactacattatgtccgcttcaaagcacgaaagcaacaaagaaaaaggatgcaaatgtgctgatgggtctcacttttaaagacatcactacgcggctcaatcagtatttaaaactgcctggtgattctaacagatttcccgataaatactcctgttctctctcctaaaggaatactcagtgcctttttatcttttgttcagccctttaacctctgcgccctggccatatgttgatggtcttgctatatactttaagaaaatagaagtattctgacaaaaattactttatttttcaccctgaatgcaccattttacctaaatttctctcctctctcattttattgaactgtccatccttctctcatcagacaaactgacccattgtcaacagtgtattttacctcttccattcctcaacaaattcttccgtgcaattgttcctaatatcccactggatcatcagtttccttctcttcactggaatagttccatcagcattcaaatatgctgtaatacttccaccttaaccaaaaaacagtgtgttctttggcccacgtccctctctgactgctgctctatttctcccttctccttcccaggaacagttctccaaagaggtatctgcacttcctgtctcaactttcttttttttttgagatggagttgcactcttgttgcccaggctggagtgcgatggcgcgacctcggctcaccgcaacctctgcctcccaggttcaagcgattctcctgcctcagcctccctagtagctgggattacaggcacgtgccaccacgcctggctaattttgtatttttagtagacagggtttctcctaaagttggtcaggctggtctcgaactcccaacctcacgtgatctgcccgcctcggcctcccaaagtgctgggattacaggcatgagctaccacgcctggcctgtctcaactttcttaacgcccatccactgtctccagaatcaactccagaaagcccttcatccccatgcccccagtgaaaccattctcatcatagtcaccaacactctccaccttgtcaaatccagatgtctgtccagagttctcttcttacttgacctcttggtagcatttgacccagatgagccgcaccctcttgaagcgtttctttgcttttcttctaagacgccacacagcctctgggctgacctcctacatcagtggccatttctgttttctctgtctcttcagagaatgtaggcatgcttcagaactggtccatggccttcccacctcaccctcctctctcctttggtgatctcagaaggttccatggcttaagtactgtctaaacactgatagctcccaaacatatatctccaggaccaatctttcacttgatctccaaactagtatggtcaacagcccagttaccacttgcaggatcccaaatggcacacggcctagacagaattactgatttattaaactccttcctcataaatgtgcttttccctttttacccttattccccatacatgaagaaccattctacatattcttcaaccatcatacattgcaatcctgttgcagctcaccacctccccagccatgacctctgactgctcctgtccaagcccccctcatctctcactggacttgcattccgctccacaccagctttcctgctttgtcattctctggcttaatatcctctaatagcttctcagcatataaagaataaaatccaaactgattgccagggtcttcactgcccttcagactctgaccccacctacttctttgacataatcttactcttctccacccaagctggctacaccaacttgttccagcctaggtacttttatctttgctgttgcctctacagagcagtctcccccaggttttctcatcgctgcaaaatgtgtgcaaaacatcattcaggagtctgttcctgtttttctttgaggagtcctatattgccctatctaaaaatattgcaccctttattctctaacccagtggttttcagtcaggagagacttttgcctccctaggggcatttagcaatggatagagacatttttggtggtcgttactgggagttgctactggcatctagtgagtagaggctagggatgctacaatgcactggacagctgcccacataaaagaattatcagggtcccacaaatgtcagtaggattaaggttgaaaaaccatgccattcgtctacttcgttattatcacagcacttatctgcatcatcataataataattaacatgtatttcagacttaccacgtgccggacaccattctaaagtttttacatttatttcctctttaatcctcatgttccaaccatataaaatgggtcctattattacacagatgggacattaaggcaggaaaaggttaactgtcttgctccagatcaagttggagagctagaatttgaatgtagatggtctggctctaaagcctttacctttaaccattgcattagagggccatgaggttacatttttttcctatattatctgtcttttcccactaatatactatctccatgagaacatggaaataatatacttgtttatctctggatcctctctgtctagacatataggaggccctcaaaaatcttgaacgaatgaagagttctgcatacctttccagcattgcttcttataatctcacacaaagctgacttcccgggaaatgacctgctttctatcctggagacattccagtttcttgctttccctctgattcagcccacactctctcaggtccagtttttcctcctcactcctgtactcaacacgagtatgattgcacccatttctccagccccgcctccaatcttgcataacacatttcagacccatagatccacagagtcattttggtggaaagaacgttagagattacagctttcaaattatttattttacatgtaagaaaagtaagacttggatggctgggcacggtggctcacacctgtaatctcagtactttgggaggccaaggtgggcagtttgtctgaggtgaggagatcgagaccagcctggccaatgtggtgaaaccccatctctactaaaaatacaaaaatttgccaggtgtggttgtgcacgcctgtaattccagctactcgggagtctgaggcaggagaatcacttgaacccaggaggcagaggttgcagtgagccaagatcatgccactgcactccagctggggtgacagagccagattccatttaaaacaaaaaacaaaaaactaagacttggagaaactaagcaagatactgatgaaaattccagtttttcttccttctgtttggaattttcatgtaactctgaaatgcttctgggaagaaagaatttgtagaagctcttagggcaacaggccccccatagcccacttaggaaagcactttttgcagtcctcaaatcgaacaggaccttcatttagatgactacatttccctaggtttatattttctttttttttttgagttggaacctcactttgtcactcagtctggagtgcagtggtgtgatcttggctcactgcaacctctgcctcccgggttcgagtgattctcctgcctcagcctcctgagtagctgggattacaggtgcccaccaccatgcccagctgacttttgtatttttagtagagctggggtttcaccatgttggtcaggctggtcttgaactcctgacctcgtgatccacccgcctcggcctcccaaagtgctgggattataggcatgagccaccgcgcatggccccatattttctttactcttgcccctcagtacaatgtgtctccatgctcttattagaacaatttccacctttgccccttattttatctccaccccaaaatcagaactatggttcttgcctttaaggagtttacaatgtagatagggaaagagatcatgtatgtcttatattagatcttccattactttgcagactggttcataatctgatagaattactggaaaaacaagtgacagctttctctccaacttgttctacttgtttctgagagtgtgactgaaaaaaatgtggtttacacccagatgatgaactgacagttgtatatttaataattaggatatgagaaaataaattccacagataatctgtttgatatcatctatattttctttaatgaaggtggtttaatgcaacaataatttttagaaggcttatgacatttttcctgatgaaacagatttggattaatggtgcttctaggagaaataatttcctcatagatcacgttcaaacacattcagaaaagagatattcaggaaagatcccttgggtggcttaaggccatttcaacctacgaacctagtagttatggacaaataggatattccacatagtaacaaattaccacccctcagattacctaatgattgtaaaagggaaaacttttctttttggaaagatctggcagtcaccaccttaaccaaaaaatcaactgcagcatcactgaattctgatgtcatgaaattgtgtgcctccagatgtgatggcatagaaacatcatctacgacatattcttgccaaaaacatacaaatggtacctactcaagctgtaagaagtaatttctagttaataggaaccaaagggaacatcattacaataaagcaatcacacaaatcctcactgtgggacgttttacaagacaattggcctgttctcttcacaaagtcaatgtcacagggaaaaatagcagggggaatatattagattaatagagatgaaattcctgagcctccagtataacctggttgaagaacaaaagaataaaataatttaaaaagaacaattgaaaaagactaaaagtgaaatggacgttaggttatattagaaaactattaattttcttagttgtattataaaattgaggccatgtaatacaatgcccttactcttggggtctcctgtttctaggagtgaagtacgtcatgatgcctacaatttattttcaaatgcttcttcaaaacacatgcccgtgaggacctagcagtacagcaacatgttaataattaaatccagctagtgggtatttgatgtactattctttcaatcattctgtttgtttaaatgttgaaggtaaaaatgttgaaacgaagctaatggtagtgcttcagaaagttacttagcaaagctatgtcctacttacatttgtcattctgcactccttattaggaaactattttattaaatctcctgtaatataactgatcatatatgcttcacacaggaaagccctcatacggaaagccaaacgcttatatagccaactactttttcttaaatcttctgcaaattctaagtaagtgactggcaagaaatgctttcggggccccaaatagagatgagaagcacccacttaaagccactgtgtggccactagcctgggcctagtttccaaattgacactttcattgacatcaatgtgatgtcagccacatcacttaaatacttacatagattgagtctcaatgtcagttcatttccagagatcagaactgtgtaacatgtcagttctaacaaatgagaccagatatgaatttacacaatatagtcaatctagagactataaagacacaacacatctaaaatttggatctgaaatgcatagtgcagaaatcacacagcccttttgatgcattgacacttttcaaactacagagaagctgaaatgtggcactaagtcattataaatatttaacaggaaaatgctggcataactaaaagagttcaggaacatacatatatccatgaagcttcattgcagatactcatgagacaagcgcctcaagtgactttacatcctggaaaatgaagacaagtataaagaaatatgattctgtgaaagtcatttgtaggacactccatattacggtgtgtcccacaatcataaaacaatgagcttttctctgcaatcccatggcacaggtaagtgcaagattagcatcgctaccaacagccgaaatatttggggtcaaaccctgttacaaaaccactctgtcactgaatttctccaatgcagcagccaacaatttataggaaaaagaacactaatatcaagcctttaaagggtgctccaaacataaaatcatgagtgctctaggaacttttggagcttatgaatcacactatgcaacgtgctcatatatgccaatgcccgccacgttttactcaagttggtgttgatttggagatgggccctgaacattaagtagaatatagaccatcagcagttactaagctaaatgcattgtgatagcttggaagtttagtccacctatttgattctgtcaacttgttgatacagtaaccattgcaatgacaagttgaccattttgagaagtttatgaaccccatcagctctctcctgagagaataatgttgaataaatgaagaaaccaaaccaaatatttggacagcattatcaacaaataaaaggtataacatatgacttagcaaattttttagctatgtctttaaatttttgactgaggttaggtcaagggtaggcacatttaataggcaacatttcataacaagaatgaaaaatgatgatgattcaaatcccaagttatttcccgatcattgcacaattttggtaaacctttaggaagaaaatttgatttcatctacagatcctcttctagtgttccactgattatattactataggaaatatatgttctttgcccttttcattttagaaattcttgtttttgtcattattcactcaacaaacatttctcgagaatcaggcaaacataaattaaaaatggttgacatgttagaaacacaaacaggtgctgaatgagcagagaggacagatatctgatccatgctggctaagtgtgtgagcaggggcttgctgtgagatgtgccatgtgcccggaaatggagggcttcgggccggagtaagaagtgactgatgggatggaggggtagggaatgatgttccaggaagaagcagcagcagtcagaaaggcaagggtggtggaaaagaaccatgtgtttggcagcttcatggcaatggggcagaggctgttgggagctcgcatgttgacagatggtcaagactttgtaatccatgagcaaagctggaccttcttctgagaataaagggctatctttaaaaagtttaagaaagttactaacatgaggaagtgatccttttggggttgataggtgtgatgattgggtttctatgcatgtgtgtgacatgtgtctccctcaaagcttgttaccacatccgtacagcacccataggatgttgggggggtgggtggggaaggaaaaacaagaagaaaaggaaaaagagaacatgagtagatgtgtgttttcgaaagtcaactctggcaagtatgtagaagttggaggaggcaggcctagaaacctatcacaaggttattgccataattggaacaaaaaaatgtgagtgtgagcgaaggcaatggtgagaatagaagaaacagggatgggttggaaagagcaacaagcctacaaatatgttttgtaagtttagcatctgtaagaacctgaaaatggatgaagcttaaaacttgagatgagagttagacatagatatgaattccagaaaaatcaatatatgacatttcttgcccatttacatctccaaatatcttttctttgtagtgttctaatcaaaacatcagcaaaggaaatacaaagcaaagtaaacaaacaaacatccttccatctcctcatccaccctgcttctcctctaaatgatgaactcattcttttcaaaatatattaatggaataaattcaacacttaatgtacatctgaacctaattttgtaaataagacatattttacagcacatatctttcaattaaagtgccaaataagacaataaaaccttcggttggctttttatttcattgaacagataaaaatacttaattaaataaaatgcaaaatgatgacctgtcagattgctccctgactccagaaatcatctttcatccctgactatgtgtgccagggtcatacaaccaaacctctccctggggtgtaccccaacagatgggtacctggcccatgacttagtgttctcacctcctcccatcaatttctactccattccccaacaattacatatccagggtaaaatcggatcaaggaaaaaggaggatttgtgtctccgcagttcatggccctggcatttatagctttccccctttcagttttcttgaattccttctccatcctctccctaccccttatccaggaaaagtgcaacctgtgcatgtggttggtcttcagtgtccacagcaatctcgctgccacagtaatggcactcttatgggatctgtactatagtcagggaaatctcacaatcctcaatgagtttagcagggaacggaagcctgtttcttctcatattttaatttcctgggctttgcatttcttgattttcctctagtttcaaactttggaggtgatgtgaggtcttttcttcctaggttaattcacttttttttctagcccaaaccatctcctacagtatctttagagggacagaactgcagagtcttaaagggcaaaagtgaggcaaacctgggttccaacccaaccttccaattgccagctctgtggtcttacactagtctggctacagttcggtcatctcacctacacaatagggattacaaaatctcttttttcttgggttttttttttctttttgagatggagtttcgctcttgttgcccaggctggagtgcaatggtgtggtctagcttactgcaacctccgcctcctgggctcaagtgattctcctgtctcagccttccaagtagctggaattacaggtgcatgtcaccacacccaggtaatttttgtatttttagcagagacgaggtttcaccaggttggccaggctggtctcgaactcctgacctcaggtgatctgcctgcctcagcctctcaaagtgctgggattacaggcgtgagccactacgccccgccctcttgagattttttaaaggaagttcaaatgagtcaattcatgtaatgtgcttagcatggaacccggcactaaggaagtgctaatcaaatatattatgaattcttaaagaggccggttctttttttaatgtatttttgttgttgttgttgttttccatctaggctactctggctcgtttctgtaggaagtgaagcccattcttagtgcatcctagactcttccttcaggaatcctctgatgcagcttctctctgttcttagtttcctatcaggccatctagcttacctgaatctctccaatctgcagcagaccatcctggtttaagcttggtttaccttgtttttatttatttgtttacatagcatcttttcaggcatttctgggctttgttataattcccttcctaaaatattggccatctcaggaaacagtttcacctcccctaatatacattagccctcccaattttcttctatccatctatctttctgttcattcatccattcaagctatgataatcactggtttccacactccagtagttcataaatgtaatggggaagacagtacattgtgattaggagagtaatgaatttcaatttttttttttttttttttttttttgagatagagtcttgctccattgcccaggctggagtgcagtggcacagtcttggcttactgcaacctctgcctcctgggttcaagcaattctcctgcctcagcctcccaagtagctgggattacaggtgtccgccaccactcctggctaatttttgtatttttagtagagacagggtttcatcatgttggccagactggtcttgaactcctgaactcaggtgatccacccgcctcggcctcccaaagtgctgggattacaagtgtgagccaccacgccaggctatgaatttcaaaatattaaattgttatttttttcttttgtacttcattttaattaaaaacattacatttctttttctcgtaaggtgaaaggtgatcaatattaaattagataaaatgtttaaaacacctaaaagagctcctggcacatagaaaggattatcaaatgtttgaagagttattaaaaggtataaagaattatcaccgagaagaaacaggtgctctttatctatgtgttcaatgatgcacaagaaatttccaggaaacaggaggggggttggggagagatgctgtattccatactgaggaaacagcacatataatggcaaacattgaggaatgcagactaaaccacatgtgatgtttgagaactccaagtacggctagagaataaaattgcaggaggaagcagtgggctgggaggagcaggaggctgctatggtaggcaggtgtcagagaatgaaagtctctttggtggtacacccagtattgaatctggactggacccgagcagaaataattgtttccaactttgtcagtgtctactccgaaacagatggcatcttagatacctgacattcattatcctatttaaacctcaagtaaaatgcaacatagatagatatcatcccacttcattcacataaaaatcaagtcatcaactaccaaaatggtgcagtcggggttttaactaaagtccacgtgattgcaaccacactttggaagagattagactaagggggcggggggcagagtgaggagtggccctctgacatgttttaagggaaggaataatgttaaaaaattgaattttaacaatcataactgtgcagcagtgtggataatagatgaaagaaggaagagtcttacaagcagaaaagcccattaaaacgtaaagcagttgtctggtgagagatgcaggagtctaaacaaacacagtgtgaaattcaaagaaaatgctgaatctgagacctatttgggaactataactgacaacaatagcatcctcacaatgctcactgacttttcatcatgcgaaactcaagtaatcaagggtccagcagctcaccataataactggatgccaagaagaggggaagagaagaacaaagagtttttgctacaactggtaactgatcctatcaagaatattttgaggccagacacagtggctcacggccataatcccagcactttgggaggccaaggcgggcggatcatgaggtcaggagttcgaaaccagcctggccaccatggtgaaaccccatctctactaaaaatacaaaaattagctgggcatggtgacaggcacctgtaatcccagttactagaaaggctgaggcaggagaatcgtttgaacccaggaggcggaggttgcagcgagccgagattgtgccattgcactccaccctgggcaacgagcaagactgtctcaaaaaaaaaaaaagaatactttgagaatgaatttgtaaagtaacattgggctacagctcaacactgaatcaatttttgatagtgaattaggaagtaatcccagacctgaagaacataatggaattagaggcagatgaagtataaaatctcagagaggctgtagtctagggagaagatcatggtttggccacagttaatggaaaaagagaccagagtgggttagagaacctctatattctgtgcaggttgagggtttggaggcaatttccagaagttacctcatagagattctttattcaaatatttccctagaattcaggtgtgcctgacggtgtggctcaggagtgatgaatgccccttccaggacttcagcaatgattttttaaaatgcatatttggagccttaacacaagaccaggctgtgaacaatattttaatttttaatacacatttggacttgttgagagtctctgttttaataatgttgcccttttttcctctaagaacaggctgaatattccttagagagacactttggaaatcgcactatggcctgcacggcggatatctgctcttttggggttgagggaaggagcttgaatgtctctaagagcagaataggaagggaatagggttcccagatggttccagaggatgctgaacgttcactgaatgaacccctataagtatttcccctgtgctgctggtaggaaaaataccgatagagtttaaagcaaggaaggatggatggaatgtaagatggattgattcacaggtcagaaaccagatgctactgcaagtgatccctcaatgacatcatactcaacaaaacaagacaaatgttcttggtacccttccagcgcttcattgtttttcattgcctgccttaacaggatttagaatcacacggtcccagctgttaacaggtatgtaccatcacgctaccacttcaggcacatcagggaaaacatacacttggcttcctttctcagtccatacaagcattttgaacagacatgagaagagtttaagaaattgtggagggcgacacaggaccatgcctcccatgtctgacaaatggctgtgttctctgatgactagcgtgggatccatcaccctgcctcctaatccagggccttcctccagcccagctcactgcccgggtactgctgccctgtcatctctgcccttcatccctcttagaagccaatccccacttcccagtaggtggcagatacttctggtgtcctttgtacctttctcaacagccctccctgacattgcacattcaggattaggctcctgcactaatagatgacagtaacctgttattttctcagtgtggatctgtcagacttgcttgggcataaacacagttccctggtatcagcagtaccataaggtgccaggatccactgacctaagtttgctgagagatgctgaacaaaggtaaattttcctaatttgcagattgtattgtgaagtcaaattgagactattaatttggccacctttcccatcgggtaacttaggcagcttggtagctcagtgtgcatgcatcagtgagcttcttgggaaataaatcgggttagtgagttgaacaaatacttatgcaatattttctatgtgacaggcattttgctagccaggcaatcataaattagaagcccaactctattctttttttggaagaattccaatctggtaaaggaaacaaacaaccccaaaattgtaaaaagatggcagaatatcaaaagtggtagaagaaagttaaaatagcttcttttttttttttttgatagagtctcactctgtcgccaggctggagtgcagtggcaagatctcggctcactgcaaccttcacctcccaggttgaagccatcctcctgcctcagcctcccaagtagctgggatcacaggcgtgtgccaccacttctggctaatttttgttgtatttttagtagagacagggtttcaccatgttggccaggctggtctcgaactcctgacctcaagaaatccaccagcctcggcctcccaaagtgctaggattacaggtgtgagccaccaagcctggcaaaatagctttttatagtggcccttcacctccaggtgtttgcatttcagtgggattaaaggtggtactgaggcctgggccagtaggtagaggtcacctgagaacaccgggccctcccattgcccatgcctgggcaataccctgagtatttggtccttgagtagcatggaatcctctctagatttaatcactactaagccctaaaggtgggagtatatgggattcatttcgtctttgagaaaatcaaggcatgcagtgcagttcccttgaatagggagagtctggagggttgcacaaatctgaaaattattcctgctcagaggctgtatcgttctttgttgagatcaaagtccatcatgtatgccgacagcgttaattttgaagaaagccattcctcacattatctcctcacattttgcctcttcctggcaaaaaataaaaaatgttgttctgtcccttagatttgatttatttttcctctagtttattccccttcaaaccaataaacaaattcttcctacaaacagcatgagtcaccactcgtagcaaacatcctcacaggtggccgagaaaaagaaaatgtgtgtgtgtcacattcccattaaggttacagcctgagcttcgaacttcattttggcccacagcccacttgtaggtctctctgtgggcatttattaagttatgttggtctcttcaaatgtttcccaggccgggcgcggtggctcacgcctgtaatcccagcactgcaggaggctgaggcgggtggatcacctgaggtcaggagttcaagaccagcctggccaacatagtgaaaccccgtctctactaaaaatacaaaaatcagccaggtgcaggggcgcacgcctgaatcccagctactagggaggctgatgcaggagaattgcttgaacccgggaggtggagtttgcagtgagccgagattgcgccaccgcactccagcctgggtgacagaatgagactctgtctcaaaaaacacaaacaataataatcataataatatgtttcccagactccatgctctccagtcagcccttcctctctcactggcatcattttggtctggtatttccacccttcctttggaaaaatctctcttctactcagcattccccaacagcctccgtgctcagtcccaccaggacaccaaggtgggaccctgtgttaaagtgtacttcccaaggctatttgcatttgcataggcttcagagcattaaatccaaggcaatactctcaaaaggtagaagtctagatgtcagctgaaagatgaaagagactggcgagggtgaggacagagatgaagacgctaataagggcctttctgttgctggctccgtagccaggcccctcttctcaggagtaatcatgtcaactccatcatccccagtgaggtgggaatcgattttatcacacctttataattacacccttcttatatttacatgaactgcttataattatgtggatttcttgcaactctcataagctgcccaagtagggccaatctccccggtgtgggcagggagtaggcgcagagctgggctttccatcacacctgtgtgtgtccaaggccaaccttggtccattatctcatgcctggaggacatcccggagggagacgtcctttcttttgctttaatccattccttaagttaactcatctcttgctgtcctgaatgttttattgatgctaactttatttttaaagattataatctgcctgttctttttattctttctttactagaaatagattttatatatctcaggtataaggacacttcttatcatccaagataccctccttctgtattctcttctgcaaaataataccccctctatagtcccgttgccattcatcaaggttgctaatggactccctgtgaccatctgattaatgggctaatacaccttctcaaaagcaatgccttttaaacatagaaataagtaagacaataatctcacatacatttaaaaaatcttatttttatcttacagttgatttttaaatcttaaaactttgaattttaattttgtattattttgatagtgaattatattacacataaatgctttttaaatattagatgtacatttccattttacttgcttatattttataaataaaattatgtacattgtaaatattttgagaaacaaaatcacaaagtgtatcaagctagcataattgatgttgtcacagaggcgaagtgtattttcactcaccagaccataattagtaaataaatgaatactgaatgaataaacgaagcgtctcttattgtttggcactcattattttcaaatgttggctattaaagatagataatgctaggctgggtgcagtggctcacacctgtaatcccagcactttgggaggctgaggcaggcggatcacgaggtcaggagttcgagacaagactggtcaacatggcaaaaccccaactctactaaaagtacaaaaattagcaggatgtggaggcaggtgcctgtaatcccagctactcaggaggctgaggcaggagaattgcttgaaccagataagtggcagtgagcagagaccttgccattgcattccagcctggccaacatgagtaaaactccatctcaaaaacaaacaaagaaacaaaaaaacagtaccaccgggctagcaatttagaaactataatcaatgccttaatatgtcccttcttttagaaaaataactacacaaagcatctgcatgacttataagagcttccacaaatataccataaaatgttagccctgataatttgctgtgacatttaacatttcaatgggccatgtttcttagagatcactaggaaatgaagcagagcactctttgcattcatttctgctccccgagaaaacactttctctccttcactcaagccaccattcataacccagtgatgtgtgatgtcacttgtcccacagaggataatgaacaacttcccgggaaatatttccatatgactaacaatttaatgtcttagacagaaactgaatcttgcctactgtatagaagaaacaactgtgttagttcaactgcatggtacatgatgaaagtccctgttatagctattccttctaacagataattgatggggccaagagacaaaagaaggaactcactctcagaaataaacgctccacaaagcaatctcatgcctcacctaatgcaatatgtttctcatgggtcttttgttactctaacatattaaattatccttccaattaccttggcaactgaaacaagagcgcctaacacgctgatgactttcggacgagcacaccagctgtcagttataaatgataattaaggcatcttaattattaagcacagtgaaaatatgcagtgttcattttttataaaacttgtgtcctaaggtagaagaatcctcataccaaccaaatgctctttctctacctttgatcagcaatttggccttttttctctctgaggctgataaattgcagcaacctttgagatactagaccctccacccccaccccaggtcttcccccaggtctccttagttataaaggtagcagaatgtgatggttgaaagctgcatttgtaaccagcttaccttcgcaacaatagcaagagtaacaaagaatccatcctaataaaagctctgtgcacagtcagcttaagcaacgtaaagtgttcctttattctgcttagtagcttctcccccagaggttaaccattttaaagctggcactcagcctgagaacaggaacaaagcattactagaaagcagggatcttcctccaggatcagcatctctgctttccgtaattcttaagaaatatagaaactcaatgaaaaggaagtgatacctttggatgggcacattccagcacaggaaaatcgctgtcttgtcggctgctgtgcagaatgagttgcttgggcaggtattcctctattctcagctcccgggtctgccttgtagccgcagccagcctagggagcatttacggcatgtacgtggtgttcatccacaataaaaggagactaaccagctcagcttggcgctgctcgcctggaggcatcagatccttggaccctccccatctgattggctgctacccggtctagccgaactcctctgccttaaccttctgctgcgttcaatacattttccctcgggatacagtcagagaagagctggttagggaatcagtggcaggttaaattgagctggctttaaaaatcagtgacatgattttctatgaagatgtctaatgtttaattttccaaagttctacgtaatccacaaggagagacgtaataaaatggatatgatttaacaggagcggcttcatgattcctccctgaaaatacctggagtttaatgcat

SEQ ID NO: 2072 - DNA, 226814 bp, Homo sapiens
atgcattttctcttagtttaacaagttggaataaaatacacaatttttataaagataaatgtcaagaagaaaaactgaagtatacttccaagcaaaatttattagatgtctattcaagaaaaacacaatgacctttgcttgtaagaattcaaagtcaattacctggaagccaggtatgaatagttttttcttttaaaatcagatacagagagtagaaacagtaatttttcttaaatatgacaggcaacagatattgaagtcttttctcataaatggcatcaaagagaattattcatttatcagcaaagctgcatgcagttgacttaatttcaaacctgaagcctttaaaatatgaagctggttatgaacttgacagaaatcaaggtaggctactcaacgatgtttctttaccttcttcctaatgaaattcccttgtcatcagtcagtagatatgtacatttcatttggcttctacgatcttttaacttcatagatttttgcataaatgctatctgacagaatcacactatctaggggtgcttgtgatctgtgagataaggagaggctagtctgctgaaagtgttgtcgcaggataaagaccaaattaggaaacgcccctgttttctcaacaactagtctgtacaaaaaaagagcaaacatatgtacaaaattctagaggctacgtacattgtgaaaagatcaatatcactgtccatgaaagagatgccataaaaagttttatctgtaaggtgctcaagatccaaagatgaacagttcttatgcaaagtcataagaaatacaaagctagttttcggagcaggtgtaattcaggcactgtgaaccatattaaaccttccaggtcccaatatcattttttaaatttctgcttcagggcagaaaataaaacctgaatgatttaacattgcttctaaaaagtgcctaatttattcctaggaaatattttacacacaccaggaaaatcaggctcaacatattcctgtcctcaaatgtagccaggattctgagttccatagaagaaaaataattattatagtaaaaataattgtagtaatcctaatccttgctaaaaccaactttaatacttgtgatgcttctgtactctatttctataaaataatgtgtgagattctattacatttccataaaatgtacaacatatcatatggattatatgttctcatacaatctcaaatgtgtatgtgtacacacagtgaaatcttacctactagtattgcttacagatactttcaggtgtctgttagaataattctttgcacctctcactaacactgcttttacttacattttttcagataaataaaacactaagagctcattgttcatgatgctgatcattacattttaatataaaatagcgatgcaactttacaacacaatagttttcccctgtagcctagctcagcctcttgtattgtcatgattattaccgaaggcttttatttacttactgtttgcacttctaaaaaatgcaaacaaattgcagaaaaagactcctatttgaaaactcacattcaatcagcaaaatcacactcatccaaattaactcgcctcctcttgctttaaaggttgtaatcactgtgcatattacaacatgtatgtgcaggcaaacaatagctaaagtacagttacagttgtcatattgtgtaaaccaagacactaggcaaacttgtgaaaagaatacacactgccaagcgaagaatatgaaaatgcaaaccacagcattccccaataaacaattttctggtcgtcttgggggagaacatcgcctggggggagatgttgaaatggagccacgaggctggacagcctcctggagacactttttttttttttttttgcctcaaatatttgaccatttttaaatatcatgatttttttctttctgatcccacattttgacgtgtcaaagcttagagcaggaagtaggaatccacactttcacggagggggaccagcctgccatgtcgtccccaggctcacagcagcggcggctactctgctggtggtttggtggcaggtggagatggtgacggcgcattggaaaccgtaaggcatgacaacgggaggcccgcggggtgtttcaggcgcgttgacgcaggtgcatggctggcaggcggcctctacagaaggagggagcgcaattcacagcctcttgacgtagtttccggggaaagtaccaaagaatttggttcttcttgaggtccctgaaaatagaagcgagtcatgaaaggggggtgacaacgatatcagttcatacacatgggcttgaatacttcccatttacaaggcctcggaagacagcaagccccgaggggtttggaaaagaaggcaggcaactcacatgaagcccataggcagacaaaataagcagtgttagctggttgcctgacgctctcactgcccctccggcataaatgctgcgctgccatcgcggcaggctaaacagaaatgctgagcctcccaagctaaagggaaagtcagccctgctgaggaggggggcggaggagctcagtcactgaggctgccacaccagagtcgggggtgagggatcaaggcgaggctgacaggtgacagggtgagtggaaaatcctaagagcaaagcttctcagggaccagcaacccgcgcaacacaggtgcgacatgaagacatcatctgtggcaggctgtcgctgttccaacagttttatcatcttacagaagatcatggtcagtgccacatcatttatttaaaaacagcactgccagagtccttcatcgagtatacaatttttcaacaatttacaaatcattaatgaaaaaaaggattaagcactatttgtgtgtgggagttctatcagtggcatgatttttaacatggtgtgtgtttaaccacacgcacaaatggctatcataattatgttcgcctctggtttcaaataatgtaattccttggacacttcttgtaaaagttggtgcactaaattgctaaattcttctttaggcagcgcagatggaccggataagggtctctcaagcttcatctgtctcctatatcctggcacttactgccttggtttgatggctgtttttctttttccttggctaggcaagccattttacgtttctcctccctcctcctcctccctcctcctcctcctccttgtttttgagatggagtttcgctcttgtcgcccaggctggagtgcagtggcatgatctcggctcactgcaacctctgcctcttgggttcaagcaattctcctgccttagcctcctgagtggctgggattacaggcacctgccaccaagcccagctgattattgtacttttggtagatacggggtttcaccatgttgaccaggctggcctcgaactcctggcctcaggtaatccacccgcctcggcctcccaaagtgctagaattacaggcatgagccaccgcacccggcctttttttcttcttttaatggaaataaaatcagaggcttgtggccgcaccagggcctcaattctttcatgattttgccaccgatggatgtctagagtgagccctcctctcctctcacctttcctctcttccattctctgccctgcagcctgtgtttccttttcacctctttctgtggcccagtgtaaaatacttttgtctacaaatgttttcccagaagacctctcgtctttttttttaggatggtaaagatgaagttgccttttaagtgggaagaatggaacgtctctctgcttccaccacaaactaaagttaaggtgagtcactgaatgttcgggcatctacgtcagacctaggaaacgggagagctgttcacttaatctcactccctctgaaattagattctcactgtggacaactaacattttccacagcacagagcgttgatatttctcttctggggaccatttgttgttgttgttcttagatctcaatctttcctggtttttgctatttaaagaaattgtcttctctcagttgagttggaaataaagctcgcagaaaatcacacatagctgaagcagtgaatactaaactatattaaaaatgcaatagccttgggattacattgtgcatatgaatgtctgaaagatcaaaggcattacgaattcaaaggaagctcggccatcacagcaaaccacgggagtgagcaaactcaagcaaattacaaaatagccgaaggtgcctgaggaagaagcgcacatacccacaaaccagccgtcatcacacttttccatgacatcaatgacatcactttctctgagctccagctcatcttcattcctgggagtatagttatacagagcctgaaaccttaaacaggacaagggaatgtgtttaaaaacatcttgacaccttcatgaaatatagaagatagaacaatattcattcttcctttaacattcctattcttaacaacattctgttgggtggtacaagcctggtaagcatgtaaatagcattctattggatggtacaagcctggtaagcaggtacatagcaatatgtagatcttcacaggcattagaacactctaacaacattttgaaactcacgaggaatatccatgaaaattgtaacattcataaattggattaaaatatgtcaacatgtataagtcagacccgcatttcagttgtccagccatctaacgtctatcatttagacattaaataatagtacaaaatataaaataagtgatatttgtattatttaactgtttaaaaacaagaaggaatcacaattttagctagccataatcagaagcaaataatgggggcttgagaattgaattttcaaaggttctaaatggagatagacaaaatgtgtcagacatgtctttttaatcactctgtgtgaattactatacaaaggaaaattattttttttactaagaggaattctttagatcagtttaatgttatggtttggatcagtgttttctgaggatgtagaattggaagatttgatgtaattagcctatgaagttgagtagatgtattctatgtgcagttattactgattccatttcaagcagactatggacataagtctctttttaaaatgagtcccagaaaaattgtatttgattttaaaactctctcttgaaataattttatataaaaaagaattattgatagaatgctatcactttcctttcccggcctgaattctttgacagcatatactgtggtggaaattgatcaataatgaattcagacactgaatttgtggtaagaaaacaccatacattataataaatagtaacatgggctggtgtttttggaaaatgaaggcgaaattactgtagctgagaaggtcaagaagaatttgataggcagttaacatgaaaacttcttcataatagtactaaaatattaccagtactgtgagggggtttttaaaaattgggaatttgtttctgctgctttctgtaacagtcatgtcattctgctaatgtgagaaaataattaccactttctagggtattttagattttttcatgccaacttaaaaaagttgataatcttgactaccgctccggaacaagaatgatttatttttaattactttatgagtcagaaaataatattttggtagaacaaaactattctatcatttaaactcaaatcttatgtcattaataagcaacagtgacctactggcttccccccgttcatccagcatttggactgggggagctggatagagttggcttcagagaatgcctaacaacatcccctagaaaatattgttttccctggcctggcaccaaagcctgaaatttcaacattagaggcttcttctcctgttaaaacttcatccttccagtagaccttacagccacttatatccttttgagcatgggcttctgaggccttttcttgagagaggggtttgtgattatggggaagggcagagaaaggcagctagcatcccagagtagtggccaaaaagacaggcaggtgtggaatacagaaacgtcacctgatttggatgtttgcatgtggccagctttgctaggggtagtccatttattttgttgcttgtgtaaagaatttgatttggaggctgctcaggtgaaggggtggtatcttttgtgtatctgtggggaaagttcacggtcccttttccagtttcacatttgagagagatggtggttcctgggctgctgttttgatggatacacacggcatttctcactttgggaaaactgattcttttattgagcttctcaggcttgaaccctgcccaggctcatctccacccactcatggagaccggttacctaaggctgcaaacctcagctgctggaaagaatctcaaggtctcagagctaacgcaacaaaattggcacagactcctgcttcatttttgtctgatgaaagccagcatgtttgtccaaatttatttaccattctggtttaattagaccacagaaacaaaaacaaaacaaaagaaaacccacggagttttatggaaacgtaaacacaccttcaggaaatcctcctgcctctcctggctttcaaagccagtgttgcacaatgggaaatgaagacaaatccaatgttaaaaaatgctgttgtgaaagatgtgttggtgaggtgagtgatggtggtggggtaaggatgcctcaaaaagaaaggtgtcttttaaacaggaaatgctgagccagactggaagccctctcgataacttgcaactttttctagaacatatttcactaaaactctgaattgtagtgacataacattatgttcctactttggctcaaaacttatttttaaatgaaagcaactaagcaacaccctaaaatcccactaattcaggctataatcaaatataaatttaataaacaatgttttctaatatacaaatcaggactttgaaaatgtaacatatctttcattcataaacactttgaaagctgtttaatataacatgttggtaatgcaataaacctaaacagccctggaatttattttttatcatgtgatcttatcatcgtttgggtaaataagagaacaaacaaaagctttagaatgacaagtcgtatttagtgttttccagttaagcgatctttttgtttgtttgtttgtttgagacagggtcttgctctgttgcccaggctggagtgcagggccatcatcatggcttattgtagccttgatctccctggcccaagtgatcttcccacctcagcctactaagcagctgggactacaggcgcatgccatcacacctgactaattttttatttttatttttgtagagatggtgttttgctatgttgtccaggctggtcttgaactcctgggttttggccttccaaagtgctgggatttcaggcatagtgactgcacctaaccttcagtgagatttcaaatgattatcactgctaacctgttctttccaaaatacagactttcccgcaacaagaacacttttctgcctgtgctctgtgagagccagtctcatccggagctgctttttgctaagtttcaggtctgtgaggagcaaggaaggacttgatggtgataaaggcaccaggtcatatgccaggacctgccgcaaggaggaggctattgttagcctgttctgctccaggtgagcagagtgtgggcagtgggtcaggatccccagtgtgtgctcagatatgggggacaaggggttaggtccatgaataagccttcccaggggtctcactctcgactcacagtgtgggcagaggccaacaggaagctgataactcctgaacgtctctcagggacaaaatgggcccgaaaaagaaacacacagagagaatcttcaagacaacgtgtgacaccttcaggctgatttaactcatgtatcagaaaggagaaggaatttgaaaggaaagtttgaaaaggcattttcctggtgctgtggaagtaatcgcatgtaactgaataacagtgagtgttttaatactgcccttttcaaatgacccttctaagcatgtaactttggaatgatggaatgatcgctttaggtcttttttacactgaggtccacttttaccgtctcccagtgggtgtaaaagtaaggttagaacatgttctgtatgtctttgaagctcgcagttactcgttacacagccagcagagcagagagggagacagagttatccatcttaggaatcactgaagcattgggaagttttcctagtgtgtcaattaaaatcttctcagagaactatgggttcttttaaaaattagtttctggtcactgtcataaaagatggagagactattacaatttctcgtaatttaagaggcctcatgttagtttgatctttcacgtgcaaagccatacatcttacattttggtacagttgtccattttgtgggtcaaggttagtctcaaatttagaagataagaagaatacttacggttcccccccaccttgaatattttcatgagtaaacacaggacgctgtggctgaaatgaaatgattttcaatgtaatcaatgtttaaactggtactaattaaaagataatttggataatggcatggtacttttcttgacatttaatatttcctgttgtaaaaaaccaagaggaagaaaaaaaccaaataaaagctttctgcaggattaataattaaaatatttaaagggagctttaaattaaagcaaaataagcaaggtcaaatgttttgaacatgtctacaatctagtctgctcaagctttaaggaaaagtcagggtttggtcccattgatttttcaaaggccaggaataaggcaagaacatagacggcaaaccactagaataggaaatatagacaccttcatacaaccttattctccagcgttttctcaaacaagcagaaaataaaccacatttagtttaacagcaaagtatccacactcattctttcaatctttccttcacagacaacattttcacatacagcacagaggaaaatatcaataggcagacatcccatgctacatttgaattaacattttctgttctcaatgtggagagaaaacatgcatttttaaaaagagaaaacagaactttggaatgcaacgaacaatatccgggtaacatgtaacattttaccttagaagagaaacattggtagaaatttccagtgcactgaactctcaaaagagtttcttttctttttaaactaagcatcaagaccagtatctgtaatagatacttataatattggaaatgacaagccttagcatcccatatacccacattaatattttcagtgaatgaaagttaacatgtttgttgaatatataaactcagtgtaatttatattgactacctaaactttaccttttaggggagaaatgcaaacaaatcattcataatccatttcaaaagcatttgcttctaaatgatagctacagggtaaaatcagaatttgcatggcaattatataagtgactgtttgatgactactgaaatagctattagatccatgtccttagactttgggaccagttcttagatttccatagttatgagtggattactgataggctgaaatctcttgctgccaattgtccatagaaaccccactgatccaagcttggatggataattctgaggttcctttcagtctacgagtcaatgattcacccacttcctaaattctttatccaccccctttctatcctacttgtctatctagcataagactaggtactcacagtactaaaactgtaagctctgactcggttaactggaaacctttattaacagtgttcttagaaatttcactcaacagtctgtggatagaatatttaaaactagagtgcgtaagaattactgcacacaattatgacttaagagtgaaatagtttactcctgtaaatcaatatgactactaatgatgtatctattattaaaattggaagatattcatattttaagaaaaattatgactaaccagttttccaaccatcttaaaggtcatttaattcaagatattattaaatcaatttaaatatataagatggtaattgtaagtcattgataagcctgtatcatattacctatttcaagttctcttccagtccaataaaactttatatatgtataaaactttcatgcagaagtaagatttgtatacatcaattgccattaatattattttgtaataactttccagtctttttttctcagtcttctttcttatttcaaatgtctgcagaataatgttctcccacgtgtgtctacatatcatagttttcttaaccattcctctcttttttttttagttttgaagttagaattggtctagtctttttttttttgctatcataaacagcaatgctatacacattttttatgcaaagagctattttcttcttttgaactattctttagaatatattcccaggagtaaaacttctggccaaagagtatgcattaaagccatatgattttgagaatgtacatgttagtcactgaaaaatactgtactcaaaagtaacttgaaaatgtctaatatgccagactgcatatcatataccaagatagctactactctttccccaaaacaatcatagcaccatttgcagtgcataataaagttatgaataagaaaatattatttattcttgtcttaagagaaaatgttgtgtaaaatatatttcattatgctctaaaattggcatccctgttttcacacatttaaaccattttaatattttaaaattgagtaaaagtttcaacttctacatcatggcatccaatgctttgtaaaactggttagtttcatttcattgctcttttgttaaaatgtgaataccactttaaaaatcaaattgttcattaatgtaaaacaatcaacttttaaagtccgtatatccctttttagttatcatcattataattctactagtttaattcctttaactcaacccacctcatcaatcatttaactgaactgtcccattgaccattatgaaaatttggtgattgctgcaaacctgcagcttcctggatcccacgtccatggctggagaacgtatgttcctgtgtggggcagccagcaccgtccttgctttttttttttttttttttttttgagatggagtctcactctgccaccaggctagaggtcagtggtgtgatcttggctcactgcaacctctgcctcccgggttcaagcgattctcctgcctcagcctcccgagtagctgggactacaggcacgcaccaccgtgcccagctaatttttgtatttttagtagagacagggtttcaccatgttagccaggatggtctcgatctcctgaccttgtgatcttcccgccttggcctcctaaagtgctgggattacaggcgtgagtcactgcgcccggcccccgtccttgcttttacctgtttcccaatttctcttttcccttccttcatatctttcaaaccctgcccctctttttacacacaaatcatcagttttctatactgttcacatcctgaggccagaatcaatcaagacttttcgtagcagagaagttgtgtgtgtcttataatggcgagttttagaacttttcaaagcttacctttaacaagaatcacctccatgttaatgtggataactaggagacagttttgaggaaagctgactaattacagtacttgaaatagtttattttaaaggcatttgactagtagggaatgagtagcaagaacagttatctaagacggctcatctgcgtctttctgttttgggcgttaagcaccatataaccttggggatgcctcagcttccctatctctgaaatcaatgagttggacaagatgagggttaatcgggtcccctcagggattccatgaaggatacacatttccacagatgtatttcctctgctgtgtaaaggtgtccgtcatcagttttacacagagagctgggacactgacattgattggttaattctcatgtgtctcggtcacgtaaaaaaaaataatggttacaattcaactccattttgcagaatggtaaaccaaaacccaaagatactggataatttcttaatacgacaaataggtaaaaaacaaacagaaaaagaaacaaaatggtaatttcgatgtgcacgctattgcatgaaagattactatgatggactacttggcctaccttggctaaaatcagcatcttaattttgacgctgaggtaggtgcaaatgtcctataaggtgatgtaaatagattatctggggagactgtctttcgccctttccccttggtgatgtaactcaaatggcaagtcgcttaagcagagatttgtaatgcagctgcactctgtcgccacctagtggtgagcaatggcagcaacaagctgagagttgtttctgctttatctgcccctttttatccaagttcccaaggctggaaaaattttaaaagcctattttaaaggccgcagagtgatgtggaatagacagtcatctgttttcctaaccatgttcttccctccccacgttttaaatttttgagaaagcatcccttgtaaagccaccagcatttttggtccgtgtccatttctattttgactatctgtgcaggcatttccatttcccctaacttcttagcagttttaagataaatatagaacaatatacacttgtgacattcagagaggcttacatgagctgaacctagaaagatggctttcaactgacacattacaatcactgtgctgggcattttgaacaagaattatattatgcttatatttccttgatgaatcttaagagtagaacaagagaaaaatccagtgaagcatgctgcggttttcatcgtatcctaaatatgtatttttttctgtagccctgactatgtaagtatttttctgtagctattttttaatgttgtcaaaaacggatacaaaagagacaagttttaaacacatgctaatttccaaagccagaaccaatcacaagttgctgttcataaggaagctggtttgaaacatcatggagtctgtaacatcagtaaaatatatactttccgatcttagtgagctacagtctgttgaaaagccgtctaatttatcaaagcttctgcagttatctctggaggattagctatatttagtatcaaataattcttaaagaaggattgactgttactttaaacactaatgcaaaaaaatctctgaaagcaatataagcagtgctaaagtgtttttatctttttttataaaatattagttgtcatatttgcccaccagaattcgatgaaattctcctaataataccacgtttatgtttctagaggcttatttttccttcttaaattatgaaggtaaaacacaactttgcataaatctaaaaaaatagaatatttatggttcacacaaacacacgtgtaatctgacatacaaatacataatgtaaaaatcaggcaaaaaataaaaaaaaaaccttaaggggaacacaagcataccatctcgtggacccacaggagggttatagatgggtccttttcactgcaaaagaagcttatgttttgctttggctctggaaggccattcgggggagtctaagagtctctacaaattggcatttctgtctctatggcaacacaaagctctgcctcagcaacaaaatgaggtcttcctatgcaatgcaaaaagcacaaagtggcatgaatgcagaataatatcgacttttctttagaaataaaaaatgaagacttctgtgaaatcaagcccttgagaacttcttgaaatgcagaagcacggccatgcgataggccagtcaaggttgaatccgggtccattaaaacagaaatgaggaaaggaatcctgacttatgtccagatgaaaatttccaaactccttggctgcattccttagaattgatagtaagtaccatttagagtccatgtattttaaagtactgtagatactatggaacgaagtagctaagggaaagtaatttgacctttaagttcaatcagagctggcaagaaataggaagtggatagaatccagacagcagtatggggacaaaaggcagactgagaggatgtagtgcacatcaccagagaaacagaagatgttagacaagaatcatggatttaaaaaaaatccaaattgaatgacacagaagcaaacatgaccggaagtgtgtgagttcggcactgtagatgcttggcaacagttttttctttgcaggagaaacggtgactagaaagcagtgatttagtgtagaaccatgagacagatgtagaccacaaaacacacgacactcttatttgtagagtagagaatctgaccatgtctttgtggagtttggaaacctcacacacacctaaaagggaagcacatcaccaggtggtcgcttcatcttcagggtgtctccagcctcactttaaggccagttcacagcaaagacaactaaggaagagccagccctgggggcgggggaggtggccaggatgcctgccacaaagtgggggcatgctgaccctaccctgtgggaaccgctgagccctctgacaggtgagccgcagaatctcctagacatcactgggctacgaggaggcttacccaggacacatatctcgctttttacgtcagcctggaaaatgtacaagaagttagttagctctcatcttcgtcacacagacttcaggaggagctttcctggctggctttttccatgcacacacagcatgccaaactcctgcacaacagcagggcagggagggtccacagcttctccagctgcttatacagtttccacaccacaggcaccagctgccatcttaacatggcacccacaggcacagcagaaaaaggttcacagaggaaagctggcatagggaagaggccaagaacatataagaaatgttatatctttttttgtcttttatttttttgagacggagtctggctctgtcgcccaggctggagtgcaatggcacagtctcggctcactgcaacctccatctcccgggttcgagcgattctcttgtctcagcctcccgagtagctgggatcacaggcacccgccaccaggcccagctaatttttgtatttttagtagagacaggatttcaccatgttggtcaggctggtcttgaactcctgacctcaagtgatctgcctgcctcgggctcccaaagtgctgggattacaggtgtcagccactgcgcccggccaagaaatgttatgtctttcatagaatgcttagcaattgggttcaagatgctctcaaacctgccctgctttttcatcttattgaagggatgcaaggtgagatagaggagaatttggcttaatgcctgtcaaatttcatggactgtatcagacatttgttggaggcaaaattttctaacacataagaagaaaataaggcctttttggggggaaacatggtgaaatttgatgaactactgaagtgccaacctgtgggctggactgttttggtgttttttttttattttcagagtaagatctttcatatgacagtgagtaagctgaccttcttttgtgtaggttttattttccttccaatagcggacaggatctggcagtgtactgcctggtatttgatctggcttaagagaacttccggaggaataaaacacgcttaaataaaagcatgtggttttctcaactctcatttagaaaagttttcctaattctcagtaatgattgacctcaaatccccagcctctcgggatgaaatgtgtttggcaccgttgcttaagtgtcgtggcagacgatgcttgatgctctccacatccattctcttcttggtcctcagtaatggggccaggctgttgggtaggcacatggccattctggataaagaccacatttcctgacttgtagctggatgtactcatgtcataagctgagaccgaggggatatatgcaattctgggacttggccttcaagggagaaggtgtaatctcccatcttttctccttcctgctggttcgtgtgagaagggaactactcgagctgccacctgggacccatagcggaagcttctctctgaggatggcgatgagcccacatcagatggaaactcctgggttctctgatgactgcggggccaccataccagtcccggacacccttcatttatgtgtaagagcaatatatttctacgttgtttaagctataattattttgagttttctgggactgtgcttatcccagtcttgactaatacaggggttcaatgcatatcagagctcttagagaaaaaaaataaccccatttagcttttagaatgatgtggatcataacagctggaaagagcacgtgaacatattaggaaaaatcagggcctgatttcatgttgaaaaccgtgcgccggggatccccttctgatgggactgctttagggtgacgagacttcctggtgggaccacaaccactgagttacttggaagaaacctaaaaaagagcctctcactctcctcacagagcttccgctgcaacttgagaccacatgcggcaagtctcttgcaaaatagtctctcggatggaaatggaggctcagcttatagaggagctgagatttatactattttttttgagatggagtctcgctctgttgccaggctggagtgcagtggcacggtctcggctcactgcaacctctgcctcccgggttcaagcaattctctgcctcacccttccgagtagctgggattacaggcacctgtcaccacgtccggctaatttttgtatttttggtagagacggggtttcaccatcttggccaggctggtcttgaactcctgaccttgtgatccacccaccttggcctctcaaagtgctgggattacaggcatgagccaccgtgcccagccaatttatactattttttgttatgaaaaaatcattattttaaaagcagatgctcagaagactgggggaaatattggattcagatttatacattaaacataatttatgtatctttcagtcatctgtaatctataaagtggtaggaacttttacgtttatggaagattctggattgcatttacttttatggagattgtcattgtcttagaaaacactttaaagaatgaaattgcactgacttaacatgagttaactaaacaatggttgatggggttgataaaaatgttattacaatgatttcatgcgtgctatactatgtcattaaaacattactaagagtttattttctctttgctttcagtgctgggttatttcttttctttacaatgagcatcagcattcttgaaatggaagaaataaaaaggcttcggactcagattggcagagtttgtaactgggtcagatgcagaattaaactataatggcctaaaattacgagttgattcaatttgtacttaaatttacaagcacaaataacttcagtgaatatattctttcaatgactacaaaatagatttataaggtttaaaaaaactcagtgggagattcaaaaattgagatttcctcctaaataggagataaaacagagaaaatcactttgatttgctggagttagtcagaagtatctcatgtggtcattaaaatattcttttaaaacatagttattgtgaatacctccattctctcatgtcattctgcaaacaacggaaacttaaagaatatacgagaagaattttgttcttgcagaagagtaaacctttttaaatcctggctttgtcctgatgctacgatggtgcgtcctccgtctttccaaattagagaactcagattctaaggctactttccctcttattgactaagcttaaaaaccgaagaacaagttaaaaaaaaagacaagaaataaataccttggccttaaaaataaaaccacagacagaagagaaaaaaagagaaattcttagccttaggcatcatataaagtggcattatttaaaacatttcctaattattttctgccagctaagaaaaaaaacctcaaagagcaaaagcaattaaagtgtttcattttttacaaagttcctttcacgcctaacaggagcacatagatagactatgtcagcgaatgggtttggtggtagtggttttgagattgtataaatggcacttcctaatacagaaccttagctgtattagagccctaaatttttacttatgtgcagaggctctcatttcacattcaaaagactgaatgtgagggtgagctattgtttgaagtctgtcaccttttttccaaaggaaaatgttttaggatcattctgaacatagaaggaaaacatttcagtgatggactaatttcatgctgtggttgtcattaaatctctttccaaggccagtcattaattttgttaaaataattttttaaaaatagtatctttaggttaaataccagcggaactgtcagcctgcaagtctcagagatggatgctttgtgaagtgctacaaaaggatgatccttcccacatcctcatgaatttacgtcacttttgtggaagaacaaggctcaagacagtcaatgccaaagatcatcctgtctccaggctctgctgaacctgccgatcggtgggaaatgacgggagacaatgagtccactgagaggtgatggagaatggcaggcactgagctaagataccttaaatgtgatgcttctcatgctgacggccaactgaaaacaatctcatcattacttcttattatgatatacattttaatttgtttttctcctcaatctgggtatagctgctatgcaaatatgtcttttaaatgtttggatagaggccacgcccatgatgttaaaagttagcaatcagtatttatgtaacttcgtaggtcttgtgagagggcgcaaatctgaatgcatacatcttactaattaagctcattgaagacatgcaataaaccacactcaagatgcagttacctttaattttggtggattgatctcctgttgataagaatatttagggaggagaggaggtgagcagggctgagaaagtgtagagtccaggtcagaaacagaggcgaagagagaatgaaatggaggggaggaaagcaggtggctgggaaagggtgtgggtgcttgctctcccgaagaaaatgacggaggcttaaatatcgaggaaagacgagaggtgattatgcttgtctcagaatgaggttacatgctctttacggaatttcctctcaacttccaacattttaaagttactaataaccttgggaagttatatttatgacaaattttttgctttgaaaccactaacttcctcttttgaatttgattcaaaatccccaatggtatgatcagtttaatttttcgcatgggggtggctggagataggaacacctatattctatcattttctcatatatttatatgatggctccttctaaaagtgaaggaaaaaagtatttaaaaccctgcaatgactgtaacttgcgtgtaaagtaggttgccaactatagtcagcgtgtcacaaagctggggaagccgtggccccgcgtgcagggtgtgagctggtgctgggatgagccggcctagggtactgtctgtgtcagcaaagccacacatctaatcacaccttcagattgattgaattgaaaggaatattagttactgaaataattgatgtagagacacgtttggctccttgcaatgaattatctatctgttattaaataaggtgtttgttttacacaaatgcaggcctggccgggttattttgaaatacaggaactatgaaagaatttgacttggatagtagcgtaataggaaccatcctttctgttatttcataatttctataattgccagtaattatacttgcttcttaattcacagggtacatttgtgggatcaagtttctttttatttttgaaatggagttttgctctttttgcccagaacggagtgcagtggcacaacttcagttcactgcaacctccgcctcccggtttgaagcagttctcctgcctcagcctcccgagtagctgggattacaggcacccaacaccatgtctgactaatttttgtatttttagtggagatgggggttttaccatgttggacaggttggtttcgaactcctgacctcagatgatccaccagccttgggctcccaaagtgctggattacaggcgtaagccaccgcagctggccttaagtttctctttttttttgagatggagtctcgctctgtcacccaggctggagtgcactggcacgatctcagctcattacaacctcctcctcccgggttcaagtgattctcctgcctcagcctcccgagtagctgggattgtaggcacccaccaccacgcctggctagtttttgtatttttggtagtgacggggtttcaccatgttggccaggctgatctcaaattcctgacctcaggtgatctgcctgcctcggcctctggaagtgctggcgttgcaggctcgttttttgttttaagagagaggtttgcaagctaaagtttctggatattttctgcctttgttgattaaaaccactgttcaagattcttcataacatgaagatacagtacccagttcttaagtagtcaatgtgaagtcaacacaaagagaacgacctctttagaaaatcgaaaggggacagaagtgctgtttttcttttctgttgtctttgtttattattagcattattatttttgcaaagtgccgttatgtcaaaggtatggtgtacagtttctcatcctggaataggacaaatttctgggcatcaacttcctcttctctaaagtggggatgataatgtcacacacctcactgggttttgacgattaaagatgtggagtttttagaatagtgtctgatactcagtaagagctccactattagctatcattgttaatattggaagattacaaagactatatcaattacaaagacttttacaatataagtttatggtcctgaagaaaaatgggataatggaattatatcacatatttacatcatttaattaaatatggtgtgttttcatatacccactccacccccatcttatatagtatttgtgttttttgtttaaaaaaatctgttagtcaaaataggtatttattaatatgattaactctaatagctaatcatggtaaggccggttagttcttccataatcagacaaaattaaaatacctcattactgggttttgctgcattgctgtcctccttgggggtcctaggatctgtgggggtggctatggggtgttttaggcagttgggtttctcctcctcctcctcctcttcaatgtgcaggtgtggggtgccctctgacccatcgtggccacaccaccaggcgtctccttcctgaggttctggcggccctctctggatgcctgacacaatcccctcatagatgccctcatcttcctctccaatgaccggaaggggtacaggcaaggaacccacgctggtgcacgcagaggccacaaaattatcccctaggacttctggtgcctttttagggtctgagaagccccttctcatttttctcaactctgcaaagttgctttgagttgtcgttctgggatcctgaagaggctctgcatggtaaggctgggctgcagccgaggccacacccgcgtgagtggaaggtgattcggcaggtgcagtcgctggggacaatgggaggaggacagcaggttcctccttaatttccaggatggcgtcctctaggatggttggtttggcttggtcagctgacaaggttaaagcaccaagcttctccaattcacccaagaagttgtccaggaaacgaggtggtgttggggccaaagggtttgctggtagacatgaggctgtcagggacaaccagccctggccagttccctggagagctcctttatctgagccaggtgagactttgtgggtgggaggaggggctggttcactggaagccaacttggaaatgagcacggattatgaagttaagaaaaaataaactaagaaaataataataatgcatcaaaacatagcgatggagaaatgcagaaaagatgcggtggtgaatatgaaaataattttatgtttaacatagatttgaagacatttagaagatatctagatttgaaggtattttgctgaaatttaaatacataaaatcatttatgttaattagaaaagttacttcacaaatgaaactctactagttttggaaggggtcttaaatgtcaaacaagataaagatgatatagagattaccaggacagtaaaaccttgagagatttatttttatttatttttaattttttaaaaaattttttagagatggagtctcgctgtggcacccaggctggagtgcagtggtgtgatctcggctcactgcaacctctgcctcccaggttcaaacgattttcctgcttcatcctcccgagtagctgggactacaggcgcatgtcaccagtacagctaatttttatatttttagtagagacgggtttcaccatgttggccaggctggtcttgaactcctgacctcgtgacccacccacctcagcctcccaaagtgctggggttacaggtgtgagccaccgcgcctggcccttaagagatttaatgcttacttactttaaactatgttgaaaagatattacaggtttccagatactgacttagtagagtataaatgactccagagaaatgttaatgtagaatgaaaactaatagtgaagtcattttatttcctgaatgtgtgtagtgttctcttgtcctgcaggatagcccaatcttttaaacgctgacaattttctcacttatgtttgcaaggtgattacaacatatgaataaagtattttagatcattatatgttaacaaatttctaagtgaataagttctgaaaactatgtctcaaagacaggaacccatgatcagaatgaagctgagcttacataactacggcttcaaagttttaaaaaatccaaagtaaatatttacatagaaagctcatttgatgctaacgggagggaggacttctgcttcagctcccgttctctttcaaagcttgacatttatgtaaatcagaggaggtatgagttatgaagcttaatcttctgaagtaaaatatacttacttctacatacgtagtattactgatgtattttggatatagtaaatgaaacaatacatttgaaattttatgcaaaggtattaaaagtagttctgataaatatatacaccccatatgtacccataaaaattagaaattaaaaaatgtagttccagaagtgccacttactaacattggaatacgtttatctacccttaccggactagagaaaatgctacctgctatgtgcctaaaagccttgagaagggacctttcactttaggtctctccaggtagatgtctttgatttggaaagaaaaacatctccaaaaagattctggagatacactttccagctgattgtttaggataacactttacacagggaagcagccctcttgctcctggggacttagtgtgtgtgagtgggtgatgcatttcctacttaacttttgactcctgtgtcctatagtaggagtggggtattaattagatttatttagctttttttttttaagtcatcttatcgtgggatgacataaatatcacaaaactcatgtgagcatcttaatacaggattcaggacctgggctgcttagctgctgacacacagtgagactgcacgtgtggtttgcgcctaggtagacagccactcctgttaagtcctgtagatgctgagttttcaatgatataaaccactcaagtctcattcagcagtctacagaagttcccttactagctagagttctagtttataccccttgttacataacacagaagttttcatagttagatttggaaagtctgtgaaatatataataatttcagaccatcaggtttccactttcactttctgttatgccaggaatattatgtagatgagaaagaaagatcttgaattcccttgtcattactgccaccatcaccattgctatctgatgctgcgactacgctgtgccgtcaccaccacagtcaccgaaatacatgtcagcaggttaaactgcttagctttatgatggacttgcttataccgaaagccaaatgaagcatcctggtataactagatcacaaacctatacctataatacaaaacccatacaattattttgttttccaaaagcatcagaattggattctaatgcactaaaagcagaaatatcagaaataaaatcaacatacattttagtctcccctaagacaaagacagtatgtcaagaaatgtgatttaaatgtgtcaccagagtgatttataaattattaatgagttctctgtttgtaaatatcagttagaaaataggttctgtagcgtttagtatattttggatgttatcatttagaaatacattatatttatctttctaaaaatggttgtcacttccgggaagttttcttcattaagcctgtgacatcacagcatggattaccagttgggataaaaccattaagtatttcttcctaattatggacataagcttctcaacatattttttccccagcagtgagcaataaaaaactggttattagtgaaatttgtacatgcctctgtttaaaatctggtattactttaaaaacttgaaaatatattcaattacagttaaattgtattcacatcaaagatgaaaacattgggatcaaaaatattatattgccattaaatattatattaggacatatggaagaatttgttagatgtttaatgagcttttgtacatacatgcttttcttccttacaacattttatttgaaggtacagttgctttgaaatttctgtgatagttatttaaagatgactgaatggtggataagacaaatatatgcatgaagattcttatcttttctctttatcaatagaaaatactgaaggaaggatgctgatctgtaaatgctaaggtctggtaatgaagtaaatatacttaagaagattctggaaaactataaccaatcaagcaaacaaaattggatagtaccaaactcttccatatattatccatgaatacagggttgagggtaattatttgcaactgaaactcagtcttcaaagaggatcacaataaataaaatgccaagacttcagccttctaaaaaaaaatgcctctcttaagatggcagattcttagatcatttcctcatataaaatccttctcaggctcattttcaagaagtagtttaggtcactgggatgctatcttgaaacagttttttcatcggaacatgaagtgacttcacactttagtaacatctgatatgttgattttattttaccagctctcgatggtttagcttttcatgtcctagccttgatctcaattaaaataattaataaattaggcaacttaatacattttttgaatgttgagaagtacttaaaacattttggaagtcattggcaatttaaagttttattcctagaagttaatgagaaaaaagacccttacatgcctttcataaaaagaatataattcatcagaaaaataagaaaaaatttcacattgtgagtacagacaaatagcctttttacattcaccaattaaagaagcaaagcctcttttaaattacgtattgagaaagataatcatctttagcccgctcaagtgaaacagtagaactggcatataactgtcctaaaactgataaaacaaacttgaggacttataataaccgacaacattttcatttaaactaataaacatcttgacttatagactctaattaaaaatttttgctctagctcattttccatataaaaaacttgtatagatttgtcaacctaataacccggtgttcttgtgatatactattttgagatatacatagtattttgtgttgtgtatatttatatttcaaattataaatcacaattgtatatacatgtatgaatatatgattatatttatttatatgtaaagattatattatatacataaaatttacatatataaaaatgaagctttaggaaaaaattatttcagaaaacatttatgtacacaggagtacagatatatatcatacgagacttcatgatactctcgttttctctttctctttcgatattttaacttgaaaatgaaatgagcaaaattaatcattaaatctttatgccagcacctatttgagaaacactgacttatatttactgatgtggcactcacacatgtagaaacataatatgtaaatctctttctctgcaatagatatgatattctaatctaatatcctaaagtcacacaccgattatcttacttggagcttccaatattacattaacatgatagagtatgttcttaccttatttgagctcaagctgtgaatcctatcactagaatagctgtggggtattggagggtcagggtagtcctcagcaccttttgtgttcttcttgacgacctccacataggaaacagggaagatgccttgtctgttggttcctgggattttaccttcataccagttttgatcaactcttttaagaagaataactctatctccctgttatgaatatgagaaaaatgcattagaaacagagatagaataacatgaaaatataattgtcaatgttttctatgaaaaaataggtttccatttgggcaggttttataccttcagtttttgtttaatcaggggagggcaagtaaggtactagtgcttactagaaaaatacacatgatcaacatatatgtaattgaaatgtccattcaggccatcagaatcttccctaaggatgcctgattaatgtgaacgggtttatacttgtttatgctggtattgtgtgaaattatttgtctaagttatttcaaaaagcagaatagtgtaaaaggtaatgtctcaatgacaataggattattttatctctggcaggttcagtgcattggccttctgtaggaagagcttcagaaagtgcaccatagcttgctgtgagggtctgtctgaaatgggttacagaaaacacctctagaagggagaacatcgaatggtacaccgttttctttttttatttctattttttttttttttttgagagggaatctcactctgtcacccgggctggagtgcagtggtgtgatcatggctcactgcaacccgcacctcctgggtttaagaattctcttgcctcagcctaccaagtagctgggattacaggcgcccgccaccaggcccggctaattttttgtattttagcagagataggggtttcaccatgttggtcaggctgatctccaactcctgacctcaagtgatctgaccgcctcggcctcccaaagtgctgggattgcaggcatgagccactgtgcccggccccttttcttctttaatctacatgcgctaagtagtgacagagtgaactaaagggatgggggaaagagagcgccctagaatatcaatagctgtgacaagactggcattcccctggtcttcaccctgacaatggaaacccagcatccatctgagtagttggtgaccattccatacttgtcattaaagatttgaatagaacccttggctttcacaatgatagaactttctagaatcacttccacctgccatgaccgagccagtgctgcagaactcagtttaaactttaactcaaaactacacgtagcctagaagtaggcaggcaagttgatgctaccgggcaaaaactgcagctgcattcagcaggtgatacagaagctcgggcagcggcacctgatggtgtgatggagctgaaacagtcattaatctcagcccaacagggcacccttcttcaggtgctacccaagaagaacttcgaccttgagtagcacttggaagttctctttgtgttgaaacgctggatggttgattttgtgtgcttcaccaccgctgagcagaacatactcaagaaaagtcagtctcaggctggatgcaatcgctcacgcctgtaatcccagcactttgggaggccaaggcgggcggatcatgaggtcaggagttcgagaccagcctggccaacatagtgaaaccccatctctactaaaaatacaaaaattagccgggtgtggtggcgggcacctgtagtcccagctaatcgggaggctgaggtgggagaatcgcttgaacctgggaggcagaggttgcagtgagctgagagcacacattgcactccagcctgggtgacagagtgacactccatctcaaaaaaaaaaaaaaaaaaaaaaagtcagtctccccaaatctgaaaattgcaccgattttctagtataccaagaacaggtagttgctaggctgttgtgtgagctgtaagaggcattggtgaagcctttctgtagaacatggaacaggagacagagttcatgtaatgctctgtggttctcatgctaggtggggcagcccagaggataggaaagaaggaatcggctgatgatgcagaattaagactgatgggagagaatgagacaaggttctgccaggaccagaacaaaccaggactgtggtattgctcttcatcgcacctggctaaggatttcactagtaggtgtgggaggtcctagagccactctaaatattactacctcgcctgtgttgtgtgcagaggcagttacctcaaacaaatatatgtcatatttagaaagcaataagaataattcatttatcattctcaattatgtaaactagcaggttaaaagaggtttttgattgtttttttgtgtttttttttttttttttttttttgagatggaatctcgctcacctgccttggcctcccaaagtgctgggattacaggcgtgagccaccatgcccggcctcgaggcttttgatattattaagaagagatactaggattggatgggctgctagagaaatttgggtcaattatgaggcccaaagaaggatgatccagggaagagcactgcagagatggctcttaaagcggctcccccaagaggaaggatcttctttacctaggaccattcctagattccaagatagaggaagataaggattggaatatcttgtttttaaaagactgaaaaataaggcagcaaaacaacatattttgaagtgtatcaaactgctttttccttttgtgctcccgaatgtataagtccttgattttcagccccatgcccggcttcccagactaagccacagagggagaagcctggtatcccacggggaactcctctaaaaggacacagggaccagcagggaaccgtgactctgggctgccttaaagagtcctttgtagaaaatagggtaaacataaaaatgtctaaagaaaaagataacctattttagttttgaaaatatacagccttttcaaacccactgaagaacaaacaaacaaaaacaaacaaacaaaaaaccagctgggctacctttctcagtgacagctccacatttgtgtctgcgttgaagttgtatttggctatagcttctccgatttctccgggctgggctggcggaggtggtcttgcaggctgtgctttctcaggaggtgtgagtttctatgaaggaaatagtcatttattctcaaatctgcggtgacctttgaaaccaccgccatccaagagagaaagggagaggacctacctctacgtatgagatcgggaagatgcccactctcccgtggtgttctccctcataccaattttgatcaattttcctgaggatgtagacagtatctcctttcttaaatgacaactccctggaagagacacgttgacatggtctttttgtgatgtacagcaataattctcaagatcaacaccctcgctagatctgcatttgtttggcaaatatacttacaatattaaaaaatccaattgatattgagtccgattagataagaatgatccttgcaaattcttagaatgcacttaaaacattataactttagaaatgatttcaaacagagtaagtataaacattccattggatataaatcacagacagattaataagaagtttaaaggaggggacagactcttgctactttaccattagttcagagaagaggcattttgaagcttggaaaaatgatggaatagttctgcactgattttttttttttttgtcctgaagctagttggctagttagttactagccccccagccccttttgatgtactgaagcttacatgaaggaaaacaaatatcatgtagcctcagaatagaagtgccaacaccagaacaaattttatttgtggatctttgaagttggttgacaggtattttaatagaatatcttgataaggaatttattttgtgtaacagaaaagatcttacacttttaattttcagtggggcaagaagaatgtgttttaagtgcaaagacatatgccaatgcttgcctttctatcttttatttacaaaaaataaaaatatttttaagacactatatttttcaattttggctgtttctaagaaaattgtaggtatatttgatttgggtatttataattttaagttataatgacattatgcattttgaataattcacacctaaacttatcaccttcactacatcaatttttcctggcttaatcacccaggtgattaggttggttcattattttgcctccgcaattattcttggatggagggcgattaatttgtatcttctcccaagagcctcattttgcaatacatctgccctcccactctggaatcttctgcattgttttgttcagaattttcattttttaatctttttttaaaaaattttggttcagaattttcagttggatcatttattagtataggccgtttgatggagagagatttatacctgatggagaacacttctcattgattaaaagaattaatcgaaaaaatggtggtatattaaaagaatgatcacacatttagaagtgctaaaatcttcacaattgaaaatgtgttaaattttcagtaaccctaaaaacaaagaagattcatggagctttacattcaaatacagtgcttccttcttttgtgcaaatgcctaatgtaaaaaacagaaaacaaagcaaagcaagatatttaatgttcacaacacaacagtttcatttgtactaggtatgttttgtttctggaaatgagactagctttttaaaatataatatgaacatatgaatcagaggcaaccaatttttcaaagctatgaaaaagactcttttgtatttgtataggttgcatttaaaattttgaagtccttaagacacaggaaagtcttactcttaagttttcaaaactgtgtccctctcatctcagacctagaattttaaagtcccatttgcttttttcccctcacttttatttttatttgtttttgagatggagtcttgctctgtcacccaggctggagtgcagtggtgtgatcttggctcactgcaaccttcacctcccaggttcaagtgattctcccacctcagcctcctgagtagctgggattacaggcacccaccaccacccctggctaatttttgtattttcagtagagacggggtttcaccatgttggccaggctggtctcgaacttctgacctcgagtgatccatctgccttggcctcccaaagtgctgggattacaggcatgagccaccgtgcccagctgctttttaaaattaagacttctcagaagacctcgtgagccttgggtggacacccttcctacttcacatcccctgccattcctcaggtttttatatatttaagaaagctatggattgatttttacaaagaagaaatgaaacgtgtgctccgtaacattattttataaaactgatatgcattgtacaaattgtcacaccatatccacagaacagtagttaggaccggagtacagtagaaacaaagcatcttatttctctaatttgaaaaaaaaagatgtaagcttttcttcaggccagatttaagccatgttcaacatcttaatttctaaacaggatttttcttatctagttcatttcctatctcagcagcattaccaaattctgagtgatttatttatatatgtcttctgccagagacagtttctagagctattaactcatattatatgcatttttatgagtaaattattttggttattatatatatatatattcagtgtaaacaacatataataatttaatgacaatttacaatgaattcaatatctgtcttgaattctactggagaacaaagtttcttaaaggtctgtgcacataggccacaaaaaatctgggcaacaccctcttatatataagtctgcttatgtgcttccgcaaccacatgcctatctgctgagcaaagaataaaggcaaaagaaatattgcaattcaggatggtgaaaacaccgacaccaaaagaccaaaggagaaaactttgctcagaatctctgagctttgcaggctgaggatggagacttcaatacaggaatctttgtactaagttctagtcatcaaccccacaaactatgcttggaatatttggataaataaatgttatcaaattcccccagctagtgttaattactccccaatactttatttatttacttattcattcttttttttgagacagggtcctgctctgttgcccaggctagagtgcagtggcgcaacctcagcttatggcagcgtctacctcccggtgaagcgatccttttgcctcagcctcctgagtagctgggactatacaggtgtatgcccccatgcctagctaatttttgtattttttgtagagacatggttttgccatgttgcccaggctggttttgaactcctgggctcaagccatctgcctgccttggcctcccaaagtgctgggattacaggcatgagccactgtgcctggcccccaatacttcattaattcattattgacacaaaattctaaaaacaaatattcctaaattctttttgtttttcctatcctttagaattcattgtgttctacctaacatgtttaatgtaatttaaaactcagtaattctcaactaaacttaaaataaaaggtaattctgaaggaaccatttaattagagtagattgctgcattgggaattagacctcatttgtaacagatcctactgcaatgcttatctcttaaagcattactaacatttaaaaccaccttaaatcatatgatgagtatttatcttacttacttagatgtctgagccttaaaatcataaacagcttttgcaggcaatttctgaaaaggaagataaacaattagcactaatttaaaatttgaattttctacaagaaagtagtttaatgtgccttaaagaaaaaggaaacctcagggaatcatcaaacatatgtaatgttaatcctgtaagcaatttataaataagtccattcattcttcatttagatatttaagctataataggaatataatagaaggcttattcaccatcatatttaatcttaggaactaaggtagattaatgttataatgagagaataaaatgcctgcagaggtttgcatcctaggcatcattttggctgttacaaaggctcttcctaggataaatgtggagggtcaatggctctatgttctatggagattgacacagctccctctgaatcataataaaaggaccagatgtcataaaagaagtaatcattcccttcattagacacttattaacatattagcaaaaaatattagctcaattatcactgggaggctggttagtgggcaaaagtataggtgtgatcatcttgcattccctagagggctcaggaatccttcaacactctgtccaccagccactcgtcttttagttgtgatgtgatgtgacacgtgcccatcctcaaactctgggggccacagatctccctgaggtaccctgtaccctatagctagctaggccagctcttccttcctcaccaaccaacaatcccttcactccattcttttcccccatgactctggtgaactttaggaatcctggaccatttctaacttctttggggatcccacaggctctggactacatcagacgcctataagatcctctggagcggctaccagtccaagtccagcttttagtttccatccagccgtcatggctccaaggcagtttgagcaagaactctagccccggctcagggccctggacagagttcagttggtgggtggttcccaggggcagtatcccgagaactgggctggttaaaagctctttttagggatcctctccaataaaaggaagccagcaaaaatgatttctgtaggctctgtattgatttacaacacagttgacatcaggctttctcctggaccagcgggccaagaaattgtagaggaaacctattgcctccacgaggtgccctaactcaggacacttttaggtcataatggttaagttcatgggcatcaggtcaagactcggagaagcctcatggccaaaactgggccaccactagggaagacccacagctagggtcagggtgtggactgcttctagggtcagagttgctatgctcaggccccaaggaaaattgtttctagtttctcagtattttcacatttcctgtccgagttcgttactggtttgggataatttttggctggtaagtgctgtatcaagtgtgttgctgtgaaagactccaatgctattaaattaactacctctttttctggagttcctcttctttcccttggtgcacttctccccatgtcagtcaaagtggatgagtaacttctaggggactcacggtctattggaaagaacagggccagtcatggtgagtatccacttaattacaagccaacctgttccgccattttccctggtggccactacttttttccccaaatttggagagacaccgttatcgaacacatgggcataaaactcatagttcattacaaagttgtgaaataagacacaaaacaagagcatttcaaaaggaaaaatatctgaggttgcagaattataattgtctatataaatatgattactacattgctgattaattatattgccacacccagtaagacaatttatagttagagggatttttcatataaattttttccaaagctttctgtttctatgcctttgcttcttatttataattactattataagatttacagaggatggagaatttgaaaatagcaacaatttgtagaaaaagaaacattttgtggagtaatttaagactgtagtaatgaaaaagaaagagataaaaccaaagaaagtatgaggatgacaggagggtggtgatgaacattctccttctgccttactctcccctcttcgctcttcctctgtttttaaatacttattgaatctcaagatgccatgctgtttatctacgaccttcctttgtgcccagatgataaacaccttatcagaaagcaaagaaacaaagagatattgtttcttcttactccaagcaaaaaagggataaacagaaagcatcatgtcagttgccaaattgcttatgaaatattgaattatttttgttcatcttaaagcaaagcataaataatcacattacaaaattttgattgcatgtagttcttaatagtatcttataccttttgcacttacgtgacttacatatggagatgtaactagacattaaatgtattccagtagtctatgttatagaattttatcagtacaactgggtcaatatttgtcaattctttcttttatcccttaaatatatctagttatccagactaacaagaagcattaaaaataaaatttattttatccatctatgaaagaatttaaagtgctgattcataataagaaaacattgttttaggattttgactactttgatgatgtaaattctaagttaatatacttttatgatcatagggcctcataatgatcataaattttaaattactttttctaacccagggaatataagctatttttcacttgggtgaaacacaattggaaagtaaatattttactaaaaaacaaaatacttttaaatgcatttcaaagcccttccaagttacgtttcaaaaatgtactcctatctgcacataaaattgagagatggttatattaggatattaaaagcctggagaaggtagctaatttattaaaaaatgagattctgacacatttcaattagtgaaaattttgaattgtagaaattgattttttaaattctaatttattattttgaagcatgttgcttcagcctaagggtaggcaaagataaacgtaagtgtatagtgtagcaaaagtgaaagcaaacataaagactaagtagatttgtgcaagttaattaacaatcgagccatatttgacactagtatgaactgtgaattatgtctttttttttgtctgagattatattttatactataaattctgaattattaggggtttgaatctcttttctgttatctactctctgtgtgaccttggacgaatttcctttcctctctgggcccaacttccaaaattgaaaatggcttttgaaataacacccatttcataggcctatgccagttttattagataatgtatgtaaagcactctgtagtgtctggtgcatagaagtttctctgttgaccaactttcagcccggaatgttcattccagcctcttaaaatttacgtagtgaacagatgtgctgtaagaattaatgaaaataattggtcacaaatattaaaacaccctgggctgtaagttatataaatctcaaaaatagtcctctgcctttcaattgctatttattcttgtgttgccacttcaaagttatctatgaaaatagagtttagagtcactgttagcctgaatagtgtaattcaaatttcaatacaggactgttttagcagaaagagaaagtgaatgaattaagtaatggaaaagagaaaatgaatacactaaatggtggaaatgggacttttatatatatagcttaaagatacattcacaaaaattttatcaccattgtgtccttgaaatggagaaagctattaaacaaaccctaatttctttgtgtccatcaattactaatcacatatttcagttttgcttcttgaatgttttgatatagtatcttctatatagaatgtgacaaattatttattaactgaatgaatataaagttttaacgttaatataaacatttttaaaaggctatttgtggaactataggttttgattcatgtcacaacgtaatttattgtctcaatgtgagtagtggttgtttcaaccctaatgctgagctacaaaatggccttccctctcgttttcgaaagagtaaatttttgtgaattgatgatcactttaagccacacatcaagtccaaatatcacatgggcaaatgagaaatattcagtaagacatatttgcacaacaagtttttgcttcacaacacataacgacgccaaatggtctcccagctcgggagtgatgagatgttggaatggaaaatgaaagagctggagggtgggtctctgaaccacaaggaaaaagaaagaaaagctcatccaccttggagtgcaccgccacggtcttggtggtggcagctgctgttggctgtgtccacgtcttggaaagaggcactgcggggcattctcccgcagtcattctggtagggtggacaatgaatagcaccatcgggaggcagtgggtggagaggctggtgcagggggctcctcctcagcgctctcagggatgagttcctctcgggaacatctggcagcagctcactgatgaggcggtgcaggatgctgttgtccggcaagctcccccttttcttttcagctttaatttggtcacagatgtctttaagggcagagtccagagcctcaaacacagatgctttacattttgccttttcagtctgtttcttaggagccgaattttttttcctccggaaaggcacaggactgactagaaaagcaagtttagaaaggccagggtccatttcttgccttctgggctcctcggtgttttcgtgtctggctctttcgtgttttaacattgtggtaaatcgagtgtaggaggccgggcacctgcctttgcaggagctgatgaggtggcggtggtggtggtggtggtgatggtggtggtggtggctggatccgtaaaagctttcggaggatgtgaaggaaaagtgatcaaagtcactttcactgcagaaggatgacccctctaggtgaatgtagtcactgtggtcggacacaaccccgtcctggtcgctgtcggaaaactccacgtgtgctcggggctgctcatcgctggtgacttcaatgtgaatgggcaccagggcgttagactggcagcctcgccggccccgagcgggggggccgctttgattttcttcctccagcaaatactcaatggaaaaccgcctcttgggacataggccattttgcggtggttctagggttacgggagacagcatgtcatcccctaaatttggcatggatttggacttctggatcagcttttcgaattcggagatgcgtgtgggcaccatgtcccggggcacctcctccgtggagcactggctccaggcgcgcagcaggtccttgtgctgctgctcgctctcgtactgcagaatcctggacttcacggagcagatcacctcggagttcatcaggtccttgcggttgatgcggtgcattttcttgtacatcttcaggaaccccggggcgttgcgggctgacctgtgtctgatccttgatctgccgttactgcgaacctccgggacgtagggggacccccacgccatggggcagctctccttggagtcctcctcacataacagggagcccatgctttccgacttgactttcgggtccgggaagctatcgcagtcgtcgtttaggagatcgtcacagctccgggatttgattttgggagagacggtttcttccgtgctgctccagatttctgcgttttgccgggccatttgccagccgttcttgaaactaatggctcttggtgagtcccgagggacatccaagtgctgtctgtaagtgctacagtaatctaactcactggaggggttgccgttgagccctgagtaactgcaaagggatggacatattttgctatcatccccaccttttaatccagagcagcgtggtagaagagagacatttggagaagttaaaaggttcacaaagagaggagagcatgtcagtaaagcatcagacagcatagcaaggagaaagcagttagtgtgttttaatctaggtgctgattgttcacacatggagcttcaactctagagaagaaggtctaattctaaagcgagctaatactttttcagtgaatgtagctttgcagagagagttgacaaaactgtgtataagaagcaaccgacgtaagcaaatacacctactcctactgcataattcatacacctttctgacaatattgtttgccaaaacacaatagtgctgcttcagctgatagcatgatctggtagtgaaggtttaacaattagtgtcaaaagtgttatacccttacgcaatttaatagggccggaatttgagcctcatttgattcgtaatgatacataggtgaagaagggtttatacatttacatcgaattaatactctcatgactatatcaaataattttttgtgggttttagattttaaaagctataaggcaaagtattctccaaaattgcaaaatcaaaatgctgtgaactattgctgctaacatttttctagaaaaaaatagctaaagctctttaaacaaacgaatttacctcttaaattgctctacctttaaccttttattaggtacaaaattctcataggaaaactgaatataatgcaaaactttcatcagaggtgcatataccatgctttttttctcggaagagttctttgaaaaatcatttgcaatttgataatagagatctacatttggcctcaattttgaatagctatggaaatgttcttttgctttgctgagtcaactaataaatgaggagccaaattatatctaataggacattttcttcctagaaataaaatctaatggaggaaaatatctctattcaatacttataccttacaatgttctctaaattctttaaaagtagataagcacattaggtagatctgtactgtctgggaaaggaagttgatttaacattccctgtgatgaaacaaatatctacatttatcagaacccttttaacttttggctagtatccaagaataataggtcaatggcatttcatgacctacttgttaccttaagatattcatttgaataagtgagttgaatctgataaggcatctctgctcctcagaggaaagatgtgatggatggggctcacacgccctgaaccatcagctgatatcacagctttacaaggccttaaaagggctaggcatccacctactcagagtccaatcatcacgaccagaataccttttgcacacaaatcagctaccacttttaactaccatgtggcaatggttttagtgactatagttgataggtgtagctgaattggtctggttttatagaaacttacattagagctcaatttctttacacatttcaaaatctctttctcttctctttcaatcccaagatattagaggagattgtggggtcccacatttggtagagccctagctccctgtaggggctggttcaatcctcactctccatctcagaaatattcctgtcctcaaggaataccactaaatggtcttccagaaaccagaaggagtgacttctttcaacagtgagctccctacacttgcagagaggagacgggccatccagaaaaaaaggcttggtgattcctcagtgatatcattatggtttgggaccaattagtcctgactgtgagctgctgtgaattgaccactgtgttacatggcaggaggtggatgctccactgttcatgtgaaggtggcccaaaatatacagcaaatggctaaagaaattaataggtcggatttttttaaaatctagaattgaataattttttaaaaccctccaaaccaatgtatattttagccaacaatttgctctgttgctgcttgtaatttttatcctataaatttgactaatttgctagttgtagaaacattagaaaattttgactatatgtcaatgtttacaaaatacatcttttagtagcctgatgatacattatttgatactttcaatttgtttagaaagggatctatttgggggaaaaaagcattagcagatgctagtcagagttctttaagcaacctaagtggctcgccagcttgagtcagtctgggtgggaagaaggctattgttctaaaactatattttattccagacactgtaggtgagagctggcacatgccactatcactgggccagctttcacacagtgctctaggctaaaacgtaaactagtaaattgttgtgttttcatttactatgctcaccttttgctcttgatggggaagaaggagaagagctagtgaaagactttgtaagagtggtgcttgatcctgggaggtccactcggcctgggctagtcctgctcgcactttgatctcccaagccccgtggtggacccactgcaggctcgctcttcctccgcttcctgaagtcactggccatgcttgcagaactgaaagaaggaatcagatctgtttgattggcactggaggaggttcgggtgtgcaccagaaaaaccggtggaacgtgctagtgacaatggcgtaactcctaaacctctatccccaaaactgcattgctaggaactcatcccttgatgttcaacatgatttctctagaaggatcttttaaaaaatgaatagaccttattatttattttgagatggcttctggctctgtcacccaggctggaagcgcagtggtgcaatcacagctcactgcagccccaaactcctgggctcaagggatactcccgcctcaacctcctgagtagctgggaccacaggtgggtgccacctcacctggctaatttttttaaatttgttatttatgtagagacagagtctcactatgttgcccaggctggtctcaaacccctgagctcaagtaatcctcaagcctcagtctcctgaagtgttgggattacaggcgtgaaccactgtgcccggacaactaaatttttttagggcagttttaggcttacagaaataatgactggaaagtgtagagagtttccttatagtccctttcctcttgcacagtttcccttatcatttacatattcttttggtgggtacattgtcacaattgatgaatctttcctgatgcgtcgtcaccccaagtccatagtttacatttgagttcatgttttgtcttaaacattttaggggttttgagaaatgtataatgatgtgtgtccatcattaatgtgtcaatcatataaaatagtcttcccgccataaaaagcttctgtcctccagcttttcatccctcccttcctcccgctcatcctggcacccactgatctttccacacggcctccacagtttcgccttttcaccatgcccagttgatatcatgcagaatgtggcctctcaggttggcttcctgcactcggtgatacacttttaaggctcctccatgtgttttttgtcacttgatagctcatttctttgtattgctgagtcacattctattattacatggatgcgccacagtttatgtatccattcacctattgaaggacatcttggttgcttccaacttctagcaattataaataatgctcctaagaaaaccacctgctggtttttgtgtgaacctaagtttttaaacatctttgaacgtcaaaattctcctatagtgtaatatgttgattgagaattcagtgctataatttgtatcttgtatcttttctctataaagcggagttctaacaacatgaatatatccagaggggcataccaaatacaggaaataactgaaaaaaaaaaaagacatcaagagaggaaaatctctctcacctcaagggttgcctgcagcttgtcctatcatctctatcatcttagctttagaagatgttatattggaattccaacattttttatttaaataatgaatgaaggctgagtatgatggctcacgtctgtaatcaagtactttgggaggccaaggctggaggatggctcaaggtcaggagtttgagaccagcctggacaacctagtgagactctgtctctacagaaaataaaaaagttagccagttgtgtcatgtgcctgtagtcccagctattcaggaggctgaggtgggaggatagcttgagcacaggagtttgaggctgcagtgagccatgattgcaccactgcactccagcttgggcaacagagcaagaccctgtctcatcagtcagtcaatcaatcagtaccagtaatctggtcagcaaattaactattaaagattccttcccctcagttgcataaaatactgtcaatagtctagaacagcagggagtttctgtcatggttttgagtttgagtacagtatcatttaagaccaatgttaatgaatgaagccacatatggcacagcacactgtgcatgaaatcactggattcttagacaagacttgtgtagacaacagtgataatagcaacagcagcaaccccagctcctatggagcccagcagaatgctatgtgctttctttatgtttttgtcttatttagcccacacagcaaaccgatgaggtatatgctgttatctcagttttacaaatggtaaagtgaatacatgtgtctgggatgtacggaagcaagcggagaggcagacctcagaactggtttgtcctcttctgaagaggatgcatctcctagacctgtttttgctgggactgtcctgtcatgtgagggtctgtgtgtctttacggcaatctgtagattagattaaaactctaaaattcaaatattttaggtgcatagatagaggcagaagataaaaaggaggggttccagagttcctttctcagggatgttattgcagttggatggcactcagaaacccaatttatgattgacccaattcacaaagaaatctacatagaagggtaaattaatgctactagataaatatttgttattgatgttacaatatggctgggagtttgtattattcaatattactattgaactatgtctgaatatgtctgaattttgtgatttgtttttttttttttttttagactgagtcttgctgtgttgccaggctggagtgcagtggtgcaatctcgactcactgcaacctccaccctcccaggctcaagcgattcttctgcctcagcctcctgaatagctgtgactagaggggcatgccaccatgtctagctaatttttgtagttttagtagtgatggggtttcaccatgatggccaggatggtctcaatctcttgacctcatgatcttcccccctcagcctcccaactgctgggattacaggcatgagccaccgtgcctggccatgaattttgtaatattttttaaaaagtgtgatatttaaagctaatggaacttacttcaggcgaactctgagggaagttaggcctagcggtgacaagctatcttgcctcaatttcttttttttctctctccttgccaactgtgtaaacttggtaagttactaagcctaggtgtcactttcctcagagataaagtggggacaatagtatttaaccatagtgttttcttaggattgaatatgttttgtacttatgcctcatttattggtagtattaataacagtatttctgatttgtgtggtcaaagtatgattaacaaatacgtgtataacactttttaatctataatttttttcaaatatattattataagggccatttaacaacattgaaaattagttacttataattcccatctaaagaaaagaaaactgggtataggggactaagggaagagaaggatttctcagtctgtgaaggaatttataattagttcactaattttttagaaattcttgaaatgatcatataaaatgatgctgaaacaaaataaaacaacttcatgaggcatggtacttcaaataaaaatgagtgatacatgatactcattactacttcactgaataattttattgttgaaaaagaaaccactggtatagaatattctgctacaacataataagattcttacctcatgggtctttccaggcttctgtctatagaggactgatacaaggaggcctgttaagataggataatagtaccatgaaaaattttaccgtggcaaaattttgttcacttgtcaacattaaattaggtatcctaaaaagaatattataaaaattgaggttgaaagtaccattcattatgactataaaaatgtcttcccaaagagagatcatgcgacctgatttctacttgggacctatctgctttcccttctgatataatgcattgcagttctctgtgtagctcaaattatccacaacccaagcattgcatggggggaaattaataatattttctcagggacactgaaataagagctaaagttatcctacagcctgaactgcagaatcttacctgttgactgtaaatagaaatttcctacagaaaggaatggtttgatgttttaaaaaatttgtagtcatcattcaatccttataaaacatcacattttaaagtttttgttattgttgttaccaagtattgtcttcagaatgtaacacataagcagaacttaagacaccattcatctgtcaacatagacatgacgtttaaataaaacccacagagtttgacttgaagaaactaaataaagtacctggtacttcaatcaggtaaatagttatacttttacaattaggtgagttcagggctagtttaaaataaatgagctaatgaagcaaaatataacttttttaaagtgcgcttttaaatttttccttcattctgaataatacactgaaatagatagtaagcaaaaatgataatatgaattttttattttccatggcatctgctgggataattgctaaaatatctaaaaggcaagagaggacactgagctatcaagtgtttgaggtgacactgtggtatgatgtccagaaagcacagggagatggctgggtgcagtggctcatgcctgtaatcccagcactttgggaggccaacgcgggtggatcacctgtggtcaggagttcaagatcagcctgaccaacgtggtgaaaccctgtctctactaaatatgaaaaacgagccaggcatggtgacacattcctgttatcccagccacgcaggaggctgaggcaggagaattgcttgaatctgggaggcagaggttgcagcgagtcgagatggcgccactgcactccagcctgggccatgagagtgaaaccccatctcaaaaaaacaaaaacaaaaaacaacaaaaaaacaaaacaaaacaaaacaaaacaaaagtataaagaaagtatagggagatgtataccaagtatagatagttttgcctttggtcatatttgatgatcaattcatcacagataaaatttggtttgatgaagaactggaattctagtttaaaaacatttgtctgtatgaaagcttaaaaatgtcagccagaaaggcaaggtttgacaaatgttgtcttaagttgccatcatctagaaacattttatcagagtattaaacatctacttagtggaaatcaaatctcactttacaaactatttctataactcagttttctattaattggtaaattagcaccaattaatcaattaaaacaatacaattttgcaattctgtatgtatatcagtcttacaaggtcccttttgcataacttacgcttctattaactaatattttaatttaattctatcttactaaatgaaaatggaatcttgtctagaaacaaaagcatctctgcatgagaatattcccatcctccttttagacagaaaaagtggattgtaatatttttagttcctagaaaatatttagatttctaggttctcaacaaatataaaatcaggagaaaagtttggtttgctagtctgatatgtgtacatggttattttaatttgctgagctctgaatcagacactgggaaggtagaaaaatagatactaaatatgaaagaaagcaaacaagtaaaataaaatcagatcgttatattacaattaagaaatattaattctactcgtttgcagaagagcgacactgaagagcctgagagcatcggcgtctgtgcagatcacggctttcgtgggacaccctcacacacagctgatcaccaaaaagtgtgaagttcacaacactcttagaacaaccctacagtgatcagaaaatttgaattgtcaacttataatgagcctaaacaatattgtaatgtgaaataaaacatagtgtaagaactgattgtgttttagggttaggctaagaaactactatttctccttgtactggtttctacattcaaaataaatgaaaaccagttttgcggtttcatgtacactcagagaaagttcagtattaaattgtaagataagagtaaaaaatctagattgatgactgagagaaaaacttgtacaataattgtaagaagtgtactcatcccaaaatgaaaattatctccagaaaagaggttacaaattttaccagttatgatctactatttacatattaccattattttaacacacttagaaggtcaatttagtgaagtacagatactgaatcactctttctgttaagtagctatgagattaaattttgcttaaatatccgtaactgttcttcattaatgccagttttccagttatggattaaaatctatgttattcatggtatataccaggcagttgataaacggtagctaaggtaatgtctaatcaattacatttgtttttaccagaaatgtttaataacaaaaggttattaaagacaaaatccagaaccttaagagaatatattttcttacattctgaaaaactataatgtgaaattaataacatagttaacatatgctattagaatcatacagcaccccctctcaatcccagagataactggcaaatagatcaactactggcaaagtgctttttatgtgttgtttttttttttttgccactaccatcacataatagaatgcatagagttaagtttctactatttttatgcccaagaattattgtgtaatattaattaacagaactcttttcacaggaattcaatagttaacaagaaataatattaagtaagtaatttgtttttaaaagatttatcctctaaatatatatcttggaagtgctgaaaagtgtgatataaaggaaatagcacagaaatgaaggttaagagagatatatttttttttctgccactatcttaccatgtgattttggacttatttcttaaaattattgcactctacttttttttttaactgaaaaatgagtgaattggacatgatgcactctaaattccatttcagttatctatgaaccaactaccttaaaaacaccctagaaatatctgagaaaaatatctgaccacattgaatttcaaaataaattcttgggttgttcatatgttgaaataagactctttctgcagatattaaggtaacataacatacagaatataaccccttgttttatttgattttcttcagattacatgcctgcctgcctggctataaaatgtaagcctttagaaataactgaattcaataacccagaatgttcctgattactctattttaccttttatttaatatataaatattttgatcacttctcagttttaacacacactctgatgtttaccacagggtaaataatttgaaattgcaagttgagacgctagaaatttgcatattttcttgagactctatacctgcaattccagtggtcaccactatgtgtcagtagtacctcctacaacacaacggttctactggttgtgtttcccagttgcacatatttaagacttttaatgaaaataagatatttattgtgttatagtattcacttaagaccacagagcaactaatgtgcaaaaaacagtttatttacttcgttcccatgctagttgcttctaagagttccttgcaaggaggcttttatatagctgatggctagcaaaacagtgccatttctgcttgtgtcttctaatgagtcatttatccactttctaaagtaattttctgcttttctttgcagagagcaggttaacaagcttttgactctgaatcatttctgcctgtatcattctctctttcaaataaaactctgattcaaataaaaatatacattggctgccataaatttttcacctagttgattattataggctcttaagtagagattgcaaacgcatttcattttatatgccaatgataatttgttatagtggctgcctggattacagtgttgaaaaggagtagtcatgtctgtcatgggtatgaaactgggaagttgtgatacacaatttccaggtatttgccagccctattcttgactgataatacaatccgtaagttgtatttaggaaaatgaaagaacaaaaataaattttagaaatatatgggacataggcatctgattatccacactccaagcattataatagaatggttctaagaagccttcttgtagtattttactctgtctcataaaaagaggtggttaatatatgcactaagactaatacttttgatttttaattttcacgctgctgaataccagaactacatagaatagtataactagcagttgtggttggaatgattcttcacccagagtccagagatagccaacaactctggtataattaatgtccaggcaatgatactggatgcaacataatgatgcaaagatagatattttttcaaaaatagcttagacattacagagaattgtaaaacacagatgtgcagaatcacagtcacagcctctaagggagatatctgaaaaagagagaataacgtgtttttacctcattgaaaacaccagaagaatgatcttgaacatagtccagaggctttttaggaggctgggtgtagacgcaccacagaagcagaagtgtagggatggaatggaggagagtcaatggcagcaaggaatgaacatgtggaaaaggtgacaacagttagaaattgagtgttgacagcaccagctacacaaacagaatgacatgaatggagcaaaatgggggcagctgggaggaagtgtgcaacgtctgcaaatattctcaagcactgggaaaattggctagtgttcaattagtatatttataaattcattttgtcaaatttcattagcactcctagtctctggccacagaggaatgcaaggtaaattaaagaaacattaaaggagcaagtggatagcatgctggtgagtttccatgtgtgactgaaaatgattatggaaaatgctgataacttaggctcagtacagaatagtccctataagctttctttttgaattattttattttattttattttatttttttgagacagggtttcactctgtcacccaggctggagtgtagtgacaccgtctcagctcactgcaatctctgccaccagggttcaagtgattctcccacctcagccccctgagtagctgggattacaggcgtacgccaccatgcccagctaatttttgtatttttagtagagaaggggtttcaccatgttggccaggctggtctcgaacccctgacctcaagtgttccgtctgcctcagcctcccaaaatgctgggattacaggtgtgagtcaccacgcctggccgtccctataaactttctaaccaacagcaacaatacatataaaataaagctagagaatgtttttccttgaaataaaatacatttacattcacactaagatacaaatgagaaaaaatgagagaaaacattcctcctatgagataataaccctaagaaaaatcctttggtttatattcgtttacagtcacttttgattcagttcaataagctaccttgagtctaaccaagtctcctttgcagtttaatggacaaaagagactaccatcaccaatcagtaaaccatatatggtccatatgcaagtatataaatcagcatatggtatagaaatggttatatcctgatttctaaaaaaactatcagtgtaattggtaggttatttaagagtctaaaacgcataaaaacgtgtgtaactgacacacatcaaatgcactgctgttggtggatacagttcctaatcagggaagttgttaactgaacctccagttgactattttttttttttttttttgagatggagtctcactctgtcgcccaggctggagtgcagtggcgtgatcccagctcactgcaatctccgcctcccaggttcaagcgattctcctgcctcggtctcccaagtagctgggactacaggcacccgccaccatgcccaactaatgtttgtatttttagcagagacggggtttcaccatgttggccagaatggtctcaatctgttgatttcgtgatccgcctgcctcggcctcccaaagtgctgggattacaggtgtgagccaccgtgctcggcctcaagttgactctttatcccaaacaggctaagcaataaggcccaacctctgggcttcctctggcgggagtctggggattagagaagctgtgatggctttcactagcaagtctggaaattaagatccacaggacttcctgatttttttctttccttatatccctaatggtaaactaggtacagtcatgtgttgcataatgacgtttccgtcaacgatgcacctatatatgatggtggtcctatgggattataagactgtatttttaccatgccttttctatgtttagatatgtttaggtacacaaatacctaccattgcattacagttgcctacagtatggagtgcaggaacctgctgtacaggtttgtagcccaggagcaacgggccatagcacacagcctaggcgtgtagcaggctctagcatctgggtttgtgtaagtactctgcgatgtttgcacaatggcaagtccacctgatgacacatttctcagaacccgtccacatccttaagcaacacgtgactgtattttgtagtgggattactctggcagtatattatagtgagaactgcccagagattttcatttttctttaacaggctctgcgtttaacttcttactctgccatttactattttgtgcacattacttaacccctccagtccccattttcttcttcttggcgggacatcaggaggcctcgaggagataatgaagacagaagcccgcactctccaggtgcctgatgtttgctcagcaaacaggactcaatgtcaaggtgctcttctgcttgaactagaccaaatagactgtaaacaaatacaaatcttctatacagctgtaataattgtctgaatattccatcacagaaactacctcaagattttgaacttgtaatgaattagatgtaaagaaatcttaatgaatgacctacaaaccacataggaaatgtctgagcacatttgaccatttggtacagaaatgaatctggactacgctgtaccaagtgtgtgtatacattatgcattcggcctttgttctctgaatgacacccacgtctactgataattgtattttagaaatcaaacagtatactcctagttttcttatattaatagtctagcctcacttaccgggcgtccaaactccagttctgaaaagaatttataccagggctcattttctaaatctatgtcatctggatttatgcgatcagtctagagcagatgtgaaggaaaagggaaggaaaaggcacactgagcaaagtgagggaaacgctgtgtggcatgaaaaactcacgcgcgcattgacacgcaaacatgcatcaactctcaccccacgaacctcagcaggagagaacggaggaagtaaagtaaaacgagtagcatgaggatgtgaaggcgagctccatggcagggggtccctagctgtttcctgcgtccatcgtttctgattggcataagttgtgggcaactcttgcttgagttgatccacttacgcttgaggcatgaactatggaccactctctgcggcagcgagactgggtctggctggcacgcctgatgtttggaataggctcaacccagtcaccaaatagctcttttgggcgagtcacttcatcgtccctgccctcattggtggctagcagtcccagcatgggagcccgcagtctgcagacaattcactcgggtgcaggcaggtggtaagcctgggatggggaagggtgcgggaggggtgggaagacaggcgagctggggggagggggacagggcattggggggctctcaggggcctgtggatgagaagattctggggcctggatgggtgcgagcgggacccgggggagtgggagtcgccaggctctgagcaagcaagggctgcacctgcacctctgccgggcatgaagaaaggtaaggaaggaaggagctcacccgggtgggagacagagccggggcgcgcgagcttggtgtgggggcgccactccggggcggaggggaggggctaccagtgacttctccgagtcgggagctagaaagaggcttccggccaggttcccttggaacaggtgtcggagttgttgggagagggggctgcaagaaagaggggtgcagaaactggttcattagatggaggctctgggcggaaccgcgaggacaccctggcagcgcgctgtgcctgcgttaggccgggaggggagaggcctccggacggcgaagtgtccctagggacccagacgcctcgggagcgatccgggccgctgcgaagccctgcccaccaggagtggatccccaggattcacctcccggctgcctgctctgagctgagaaggggatctggttcttcacaataccgtggatggcggggaaggggagggagcctggggtaaaatcccatcttggtttcctcgatgttctaatttagagaaaaagccagttttataattgacctgcttccctgcagaggtttctgaatgttgtttttaagatgaaaaaactagcagtgttaatataaacagttggagaaaatacatacaattattctagtaatagaaaacagatgtagagtgtttaccttacccagcagtgtccttaatattttcaaataatacatggctgactagattgatttaggctgctgattttgtagtaaatctaagagcttaaagtactatatacaagttattacttctttgataattactatatgacactaattaaatgtggtacaattgaagagtacagtatcttaagtcagaaaaaaaattctaagaaaaattatatggttccctaaaagccattcactctggctaggagaggagctgtgactcccaagacatattctaggaggactattaagtgctcactgcttcagaacaattcaatatcatttgcttacaattcttaaagaaactcagggacttaaactgaatagcgacatcttggttgtgaaaaaaatgctatgtaaccttcgcagtgctgggagcttgaaatgttccatattccaacaaaagccatgattttgacattgttctactgttttattgactcgttgcatttacaagttttgctaatgatacacagtctacacttactaataaattatactcacagtgtttttagtgatgtgactttgtttcaatattttataataaaagattataggagtaattacagacaatgatagaaaagtttgaggcatcgtgacaaaatagtgcaaaagcctaagttatccaaaagatgtagtgatcataattataaagactgtgtagtgtccctgggaaatgcttacaatgagataccaagcagtcaaaacggaatctaaccacgcacctgtacagtagttacaaaggtattacaaagcttgtctctgcatgaacacagtaaagaagtcacacatacacaaacgactacaatggtgttctggtattgcgactgtttgttttttctttcttttaaatattattttgctttattgttgtaatgttatttttgtaataaataaattcagagagaacatcctactattagacataggaaaatgcctagaaatcttgagatatttttccttctttatgccagtattatatttggtttacacctcagaagtaatagtgaaattggtagagacaaaatattctagtaaccaatttgctattttctgttgaatttaaaaatttaattcaatttatatttgattcaatagttgcaatagtattaattgagattttaatgtccataaaatactatttttctccaattattatttagatcattatagatgcataattgttcgtgaaatggctttgctggagctggtttttagggtaactgacaggagagagaatttccagtaatttctcttctgtttagagagacatactatttcttctacaggaaaactaacctctgactcttttaaacttcatagtttctaatgttacacactgaatgatatcattaattattataacttctgttttcaagaatagtattttgttttgccaaggggagatagaaacttctcttagaggaaacgaatctgtttaagaaacattatgaacagcagagggcagccaacttactaaatgaataagacttgttagctatgtagcttcactttgactcccacattaagaaaatatgtaacaaatggatataccaagtcctgatttatagtaatgcatctctatgatagaatatggaaaaggaagcagaatatctaccatcttgcatcataccttagaatggcagttttccatgaattatgcttttgtttatttaaatagtcaatttatagttacaatgggcaactatctagaatgcatgccaatagaaattagcagagaaaacacccaaaacaatgatagctggtaattatcgataactttggaatgcaatgaaaggcacatgtttgagcagagttgtgttaaaggaagtgttagtggcagaactagaattttctctttgctgtggttgccgtattgaatcttttaagtcatgcaataattaaatgtcctatggtgacctggaggcactgctaaggaacacagaagcctcgcaacagtcagtgacacacatacagatggtcagtcaacagatggatatacacacaaatcactaatctcagtaatttaacactttccatgtggaacatggacattcctttgagtacagcactaatattaacactcagaaactcatttaggaggtatgattatggtttactctaattgctcataaaaggcaaaagagcaaagatactgatatgcatctttctagccttggtgtgatttttttgttgttgtttcttttcattaaaaaaaaaaaaaaacccaccagcaaacctccgtttaaaactaactttgttagtcatcagtgcaagaggacgtgttcaagaaaagctacaactataaatcacaagtgatccttacttaaaagctaccaagggtgaacaactttaaaaattttagtgttttctataatttaaaagcatttaattgcttttgtggttatcgagattccactaagtattctcagtgaggcatgtgctttctatacgttgttctaaacaaaaagaagtgccagggctattttgtttttcaaattacgctcattccattttaagttttaatgacattgactaccgtgttttatatttattgtggtttcacaataaatgctatatacattattagttgggataattcttaatggtcatcagatgaaactccttaaatttttatagttaagtattgactgacaatctttattgataaagaagcttaagttcattaagggtttaagttgcatttcaactctgctacagtgttttcaatgactattttcttctgcttttatcattatgttcaagtttagttattgtaggttagggtaacattttcatatattttttttttactttatcaagcatacagaggtcctaaacaaatgctttattaatttttttttttaaatttaacattactcacctacaaacatatccaatgcaatgggatataaaggttttagtaatataatcccagcagagtttttatgattgtctcatggaaaaattaaattgtggaaatacggttctgatttgtggttcgagtcagttcaaggcaaattcctggtgactgctaagtacttttccagatcaaacattaggcccaattaattaacatttctaaatttacagtcacatgagtatttatgagcttcaaaaaagtgcgctcacttttactttccctgttaaagaacataaacgcatatgccactgattcctaaggaagatctctttgccagggtcttgggaagatttttgttcaaacagtactacccccctgccttctctgtatcccagggaatcgtggaattatgagtcactactaatagcagtgtgtcaaacccctccaagaatgttttgagacccactgggccttttgcactagaaatatataggcttcatggataaacaacagaacaaggattcagtccctcaccaactttttccactgactgcaagggtgaaacctgtgttccttcattcacttagaaattccacgaatgcatattcactgaacacctgctacaggccaggcatcgtcccaggtgttgggatacaactggtggaccagtcacagccctcgccttcaagaagctcaagatctcatgaggaacacagtgtgccatgggcacacagcagggagagcctccaacctaatgcagaggagtcaggcacattccctgggggaggtgggactgtgctgggacctggaggatgggatagaattctccatgtgaaggaagaggtggtggggagagcttttcctggtggggaggtgcagcctttacagaggcccagcaatgcgggaattgaaagttctctgtgcagctggaacctagcgaggcagggagggtgggaggagagatgaggctggagaggtcagctggagcccagtcacaggtcttctataaattatgctcagggtttcagattttgctcgaaggacagtgaagagccagagaaaattttgagctggaggttttataaagattttctaaagattgccttcgctgtggtgtggagactagactggagaggtagggaaatgaatcaggtggctgtcactgtagcccaggcacggacaattgtgggccagaagagaggagcagcagtggcacttctcctggcaggcgacactgagtccactgcaggagaggggaaaacccaagatgaccctttggaaaagtgggcagatggagaggccatgtagagattcaaaagagcaacacagaattgcccaggtgttgtgtatatttttcaaaaattgaaaatgaaaagagcaaaggaatgcttccaaggcatcttggagtcaaaagacatgagaatgcatgaataagaccttgatacccctcagcgctggccatcgctgcgacgccactctcattcagcacgcctgctcttcaacctctagcctgtattttcaacacttcagaatcttatgtaaactatatcagtacgcggccagtctctacatcaccacggcccacttggctctttttgttttctaatttatagaggcaattgaaacgaagtcaggactaatttttttaaaaagatgatgagctggtcctacactggaaaggctggccaacatgtcccatatggccagctcaaaccattctgcttaaggctggtcctctccaaaattgtttaggagggttaacatttttggttctttctatttctccataagatagccattctcacttccttccaagtttctaagttccttctacttatcttctcctgtggctgcagagacctatccacactcgaatctctgtcacactcatggctccagagtttcctgtcttacaaccagtcacatctactggtcctgtgtggtaactacttagggcctaagtttctgataaagtaaatcaagtatactttattgtaaattagccaataaataaattaatttatactgcaaaatcatcaaataagggaatcaaataactgctacttcaatgtgtttcctgctcagccacacctggagtggctgtacagcagcgaccaagtgcaccaggcatcagtatgcctgggctcaactcctagttctggctcccaccatgtgtccctggggcaaggcgagctaatgtgtgtttcagtctcttcatctgtaacatggaaatgccatgtgtctgcttaatagggctgctggaaactttacatgagataaggcataaattactaattacagcgcctggcatatagtgagtgctcaataaagatttacaatgattgctattgctattattattgctattgtaaaacgaggagtctttaaagtcttttttaacccaaagacaagagtaatgtgacaatttcaataacaatgatagggtcaatgtataaaccctaaagggagcaaagggagggttttttaggtgtgcgtctgttttaaccatataagaggctgtttactttgcacaaactcagatctagtcttgcatagatattaaatgatagacttgaagttcctcaaggtagagagtgtgtcctgttccccgctgtgcacctcacataaagcctggcatgtagctggtgctcagtcagttttactgaatgactaaataatagaaacatcgtggtgggagagcgtctaaaaccaatcctgtttcctgacaccacggctaccaaagcattccaataccattaccatgttcgttatcctaagagtctcataaattactagaaagatcattaaaattttgttatttaatttaaatctgagatatattatttcactgttttcaattttctgcaatgatgacattgtgtttcactcaattctcattctggaaatttcagagtagcatgatactcaatcacagaaactagtaaatgggttacaagtttgcaatggtgcctgcaaatcagtgattttttttttctttcagtttttcttttgtagtcctgttactctaaaagatatgagttatttaaagaaagggtaagaaggcttagacaaatatcatgtatgaattatctgatgataaggttttgaacatgcttctccagaacacaaccgcaaacacagggtttcaaagactcaatcaaggacactcatgttgggtgtggcaaggctagagtttccaattaaaccacagggctggccttggattatatatgagtgtgatttcttggagactcttgaaggagctccacaaagaaaactctctttttcctgttcactgacacctaaaattcttttaaagcaaaaatgagagtaaattgcaattgattgcaaatgttttcctagaagtaggcttggaaggagatgcagaggaactgtggagtttcaaagaaaatcctgaggacactgatttctgaggggaagcaaaggacatgcaagggagtattggggaatcaaaaccaaagaaggccaagggaagacctatgtgtgaacctgcgcttcgaggaggcaagtggttcttcttaagtgtatagatatttttgtttgcatataattaaataattggaaaaaatcctgcaaagtgaaatataatcttgatccattagaatgacaatcaatcaggaagcttgaggcttggtaacctgaggagggatttaataagaagcaattaaaacaacttgttatgaaaagggcatttggaaaattctcccttcatccaaagaaatattaaaaagccaatatggaaaacaagggatggaactgcctgggtccatgtatattggggagattaattaatgatttttctcattagcaagctatgatagcaattaagtattgcacttatgaacttttttaaaagttaaactctgattaatgattaggcacagttagagttacatgcaaatgaatcttgcatataaatatatatatgtgtgtgcatacacatgtgtatatatgtgtatgtatatacacctgcatgtgtgtgtgtatatatatatatataaatacacacacatacacacacacatacacttgtatttggtcagtaaagacaatatattagaacatgtatctttcaattctgagatgagatgtacaaatcattatacaaaataaacatgatttctaagtgattacctttgtgacaaaaattgctaatgggtctgaaattcaggtttattggggagccctgggagcccagcgagctggcatattctgtttaatgacaagtgcttactggtctttcatgctgaagaattgatgacttgccaggttcatattcaaaaatactccttggctcagaccgaaattttcttgtgtccacttttctgtctggaggatcccagtcatgcctagaaataaacaataaatcacacattaaaataatcctttttgcttaaagcaattgtgtaaaaccagttatctgttttcaacattacttttagcatagttttaaaaaaaatctctcaggataaaaagttaacctgtgaaaaataccacattcccccgccactggctccaaaagtcacatgaggggtttgtagacgcgcagagagtgagtccctgggttcctaatggcagctgtgtatatttgtgcttaaaataggtggcagtatgctctgctgaactatgagcatttaacccaccactttgtgacctttgggatccttgatccaaagtgacaaggagtaatgcacacaccatgtttgatcttatttcttgaagtgggatcatcgcttgggaagagcacagaagtgtcatgtgggttggcgtgcaccagagcaggcagtgtggaacaggaggtcgtcttttggtgtgagccttgaaaaaccagagtcaaacatctcattcatgggaaccagcacttttcccccaaggaatatcttccaagaggctgtcagaagacttacgaaggaaagcttcaaaaaagggtttcacaaaattaagcttttctaggctactgagctaaagaagaaggcttctttttttttttttttttcgagacagagtcttcctctgttgcccaggctggagtgcagtggtgtgatcacagctcgctgccatctcactcaaactcctgggctcaagccatcctctctcctcagcctcccaggggccatgatttttaggaggaaggattttctgactgtagataggggtaattctgcttccatggaatggaatgaaattcttgctccatggcccgttggaaatagaaatactctaagagacagaattagggacaagccctagctttctactaaattcatgactgatatggagcaagaccccttaaactttctcagtcttcatttttttccatttgtgtaaaacacagacagcaataatgtgttgttcttccttgcagaggagttttgagcattacatgagataatacatatgaaagccatatggaattttttaggaggttatcatatgttttaatgagatatttaattttaacaaaacatatcagatgggtaatacctttaaatcaaaacgttaattttggttattttttgatgacaaagataacaatttgtgtctagaaaactgtttctcaattttaaggcctcacataattcatcctgaggagattggtattaaaatgagacccctttcacacacgatgtgtgtgttttggtgggatgctgtgccctatatgatcatcaattactctattataaaatttttatttgttttttttttttagtgaagatgggatttcgccatgttggccaggccagtcttgaacctctggcctcaggcaatccacacaccatggcttcccaaaatgctgggactggctgggtgcagtgactcacgcctgtaatcctagcactttgggaagccaaggtgggtggatcacgaggtcaggagttaagaccatcctggccaaggtggtgaaacaccatacaaaaattagccgggcgtggtggctggtgcctgtaatcccagctacttggtaattgcttgaacccgggagtcggaggttgcagtgagacaagatcacaccattgcactccagcctgggtaacagagtgagactccatttaaaaaaaaaaaaagtgctgggactacaggcatgagccaccacgcctggcctgatcatcaattactcttaatggtacaatagggtgttgaatacaatttttctggaatgggtatgataacacttaataaccagtattaataagaaataatttttatattcttatttattaattgctaggatagcataggccttgggtttaatcagagctgagcttggaccctggcttggacataacgagctgcatgagctgagtaagttcctaccattttctaaactgcagtttcttcctctttaaaatagaaagtatctcactgggttgttctcggaatcaaatgatatgacacagaaaaagcacttagcctagtgcttggcttgtaatgagcgctcaatgaaggttacctataagtagaagtattagtcataatcccagtaaaaataacacaataaaaaagtgtttataaatttttattttcatgtagatagtttgtataaaaatatttcagtggagaaaggaaaactcgtattagcttgaaaaactggtagaaacaagtcacagacacttattaactaatgcctcattatgatttttgaataactttccctgctttcaaaaatgtctcttattaatagacctggggaaacagaaaatgaactgcatagcctgtaacctggtatgccaaaggaagtacatgtccattatttctatttacttgtctcttatatgtatgtattgatcaaaaagcagaaaatgtgtccatattacttcaagtctaatttagggcactccagtatcatgaaagaagacagggaaaacatttgctacaatcccagcagaggaggtcaatatggtatatgtatagactagcaagattacacatccgctctctctgtggcaggtgcactgattcttctactgaatgccatgtagacttatttttatcctaagcgaaacataggccaccctggggggaaatgccttacttttctgttgaagaccgatctcttggtcgaagcggcgggactggaggtggaacatgtgggggaggcactggggaggacgcatccttaaaggcattggggctgttgtcggagtggcttttggaaagaggtctgtaggtttgggtctttgcagcagggtgtgactgagcactgtagggtgggttgtacagacctatcatgacaaaaaacaaaagcagacaaaaaacagaagcaaatcacctcttaaaaatgaattaaattatttgtccccctcaaaatagccaatgattgcatagaaattattatcaataagcatattcataatgcatacattagaaggtagtttcttaatttattaatattaatgtactaatttccattaatttattaattacaaatttattctgtacctaagccctgattacagtaaatctttgtcaattatttcagaactagtaataattcagactggtactaggaatagacttataagcactcagcaaattttctcttcaattgtatacactaagaaaatagttcagttttcagagcaagattaaaaacggaactgtttccaaatatcttctaatactttaaaaaccctgatttacatatgaaaattgacatgctaattgtagtcaaacaaaatattgcacacagttgtgtttataaagtgctgtgcaaggtacaaggaaacatgagtcctcaatatgcttagagtgcacctgggaaaatcagacacaaatagaattatgatggaaaataattggtaaaagataataaagaccaaatgaagaaaacacatagtaagaattaaaggatgctagtaggtggtagattgctcagagaaggtattatggaacccacgagtccagagtcagccctgaatgagtttcggtgagcagggcaagaggggagcagggatggtatagaaaaaaaggcagaaaagtgcaaggtgtgaagccatggcttgcacggttagtagagagcaaagagactagctgcagttgactcgtccactgatcaaatgatcagcttgtagggctgtacaaagtaatatatcactgctgttccattcactaatcactaatgtgacacaaacctcaatattaaaacagttataaaaattctaaattttcctgcacccaatcattggagctaattctatttgtacccgttcgcttctcctgaaagtccatgcacatttccacagcaaatgaaaagagacaacatctacacttacagttttgcttggattcaacagtcggacttcaacttttgagctaaataaaggaggtgagtttggtgggcgtgggagcagggatgaaattaagggaaacatctttgtgggcctgaagctatcagtggggcgagccaagacttaaacccagagggcttgctgagtttgttctactgattttccctctatcaatttgtctttggagataggagcacaatcccaaatagttaaagggcctgaatgtggtctccaggggtgcagaacaggaggatcatgcgaccccaggctgcccagaggaccccaagtgaggttgcagctgctgaaggggaggggagcagtgccagcctccgagcctggtctaaagaaagaagaaaaaaaatagttgtgcacctgtcctgagcctgtgactgggcagggagaggagccctgggcagaatcccgaggcaacactcaggagaaagtgatgaagggaaaaacatttgtcaggggtccctccttccagcctgcagacccctgcacgagataccaaggctcgccaatccaagtggcagtgcctggaactgaagccattctattgtgaccactggcaattctgagtcagaaaagtggccccgccaagggggatttttaaactctttcaatgaatggttgcattttggagcaaaaggcagggacaaggtcacagaatactttgtttgacttgtttttggtgaagtgtatctgaaagatcttacacaattgtaatcattctctctgctgataaaagatctttatcttattttgtaccctgggttacagtgtgtcctttcagcctatccttcacactttggttaaacattcctgaagctgagaataaaccaacagtgggaatgaatgagataaaccagtattagttctcatttccatgagaaaagtcaatccttttgttatgcacgctctgagaaaagaaaagaaatcctcctcctaatatatgaactgaaaacatgtgctcaaacagaaggggaaaaaaggtgaccgtgtcgttcttccaaacattgctgagcataaaatagtcattgcgagcaaggaaacccatcctacctgcattgtatgtataaggagtattatacatgtctgtgtcatcatctagaaaatgaaacataaatattatggtaatatagattgtcaccaaaggacaacgagacagcagaacttcagacaaacaacagaaatttgttagaaaagcaacgtatttttcctagttcataatgccattttctttctttttttctttttttttaagagacagggttttaccctgtcgtccagtctggagtgcagtggtgatcattgcttactgcagcctccaaacctccaacccctgggctcaaatcattctcccacattagccttctgagtagctgggattacaggtgtgtgccaccacaggcctctgcaaactgcccttttttatctgtaacatattcgtcttgctgccctcttcgtagcatgcaaagtcaggcccttgtcctcgcttccccagaaacctctctgctctggatcgcaaatttcctttactaagtgctttagtggtctcctgtctacagagcaggctcaggcagacccgcgcaggctcactctcctgatgagagcagacaggggtggacagaggaacaatgtgtttttcacccaggcaacacaccaatttagactgtggacaggggaggatggagggctgaggccagagtgcctggttgtcctccatggggaggcttcttggcagctcaggtgggaggcagaggcacagggatctgtcaccggaggggtgacagaaggagaacaggaggcatgctgaaaagaaaggggacacggagtttgctggggtcttgacattgtgtgtgaatcaaaccgatgcaaaagacgaatgtagtcccttcaacccacaaggacctcatcagaaagcagagcagcagacatacccggcttgtgcaccatgtgaatttgcttaaacatcgtcttgtaccagtccttgggccggtcgactgtctgtaatgaagagagcgtccaatggttacaaactggcttccaatcaacatcgcttctcagtgttttcatttctctattttatgttcttaataacagagtcccattctgtgataaaatgttctgactctttgctatggcttcatgacagtttcagcaatttacttagttatgtgtgcagtttgtaaacatatggccttgtgtttgaatttaggctgagttggaacattagatgctatggttttattttttcaagttatagctgtaccctgcactagagagttgatatttgcacaaatatataaagttcacttaatgtaagttattgttgtactaatttgtttaactccttttggtagataatgatcattatccttagatgctttttattgaatgttctgtaagacagtgttttcagaattaactggggaatatttttgactcaaattgtattctgatcagtgtggctctagagaaataaatttgctatttactagtctaagctactaaaatactgaatgtagtaggcatcccagagtcctacggaaaatttaagaatgtagatattgcttcaaaaatgctaatatgataacagagtgtatacaacatttgctcggctaaaattgtaggttccttgagagtagaagtccttacggatccaggcgtcggacatgaggggagcagtaggctgtagtggaaagatgaaattaatgtagagtcttgaactaagattcaaatcttggttccttaaattgctgcttaatacaccctagcaatacgaatctgggcaagtcatgtcaccttcttgagcctcagttttctcctctctaaagtgacataattatatctaaatcataggattgttatggaaatcgaatgagacaatgtatacacaagacctagaacaatgcctagaatataacaactactcaataaataataacactagggaactgcaaatatttgtagaatgaaataatgaatgaacgtagcctattggatagagctctgcctttctggatacctgtaaaagtagacacatgcttttataatcgtactcacagattttgcttggcaagatcttaccccaactctctgagagctacctgggcaacaggcttgatgattctgcttatagtaactaaacacaccagacgttccaagacagatctcgatttaaaaacttctgttaggactgatacgaaagcattcttatacttactagactgagctttgggttagattttattgcctgatctttttttccccagaaatgtggtcactgcatttttcctctggacattaagggttttgtgctatatctaaatttattttgacctctgagaatatattattctgaaaaatcaccccaaatacaggttaacatgaagggccacttgacttcgttatgagtcagctcttcattctcggctctttctccatggaagagttgaggttattgattgactattcagtcaaaggacgggacatggtggaagggattgcagtggtgaagcaaaggtctattatttgctggttcaaagttgctaaacatgtatctttcaagaaagtttatttttataaaggactgatttctctttcattaaacctcatttcttttactgtaccaaagcaacagaaaatacaacatagtgttgtgcaaaaatgttttcctggacgtgctgatggcaacaaggaagcctactaagtaagtcctatcactgtatatggcaatacatgttgacagacaggtttttttttcttcacttgctggagggcctatatcaggtaggatctcacagtgatgccatctgctagctttatatggtgagcacaaagatgccagaaaatgccctgctggcaaagggaaatatgaagctggaaaaataaaatacgaaaactctatgtccctttctaaaagaagtactctaagcatttaaagttccttttgtaaatgccatcatggagatcgctatgcctaaggctgagaataagaaaatagtctactcaaatttcaggaagtttacttttgtacgtaaaatcattttgcatgaaaaatagctactagcaattcactatgccgttttttctacaaccttgactaaatagacctgaatttttacattcctacagttttcaaaacatcagaactctacactgatttaacacgcagagatttcaaaaaagataaaaaaggacatattttctacatagcagtatacagtgactctgttctatttttttctccttttcagttttgaaaatactcaaacaagtgttatattggaagtagaagaaaagaatcttgtatttcacttaactagctggccttaatgacacaatctcatgggagctgagccctggcgatttttgttgttttgaagaacagcactgaaaggttcacatagatgtcccaggtcacatgagagagggcaatctggagagctgattccctgcattaaaatagctcaaaagtactgtttgttgactcttggctttctagagtttctggatgactttacaaaattctgtttcctcggcataggctggctgtctaaaacgatactgcagcatggtacattgtgacagtaccgcctttggcaaatacactgaatctgatcatcattactttctacacatgagaaagaaaaacaaccttggagagtcttggcctgctgtggctcagagacagcctgacttgacatttataaccacagctatacatggggatgtactctggagggctgtatagtcagtgtaagaggagagtcctcatagacctggaccttctttgtcaagttttaaaggtccaagtaagacaacaattgtgcataaaaattacagttccttataaggaacttctgcattggttatattgtgttttctattttatagaagggaaactggcattaaatgtttagtgtgtttgcttatgcatacccaaacgtgcttttgatttggcagttgataaacattttaaaaattttaagatgatttaattttcatcaaccatctctagcatctcagtttttccttttgaaactaaccaggcaaagtctggttagttaaggaaattatgtcttataaaggaagaaaacatggaccaggcttgcatgtccattatatatcatttattgacctaaaaacatacccagatatctttgataaaatcctctcagacagaatctataactacatagaatcagggctttcttaattttgtctatactatgcctcaagtgccagttacacaaaaccaatgacaccatttctgtctgactgtctatccctatataattagaagaaagtttcaaatttaaccattttgagtcagaaatcttagaagggaaatgaacaagaaaacatcatcaccagaaacatgtaatcatcataaaatgaagaatattggtcataatccctgaacttttctttggcacataaatatggcaatcgtcagtttcaagacagattgttagaatgtcatatcacattcaacgtttcctcaatctaaagagtctaaaaccccagtaactgctgtacagatttactttttggctttcaattgtaatatagatgctgagaataatccattttaaactcttctgtctgtatataaaacacataatccccatataagaatgtaaagtcaaggagagaagaaaatccccacactttatcgttagttctttttgactgtttccaatcttaccacggctttttttttttttttcctgctctctttcccattctttgcctctatcccttattgtcttggctgcccaggtctgcattccaggggagcagctcttggccacaccccagctttacatgggtcttgctgcaaagtatatgcagctgcagtccctccccgcatggcccccaacttcacctgcaaaggtgttgttgctttcatcctgtccccggcttccttctcccggctggcacaagccttctcttccagtggacttggtcagccagctgctgcctgcccaggctctcagaagctgcctctgctactgctgcgttttgccggaaggggctgcccagatacactgagcaatgctttggcagagttttaaaacttaaaaaaaaatccaaacactttcacttatcatcccaggagagctctcagcaggcacggctgaagagggacattaaaatgtgtatttttcttcagacagcttttcctttccatgacattaactctcttcactccaatcatctcacctcccaactcccaaatcacagcttccaatctcccggtgttaacacacatctatttcaaaaaacgaacacatcactgctttattcgcaatgcatgtgggaattcaatgcagccaaagaatttccattgtcttgttccttctcttttctctctattgccctaagcctccttggtaaaaggtaaaagaaaaacaaacaaacaaacaaactaaaccacacaacacagttttaccatttaacaaaatcgcaatgttcatgatgtttcattcaaatggaaaaacagattgtgtaattctctcccatcaacagctttctttctctgccacacacagcataacattcatgagaagtcggatggcacggagggcaatcctccttatataagaccctaggaatgcacaaagccgtggacaatccgtcctttgtggagtctgtgcacagccccagacagacgcacacgctggcatttcctaccgttctaattgctgtggggattccggattcatccacgggcccgatccctgggtaatgcggggctttgatgactgtcactctcttctcttcctctgaggatcggtacagggggatagagctgctggtggtgccatccagagactgcgcatgctggggatatgtgtctgtggaatctgcacagaaaatttggtaacatggaacgtattcgttgcacagggaatcataaattcatgtgtcttgttgtatatttatgccaactgtaacacagagaccatattgccatcactgtcccttttaactcatttactttccatctgagctggtggaaactgtgtaggtgtgcggggaacagacctataccaacaagggcctcaccattttatgaagaaggctgagggaagaatggcatttgttaaatgactgtgtggaggcctctgagttaggaagtgctctaaatgcattatctcttcttatccttccagtaatctttgagggagggcaggatagggggagcaagaaccagtgttatagataaggggcaggagctgagacaagttcagtaatttccctcaggtcatcatttacatcaatattattcttgtgatactgctactactattatttataggttttgaaatgtatttccagacaaagacatgactgttgagtcagtaacagtgatttcataaaaatgaagcaaaaccaaaaatcacttaaaaaaatcttcacatccaagcctttggacatgaaagcttctgaataaataaatgctgtaaaattattagtacgatttcctatgtgcatttttaccttaaaatatcaaaaactatgactttttactctttgatgacaaaaactgccctaaggatataatttagatgaggcttatcgagttcttcatgttttttagtaacttctagaatactttcagaagcaacagagtacagacatgcagtatatagtccatttacttctaatacacaggaattttaaaaaaatcatcattattaccgttcctctggtatgattaataatatgcctttatatttttctgcaattaatttgaaaatgttggtgacaaagaatgacactttgtatatactctttatatcatggtttgtcaggactgccactcagaaagtcctttaaggtggaaatgaaaaaaattctcatgtttcagggtgggactcattgatatcattatgtgtatatgatatatatcatgtataaatgtatttttcatgaaaaatttgtataaaataagtaagctttttttttttttttttgagatggagtctcgctctgtcacccagctggagtgcagtggtgtggtctcaacctcagcctcctgggttcaagcgattctcctgcctcagcctccagagtagctgggactacaggtgcgtgccaccatgcctgtacaaaaaatttttgtacaaaatacaaacaattttttgtatttttagtagagacggggtttcaccatgctagctaggatggtcctgatctcctgacctcatgatccgcccgcctcggcctcccaaagtgctgggattacaggcgtgagccaccgtggccggccataaggaagctttttaagaaattttaactcatcaatataagggtaattaaaattcagatctctctgaggtaaaatccattgtaacatttgtaactgctattactatgattatgactattttcaatttagtttgcatcagaaagtcatttttaatacattttttgatgaagaatggataaggctagttataaaactgctttatgtgcagtttatgtgctggatggtgacataaaatgtccctgaataaacgaacagcatcatagcctttcaacactgaatcagtgctggggaaggaggtgtgctggctgctgtcaaagaagacatggtggttgaagtcccgggttgtagtttctttccccctgctactggccccttgaatgtgaaaataacattcaagctagtccttatttttacttctttattttttttgagacggagtcttgctcagtcacccaggctggagtgcagtggcgcgatctcggctcactgcaagctccacctcctgggttcacgccgttctcctgcctcagcctcccgagtagctgggactacaggtgcccgccatcacgcccagctaatttttttttttgtatttttagtagagacggggtttcaccatgttggccagactggcctcgatctcctgacctcgtgatccacccgcctcggccttccaaagtgctgggattacaggcgtgagccaccgcgcccggctaagctagtccttattaagacacggtgagatatttgacactaattgactttctatttaattccaaaaaggacttgagtgggcctccatgatactagtatttttattagcgacgaatgttttttgaacaccagcatgtgcaaagtcctactctaagcaaggagaatcaactctgccttcacatctgatccattacattctatgaacccataccttatgcaatataagttaaccctttattttattattctcatatatggtccactagctgtcatcttagcaatcttttgtcctaaactaagtgtaaaattcatctagggcaaggtagatgtacatattcctccgaaaccttatcacagcactggccagctggaatttgttcagtgtttacattgggaatttcttcccatgcagaatattttatatgtaaaatctacttatcaatatattctaaaatcaaagcctatctacattcaagtatttttgttgttgttgttgggtggggatagggacaaaactgcattcactaagacaggcaatgagacagagtcaggctttgttaataattatttgggaaaaagctgtggctagaataatttgtcgagttttactttatatgtgtgtaaatgcatagttccattttaaacaatctagatataatggacttccattataacaccacactatgggctgattgttaaagggcaaaatttcggcataaaccagttttactttcttaactctaaaaggacatcattgtaggattcacagatgatcctcaggcatagcatcagcgaaggcacagatatatttagactttaataagtcccgcggctacctttaaagttttatagttatagagctttggttgacctcagaagctgagttccaccatgcacatgctggatggtgacataaaacatccctgaataaacgaacagcatcatagcctctcaatactgaatcagtgctggggaaggaggtgcactgtctgtgtcaaagaagacatggtggttcaagtcctgggttttagtttctttccccctgttgctggcccctgtggccagaggaccaggcctctccttttctgggaggtgcaggatggtgctgctgtcctgagaattcccctctgctccctgctgtcctagaagcttcctagtgagtcgacatcatggaaacttgtacagcctgaattcctatgatagttcaatttcgtattttttttgatattttaggtttttaagttacatttttacaaactaagaaatatttatgggccgggcacggtggctcatgcctgtaatcccagcacttagggaggtcgaggcaggtggatcacctgaggtcaggagttcgagaccaacctggccaacatggtgaaaccccctgtctgtactaaaaatacaaaattagctgggtgcggtggcgggcacctgtaatcccagctactcaggaggctgaggcaggagcatcactggaacccaggaggcagaggttgcagtgagccgagatcgccccattgcactccagcctgggcgacagagtgagactccatcttgaaaaaaaaaaaaaaagtatttatcacattattttctgaactatctgaacatacttgaccatgtaagagcatttctatcactgtacagcaaagcttctttcacaggaggccacaaaaagtccatgagccccaggaaattatctgcttacaattttttatgaacgtccgtatgtccatttgttttctggaggagagctctatctttcactgaattcctagtcctcagagggttgagaacgattgctctatacaatgacagaaccttcatttaagggaacacttaagtttctcttgtgtggcttcctgctaccatatccctgactgcaggtcttccagccttggtttgaatggtggttttctccttgtgtgagccagtagatgactgcgtccctgctatgtgggacagcctgtcctcctgttacactgttttaactgtcaaacgattctcccttatatagaccccaggaaatagtccatggtggaagctcttccaagtccgaacaagctgccctagtggaaaacctgcattcatgtcctccagtggcacaaacccccttgccctaagtagccattttctttttctttctactccaccacctcagacatctaagtgcccacaccaggctcagacacaggtggagacatggtcttggaatagcatggtgcccatttcctcccatgttgggtcctctgccccagtttctccctggggatagggtcatgagtgctgagcgctcccgcctcaccttgatgccgcatatctttctcctgtggttgtacttgccgcattgaggttgccatggaaatcacggtgagtaaattacttaccgagggatgtgccgtgctgcatgacaatgctggagttgagtgaggctgggagagaatatgccgagggggaaaacggcctctgatagtaactcatgggactcacggcacctcctgagtttccattcactgttatctggctctgagaaaagcgcaaaggcatcgagttaaattagcacatagttccctgtaaacatcattccattaggtgataataaaagacttccaatcacatgagagtaatcagctgccaagctcttatttattttgaaaactgatgtcagagggcatgctacattctttgccttctctctattcccttatttctgaaaatcactctcttgtgtatctgagggtccagggagtggttaggaagaatgaaagtggctgactagtgggcatgccactctgccaacagaggtgccaaatggtatcagtaggagtcagtaccaagtaaatgtggaggacgactttgctctgacagtcgtaacatcagcaatcagaacacggtggtgctgttccgcatgcagcattgacgtggatgtcctttgacatgaggcaagggattggttctcagacttagtcagggatatcttctagtgaatgaatgtttccagagctggtgaataacataaggaacctagttgtttggatgtatatatcatgaagcaacctattctagaaggatcaaatacctggtaaaggatcagagagacatgttcaaccactggcttctccctacttcagcctcattgagcacttcatgaatctctgtttgatttcttaattattcattgtttcgattgttccgtatctgactattttatatccccaatggtatctcaagcttcttgttgaagatggtcatatatatgcttctttaatattttgtataacatgcagcctagtgctgatgacagagtagatgttcaataggtatctattctgatggaactgaatcggcttagttcacagatatcgagctcaggactattaagcatgcctgtctacccacagcacagtactgatcattacagggcgcacacaatgcatgcaaataagatcaaacattagtaagaacgtttagttaaaattatagctaaatacacacaacacacataggcacacagataaagaagcataatttgtgaaacttttctacttattttaaaacaaaacaaacttctattccacaggcttgaaacatagatatagtaactgtgtatttctatgatttcactttaaagcaaatgggttttcaaatgacctagaataagtctaatttcattactgtataaccataccacttatgtccccaaatcaataaacatttcattacaagccttgtgcttattgattaaataattctctaagctgttagaaaaattacactcatatcataaccagccacatcttgaggacctgctccctggagagagctggacgttcaaataactgtgaggcacaggcctgcccaaatcttcagagcttttatgtacctctgatggatgatttgagaacactttcacctccttgcccaagttaagtttggtggatctttgtcaatatcattgtaatactattataacatgttataattaatgttaaaagctgaagaatccttcttattaaaaaccatcaggttaactatattgctaaacctacaaacttgctctgaatcctattttgatggtttcaataatattgactaggggttaaaaaagtaaacactgagagtagatttattcttttttttttttttttttttttttgagatggagtctcgctctgtcgcccaggctggagtgcagtggcgcagtctcggctcactgcaagctccgcctcccgggttcatgtcattctcctgcctcagcctcccgagtagttgggactacaggcgcccaccaccacgcccggctaattttttgtatttttagtagagacggggtttcaccatgttagccaggatggtctcgatctcctgacctcgtgatccacccacctcggcctcccaaagtgctgggattacaggcgtgagccaccgcgcccggcctagatttattcttttattgtgttcaaccaatcaggattttatgactaaaatactatcattagcattttagaaaatactgtattgttatagtgaattcattattaggaaaaacatgtcatgaataatctatttgcaattttaaactgataattgcaattaatttcccttacaagtagctctgctcgtgcccacaagactgtatataagacagttagtctcctgtaaagtcttaaaaacagaaaattgaacaggttagttggtagattgataccctctcactgccttctttttttggttaaaggtcctggtaaagttttaaaagctaagaaccattgaagcacagtagggcatgggaggaacccacacctgctgtgctcctggtgcccgtagttgggctggtcctctgtggcagggagggactcgctatggggttaggcctggaaaatgaggctccttctgtagccagtctctgaatggagcatttgaatgcaaagtgttagacacagccattgggggaataccaaatcccattaccaaaaaaagcatcttttactttatgtaaattgtagtgtcttaaaaaacatatggcttattataacatttctctgcgcataaaatttgcagacttatcagcttgatagaacataaaacaatgtagcacaaataaaattttgtctatgacagtgcttattcggaacttcattataatatcaatttaaaaaaaaaatctgatttttttgcctgaagctatgtgtctcttaaatggaagccattacttagacattatatgcaatatagaatctgtgccataaaattttgaaacattttagccattcacagatcatttattagggattgcttatcacatagatatatttaaataatatatgtatggaaaagatgtatatattgctataaatgaaagacaaattattgataaacaaaataaaaaatgtattcataaatttctgtcctgaaatggctcaggaagaataatttttaaaaatcgtacagctaaatttctgaaaggtagataggattatcgacatcattcactcctggacaatagatgagttcaaaagttgtagctgttagagaaggaggaacaagaaaaattagcctcatgcagtcagtaatcatttatgtgagaaaaaggatatagaaaagagtcacacaggacacattaatgtgagtctgtgagaaaaactgctaacatgtattaatactgggttaaaattttttgaaaaattttagactttatgatcacaacatattgtgatgtatacttagctaataaggcaaatcactgtagaacttaccagctacagtaacacgggaaaccgtaagtaactattttagagtaactataagtaattctaaaatgaatgaagagaatgaagtgactttttcagccttaagcaagcttataggatgactaatgatttccctgacagatggcatagaattggtttgggaatcaacacctatgtaaataaaaatgtcagccgaaaaatgagatggcacaacaaatcagtcctttcaaggaaacggtggaggcaaagaaaggcagaataattacatgagtggccgcaggggtggttaaggtggtgccatctgtcacagcagacctctgaccccaggtgggggagggtgtctcagaacggccagtggtgtcagagtcaccaatctgcagctcctccagcatggctgtggaggactcactctccgagcgggaggagtgctcggccagggaggagtctgttgtcagagagcctgtgtcgtggctgtggatgaggctttctggagctgggagcaggtgtttgtataagcaatgggaaaggctctggggattatgcaggcgtgaagaccccacaccatcggggggcggaaggctgagtgatgctgagctggtgccactgcctggtgagaaagtggctcggttcaaaggtaccacggaaggagggcacggaggagaagcttctggtgtggtttgtctgtgtgtctgtgaagcatttacctccaacacactggcaggtaagttctgatttccaagctgagtatgaggaaaaaataataagagataaattatccaattaacaaaagtacctctttttgcgatgtggcagagaaggcaaagcatcggttttatttgcaagcactttaaggagttacattcagatgggttaggtgccaaccacacagtgcagaaaaagtgtgaaaacaggaagaaagtgaatccagtcggtgtgttttgaaacaaggccggttttcacacagcactgcaatgtaattctggttaggggcttgagagtgttggcataacgaaactgtttcctcaggagttttagtttttgtatttgtgacaatgataagatatcagactatcggtcagcagaattggtttgtccttcactagaaaaatctaatagcataattgcctcccccttgccaaaatgtccccaaaacataaatctgtttgtcttattttttcctggtttatgaatctaaacactgataatactaaacacaactaagcagaaaagataaatggaaaagatgttttatttcctttccactaattaaatctgttctttgatttcactacaaaatacgaaaagaattggactttaaaatatcctagcaatgcaaatagaggtaccatgtgtgaaaatgaaaaccagccactgataatagttagaatgtaccctagttagttagaactatggttggcactaaatcttaggtaaaggagaaagaaactgaaggaaaaataaaagatttaacagctccaaggctatatatagcccaagaggctaaacatagcgaagggatgctctgtaggaggaagagagaagatgaccatttgaaattttacaaccacctgtggtagcctggatgacgtttgaccacacgtgacaaataggatgataagtactcaattcaacgtaagtgaataaaactccgaagcaacttttcttacttattttttctacctttcagaacagacactttttggaggggatgtttgggagaggaaatggttttaagatagatggccagaggtattgtgagatattagtacaaagatgggaatgaatgaaggagaactgtttacacttagaaatactgcctagtaaatgtttaagttaaacaatttggtgttctttggcagccataattttcataatgactgatgtcatgcacgttgttagcataataaaaaggttgcaataatttttttctcagacttttacttgaatacttttaaaaaatccatcatataaaaaggtctctctgaatcatagatcccttagaaatctgataaatgtgactgatccttcttttggggaaatgcacaaattcatacatacagaaagttctgcataaacttcagggggacagagacactctaaagcataaccttaatctaatgggttaagaaaccccaaccttggataaaaagacagattttcttgtcctaatcttacttaatatgattttttttcttgtttaaacatagtcattttaaatgtgatatatatatatatatatacgtatatatataatatatattttactgttcatggttgtttaaatctctagaaataactgacagaaatcttagttacccagaacttaaaatgttttggtggggatgcatccttattattactgagtgtttacaataattgcaatcttattggaggtgaaactttaatattatgaaattatcataattctaacttaatgtattaaaatgttgctataagtctgaatgtaattcagtataaagcagtctttggatagcgtcaatgaaatttcccctaataattcagctttactaaggatgtttccatgtaatacgaatctctttttagttttatttatgctaaatgaaaactatgaaataatacaaatcatacaaaaggatttgagttatctgctcatgagacttttccctttcaaattaaaagaaaaaaatctaatgactttaacccccattggactgacttgtccatatcctatgacttgaaacatgtcaaaagctaaagcgtattctaaaatcaccattgtcacgggtaatatgatcattagtttgcatagcactgtgtctggggatggtccttacccattcaattgttcttccaaatagaatgtccacagaaaacaaaattattccacctttcgaatttctttcaccacctcctgacatgctcctggttttgagtcttttaatgcacgtgtgtgtatgggtgtgtatgtgcgtgtgtgtgtttgtgagtgtaaggcatgaaatgcctcgtggtgagtcacatcacacttaaatttctacagataaaactcaataattcaacagttatactggtcacccacaaaaaagctttgacaagaccccaatcttcacatgaatggaatataccctgtagacccaaggggaaagaaagaccatgttacacgtgtttctcctgaggaaaatcagaagagcagcaggaaaggtatgaaaggggaagaaggcagtattttcccaatctggactacctcaaaaatagggaaaactggctttaaacaagtgtatttttttcttacttcatgagtggcaagtagatgactgcaggtaatcatcctaattgttttaggtctccttcttttcaagaccatggaaggctaaggtgtttgaatagggatcaagggtcaccaactttttgtgagtataaattgttttttctttccccaacccttgagctagcaggaagagggtaatgagaaacaccagctagcagccaggggctgcctggtcttctgcaaaggacagggacggtgcttaaaccttaatatgcttcatataccaagagagagcacctgcttactcaaactagcactgagcttcttcgtccaaatgactccaacccagaatgctaaagagagcctgtggatgagagtgctcaccaatcaacactggagctcctgaggaatgaaggggcacagagattcaagggagggtgagcttcagcagtggaaaaagtgtattgagttggatgaaggcattgcaaactcaagtgcccatcatgggtcaggaaagtatccaggatgtgcaaatcaagcccgtgttggatgacagggaatgatgggaccgatggcagaatgcggaagtcatgttccccctcaaggcgggcgtcattgacccatatcctttgccttgaaacacgatgaaaattaaagcttactgtctctaagaccaccatagtcatgggtaatatgacctttagttcgctcataagctcagtgacaacacatctatagtcataagcccctaagctgtcacttgctgacacagcagatgtggaagctggaggtggaagagggtagctgtggagcggggatgtgaagaaggagtgcatggccaggcctcaggagaggaggggaaagtgctcgttggggtgcaaaacttaaagagtgacaaaaaactcagtaattgagataaattctgtttcaatgcaatctttgaaagaaaatcaacatcaatgcaaaaaagcaaaaataccccatactgaacaaaaatgtcgaaaatataaatgaagaccagcgcatgccaagccataggaaaagagagtctgggtctggcgtttttaatgcaagaaaactcatcaataatattttcaaaatctacatttttgcttatttcagttttagttgagagaatagacatgtttgacaatttccaattaactgatggccatcttaaataatttgtaattaatttaaggtgaagtaaacatgtaatagggcaagcgcagtggctcacacctgtaatcccagcactttgggaggctgaggcgggcagatcacctgaggtcaggagttctagaccagcctggacaacatggtgaaaccccgtctctactaaaaatacaaaaattagccaggcgtgatggcaggtgcctgtaatcccagctactctggaggctgaggcaggagaattgcttgaacctgggaggtggaggttgcagtgggccgagatcacaccactgcactccagcctgggtgacagagcaagactctgtctcaaatttaaaaaaaaaaggtttattttgctttaaataaaatatttaagcttaaaataatgtgtgagtgttaataacgtgcgtttcaacttttcaaaaaaattctaatgacttaaacattctaggaaaaagctcattcccaatatatgaaaacaggtataaggaagcacagaatttccttccacctcaggttccagttggcttgacatggccctgaggtcaaggatcctaacatctctctcttaacacctttagtcattgagcttctaggcctcatttctcaaggaacataaggaatatatattaaatgtcaagcaaagaaatctgacaggcttttgttctcttttttccaatgatagtaatttacttgaaaagaaaatatctaggaaggggtttttttttttttggagtcttgctctcgacctccaaaagtgctgggattacaggcatgagccactgtgcccggctggaaggggttttaaaaaaaccaatctttacctcccatccacacatcctttagggaaaatgtgccccctcttttcatggcctgtcctggtggtatgaggagacctgcctggcagctgtgtctgttgccggatcatcattttgctggccacagctgattaggaagggggagtaactggactatgctgggccagtggggccctgcctccctcctgggaatttgaattacgtgacactgaatgcccctcaggtagctgtcgggtacccaaatgcaaggagtcagagagtatcatggaaacccatgggcaacttgaagtaacgacagagcagaaactaagagacagacagggaactatgcagttcctacgactgagaaggatggagggtagctgcctggccattgccccgtttccctaaggcctggctgtattgcctgcattgtaatgatgtgagattgtctgacagcctcataataaaaattattttaaccatatactccccacccaagagctgggtgacaagtgatctaaaattgtcacacagattgggcacactgacagcatgtggcatctgaatcaggggagtaaatatttctactgtactctgtggtattcagatcgggaatatggttttgcatctgggaaagtgtcatattttaagaacattatcaaaatatgggatttaaaaatcagcttgtgtgagagcatagaggtagcagaggctagtggctgagctgtggatcttgagtcagacagacttgggcaacttgtttaatttccttggcctcagttccttcatgtgtaaaatataggcatggataaaacccatctcttaaagcctgtaaaaattaagtagggcaatgtaaagtgcttagcacagtgcctggtgtgctgtaatagctctcaaaaaaaggagaatcatgttttacaaaattaaaatgctgggaaggaacaggaatgctctgcacaaagccagtagcagggtagggaagagaaggatcacgtgaacactgtcagatagaggcggaagaacattctgtctcttttgctctgtggataaccatgcagaagttaaggaaggcagatcatgacgtggtattagaaattctttccaataattcgatctcagaaatggccaagcactggactgctgccttggaatgtaactgagctcttcattaagtgtattcagaaaaggctggatgcccatctattgggagatgttgaagaggacgttttatttgtaaactcatgttggactcccaagtattctctaatgttcaattatttaaatacatgcatatgcatgcgcatgcacagacatcaaatggagaaattgccaaagacctgatcaactaatagcattacgagcccacagaaaggaagccatactaatggaagacatcaatgattggggccggtcttgatagcaatgttccagaaagtgcgttctgcagttctgcacctattatcccacactgctgacatgtctgcattactctgtcctccttagtatctacatactgatcccatggagcaaaagaaatgagtttcctctcccttctacatgacagtcgggcaagttcccctgtgagtccccagcatatgtgcagtggcagctgtgaaggtgaggctttggcaaatgattgattatgttatttcataacggacaggacaagcttatcttcctgaagcaaggaacatagcacagatgccatagaaactgtttgggggtgtagctttttgctggctttccaaagtgtctggcttataccttcacttacttgacattgagaacaatgtgacatttttagcaacaggatatctgatcacacagtgccataaggataacatgcctcatttctggtctgtttgtaggaggtcaattaaagcacatgccgtttagaaaacactatgaaaaattgtcaaatatgaagagaatttctaacagtgacctgtagttttcttcttaaattaatgagcagacattaataataacaaaactatgtaaataaaacttctgaaacactgaaatgtacttttcacatcttggtgtacttttatcgcttggacctgctaattcctgggagcctaattctttataatggagcacatatttggctgactcacagggtatagcttacagtgcttggcattggctgagacttgccagaatgcggagtgcaagtgtttaaaatggaaaggtcaccattgtgaaaggtcattacatggaaaatgagacttaaaaatgaagcatatcacaatcatcaagatgtagaaacaaaccaaatgtccattgatggacaaatagataaagacaacgtggtgtatacgcatactaggatactattcagccttaaaaaagatggatgtcctgccacatgctgtaacatggagcaatctggaggaccttataccaagtgaaggcctgtctcagaaggacaaatatctgagcagagagtagactggtggttgccaggcgcttggggaagggggatatgagttgctattcggtgggcataaagttttagttatgcaagatgaataaatcctagagatctgctgcactgcatggtgcctacagttaacaatactgcattgcacacttacaaatttgttaagaaggcagatctcatgttaaatgttcttaccaaaattttaaacagagaataaaaactgcaacagcttcatgctaccttttttaaaaagccttagaaaagaggacacgctatcttggaacaaactgaaagtctgttgaaataaacttttacctaccagtaaaaaaaatgaagtattgttgaaaataatatatttctttttcccaatcagatgcataatttggaaaaatattatttaatgatgatgacagctactgtatgttgaagaattaccatgaagcaggcaccatgccaagatccttatatgccttactcaaacctcccagcagttctatgaatggttgctatcattgtccctgttttatagatgagaaaactgctgctcggggagggtgaataactagatgaatggttttatgttaataagatcttgaaacagctgactgcccaaccactttcttcccagtctctctcatacccactccaagaaagcctccttccccactatggaatcaatggtaagttttcagatttcatttcaaacctgtctcatcaacagcatttgtgcggtgaaccatccctttctttccacacattttcctcacatggcttttaggatgccacattttcccagatttcctcctcccttagaggacactgctttcagtctcctccactgcttcttcctcttaatgttgagattcactcaggctcaactcttggtcctccccttttctctgtccttcccctgctgatctcactctgtctcatggccacaaaacccatcgactagccaatggctgatacctccaaccaggacctttcccctgaagtacaggctcttacatccaaatgctcacttgaccacttaatgtgggtgtctaagaaatgcctcaaacttcctgtttcccaaatggaacctctgaagtttccaccaacctgttccacccacagctgtccagtctcagctgatggcgatgctatcttccagttggagtcaaccttgacttttctcttcctcacatcccacatgcaatctgccaggaagtcctgtttgcttgactttcaaaatacattctcacagtctgatttctcaccacctcctctgctgccccctgctttgagccccatcatttcttacctaaaggactgcagtagttacctaactggtttgcctgatctcctccttgccccactatggtacgtttttcactgagctgccagaatgattttgttaaaatataagggaaataataatggtggtagcctcaacatcctccagtgacctccatttttattgagagtaaatgtcaaaatccttgcaatggcttataaggcctcctgtcatctggtctttgttacctctgacttcacttcctatcactctcacctcacttacttcctctccctccctcaggcttccttctggtcctcccacagccccagcatgatcaacctcaaagcctttacataagacattccctctgcctagaatattcttcctccttcaaagctgttctcttttcagtgaggtctattgatattgagttaccatacttgacatgatatctggtctccacatctctactttgcatggcataactcaatttccataatcttctaatatatgtaatttactccagttcttattaatgcttgctcctcctgccacacacagacaaattttaagcaggaatggtttcaaatccaactctgttactagaacagacttgacataggttaggcacccaataaatatttcttgaataaatagcagtgacaggatctcaaatcttaacttttagatggtgccgataccctggggataatataatcaaactaaccgtctctgcgcagcctggataaaaccatgcaaaacgaaaggtatcagcttgttttcaaacatcacaaaaccattctgaagaagcaaaccaggttggatgagtccaatgactgatatgtgttcctatgacttctcctacacctgcttcctggcgtgcccatcctgggacactggcgagtctgctcactgacactggcacgggcctgtctgtacagtcacagacggattttgctccctccgaccttcctggactcctgaacccgatcaagatgcatctgcctcagctcccaccatcatggcaccgtgtctcgtcactgctgagtaacgacttcacaacgagaagtagcactctttcagagtggtggccctgcagccagcctgccagggtgtgtattctgtttctgccttttgccagctgcatgaccctgggggagcaacttacttctgtgcctcagtttccttagccataaaataaggacagtagtaatacctactccatgagattgtggcaattattaataaacataaacaagctgcaacagtgcctgcatagagtaaggccttaatatttgttagctcctattaatgttattattattattatcatctgatttcataggtgctttcagaagatattaccttaattagaagaaattgctctactgaacgaattttgcacatcttgattggctgatggagaagatattttagtagaggtatgataataccagcttgtcctttaatcatttctgtttaaggctcgtctgctttatgagtgggtggggggatcttggtgtcaattagttatcttttggagattttctgtacagtttaaaagtatatctcctcgaggatatgttttggatgatctttattaacacagatacaaaaaggagtattatacaaattatttacttaggcaccactgttttcaatattaacactagcgctgttgctgctactattatatcttttattaacagctgtcattgagtgcttgctctagcctagtctatggtaattccctagtcttaccataacctataaattaagggttaattagtattctcatttctttgttcggactcacagaaaagtttagatgaatgtctcatcacatagtaaatgatgcctggattaaaatctacagcttatccttaaagtttgtgcttttagcactacattgttctatggagaagtcaaaaagagaagcacatttctcctgttaacagactaatacatgtaaacagaaggatgctatgagagaattctacacacatggaaagttttacttcctgaaagtctggataataaaagttggctaatacactttctgaaatgataaattaagttttagtgaaaatgaatattgagttgcaaagaaatagacattgcttaaaattaagataactattccctgccaaagcaaattataattgacaattatctgaagaggttttacacatgtaaataaagtaaatctaagtgcaaaaagatctaatatgaaaaatatttctttgaaacctaaacatgctttaagtcctgaagtagtctgcaatgtcttaaatgataactgacccctcaatgatttcccataaacatctagaagaaaaaaaaaaatttagaacatgatttctggatgaaagatctgtatatgcatatttacatttaaaaatacctagacatttgctgatgaatttagtagggttttaaattggaaaatggtttctttctcctttcccttcctgcttggaaactaagaaagcattaggtcatataagaagcccaaaccaaaggagttagggtctctacgatacgcatgtattaatacgaagagactgagaagcttaaggtaccactctgcagtctgaggactgagaggccgctgcaactgcagatttttgtctctcttgctgaagaggtatctttgcagtctctggagaaagctcaggtagctgtttgtggctttcaagatcctgtcctgaaaggggagctatctgaatggaaagagatgctgtgtgtgtctcaggcactggattaggggtcagtgagcggggccttttgagaaatgacggtacttcgacagatttggagaactgtggagtactaatggggctgctacttcctagatcctggttatgggttagtttcaaggtagaaatcctccgagtttgagaatcttgcctgtagtcctcttgtagaactggggtgttgatgttagcgaatggtgcaggatccgtgctggaagctgctggtagtggattagtgattttttgtgtatatgacatggttgtgttagattcttcagaatatacaattgtctgtctcgaatcttcattggaatacatagttccctgaagaggttttttgttagcaaagtactctgtactggagggaatttgtgtgttagttactaactggtctaaaatgacaccctttgtgtgactggttatcaaagagctatgaaagctctcttttctttctggtggagggggtgcctggattgacaatgggatccagagaaagaaataaagttgaaagaaaaacagagaaagtccaagttagtcatgaaagaaaccagtgtcaaccttgcctttacagaagtaaagcaatgccacaccttctgattatgctatccattttgttagctagattgagtgatcattttcattccatttagaatgcacttatgtttattatcaatgtttgcccttggggaaaaaagtgttgccagagaatacattataacatttgctccatctacattcagggaaattatgttaaaagtgaacatatgttctcttggcatattttattagactttgacatatatatatatagtttatttaatagcattgttttataacaattttcatgcttgtggcacaattttactaatatctccaacacagagcccttttagttaatataatagttgcatactcatagttattgaatacataatgtattgctgacctcatcagtttaaatccaaagcatcagctgtcagcttttaaagaattagaatatatcctagagattatgttaaaaaccgacatactttgataagcttaatcagaaacaaaaccaaaccaaacccttgtttgttaaaatttgttctccatgttgtaaatacaaacctggcaagcaaactaaatacaaaagcaaaaacatattaaaaataaaacgtattgaaatacgcacattaggaaagaggctgtaagcagtggtctaataatcatgccttaaaataatgcagtagccaagagtgtgcagggttacctgagttggtgatcttttatcttgtaggtttggtcgaacgcttctaaaaccttttgctgcaagagaggaatatgtagcatctccgttcagtgtctcctgattgccatcattgtaagatctccaagctttcattaagggaaaacaattggatacaaaaatatctacgttcacttaaacattttttataaaatttatttttatttccaaaatcatttttatttccaaaattgtagtgttcttactagaggtttaatttaatatgcataacagtacatgaaatttaaatttaacatgaagtcagcgatgtggctatgaatatgttttctaaaagtcacaaataatataataattattcagaatattttttctgtacctgagtctggtgactgagaatcacgccctgaaagaaaaaaaaatgttgaaattaagactaaggtgaaataaatgaacaacccagtaaaaataacatggcaaagaactatatgcattgtttttgcaaacattatttcagttttaaaatctgggtatgtcaaacatgccaaagggaggcttgtacatttatttttacttcaattagaatgtcattcattaaatatctataatatataaatatctatatagtaaacactcatttttcccctcaataatgttgcaacatgcaattttaatcttattatggcaaagatgaatatatgaatttctaaatatcaaattaaaggatcaaaagagatctggtttataaacagcactaactcaaactgccagatccttagcttccaatgccctgctgttgataagcatatttaactcctgtgttacagaactgtattctgtagttcgcatttttttttaccttaagaaactgtagacctgtctaccatatcatgtgacattttcaaattattctcgagactgagtttttttcctattgcaatataaaagtcattttatactcaaatatgaaaaaactgttacaacatgttccactgtctttcagctagtaagctgtggaaaataaatttcaggactaataaattgcttttggtaaggcagttggcaagttatcagtgatatatttgttatcaattttattgaagttatatattccaaaatcttctatatgcacatttgaggtaatcagtttgcacgtttaactcatgtgtattttaagtcatcagcttgtgttgcctggtttattaaagcacatggtcaactttacttagattcattaagctttaactttggaggtgatcctaggggttggatcattagcccaacctgctgtccagtcctggattccttctacgtgttccccaggaccattattagattcccatttcaattcataaaacaggaattttacatgctggaaaagtctttgtttttcttttagtgcttcagcacagttattttcaagtttaaacacatgaacttagaatgataaaaatgggctgagaaatgcgagcatctgatttttagataaaatatttgatatgggttctttccaaatcaaaggaaggaacacaaatgtgagtcagcacagagtacattagaatgattccagctcaggtgagctagagaagactaatgaattcccattctttatgatcattgataacttggtatggattttatctccaatgaatttaaaattggagtaataaaatgggtaccatagagaaaaattactttgaagaattatgcatgaaatgtttattggaccctacttctagaatttgtacaattttttgatttttattttattttttaaagatggggtcttgctattttgtccaggctgtccttgaaatagtgggctcaagagatcctacagcctcagtctgttggttagctgggactacaggtatgtgccactgggcctggcccttcttctaggatttgatggaagcagaaatgattgaaattcttaatcagctatatgatgaagataaagaaaaatacagtttgacaaaaaatacagagcaatcatcagaatgctgctttagggcactcaggagagagatttaataaccatgaggctgccatccactgtggacaatgaacaaattttgggatttgggaaaggacaacgaaaagcaaattttggaatttgggaaaaagcaataaaatagcccaatgctactttatgaaaagagaagcagcattaataacaatgattatattctgatttttttcttgaggatagggagtttcttttatgcttggtttggtaaaactgagataaaaaagaaggctgtgtgttagcgctggggacgaggtaatgggacccagaggcttggaggtgcaagggtgcaggtgcggtgagaaagaagaaggtgtactgggcgggtctgaaggacactagaaataaactccctctaaatgatagtctgtagggggcaggctctgtttcttcacgctggtcaccgtgttgaagatgaggagccccaggagacggtaagtgtgagaatcagaggacagtcactccaggctcaactgtgggtttcttcctgggacactgggcccagggatttccaaatgaatctgtccctgtgccactggaaacattagacagtaagaggggtgggctgttctgaagggtcttgcatcgcacagtggacacgagtgtgcagaattaagagaaaggagaaaatggccattgagtcgaacttcaggatgaaccagtattttaataaagcttatgttgatgattaaagtctgccttgaagtggctggtctctcaaggagactaaagtacattcatttctctttctttaaaataaatccaattacagatacttggaacacccagtcctgatttgctcttttattatagtcttctatgtggacactttttagcatagccctgcttttattttatccctgcaggaaagactaggagagggaggacacctgttctttggagcaggtaatagaaagtatcatggatccacatcaagtaaagagaatataggttagaaaaaaaaaaaaaagtcgcccaggtaaatggcttggcagatgtgtggggaaaatggatttccccagatctgcagcattattggtgcacattcacttgtgaaaaaaacacaaagctaggactaggggccagagtccttaatttctagtgttctttagtagacagtcactgcttcactgaaaatccacgaatgactaaatggtgtaagttttcccctttcctggctgttttgcatgtgaatattttaacaaatagggtcttgaagaatgaagagctccacgtgctcttaccagcccttttccttgtgtcgaggcacaaactggtgagtctctgtctgagattttgtgcaagacattcccggttccatgtcaggggtggaactggatgccctccatggccctttccactgttatcattctaacatgacagctttcgtgtagctgtgtttgtgatacgtgtcacatcgtaatctctactctcaggttttatttaaatcccttttaactgatatgctctattgacactatcactatatttttcttgaaaattattattttgatgcctataactcatttctttagaagactcaagtgctttttaagaattattttaaaatgttgattaaattcaggtcaactaattgagtgcctactgtgtttctatgtacaattataacccttttcatttattttcttcatttattctcatttattctgacaaatccttgtgagtctgggaaacgattaagctttcagagaggtaagaaatgacaaacaatttttcattggaaagaaaggaaatgagatctagacagactaattttcttaagggcatgaaacatgcaggtggtatcgacaagaccctgtctcttggcggagtggtccccatactgcggcattcctttaggctgacaaggggttttggtgaaataaaatgttttcaattgtttctcaatagtcattgtcttggttttggcataggtttaaaatatccgtgtgtgctctgatggattgtccagtgggaatttacttcttataaaaggaaaagagaaagacagactgactcaggggacaaataggtggtgactcagattgactgtctgatcagagaagggagtgaaaatggcttgggaccttttctggaggttttacataaaggctgttgtattttaacaatatcgaaggcaataaatatttatcaattcccttttgattcacatatagacactgtatcatataagttcttatgaaagctacatagaatgcagttgtgcatattaatgctaacttctttattcaaaaatataatggaagcttctttgaaaaagggggccaggtgtagtggctcaggcctgtaatcccagcactttcggaggctgaggcgggcggatcacttgaggtcaggagtttgagaccagcctggccaacatggtgaaaccaggtctctactaaaaaaaatacaaaaattagccaggcatggtggcaggcacctgtaatcgcagctactcaggagcctaaggcaggagaatgcttgaacctgggaggcagaggttgcagtgagccaagatcgtgccacagcactgcagcctgggcacagagcaagacccacccgtctcaaaaaaaaaaaaaaagaaaagaaaagaaaaagaaaaagggatcttactttacgtctaattgacacaaaagagggctgtttttaaacaattatgtccaaaattcagtggacttcattctctagaaatcatatgcctagtgatagaaaacttaaaatagcccaaagctacattgttattactgaagattatttcatattcctaaagtgtgaaatgttttttttttcttttttgctgttgtaattccgaagcattaaatcttttctatgaagtcgagttatatgaaattgcatgtagttcagtttcgactctccacatgggcactgtggaagcagtgtggcgttccctggtacgtgcgtcaaggttcacgtctgagtaggttggactgagatcctatttggttgaaatgtcaatgacattcagggtattggcattccaattacacgatggccctgaactcttacggttattgtcttacttgccttcattcctgtttctcatggtatccaaggtaaatacatctgtagtttttctaacacctttttatgttcatacgtgcatgagccactacatacaaatagagatttgtatagagatttttttttaaccaaaatgaggtcatactataaaccttgcaatgcatcttgcattttcttttaacttaatatataactgaactcactagcctggcatttaaacttggacgttgaaatccatttgtggattagaggtggtgaacggaagtgggattctgcatatggaagttcatttttttttctcaagaaaaactcagtagtttagaattaagtggctgtaaagcgaagaacaccctgagtatttaatcaacttctagatgtatgtgtgtagaagactgtgatatgcataatgagaattaaaattatttaaagatgccccatccctttctcacttctgctgtaagacccattaatcttataaataaaaaacaagcagtccccaaactgcagctaaccaaccagccaaccaaccaaccaacccaccaaccaacccatcaccaacaggtgtgggtctatttcagggtctggaggcactgggcttgctggcctccctttgaccttctaacagctgcaccccctcccagtgcagactgtgccttaggtactgtgcctaacttcggtactgtggcttaggtagtcacaacagagatttattaaaaagagaccacctgagtggatgctgaaatctcgcacccccagtgacttcctatctgtgggtacatgtgaatcttaattggtcaagattttggtatgtttaaatatatatagtagaagggtatttgctgattggattaaaggaaagcaaaggtctctttcaaaactaatgttctatcattctgttcacaacctttgacaaagaatccagttaatgaagattcagtttcctacaaatcccttttttcatcctgtacccctgtacccctaccccaaaagtttttaggttaaaaaaaaaaaccccaaaacctctgagttatcttaatgaaatattatgctacttaagttcatgagataacaaaaacgtgaatagttattaacactcgcagttactcaacctatttttggcaagtgactgctgtttttaattacacatttaaaatgtttcctacaagatctcattttcctttgctttttacgtttagaacaaaaacagtcagaagagctagaagccattcaagtgcgacattgtgtgagttagtgatattatacctgcagccaataggtttggagaactttgcactctcttcacagatgttagcgtaacagacatggcggcacgtttgcgagcacacccaccgctatctggaagcaaaaaaatgatatagcagaggccaaggcaacgggaaaagcacgtgcaatatcatgcgttttaagagaaatgtgccagacatccatgagaaagatgaacagttagaattagtaatcatggaatgcacctgccaatttcacaccaccctcaaactaaaacaaacaaaacgaaacaaaacaaaagaagaccagggatctgtcttagaaataggtatcactgttttagtgaaagcatggaagacttaatacttaacattttatggttttctttgtgaaaactcaggcacagaactcaactttgtttataccatttaaattcaatttatactaaatctataagcactggatctggcttttagagtcaaggattagctccatgtcaggattaaaggctatggtacaacatacttttaagttaatatcatttaagttttaccatcttctagctgttataattcccaaagagagcttgaataattcttgcagtaaaaattattagtgacacaggtatgatacatttttttaggattcatagaggaacacatggcatcatggaaagtccactcttcctgtagttagtgttagttatgcaaataactagccttattaaaataaaagtattgatatatatggtatcgaaatgaccatgtttaaagaaaggagtatattgcttttactttttaaatttttatttttagggccggagtcttgctccatcacccaggctggagtgcagtggtaccatcacagctcattgccatctcaacctcctgcgctcaagcaatcctcctgcctcagtctcctgagtagctaggaccacaggcacacaccggctaacgttttaactttttgtagagatgtggtcttgctgtgttccccaggctggtctcaaactccctggctcaagggctctttccgcctcggcctcccattacaagcatgagccaccgcacctggcctcatttattgcttttatacttttaacaatatgtgtactatgattcatatctttaaacttatgcaagtcataatgtgaaataaaatcagtgtaagttcatcagccattttaatgtgctatgagaagtttagacttctaaatttggaagagaagtcttttaaaattggaaggccaatgttctatttatgaccagattcaaattccattcttacattcctctgtaatatggcatggcaataaatagttttgctcattctcctcattctgcttattgagtaaaaccaaattaaattaaatctttttgaaagttataaaaaaagacaatataaccaccgatataataatataatcattatatattgtcacatttccatttttcctttttctttattttcataaggaaagtatcaagtttgtttattggacatgacagaatttagattggtaaagatgctcggaagtataatttgaaggaatttttcataaaatttataaatagtaagattaatagaacttaaaagcagtggagtgattcttacttcacttttttaaagtatatgtttaaagtaacaatttcttaatgtagaaaatcattaaaccagaaaaccaacttgaaagaatattaaaagaaaatgaaccaaataaatcaaaggttataattaagaacccaaagaaagtgacacaaatgggagaaacaactgaagattccttcaggaaaggctccaaaaggattttagcgaactcagcaaactgaaagtgcttagagacaagtgcgtctgataagatggaggtgatgttattgcttccaggagctggaaactggttgaaatggttgtgtagtcaaaggtgttgaaagtaaaaactgacatcactctaagagtgattttatttcctagttctgttaattctgaacatctcacaagcacataggtgaaaagagaaaattccagaatgagaagatccagggtcacaggttaaatctctggtgttcaaactgtgggctgcgatgccctgggctgcactggtgcattcatgagggtgttggggggtagttcctgtttttaaggaaaacacagtgctaactgttggacactcaatgaactacttgcttggggcagtgcctggtttcaacataatagacgcgctatattccttttgatgacatcatattttggaaaaactgggattttgatacttgctatgataaaaagcaagtaccatctgaagaacattttatttatttatgtttagagacagggtcttgctctgttgcccaggctggagtgtagtgatgcatttggaccttactgggctcaaactgatcctcctacctcagcttccctcatagctgggattacaggcacatgccaccacgcccagctaatttttaaaatttttacagggatagggtctcactatgttgcccaggcttgtctccaacacctggggtcaagcgatcctcctggctcagcctcccaaaatgctggaattacaggcgtgagccaccgtgactgtctggcctgtaaatcattttagatcagtaaatgagagtggtcatgtacaatcgaattctaaggtctgagaaatttttcagtgtgcaacaggcacacacataatattagtaagtaattcttgttataaagaaagaaataaaactattttctttcaatttatgtgtactgttctgtcaaatggcttctaagttgttagaacaaagtatttataaagtaattattaagttattaagttgttagcacctaactacttaataaatagaagtgttacatatttttgacctaggagcacagtgaagaaattactgagacattaaaggtcactgtaaaacaagaaagtttgggaatccttgggttagacaatttatgtattttaggaagctctaagtcttagatgaaataaatggaggctctgtctttaataaagtttaataaagggctgaattctaaaacttgaggcatttgtaaaattgctggaacagaatgatctattatattgtgtttctacttccttttgtattgatactttctgatactccttgaagatatttttaagatcttaaaacaaggatgctacctttcatgtgtcagtttatcctaaagaatcctaacgctggtcttgccttttgtcctcattaatgacctgcagccttgctaggctactcttcccctgagctgcaagattcctggaagctgttcctactgctggaaacccctcatatgggtaaattatagatggataattatttgatgtctttccttctctcctttcttcaatagctaagatatgcctaagaaagtaatgtgttaaacattctaaaagtggacatataacatgttttgtatatattttctacattgtttagacactttagtatgaaaaattaaccacattccccatggctagtttattatgcactgattaaaagcaaatacttaacttaaaagaatgctttttagccgtggtgaccaacacatgaagatttaaataggaatatatatttttaatgattgatatattggatagatatatctatcaataaagagatatattcctgtttaaatgaatattgatatatatatcaataaaactggcctgtattatttatctatatagattatctgcattgtctatccatatattatctgcattatctatctgtctattgatagatagataaatagatagatagatagatagatagatagacaaaaaagtcagaagagctagaagctattttggggatgagaaaaataacttgtggggccactttattcatctatctatctatctatcatcatctgtctatctgtagatagataatgcaggccagttttattgactagctctttaggaacaaattcctacttcattttgtaaacacagtaacaatgctttcaaattcctaaggcaatatatgtgtgtatatatatacatatatatttaaaagtggtatgtttttataaaaacattataattattattttggaattttgagcaaaagttttcagtcacttttgatcaattttatgcatatgtttgaataccatattttccaatcattatacattaagtggaagttcatccaaataagcaaaataatcctatacaaattgcatcccatccagagtcaagcttactccttagaaatgagaagatgctttagaaggttacatttatgctgctaagcagtaacttgggtcaagtaccttagtgacttaaacaaatttacaaatttgtatgtgcttattttgctatgagggattgaattatatgaataggaaggttaattattgagtgtactgcccatcaacacagcatattcagtatatcatgtatgcatatccctgtcataatagtgttataataaataggaaaatcagcactcagtaaaatgaggaatactgggagttatgatccacttaagtctacagggaaatgtcttggaaggatcaggaaatatcacttcctcatgtggaacttctgctggagtgactttgtagctccaaaacatggctgatgctagtccagctgtgggctctacattctatttgctttcttctgtctcctttacctgctaatattttctacttcattccccatgtctacttctgacatctccaatcatcaagttgcctttgtgtggtgcatatgcagggttataacttctcttgattgctgagccttccttgtgtgttttgactgtctccagtatcctcatcttgcctgttgtccacatgtctgcaaggtgactgcatccccaggagcccgcccgcacagccttctctgaggccactacggcacatggcacatgacgcaaggctctgcactcgacctggggattaggtattggtcctcgccagtggctgggtaatcctccttgtagcacttgatgcaacaagagacctcaaaaaggcaaccagctggacatgagagaatatcttgggccatcctttctactctgccatggcgcgacggctcaaacaactttccagtgatcacttgtggataggaaatggtatcgtttaaacacaagttacaaaatttcaacgagaaagttgtttcttgaattactttgtattgtatatttcaaggtggggggaaggcaaaattataagccaaattatttctactgtggaaaaaagttcatatgtacaaagcatgtatcatgaacacttttacagttaaaatgtagacaatacagtttagagacacagttgttaagttatttggagatactactctcacatctacacatataatgcttataacactatgggaattgtgactataggttaattaagctgattttgtataaaactttggcactctatctgctgacttcttcaacataaagagtttatagaacaggtaagtttgaatattttcttctagagcaacttgcctttgaatttagcctatttttaagtgagagatttcaaaagtacacaaacaaacgacatactacctcttcctattgtttataggagttagttttaacatgtgattagagaaaaagggagtaggagcaagtaatagaagagaaaattctatgtttggtggctataagagtggggcacaaatacaaagaaagaaagtaatgaatctatgctatgtatctaatcagaaactcagaatcacatttaggatcagaagagtgctaaactaatgatttagggccaacatgatttttagagagcaaggctaaaagagtttaaaactaacagacagcatacctgtgttcattttcaccttggagagtttgttattaaagtcttcagttttcctgtaggaaaaaaatggtgcataattgttcactagcatgtggaagaaaatatcatgaaagtgtgtcgcatttttgtttttgatgtacctgtaagttaatatcacattatcattagtcttatttaaatcagtgtttaataaggtaggaagaatttataattctgttcatgttaaactttaattattggtcccatgctcataaaacagacatattctgtttttatgcttttgtttaatggtgagcattaatggatgaaaatggagacgttttgtgcttgtttttctttttttctttctttttttttttgagacagagtccgccactgtcgcccaggccacagtgtagtggtgcgatcttggctcactgcaatctctgcctcctgggttcaagcgattcccctgcctcagcctcccaagtagctgggattacaggcacatgccaccacacccagctaatttttttctatttttaatagagacggggtttcactatgttggtcaggctactcttgaactcctgacgtcgtgatccacctgattcggcctcccagagtgctgggattacaggcgtgagccaccgtgcccggcctgtttgtttcttttttagagagagggttgtgctctgttacccaggctggagtgcagttggtgtgattgtagttcactgtggccttaatttcccgggctcaagccatcctcccacctcagcctctcaaggtgctgggattacaggtgtgaactaccgtgcctggttgagttttccttttaaaaaattaaatttcttttacaaatatttatacaaatggtttttgttctctaagcctgaaatgattgcctgttaagtgtcctcttccagagttttaaaagtgaccctggcactttaaaatcattgccttacatgtgcaggtcagttgactaccggggaatatgtaatgaatgtaacgcatattttcaggacactgtcaagaaagatgagattcatctttctcttttttaaagacacaggaaatagatggtcactacaaaatccatctctgcattagtattgaatgctgatttttcccagtgaaatgttggatgcaaagcaattgagattaattcgctagaaacggttggcagaaaggggttgtctcagaaaaaagtttttttttttgagatgagtctcgctctgtcgcccaggctggagtgcagtggtgcgatctcggctcactgcaagctctgcctcccgggctcacgccattcttctgcctcagcctcccaagtagctgggactacaggcacccgccaccacgctcggataatttctttttgcatttttagtagagacagggtttcaccatgttagccaggatggctacgatctcctgaccttgtgatccgcccgcctcggcctcccaaagaaaaaggttttaaatattgtgtatcgttttatgacatgtgagatgacttagttctttctctggcatattctcttagcccatttatggagtttcttatttacccataccctgaaaccaaagaggaaagacacgctgataaggtagcaaatctcctaagtccaagagctccctgcaagagctgtctgaccccggccacttggcctttgctcctgagtgggcctgttgttgagtatccacaagaacccccccgcacagcacaacacactcacagcttccaggcgcatcagtactgcaacatccgaacattttcaagaattttatttattccttttggatgaatgaggataaatttgaaatgaaatcattggcatgatcacctgtcaagaaagacttttgataaataaagattttttagtctctaaaaagagcagcaaatgagcttcctggctttcttgcctttgtctgccaaggttctcaccctcttctcccttctgaccatttcctctgctcaactcacaactattattttctttcaatgtggctattggagttcacctcttttggaaagcctggctttgttcattactgatgaaaaattataataataaaatcaaaatgtgaatattagctaaatataatggtacttctctcccagtggggggaaaatgatgaaagaaaataacattaaaaatacacttaagtcctatgaaatataattataaagcaagattttatatatagatatatatgtatagtgtaatcctcgttttgctatatacacatgtatatgtgcacacatacacacacacacgtatatttgcctagattgaattactaataccttaggactcaataaatgctaaattaatgaacatttaaaataggtaaaatcacagtactgataatcacctcagtatatgtttttagagctctacgctgaaaacaatatagacgatatccttactatatggtgtttaatttttgtgtggtctgtgttcagtgtcatatcgttgtccgtctgccctgggcatcattgcagtgtagggagcagggcaggagccatgcttagcgtggccaggctagaactgagtttccacagggttatggggaacttcactggggcatttcataggccaacagactctgaaaaatgattgagggaaattttatgatggtgaattttatctcctatttttcagtgtatgcaactaaacaggcacatttctgttttacttttttgttttgttcttctccagaattacacagaaaaaatgtggcgtatttctaaaaactcagcttggtagccttaagaccgcctgtattgagggataccgatgaagtcagggaagagggcagcggccagcacaggagctttgggaaagctccttcaaacgtatttagtttaatctctcggtagctcttggtagcaaaactcctaatatgttaaccttaaatggacaaaataaatggaaaagaaaagcctcaggggatgtctgtgactgagactgaggcaacttctaaaacaagaagggataaacaacctccagaaaatgaggattatgaggacctttcccaaattcgacttcttcattccttttgaaaccaggcaacgctgtgcttacaactgcttaaggttttaaaacggaatgaggaagacagtattcgggctagaataatagtgattgacaaagaaaacatcaaatacagaaggttaactctcagaatacaaaatctgctgacagacaataataatgtttttgtaccaagttagagaactagttatcaacacctattgtttgaattcaaatgccgatatttacagaatatctaacactcaaaaagtaaaataggattaacgagaacaaagaaaggcgccacaaatccttgaggttttcatctttaaagtgatgtatcctgttacttataaatgtaatttgtgaggctttttaacttcccattgttttagatgtcaaaatgtgaaatgactaacttcctaatcaagcaagacattttccaagtcgttaaaagaagaatcccagtgattgagctctcaagaagaacctgaaaccgaaaggcttcttgggtgactaataaaaatgcacgattctatttcccttatttgtgctaagtccattaacaaatccacgactgagaactctctttagacagttcaaactaaagcgaatctaatctcttttgttctgctctgaaaaagtgtccttgattgtacttacataacaagcacagattattctggaaagcatcaaattcctagagtctttgcatgctgctagacaacagcatctcaagtattctcttaacttggaattgaaccagggacgagactatgagaactgaccataacatggagactaccttgagccttagcagacaatccacggagcaaagaagtctccgaacatgaaggtgtcagcatgattttcaataggtgctaggggattgtgtttacttttgtcaaagtttcatataaaaagcaacttcatatgtgtcctaatttgtgacaacaatggattggttttacttatggattagagtagcctccactgtcaaaatacatatggcaatagattgtgttgattgttcatggaagggctgtaaacagcatgacttcgggtctatagtcttttaattttgcttgaatttcttttttttctttttctttttccttttctttcttttcttttcttttttttgagacggagtctcactctgccgcccaggctagagggcagtggcatgatctcggctcactacaacctccacctcctgggttcaaaggattctcctgcctcagccttctgagtagctggaattacaggcgtgcaccatcacgcctggctaatttttgtatttttagtagagacggggttttaccatgttggtcaggctggtctcaaactcctgaccttgtgatcctcccgcctcagcctcccaaagtgctgggattacagatgtgagccaccacgcctggccaattctgcttgaatttctttggattatcagacatctcatttttctcggaatcagagcaggctgtgttctcaatacgtataagagaatagaatgggtaatttaacttttgaaagaggatcctaaggagtttgatcctgcatgggcatgaacatgcctttgtgcctgttgtctcataattctgcttgaattgttttgattatcaggcatcccattctgaagagcagcagagacaaaatcctttccccagttttggctaagaattctatgtaggtcattttatttttgtagacctgaatttaagcaccaagaccatgtatgaaactacaggactgaattttagctcagttaatgggaggagttgcccaaaagattttccacagacgaaccttaagccaatacattgctactgttattttgaaattaacatattcacagttcatatattattcaaaaaaggacatattgatgtttaagtagtaggaaaacattgcaggatgttagtttttttttttaaagagatgtattttaaacatgaacataaaaatacaatcatattaaggttatgcaccagattttaacttgaatttacttatttattttgaaatgggatcatttgtagcactctctttggataaactgccctaagtgatcaatgtattaatgcatctctctctatctctgactgtggtaaaataagaagtattcataaatgccaagtgatttcacttttctattatagtcaaatgacttaattcaggttgacatttatcttcacctatctttcctatatgtcaacatgctgctttgaaatagtcacatgaaaactccaagtagtttgttttgtgagtttagaaactctcttctgactagtttctctaaattggctcagagactcctctgcctgagtgggtggcacacaagtcaacagtagcggcatgactgtccatgctcataagaacaccaagtacctcccagaactcctgtgctaacagtgcctgaaaatgttccttattattcaggagccgaattacccgcggcatctatttatctatgctgaggccagaacacattcaacatcatttctaggaataaggagacattattaccacaaataataaagaaataaatgaacatgaggccgttgataattttttatgagaatacgcggagtgttagttttaattagaccaaatgtcctgatatttggaaaaatttcctgaaaaaagagcactatatgtcttccaaggaaactagcaattttccttttgagactttacaatgtaagctgttcaaaatacttatcaattttccctaaagactttactgattagaagttgatcacctggtaaatgattccttctgatgttattccaaggtctcaaagttggtgaatcactcatttcactatttgctttaaatggtcatgtgacttaacattggtccagcaccttactttcttttttttctttaggtggaatctcactctgttgcccaggctggagtgcaatgatgcgatcttgcccactgcaacctctgcctcccggggtcaagtgattctcctgcctcagcctcccgagtagctgggattacaggcatgcaccaccatgccgtatttttagtagagacagggtttcaccatgttggccaggctggtctcgaactcctgacctcaagtgatccacccgcctcggcctcccaaagtgctaggattacaggtgtgagtcactgtgcctagccaccctactttcatggagttccttagttttatattgtaatcttagggatcattacggaacaacatctaagtattttcaagtgcatcttttttctaagactaagtcatttgttcaacttgatagtacagtattaggagaattccattggcttataatgtgcaaatcaaaagccaaaaaaatttctaatgaaaataattcagattctgactgaggatctcataagtcaggcaccttatcaaagagacatgtgaggaattaattagaatatccctataacacatgtataggcaaactgaatagcgttggaagaatgggtcaagaaataggcaaagcttgactcaaatcccagttctgcccatttctatgcatccgaacaatttataccaatgtcattatcatcgactcccccgctagacagcaaagcatccccaatctggcaaactggcattattcccattcactaatatttcaaatattttgaagcagatctttacctttgattgagtcttaagaagataatctagactttcctgaaaatacatggggcattattgtattgctttagattgaagcaagccatatggtttattagactgatttctatggattttcccgtctcccaattgtcccacacccagcttagcaacatgttggaattgaaaaggaattctactttccaggcagctttctttcttccttaaaaagatcctttatttagctaagattttcccccccacacattgccatgaacaagagaaaacctaagaaaatagttgaatcaaacccttgccttctagcccagctatagacaatgctactggatctaagggaaagtgacactataaaggttttgacgattagcttttttaaaaaaatcattctctttccctttgacagctgatagccgaaagcgatggctgaatggaaagagatgtctataaaatgtcacataacaaattgtgtgacaaattgcagagtgataacatcctgatggcagcctactcctgcttaattcaataagggaaagtgcctctgatttcccaccttgtactgagaagcacacatttctattttgaggagaaaagccttgatctttttaaagaaccattttttaaaattttatgctttgctaagtttctcactgcttttaattttaaaatcttccgttttaatttttatatattgaaatataaaaatcatctgatatcaaaagaattatgtaatctagtctagttttgcatgtctcatacttagactttaagtagaagcaagcatcaaaggctctggtagggattgagatcaaccaactcatttttagggttagacatttgaggataagataaatggatgccccaagcagatactcaaaagtagttcatctctcctgactcctagcaaataataggcatcctcctttaaggaatcttaaaacgtcatttgaaatcaagatcttggccaggcgcagtggctcacgcctgtaatcccagcactttgggaggccgaggcaggagggtcacttgaggtcaggagttcgagaccagcctggccaacatgacgaaacccctgcctctactaaaattcaaaaattagccgggcatggtggcacatgcctgtagtcccagctacgtgggaggctgaggcaggagaatggcttgaagctgggaggtggaggttgcagtgagtcgaaggttgcagtgagccgagatcgcaccattgcactccagcctgggtgacagagcaagactccatctcaaaaaaatgaaacaaaacaaaacaaaacacaaaacagaaaaacaacataggaaatcaagctctttccctttaaaatattacagtaccctgcttaattaagtactgaatcatatgaggcaggggttagggaaaagaacaaaatatgagaagacggtgtggtagaaggcaaaactgtttgataaataaaataagaactgttaacatagaaccatatgtttcttcctctaagactaataggaaaacagtggttgattatgacaaggattccttttgcccaatcacagcacaagtccaaatggaaagtgttaatcaggtctactaaacccaaagcatattagacctccttggtctaagcctagaccaatagccattgattttttttttctgaaatccttagaattttcagttagtaagtatatctattttaaattattttcatggtaatgttacgtggtgaaagtattacagtgaaataagcctgcttattgttaattcactgttcttaaaaagccacacttttcttctgattgaatacacctgtttcctgagcacctgaaataacatttatatactttagcaatgtcaaggtttgtcagaatttttgacagaatatactgtcagaattattacaaattcatgtttatatgtgtctcagatatgcaatggtgaaatcccacttgctatgtggaatttaaattttggggcaggggaaaatttgctctaatttgatcttatagtcttaaaatttaagtaatacattacttacaaagtttatccagaatgaaatgtaccttttttttttttttttttttgagacagagtctcgctctgttggccagggtggagtgcagtggtgcaatctcggctcaccgcagcctccacctcccaggttcgagcaattctcctgcctcatcctgcagagtagctggggttaccggtgtgtgccatcatgccaggctaattgtagtatttttagtagaaatggggtttcaccatgttggccacactggtctcgaactcttgacctcaggtaatctgcccgccttggtctcccaaagtgctgggattatgggtgtgagcctccatgcctggccagaatgtatcttaaattgtacatcttaaggcagtttgattcattttagaaaatttgaacgagaaaataataagccaatggaggaaaaatatcatctgaagaaattttgaatgcattaaaagttggaaacttttgatatttgtgttgaacagtggatagtttattacattattctttgggatctaataaaagtagacaataaagacagatatcttccattttaatggaaatgtattattcagaaatgtattattaatatttatatactgctgctccattgttattcagacatttgaaaaaattctttacatttctctatgtactaaatgtacaagtgttaagcagaatcataggtgaataaaaggtactcaatttgaggagtaccctgttccgactgtgtctgcaacatttttattttagggaaaaacaaagtggtgtgtttattgattctgcagaaggcatacacacgagaggggaataggtaataagtagaaagatgatcttgacaggctgaattaaatttggctaaactaaatttcatgattaggttgaagagactggcttttcaaaaatttatatggaataagtctaagggctttaatgcaattgttgaaaaatataattaaatcaatgtctaaatgaacagtggtttcatgaatcaaggaagattgggctccagctgcctcacttttaaagtgtccacatgagtctgtgcgtgagtcaggctggcatgaacttgagtctctaggcaggctttggaggctgtgctgggtggggggagggtcacagaacgatatggtagagacactatggtgagtttccaggtgactaccagcagcaacaggaaaagttactgacatgtacttgaggtttatttttttctttcatctcgtggaactcatcccagtggcccttagggttaatgctcttaaatataccaaatttatgctttaaattgacaagaagatgtataaataacagttgcagctagaagcttcaatattccctcaagatgtacctgaatttaagaaacataatatctaaataagactgtttctcagtgctgggtttttaaccatctggttcacaattgtcatcagaaagaatgaaaacaagtccatcctagaaataaggggtttaagacttcagaactgtacaacaaaatgggatgtggtgtctattgcccttttgttcagcaaaatgccaactcagatgacctcacttctagttcttaccccccacatatgttcccagcattcttcatttttcatacctaatatagtccttcatgctctgccactatttaaagctaaaactttcactcaatccaccaaaaataggcaagaaaaacaacatacaaatacaaatttatattccacagttacacagtggagaacagtgaagcttatttgaacaaagtttttgttgtttcataatactctaacttatttgacgtactggctaaaggtagaaatgatcagaacactttttgagattgttagttggcatattttaacatatgtagtgaaatcctactcagtctgatctttattagccatttctcccccttttatctacagaaataaactctcaacactctttcttttatcttggacttttgccactcttggaaaagcagaaaaatttccttttgacttcccaactacacgaactctttcagggcagcctggttttagctccagggtagtctgccatgatgctcagggccatggatcaccttacagatccaacctgggcctcttgttcgcatcgactctaccctgggactcagcctgttctccttcaggtccacaggtagagaatgtctgtgtggacatcttcatggacagagatacccactgacttctgatctgatacctactgacttcatttccatttcttcttttataatggagcgtaaaagcactttgtcatctgtgctgcagcatttggtaaaggaaatccagaacccacgctgggaccacatgcatttacattgattctagttaattatgtttgagtggagtgatcgcttttctatagtacatagaaaatgttaacatgaactattattattgggatgttggctgtctgccattcctaacacagagcagagggtaagaaaatgtcactcatattgggagagggcaaacaataatggatgggccaaaaagttagcaaatttctttcttttttttttttttagacggagtcttgctctgttgccaggctggagtgcaagtggcgtgatctcagctcactgcaacctctgtctcccaggttcaagtgattcccctgcctcagcctcctgagtagctgggactacaggcacgtgccagcacgcccagctaattttttgtattttagtagagacggggtttcaccatgttggccaggatggtctagatctcctgacctcctgatccacccacctcggcctcccaaagtgctaggattacaggtgtgagccactgtgctgggccgcaaatttcttttttgtgggagaagccactttagaagtatatatctacataccttgtctaagtcaatgtgttgctataaaggaatacctgaggctgggtaatctatacagaaaagagggttatttggctctcggttctgcagcctgcacgggacgcatggcactgacatttgcttgggttttagagaggcctcatgatgcttccactcctggtggaggggagaaggttaaagggagccggcgtgcagagatcccatggcgagagcagaagcaagagagagcaggaaggtgccaggctcttttcaacaatcagctctcaagggagctcccccaggaatgaatagagcaagaactcactcactctccctctgccagggaggacactaatctattcatgaagtatctggtcccaagactcaaacacctcccattaagccccatctccaattggggatcgaatttcaacatgagatttggaggaatcaaatatccagaccatagcacacatcaatagcgaggaagtggcagagtcagagttcaacaacctatgttttaggggacttccaggtatgtgctcttaatgttacatgactttttttttttttattgtactaaagtgggagtcggtgttaagccttgtgtgggaaggtatgcttgggcaaatcacttcacttcgatgagcctgagttttaaagtttataacatgaaagacttgatttaaaatataaaagcacataagggacttttatggtttgaaattttgctaaatctaggaaaggtatattcaaccaacaaacatttgttgacctttaatgtgcaaaccactatgctactgtcatgattgtacatatcaagcagaaactaactggaagccaatatttaatgactcattcacatattaaaattcagaaaaaggagatggttaaagacccgtgcttctgatagcatcatgatgagatggggtacatattaacacatgtccaagccaccatcctgacaaccaagctgtctccctctttgttgtctgctttacttaactccagatataagatctagagaattgtttatatattacatgtctttctatattatctccagtgccctacccttgagcttctcaattttagaatttgatcgttcctaaaatagaatccattttataaatctgcaccagaagaaacagacagaacttcagtccatcaattttcattaatttttaaagcttttttcatgagtagtgtggtaggtacattggaggtaacaagaatcattgattctttttttattctgttagaatttacagtagaggagaacttcaaaacaggtatctcaatcatggaggcagcttggcattccaaatattacgtttttgcatagctcctattttaaagagtaaaagtctattggcttttgaaggaaaaaaaactaaaagatctaagcagactgtactcctagccaatattctcatcacatttttcttactggctgaatcagtcatgccataacttgctaaatgacaatagcatgggaagtacaatgacaatttgagttatttttcatgtggatggttgttgttctgtgctttgattactgttgagaaatgtcggcatcaggctcacaaacaattgccaaggtcctatgacccacaaaaacttcaatcagcctgttcccatgttcagatgttttggaatttggatgtttactttacataaattatgatttaatattatggctatttgtaaggctactatgtgataattgtatcattaacttcaaatgattaagaaaagcaatctgaattagggagaagtgagttataaagtgcttgtgaaaaaaggcaacgtattttccttcaaaaatacagattaactctaggtcaaggcaataacacctaaaataaatcctccagggtcctagtttaatgaatacataagaatgatttgtacttctaacatcaattcatatggaatgaatgcttctaaaaaggtttattttgtgtagtataagtatgctagcactttgcttaagaatctagcttttaatattatcaaaagtaaagacagcctagactctcactgaattacctcaatttctaaattggtatgtctaagttacgattcagacataattcatatttatttcccatttcatgttggagtcaggatattcgcttctccccaaacctcaccccatttttccagtattcctcacctcagagaatgctatcattcattcattattttttacaattttatttatttatttttttgaaacagagtctcactctgtcgcccaggctggagtgcagtggcgtgatctcggctcactgcaacctctgcctcccaggttcaagctcttctcctgcctcagcctcctgagcagctgggatcgcaggcatgcaccatcacacctggctaatttttgcacttttagtagagatggggtttcaccatgttggctaggctagtctcgagttcctgacctcaggtgatccacccccctcggcctcccaaagtgctgggattacaggcgtgagccaccgcacctggcccattcattcattattcaattcattaatcaaaaagtttgagagcccattctactccacaaattaccctggatgttccctctccctcaactctccatgttttgagaaataagacaagaaacattcagctctgggaagggcagcatgcttctatctcagtcccacagttcatttgcccaagagacttgggcatgaaagataagcatttctagtccttttgattttgcacaggtcagatataggttaggcacaggttaacacagagtgggcagatgggagtctctgaccagctcatgcggtgcaggagttatactgttgcttcactttcccataacagcaatggatccgaaatggatgatgatgttccagtgtcacacaggtaggggcagcatggcagataaacgtgagagaaaaagcagtgtgtgcatgcacatgtgcacatacacaaacacatgtgcccatgcacaggcacacgtacacatgctgttgtgttccccacccagttgtctcaaaggccacgagtttgtggattttatcttcctagttcagtacaggactacccagaagttggtcgatattaaagcctcaaaggaatcataatatcacttttgtccagattttattttccaatcctctctttgttttatcaaaaacattttaggagtacattttttcagatggattatgtaaacactggacctgttcgttaaaaaaatttcttagagatcaagaccatcctggccaacatggtgaaaccccgtctctactaaaaatacaaaaattagctgggtgtggtggtgcgcacctgtagtcccagctacttgggaggctgaggcaggagaatcgcttgaaccgagaaagtggaagttgcagtgagccaaggtcgcgccactgtactccagcctggcgacagagcaagactccatctcaaaaaatatatataaaatcaaaaataaaaaaaaattccttaaagtttaatattgatatgttctatatgcaaacatgaatgggggttttccgttttttcactgctatacactcagcctctaacaatatctggtacatattatttacccagtgaatatttatagaaagaagatgtcctcatttacagacatgatggaatgactcccatcgtgaagtggtttgtcagggagagttagacaaaggggcttgaggattcccctcatttgccattacagtccaccccttggctcttctagtctattgagggcctttcttctgagttgctattggacatcttgaatgtaatggtgtccctagacaccagtttacattgtcttccagcatatgtcacttgaggaatctctagatgatttagaggtgtcaggctaacaaatccacactcattcctgaaaatccctggaaaatggcaaagataattgagctgatattttggcaattggcaggatgattttgtttgagtctgaagtgtattttaagaagttatttaggtttcctgaataccaacagtatcatgaaaatattatgcttgccacgttgatttaatcaatcaattctaaatcaccaaattatatcatacattttaaacaaaagcatttttactattgaaccctaaacatgaatgtgacttgtgatttttgtttttccaagagaagactaatacaaatattcattttagaaaaattctcagtacatgggctgtttgtatatatcttaccacttcatatcccaaccaaaatcagatccacaaacagcaagcaaacaaacccttgactcttttctcttttagttagttgtaatataacataagtgatattgattgtagcaatggagaatgattattgttactttgggggttgtgtctcaagtatacacaaatggataaaccacaatccttggtgcatgacaaggtcatgtacatccccctccctcctttccttccttctgtcactaaacatctacacaccaaccatctaaagccaaagatagaccttcgtaaggacctgtgtctatccagatgacttctgctgttataacatccctcagctccatgcatttgagtagccatcattctgaattccatgcttatcattctcttcctttcctgttcatataatttcattgtatttatatgtcttctaaaagcacatttattttagttgttttaatctttataatgatataatgctgcatataattacattgctaagattcatctatattgttggttatccctgtagtgtgttcacttggtctcctatataatatttaattttgtcaaaataccacattttgtacatccacttcctgttcaggggcatttgggttgcttctagatttttgctatattggagagttctgtcataaacacgtatgtacatgtttcttaatgcttttcttgtgaattaactgcttggcagataatttaaatgatatagctcctacttaaaaagtattttctatgtgccaaaaactgatctaagaatatttacagatattacatgtatattaattacatatgtgttacatatatattacatattacacatatattaattgacctgaggcctcacaacaaccaaacaagctaaatactattgttatcttattttactgcaaagaaacgccaaaccacagggaaggtacaaggtcacacagctattaagtagtgagtgaagcttgggaatgcaggcagtttggcttcagagtttttgtactataatgtctttcttggatctaaggacataaaggattgcaacagtttataacacataacttagttattgaccagaatttgagtgtgagtctgtcataatcaggattaatcaggtacagtacaccctgtaatgagcaatattggaaatgctcatgtatactataattactctaagacaaatgtcataaacatctttgttttttttttttatcatgggtacaaggcacataaatttatttcaataggacagctgctgcttttgatgcttgttctcacaattccgtggtggtagttgtatttgtttgttctcatgttcctaataaagacatacccaagactgggtaatttataaaggaaagagatttaattgactcacagttccacatggctggggaggcctcacaatcatggcagaaggcaaagggcatcttacatgacagcaggcaagagagcttgtgcaggggaattcccatttataaaaccatcagatctcatgagacttattcactaccacaagaacagcacgagaaagacgcaccccatgagtcacttacctcccaccggatccctcccatgacacgtgggattatgggagctacaattcaagatgagatttgggtggggacacagccaaaccttatcagtatttctctgtgtttctcacaaacatccctgagcactttattgttatcacccaccataggatggtcaggcccatctttcttccccttgaaggagcccaggcttctcctaggcttcagtgttaagggcacagtgggttctgggtgaccctcataaaatcagatcatgaatttaaggcagagccgacttgggctctcactctccaggggagatgttcttagatgaacaaaaattctccttagtcagaaaagcagcatcctcatcaatgtatggaattgtggcaaacatattaagcatgtcattccttaagttaatatctgtcactacataataactcacgataaataaatgtggtcaagaaactatattgtcacaggtacatgtaatagataaagacagggagcacaaccagcgtttgtttaactttgcaaggatcaaaccatcatcagaaccaccctttgtgtcttcattaattttttgttcatgctgattctgaatgtttagtctcaagaggaattatgagccatcagattggatgagtcaccttttagttataatcacaggagcattcaaaaatgaaatcactttattcagctggatgaaccttataaaaagtaaatgacttcatatacatttggcataaggctaatgagctatttttagtttttcctggaattatcttagcccttctttccgccctccgtgatgcctgcctccattttaccccttcccagtgctttcttggtcatgctaatcaaaaaggaaagggggaagaaacatgtggttttgataaccttcaaatcattaaggcaagggggaaaaggcccacaaaaggtggctctgaaacgtggagcgcctttccaagatccaaataaagtgttttctagagagtttcatgttatttttatcatgacttttataatctactactatcttttaaaatctgcattagaatattatttctggatctccaatctttatatctatttctacgtgggtatgactgtatgtgtccctcaaaaaatttcaattcagttcttgtgaaccagagaactcttcaaccttttctctttttttgagacggagtctcgctctgttgcccaggctggagtgcagtggcgggatctctgctcactgcaacctccgcctctcgggttcaagcgattctccctgcctcaacctcccaggtagctgggattacaggcatgcaccaccacacccagctaacttttgtattttttagtagagatggggttttgccatattggccaggctggtcttgaactcccgccttggcctcccaaagtgctgggattataggcatgagccgctgtgctggccaaatcttttttttttttttttttttagtaaaaggaaactaaagttacaataaagaaataaagaaacttacattttgttgacactaaatggcaggtttcatacaaagactaatcttttttattagggtaggaataattattggtgactttctctgccaattttccaagtgttggtaatacatgttgttactttttaaatgtgtttttgttacttttaaaatgaaatgaaaaagacatataaattatagcatacatgtctacccctacatttaaaacaatatattcctatgataaggcagaaaaattaacctacccttccctaacacaaacttccctttaatgcctgtggccatctgtagatcctgtcctctgttagcaaactccactcatttgctttttgaagttgagttcaagatcctcccatctcctcacctgccccgtcacccacatctctgcattactgtaggctcactgcatgtgcccttcatctgacattgaatctaggctgtcttgcaacatttctgatattactgccatttaatttaactttttatatgcattgccttttttttttttaagactagtcaagtgcagtagtgagaaggaagaaagagtggaacaaggagttcagctgtaattgactaaggtgactcactctgtggaccagcctgcattgcctttctggctacattggtaagtatgttaaggagagggacaaagtcacttgaagtttttggcctcggtttcctcatctgtaaaatgaagggaaccaggcctccgaatgttgttaatccaacacctataactctttttcccaaggttgaagatccccagtaatatttcagcttgctttcactcgatgttaatccaacacctataactcttttccccaagactgaagatccccagtaatatttcagctttgctttcactcagtgttccctgactcagagatctcaaaccctaagggagaggcagagtgtccttcagtcttgacgcctgggagctgtggatgcctcattgttgctcgtcttgcgacataaaataacagcatgctagtggccaaaaggcatgaagtgttcaaacttattcaaagttcaaagtgttcaaaccttttatgtacatgattctttaaaacgagggaaaagggaattgctctgttctcaatcgactgtgtctgagttcttaggatttatattagatccacactcccccccaaattttgaagatggaatgaatgtgttttctcctatatttaccactcaagttttttctttcctacatgctgactgtttgtgttatggtcattagattctagtactgaaggggttttggtttttgcctttgttctctgtgtgagctatgcagtggcttttgtgctgaaggagggagctcccgtctcatcagtttcagaacttgagtgatggattcgtcgtggctgctgatggtaacggtgggcactggccagcctgttgctcatgcagcgtgggaggtgagcgggcacagtgcccgtggagaggtggtgctgcctgatgagcttagggaaacccggtaaacaccgatgtgctctcccagatgcaaactgagtcacatccctgtcaggaaactgcaaataaatcgtgtgcaaaacggaacaaggatcctattaattaatttgggataactttattttattttttattttttttagagacagggtctctctccattgcccaggctggagtgccgtggtgtgattatggctcactgcagccttgactgcctggattcaagggaccctcccacctcagcctcttgagtagctgggagtacagatatacaccatcacactcagcaaatcttttcattttttttttgtagagctggggtcttgccttgttgcctgggctggtcttgaactcctggcctcccatctcagcctctcccatctcatcctcccatctcagcctctcaaagtgctgggatgacaggcatgagccactatgcctggccctgacatgagactcttaaccaggccattttacaaccaatttcatgcattctacaattaaacaagatagtaattgtgtaacagatctagacaactttttcatacagatatttattttcccaagttcaactagggctagagcggtttgtagaaatgtataggtctaaccaatgcttcagttcacatggtctcttgctgtacagcaacagccaggtgagttctaagtgtcaaagtgcccacaaaaactgcagtgtaagtgaagctaatctttggtgtctaacatatttttactgtgtattcacttcccttcatctttttgcattattttctgtctcaaagcaatctgttctacatccttccccatccaaattcccaacatatgttggggtttaggcaataatatttgaggcaatcgtagaggaatgtccaaatgtgtttgaatgaggggctgtttaacctcatgtagagctatttgaagattcagaaatgtacttctgaagcccgggtctgtctttaaaaggccagacttggtatatcagcacctattcagcacacgcacaagctgcccaacaccacactcagctgaccgtgctccccgccacctatcctctccactgatggagtttcatttttctatcaagagcatcaccattttgcttgtccagccccaaaacactgacatcatatttgactcataactcctcctactatcctcatgttggagcagatcctactgatatgaacagaagccagagaaattctaggcagaaaagggtgattccccagcaaaaccccaccctcaagctgaaaagcctgaaaccatggcccaaagtgagaacttgtatccctctttacccgctaaaatgttgcctttcctaaactacctataaccatgccccaccccatcctgtgcccataaaaaccccagacttagctggtaggtgggactacagatgaatgtcagagagaagcagcttgactttggagggacagcttgacggcgtaacttcggagaagaatccagccagagacagctggattcaaggggaagactacctacctgcccatcccctgttcagctccccttcccactgagagccactttatcggcaataaaatcccccacatttatcatccttcaatttgtttgtgcaacctcatttttcctggatgccaggcaagagctcagaagccaccagtgcaaatataaaaggctgtcacactggcctttgccctcgctggcgggggtagctgcctcatgcgaaaaggcagagggcccactaagctgttaacacttaagccgcccgtggacagcagagctagaacagcactgcaacacgccctctggggctttgggagtcacaggcacccccacctggatgctcgaacggggactgcatggagttcgctcctgccagtgccaaagcggccagcgggttccagcgctcatgcacgccagcttccactctgcttgctggtgcactccctcctgtgaggagttgagaggggcaggctgagtaaatgaggcacccccctcgcaagtgccgtgaaggggtcaggggaatatcctgcatcgctactgtctctttaaaatctctccagaacctgcacacctctcatcaccaccttctgtttaccacctaacaccttagtctagctttccagtaaccttatggtttttctcccttcctccattgacatcacctgcgttccactgttcccaaagtatccagagtgatgctcaaacatctgagagacatcaggcattctcctattcaaagccctccagtcacctcccatctcccctcctttgctggccggcagcatcctctgtgtcctgggccctcactgcacctctagctcatggctaccactcttcctctttgtcctccagcctctaatgaggctggctacctcgttaagccttggacactccaagcccacactgtcctctccctggagccccaggtctctccttgagttcttcagatttatgctccagcacctctgtatcagagacctttcctaactgccccatataaaatgcagtcctccatgtttcctttgtcttttaaaagtttttctgcagaacacttcttatcacctctcatcttacgtgtttgctttttatctctttcccaccacaaggattagctcagaagagcagagactttcatcaggagaacgtgattcagaggcaggaaatttaatcatggggtggaacctataaggacgttcagtccacgtactggcatcgtgtggctctacacagggtagttaggggaagggatgagtattacaagttgctgaaaacaatatatacttttttcctttagcaaatgcaaagaggtagtcagcttcaccacttaggcaaatgcagaaatattgctgctgtggaaaagggtgcaagagaaagtcagagtgaaacaaatcggtgctttataatttagtgagtagaatctgtaatcattactataatttaatcattactatcatttagtttcccactgtcatgatattgcagcctggtacacattaatattgccatatgttcatactgcacaccattatttgcctttgtcgttttgtgtgaaactagacaaacatcacaatctgactttggactctgaccattagcattgatttcaaacagtgctgaggcaattctgtgaaatatggaatcaccaccactacacaggatcttaaacttcaattctagaaatgggatggaacagctacccacctatccttaagtataatgaaaaaattactttcctggtgataacataaccttcattatttaagtggatatatggttgattttctatcttacatttaatttccttgggttttgttaaaattatgaatgatgaggcattgctttatcaaaataatacatttgcattttaacagattttcttccattctttctaaaggagtatctcaaataatgggaggagtcagcaggctagagtgtaggatattttgcagcagtgtcttgctttcagcttcacgtcatcccattgctccctcagccagcctctgaccctacacttggtctataccaggtttatatactgagtttcatggatacacttaggtggcattaagtagaataatggcagatgtaatgtttatataacttcacttaaatttagtttaggcttttttttttcacctcatcaacacagaaaacctataacctaaaatttgtgcagaaatgtgtttcacaacagcaattaggtatacaggtgtattaatctgttctcgcactgctaataaagacatacctgagactgggtaatttataaaggaaagaggtttaatggactcacagctccacatggctggggaggcctcaccgtcatggcagaaggcaaaggaggagcaaagtcatgtcttccatggtggcagacaagagagcatgtgcaggggaactctcctttataaaaccgtcagatctcgtagatgtattcactaccacgagaacagcttgagggaaaccacccccatgatccaattatctccacctggccccacccttgacacatggggattattacaattcaaggtgagatttgggtggggccacagagccaaaccatatcaacaggcatgctacctaaacctctcaaatcatttaaaagtttcacttatcttcagaacacatgagtctataaagaaataagcaactgtgttttgggttataagttaaaggcttgtaaatcattaaaaagaagaccactttaccatggcatttttcacgacagattttttaaaaatatcaacattttctcattaatctccatgaatttgtttgcaaagaataaatttacttaatcattagctttattctgcttttggatagcatgactaaataagttgcctaaactgaaagagtgatgttaagactaaaagtagaagttatcagtatttatgctgatgtaacaggcataaaatgggattatgccaggcaataaggcgaaaaagagatgatgtaacaaaattccttctattttgatattaatttagtctccagcaatttatagcttttctctccaagaaacaccactcctgtaccccaaggagatagtaaagttgagaaaagccctatgaaaaggccaaaggaacagacacgaaataaaaaataaaataaatatttagtttaaaaaataaaaagaaataatttaacctagaataattaagactaaagaaacatgagactgaaaatttaaaatcagaaaaaaactggtaaagttaactctatttttccctaagccctaacttaccaggattaaaagacactccattatatttcaaaattgtttttgatagaaatagattaaaaagtactttatgtagcgagtagaacatttctggaactcaacaacttgaaatacaacagaccaaaaatgtagacagaatctaaatcctttagaaatatgcaggagtgacagctccatccatgttttcctccctcgactacaagtggcttaaagacagaggtcataaaaaaagagtgaaaactactaaatgctcaatagataaataataaatcttaagtgcttaataaatgttgctggaatgtgtaacagaatattctgaaaggaaggctattcttaacagtcatgcccactgtgccatgtcctacaatgtgactgctggagagagattagaagtaacatctttttctatggcaagccacacagtcagagacctaagagaaagtagtcctcttcctcttctaataaatagaaatagacagttcctatatcatcagaggatttcatagaaaaagtatttcataacgaaggcttatgatcctgattatgggctacttttaagaactgtggcatcacctgctgctcaactcccagacagagatgggcgtggtctcccgtaacacctgctgctggggcaggctggcgaggtagtcaagagtgtagatgctggagccaagccagctttgtgaaaagcccattctaccatatccagatggatcacttcagaaagtgacttatcctctctctgaacctgcccacatttcctcctctagaaacagggataacaacggtgccaacctcctggggtggctgaaggacccagtggatgcgtatacacgaagcacttagaagtgagtctggcaggtactgccaaaaatgtgactcctgctgctattaaacaggggatgttgccttggcaccgacaggtgtgactagcggttgaaatatttcagatacggggccccttcttgccttggtccctcattcaaatgaattcacgaatcaggttttctcttgtataaatgagttttttttaagggcgtctactaaatcttggtttgaaggatgaattcttctgggctcacatttgcttctttactccacagatggtggagtaaaatctgtgttcattgcaccttccgctggtgctttaggctccaggagcagcagctccctggattgagtgggagccagttctgcctgactggtctcaccagcacaccagactgcgcaggcgggtcagaggcccacggggaggaaacatcagtggagggaggatgctgtgagcggtccacccctgcatgacagatgtccctttacagaaaagaagtgggaaacagactttggcaaagggaaacggcagagtagcaagatgattttgattactagtgacatttaattgcaattagatttttaaccacaaccaagaagatgataaagcttttccatgtattttccataaaactgtccgagcttaggacactttagtgctcattcttcctgcaacactacccaccacaggttcactgtattggaagtatactgagaagagctcgtggctggcgtgggagcgccgctgtcttcaaacctggaagtgaagtgcacccacacccagccacagcagtgattccccgggagcgaccttcagggagttgctaggagatggccgctctgtgtttcctttgattatagggcataaccctgccactgtcaaaatgccagaagaaaagggcagtgattgctggacataatttttttctgttacttcctgtgagatattgttttgcacaaagggaggagactaagggagccatggatatctctgtagcagaaacatggcaactattatctgaggaaggccgacatcctccaatagcgatcctgtgtgcaacgcgtattatttgcttcttcaaattgagtcgtatctttcagtaatttcttaagacgctagacggtattacacataggcatggggggtggcttgtggtttaaaagcagggcttacacatataggtagaagccgcatgtggtcaaaggagataaagtaccacaaactgaggagtgtagttagctgggcgccctggattgaggtaaagtagaaaaagactgtgatacttctgagcccaagacatttcactctgccacactatctcctgtatatgcagttattagatagacaattctttttccgtgacagccaatatcaggtagggcttaaaagtcacaatctgggtttacaacacaactcttctgcttattagccgcatgacctggggtgagttactttctctctctgtgccttggtttctacaactataaaaccgaaatacgttacagtaagcacttgataggatcaccgtgagaatggaatgaaatcatatatgtatggccgggcgcagtggctcacgcctgcaaccccgacactttgggaggtggaccacttgaggtcaggagttccagaacagcctggccaacatggtgcaaccccatctctactacaaatacaaaaattagctgggtgtggtggcgggcgcctataatcccagctactcgggaggctgaggcaggagaatcgcttgagcctgggagacaggcgctgtaggaagccaagatcgcgccattgcacttcagcctgggtgtcagagtgtctgtctcaaagaaaaaaaaaaagaaaatatgtaatatacttagaaaaatagctggcgcagaacaaatgattacagaaatatgagctatcattttcattattattattagcatcataaacattatttcgttgtgctctgaatgcagctgaacagtactcaagagtttcaggatcagttgtataaaattacaaaaaattagaaggtcacccatcttgagaaaagacaagtttgtataaacaggacaaactactgaaagcaggagagttcaaggaagccaagagaagctgagaaagttttcttaaatctgctgtcttgttggttgctgatcaccacctcattctccatgataggtgcacagttggcgtacaggttacctagggctggatactgattgagcatatcctgtgcacaaggacacctatgtttattccacttagaagtctgaggttgttctgaatgtcaagcaacaaaacaatgcacttctttgggagagctggggcattccagattctggtcattaactgggtgagtgtctttaggcatcattccacctttgtggacttctgctccctcgtttgcaaagtgagagagtcagacactcaggttatgttcccttaatctccacctttaaaaaaaataatgttctgatctaccttcataagagcagttgtgtgccttaattttctttgcaggtttgctctatgcagacctgtcatgtggaaactcagagttataaattagaaacaggtaaatgatttatttttgccctgcaaatgagtcacactctctacaagtggattattaaattccattaaataacaagcttgcccaataattctaaaatagaatctggttttaaaaaaaaatcggtgtacctgttctctgttgtataaagaaaggtatgtgatagcatcgttaaagtatatgttttagaaactactctggcaaataattttcttagagagaggttaccgagaaaagagaaaagaaaaatttagtttttctggcttggagaagcagcaagtaaaagtcacagctctggaaccaaagcaagaaagctccttgaagaatgaggtaatcagacttgccggtaggtactctcaaaccagcgtgaactgtacactgcaattaattattaaatgtgctcaggctaggtcaggctatactaacagaattcagacacgtttttctctccagcatttggttatcagttttgtgacatatagagtaacagttataaggatcagtttctgcaactccatccctcaacctacttttttattgtaaatagactgaatgtggggaaaaggcaaagagaaaaagtgctatgcttcaagaacatttgtcttgatattttggtggcaagcatcatcaaactaactatatttggctctgactagcttagcatgagatgttagtttttagccgcaaatgagtagcacttgacaaggtgagaaatcttccttcaattgttgaaatcatccaagacgtgtttctaatctacattttgaaaacaaaagccctagcataatgcaataggaattcttcttgcctgtataactggattctgctctagggtcttgtgggatggttattacacatggcagagaaagctacgtgtcctcttgcacccagtccctcttcttaatttataacggaagtttcagctgaacacatggctttagccaggctaagattacatttttcagtttcccttgttttatcaccaaattttgaccagtgggtgtgagaggaaatgctgtgtgcatcttccaagaggctgtggccttaaaggcaagaggtgccctctttgcttttccctttcctgctggctggaacgcagaactgatgtcaggagctggggcagccctcttgaccaccaagggaagccatgtttagcgctgagaaagacagagcaataaatggaaggagcccaggttcccagaattgtgaagcctccgtactagccttgcaccaccaatctgtacttttacatgagtgagcaatacacatcttttatgtttaacctctgttaatttgaatctctgtaacggcagctgaggttttatcgcaataaatgtattcccacagtcagaatccagacaatttcaatagttccattttatatttatgtataatcataagaagaaagtccccaattttacattaaactctgtattccttctaactgtcttgggttgagtgacacggcggctattgaacgtatttctgtggcactgtaacccagtagatcacacccatgcaattgctttctcttccttaggcccaggtcacttcacctgcacctctttaaagactgtatttcctttctgtgtccctccctccctctctccctttcttccttccttccatgtatctaagagattggcctgggcctccggtacccaggtgctctgccttgtgactccatcttatgtgaaaactgtgccaggtgctagaaaacagtttgcaaattatattttggtttggagaccttgaggatgcatttactgaattttttgactggtatttacatgatcatctcaaagaatgaattgcagttttttcacagtggaggtactgataattcaccccttgaaatgaggccgtgtgggatgagcaaccttgaaccaggaccttaaaagcttagattccagccacggctccgacacaaagtgacagccgcgtgaccgtaggcccatcgctctgtctccctgggcctcaatcttctcacccttgcattgggaatgatactaaagttcctcatccacctgcctcatgggattgctcagaggatagtgtgagacaatctaccacaaagtacaactgtgagccacttcctaactcctgctttcccacctattcttttttttttttttttttttttgagacagaatctcactctgtcgccctggctgtgatctggctcactgcaacctctgcctctcgggttcaagtgattctcctgcctcagcctcctgagtagttgggattataggtgcctgccaccacgcccagataatttttgtatttttagtagaaacggggttttgccatgttggccaggctggtctcaaactcctgaccttgggtgatccgcctgccttggcctcccaaagtgctaggattacaggcgtgagccagcatacccggtccccacctactctttaactatgacagatgtgaacgtttgatctctttgcagacaagatcagcacggtgactgggtctttgccctaccttcctaagcaaatgacagaactggtagcagaactggagcccctgaagcttctgcaggcaaacttcctggagcagcccaagaaagtcagagcccctccttttcgtcacattcagttggaattttggaaaccaagcataatggagaaataacttttttggtatagccggaagatgaacccttgggcacagtttcaaagtcaaatattttactgtaaagtggaagaagaaaatacccagatctttctgcatagtcaagtggcttatgttttgcacgcattggaaagaagggaaaacaaaagctgtcttagaagacgaaatcaatcacatgaggagtggcactgctccagagagctgaggtcttcctcttaggaattacagactttggttccgtataattaggccctgtgttgctcaacttccaaataatttagagagaattatcatgtgagagtgcacatatatacatttttttccaaaacaaccttctcaatatgtagcaaaatgtagtcaaggaagaaaaaaaatgagaagttctttagatttcagccaaaacaatcacttaagctccaagtcactatataaacaccattaatacctgttaaaaggtcgtgaattctgtaagagatgtttggaacaaacagtgcttcagaactacccacaaaaataaacaaaaaagagatcatattatgtcactgggtccagacaggatgatgaaacggctatgatcacgtataagctttatctatctttccagagaacagtgtcagggacatatgggttactttccaaattttgtttaaaaaatatgaaaaacatctgtgaaattctggtaagacaaaaagagtttctaattctttggatcgcaaaatgattcttcagttctaattagctatgataaattatgttaattctaaattattatcattcatgtgggcatttaatttaaaaagtggcattatttggaaaacagtctctgcaatttattctaatgtagtttaacacgaagcagctacattgcctttttggatattttcagaagtgtgaaaactgtgaatatcacttcaggctttgcagaatggtactctacaatgaatctgtgtctggcatctgattggtgataaaaaaaattattgggaatagattattagttattctgagacagaattttgagaaacttgttgaaagagtcttgtttgaagagcccataaggaacctcctccttcacacccatactctggctaagaatgttgactcttttttcttaattaaaggctgaatcactgataatattgttgatattaagtgcctactaaccagcagcatgagcttttaacacttttaatgtcacccaaaagcctacccaaagtgcccaggaaaataaacagttttctaagattcagtataattttattttgttttgtagctaaaatgcgccagagctgtattcatgtcatcacagtgggaagaaggcaaacatctgagaaattaataaatcccacagccgatctgagctgtcacccaaccccaaagggcctcagtatctgcatctgtatatggggataactcagttctccagagtttgtaacaggcctagcacagtgcctgcacatgtaagagctcagaaagttatttgtaaattagtaaattaatttataaaattgtaataaatcaataaccattaaaaaaaaataaaataaaataaatcccacagccactaaaagcatatcgtatttggggcacaactctggccatagaggcaagcacctgacataacacagatggcttcttgctggtagcatggtggcaacttcgctgaaaacacagagacaaggactgtttcactctgtctcccttaagaactttgaaaacagttttatgtctttggagaaggagcaccaatttagcttgcatcatggatcatatagaacagggtatgttttaatgtgctaaaacctaagcaatgtatttaacagagcaatctatttccatgaggttcgtgagaaaataattcagaggctctaagggaagttgggagaagaaaggacagcccgtaccagtgcactcaaatagccagaaagagcagagatgctgattgctccaagcagtagtctgagtcttattctattcatttccttagagtaatttccagtatttgttaaggcatacagaatttgggggcttgaggtagggagtgtgtcttatccatgcttggaaatgtaacagcttttgaagttttgtaatgtttcttttttaaagcaggcatctttctagttccactatctctgtggagttgaggaaagaaagtaattcatagacacagggcagcacgctgacctttcttcagtgaacgtcaaggtcctgggctcataagggaataaggaagaggaacctcagtatattaatccatgggctccagccacgtggcagctacatattttcaatcactttgcttacttcaaacttttcttggtgtgccatgtacattaagaacagataactaagaagcaacccttctcagtgtttttggcatctactgatcagcacctgacattccaagttatttcctcctctactcggcatgccgatttctgtactgttgaacagcaggaagtgctttcaagggtctaataaattagcctttcgttgtttcaacttccaagtgaagttaacaataaaagaagcttagtatgaaaaagatccagggtttcttaacctacctcttgtttcttattttctttcagtattggcttttttttgatgatgtttgggtgtttggggagtggaaacaccataaatttgatcttaagctgtgctgggacaacttttgcatgtttttattgaatacttgggatattccactgcccagagagttaaaaaaaaaaaaagacaaaaggatgagcagctagttaatagtcttcatagccaccagttatcctttaatctagtattttctagagtgctgtgatatttgcagaattaacccacaaaacagtatcctatgggccaaccggtgatgagactgagtttgcctttgagaactccggtgggtgttctaacctaactttcctacctctcttcactgtcatttatattgttgcctgaggactcttcctaatacctagccaaagtatggggggcctctgctgtctgagaggtcaacttctaacaatttagtgtgacctcaaggccaccccatgacctgactccattctcctttttcactctcgtcttcggccacctctctcaatttgccagactatctgctctccctggaatccaccatggacgctcatgctgtttcccgaatctggatgtagaatttccctgacctttttatttacaaaattctacccatctttcaagattttccttttcctgagttgattattctttgtttctgtgttctcaaaacactttccttgagcaatgctaaatactagtttccttcacgtctgtttctctcaccgcagcatctgtgagattaaggatagtgtctttttcaccatttatctctcactgctcctagttcagcaccttgcatatctttcatgctcagtgtacttaaaaacaaaagaatcatacataagacggtgttgccagtttatcatttaatgaagaggcttttttcttttatcaattatggtaaatctttgactagttcaaaaagggatttaggcagatctatttttgagcatttctcctgttaatatttatattgaacttcagccttttggggtcaacagctagaaaccatcacagcctgctataatccattagttacaaaaggatggaaattatcctgcaaaaagcgccaggctgcagaggttcttgtttggaattattacactgctgttggatattctaactacccacttgtgttcaaaggagaagcggcatttgagaaagcttctaaatgtgggttctgccacctaccatgtagaactctatgccagtgggtcaaacatacttgccgtctaatttagcatcccaatatagattctagcagagcttctttgacatagctaatctctctgagtttcaatttcctcacctataaacttgggagtaacgactttgtgtggcaagaaccccaagtaattaatcaaaattctaactttgtgcttggacatagggattgatcataaatgtgggctattattgtcttgatctttgtttttgctgttgttcatatagtacttattaatatggcttctaatttcaggtttgtcatttctgtcgttttaattttattttatcaaataaattatcataataatcttttcattggctctcctgtccctagttctccccctaatattgatctctctccttttaattccaagctgcaattgcaaggctaatattttgaaaggaacactgacttcacattatctattaataaattctaaaccaagcccaacacaacatgatcctaacctaattttcaagaatttattttccttctcagtttttttttgttttttagtcaaactgaactttttgttgctcctttttttgtacatttcatgttttagccttcatttgagtttaattagcacattttaaccagatgcctacattgtgtcagatattttctgggtagtaggagtgtcaggataatccaaaagaatccctgccttccaggagcccatgactggtgtggcgaggcaggtgtgattttgattcatcttttgtgagatgttttattcgttgagattacctctaattactcttaaaattacacacagttttagaagtccatctcaaaatagtcccctatgaaaaccacataaatccctctcactcatttaaactaatatagttccttttctgtgccacttcatcttgtcttactttatgttatttatgttggtgttttcttgagggcagggatcatgctttattcacatctgtgtctttcatcgtaccttatgtataacaggcttgcaataaatatgggttaaatatcaaaggaatgtaatagtacaatttgactttaaatagaataataaccaaagttttcagggaccatttttcaaaagacccattcccccaagatacttaacctacaatgcttactttgtataagctctgttacttaagctaacaaacaatagttctggaaacctcatatacagaaacataaggatatttagatgtataatatattatatatataatatattttgttacaccactagacttggcttgaatgaaccagaatattgcttgcttatttccttgatgttcttttcttacacggtttgttctacaaatgtataaatattaatatattagaaagttatagaaacagatgaaggaaaaatagacacaaatatagtatggaagcctggacataaaccagggatttcagaaatagaagctatggagatgcatccgggaggagggtctgttttagcacatttgggcatgcatctttaaataggagacacatttctggaaggaacatagggtcctgtgggtaaagtattgggttgccttgttttatatttacttgaggctattacagagaatcaactacagtgtaaagggagagcaaaaccaagcgagtttggatttagggacattaagtacgctttgaacagatcagaagccctggacagacgccaccacaaaagcagcagcatctggaagtacacgtgctcatctctttgtattgcttggtgtgatttccatggctactaaacgagtcattcacttcaacctacattgatgtgatcaaaatagtttcatcagagcaaattctcatcccctctgaagagtggacagattcttaaggattgtccacgtttgtattaacgaccctattgcttatgccgtcacaattacagctaaccagataggtgcagtcaatggattttgtcaatgatttaccttcaaagtaacaatactcacatacaagtagaagttaaaaggatttcaataaatttggtaattgactttttaactatacgtttgtgtcaggcatttatacttagcaaatcttatttatttcaatgtatttgattgttctgaaatcagtgacaggttaataactttgttatcagattactaaattaagcttttatcagatcatgtttacattaaaaaagaaaagcctgaagacattattaacttcatttcaacaagcttctgtaaataaataggctttcattaggaaaccagccctatttatcaaggttattaaaccattttgtaacaaaaagcatgatttacaaaaatgtcccatgattaggcttattttattttgatacgaccaggtttgctacacattttaacataaatcaagataaacagcttgttcagaaaaaataaagcttcagaaaaatgcaccttaatcactgttttgagttactgattaatgtttgtccctgaatctgctccagacagattttatgttttctttgatgactttcactggaatatggttggcttttatgattaaacccatccttatggtataatccttgactaggagttagacattgaaaaacacttaaaactatacatggtcaatttcttataattgatttttttcagtaaactcatggagaataacttttgtggtgattattagaatgttcaaaaacatatttctattgtgaaaacccagtgcttgctttctgagtctgcgggtctatccagcctgcccaagaactcgattcagctaaggttctcccttccattatggagcctggaaggttttatgcaaaaccagtgactgtgctccccgagaaagtccactgagtagcgtgctggacagaacctgaccaggactccatgctttcaagctctggttctaccgtctgttacttaggcaaatgttttcacctgactgtagggttgattaaggcttttggcttgccccaaaaacccctgtatttctggatgggaatcagttggaagtattttgctagggtcctgtctttgccattccatctagctctagtaatcttgatggctcttatctcttatgctctggatgaaaactggtaatacttctttctccatttgttttgtgtaagcatggtggtcggtaagatgatttctggtgaagcagcaaaaccacaggctcttgtttctaaatctggttaactgaatgccttctgtgttcacctgtcatcacaaaaggatgcgcaggagcactcattattttaatcggagtcgttcctaattctaaagttaatcatggcgattctcagatcagggagaaaattaattaagatgcaatgctattttcttctctcccagggtgacatctcccaggtttctcattaaatcgcccatttagtgtttggtttcagtgctttggagccaggcagaccagatgcaaaccccagctgcatgtgccatttgctccctgaggggcagagatgatggccttgctgccagtggcatctccagccctggaactgtgctgggtgcacacgaggagccaaatgcatgttttctgaggggagtaagtggaagaatgaatgaagtcagcccttccatctcttcttccttagctgtcaaataggatgacaaaatacctatttgccagtggttgttgtgaggattaaatcatagatgtaatgcatttagcacagtgaatgggcacatgagaagaattctataaatggcggttgttcatcttcctacaggaagggcagatctctgagtcatagaaattgcttcttatttcccactttcctttatttccttatgtggtgaagtataagttccactggtattcaacaagtaaaactcttgttcagggtaatgtgctactaacttttaagtctgcatattttaaaatgagagaaaatctagttttttcattaactttctactcatctctttctgggcccgctcagcaaatccccggtttcagaggactgccctgtaaggaactatagacagggtttccatccgtatttccattttctgaataagtaacaaggggaactagactctcagggcctcctctgcctgcttcgtccttatggagctgatgtggggagaacactcctcactgtccagtctagtgatgaccacagttctgtagccacgtggatctgtgtactcgaggtcagttagttccagaaaatcatccagtctaacatttgctcagattccctaatttctactctgtgaaagacaaggaatagtacagctcttcagtttcctgggggagtgcttcattacttttcctctttttctttctacttagtctaatgactcagattccagatggttctgcctaagtttagaattatcatgatctactttgtagagagaaaagaaaacatttcttgtacagtacaacttatgtaattttttttcagggaagtgagaaaaatataacacgcagtgtagaagaacttttggctctaacattagatatcaatgtttcgtattctgtcattggggtgtattgtaatttacttatttactgtctaattccttctgtagctagtgaagtttacattttcttttttctttttttttgagatggagtcttgctctatcgcccagactggagtgcagtagagccatctcggctcactgcaagctccgcctcccgggttcacgccattctcctgcctcagcctcccgagtagctgggactacaggtgcctgccacggcacctggctaattttttgtatttttagtagagacggggtttcactgtgttagccaggatggtctcgatctgtgaagtttacattttcaaagaatgttttaatgatatggaaaaatattctccaaacaatgatgtgcaagtacaaggtacaaaccaggaaagtgtaattctaattttttttttttaaaggtcaatatactttcttttttttttttttttttggaaaagaaatattcctaataattcatttaatcatctggagagtgggttgaagttttgtaaaatttaatttcttcattatagactgtattattttaataaaagcttttctttggtgtcacccattgtgtgcagcactgagctggggccctggagctctcactattgtccatctggccgcaccactgtcagcactgctttcaatgaactgtaacagaatactgatgactcagcatttctgctgctgacaggaagtccttgagcgagtctctttgtagttcctccaagaaaggatgctcaggcactccttgggtgaacagctgcaggccatggagaggacaaccgggttgcagtagtaagtttgcactgggctatcccagagctagaacaagggaacaggtcagcccctagagtcccagaggtcacagacttgggcaggtccaggcgttaaatgcagctgtgcctttggagctggacatccaggtacctggctgcctgctgggaacaggtgagtatgtatcagccattgtgaagcctcaaaaggctgcagcctgacgtagctgcagatcaggctgtacccaaattgcattgttactgatgaaataattttttaaaaaaccaatggtatctatttgagcattttcctcatggacaccattcaacagaatgctgttctcggggaacaaatgactcatgcaaatgactattttctaggtttttctcatggtcaagcagccatgatctttttatagctttattttattttaactcagtcccaatggttaatttaaatcctttctttctttcatcaatgatacaaagagctcactttactacagtctcatcttgacagagtcaaatgcagaggctgtaaggctgcccacctgaggaggaggaactggaacttaggaaaacagctcagatgcttcatgcaaatgaggaagctcaattggcttctattgaaaatacctcacgcatcattttctcttgtctctacttgccaaaatatttataaaatatctttgccctgccatacctaactaagcctcttggaatttattttttcagtgagattctctgatgcaataaccaagcactggcttttagaaagtgttctctccccctccctccctccctgcctgtctctctccctccctccctgcctgtctctctccctccctccctgcctatctctctccccctccctctctccctgcctctctccctccctccctgcctatctctctccttccctctctccctccctccctgcctatctctctctctccctccctgcctatctctctccctccctgcctatctctctccctccctatctctctccctccctccctgcctctctccctccctccctgcctgtctctctccctccctccctgcctgtctctctccctccctccctatctctctccctccctccccgcctgtctctctctcttcctccctgcctatctctttccctccctccctgcctgtctctctctttctctctctctctctctctctctctctctctctctatatatatatatatatatatatatatatatatatatatatatgtctgtttctctgtctcactctagatatacaatcaaatcagtgtgcagatggaggacaaagagtatcacaaaattattattgtaacttgtggataataaatttcaaaatctgatgtctgtgctccaatatctgacctccttttttgcaaaatatgcacatgtgaaacctgatttactactgaggaagttaaccctttccttttgaaagtaatgcatcagtagaagatggaaagttcagtggagatgggtgatcttctcaattatgtgcatgagaataagtaaactcccaggcattccgtcactctccaaagtcagaacaatcaagaggacacatcaggctttagaaaaactcattcccttggaagataatctcaatagcatgtgtgaataggaagagcatcaaagtgtgaccgagagagtgtcagagaagagtcacctattacaagcatgatcatagtacttaggaaaaagtaagttccaggcttatgtggatattcatatagatattttccagggttttagaggttcatgatttctcagggagaccaaagtgcctatgtgactgtgaggggttattagtcctctgggttctggctttactcagaaatagcctggaccacatgggtcagtcctgccccacagacattaggccccctcctggggcccctgcagagtgggtcagttctgcagatgtgggaagggatgagtgttgggtttgggaaccaaaggctgtgtgttgagcttacagtagacaatttggagctgcttcttgcttagagatgacccaatatccaaaagtagctattgcgggcaagtggtgttccccaaaaaggtatgttgaagtccttcctcacccccagtacctgtgagagcgatcttatttggaaacaggatctttacagatgtaatccagttaattgaggtcatactggagaaaagtgagccctaaatccaatgactggtattcttacatggagagagagatttggagacagatccatagaaagaacattgcgagacaatgcaggcagagatgggtgatgctgccataagccaaggactgccagcaaccaccagaagtgggaagaagtgaggaaggattcgctgctggagccttcacaggcaacccggccctgctgacaccttgatctcagacttctacacccccacgtagagtgtgagacaatagatttctgttgtttcaagccacccaattggttgcactttgttgcagcgctctagaaactgatacagtggctcaaacagagcctctaggtgtctcttcttttgcaatccaaagactgcaccagtgctacttgaaggggtaagagagctaaataaatttgcttttggggagatagatttgggtaagtttctccatgctgagttagatgagtgatatgtggtggtggtaaaatccagataacccttgagtgtgatgatttcagaaagagagagccaggaggcctgggagccagcaggccagcgggggtccgcccactggccccgaaacagcgaacagtgacattggagcaagggcccatcccgtgcttctctggagccccactgggcagagccaggtggagaagcaggaaactgcacattggtgggctggaggggcttggaggggctgagacaaggtgtgtgcttggggataagggcgttcctggtccccggtgaagcatcagtgaccaagaggcatcctctagaagaggtagacactacatgggaagggagaagcagcatgaaggaaggcgctttaggacaaggggatcagttacagtttcttcgccatgtgccttagacctacagcttgctattccactctgaaataaggcagagtgaagaattcaaaaacaatcactctgggagaaaaaagcgagttctcttgatatccttgctttctcctggcctcatttcctctgatgttcccctgccctcttgcaaatcaatcagcctaaatcaagggtgtctgtgcaggttctcaagacagacatgctgctgggagtggcacgtacgtgaacgtcaaggagatgtcagggcatgcgcatattctttggtgcccaccgtcttattttcttaacttactgggaaatctttttgttagagtgcacgcattaagtttcttcctggcctcatcagccccaaacccaggcagtggcgggcggtttcccgtgaggacagcgtaccttctgaagaaatgcacccagatcagaatggtatacgagtctgtcctattctcgctctagaaaagaaatgtcacaataaataggtgggtggggtctgccccacactccccaaaacaaccaaaacagcggcgagatcaaactgaggacaacgttatcatcatatattcttttctttacacagtttgatacctacctacttctcagaacaaacaccgcggaaaggaaactgggtggatacttactgtttttagtttgttacatactacaattagtcaccattagctaattatatagaaaaggggaaattggggctgttttacccagagttggttttaggtgggggtgaagcaggcagggtgatattggcagcctcatggttggttttgctgattcagttcctctttccttgccccctatttcatacaaaattcctctgacaaagcttcctgtgtggccactggtcagcattttaatagaatggaagggtgcagcacagcaaaggccatagtgttaatatccctcgcatctgccgttcccacctcctccttgcttttccagtcctttccaactctgcataggatgatggggagaggagggagctaggaagggtgagaggcaagcaaagtcatttccagcattttaaagtcagctctcccaaaatgctctctctctccatagccttctccctactggggcttcaaagccttccctctacctgaaaccactcagggtgcaaggaagcctcttcaggtccccctcatccttgatcattacaccagctcttgaggatcctttctttctctaaatttggcaacaatcttctgttgcagactcttttcactattggaattccctttcagggactgctctctacaacttatatggctgcagcagcagcttatctgaccatttaaggctctacactgtgcagacagaaaaggatcacactcctctctcagacacattataagaaattttatacaaggcctgtgcattttcaaaacacaggattgacctaatgagcaggaatttgagaccaggtaggaaaagagggtcatgggatgtggggagctgcctgggggctggtgggaacttgccaggggtcctcatatcccttcatgagacagttgcctaatcagcctatttcaagggatggccctgatttcacggtgaaaagcaaggcatgtttctgcagatacgtcagtgctctaacagcaacatgtcctctgctaggaggacatcctaggagattcgcttccattgaatcagagtaaactatttttttttttttttgcttcttggcagaatattatttgcagatatctgcaaatttggtaggaaagcttttttttctaaatggaactatcctgaaaacaaagggaaaaaagggcaaacacacacacactcacacacacaaacaaacacacacactcacatgcgagccttcccccaaatccttccaagtcttcattctatttaagctgttcataaataatatctgatgataatctcattgaaaatgcatctgtttttatgttaatttttgttaatttgacatccctagacgatatcatgaaaatatttactgtgtgtacgtttgtgtgtgtgtatgtgtgtgtgtgggtgcaattttgtccccttagtccatgatgaattaaaataagtagtttacctatagataactaaaattctatacatgtcttcatgaagtttaccttatttaaccgttgcaattaacacatatcccagaaaaatctttaaattttatttttaatattatcctaatgttgctgagttcccagcaacacaattatttattgcagccaacatctaccatgcttactattacagcaagctcttttccaagttcttatatcaataacacacaaggcagggcctgtgatatttcccatttgtggatggagaagcagagccgtggacaggtgccaagtcacccaggtctcaggggtggggtggggtctccccacagacagcctggctcagacacactctccactgccgcagcgcgagggacccttgtcatcatcccacagagtttgccttgtcattgcttctgaagtgcttagagactgtcaatgaaggagcaatctcaataaactttgtggttttgtcatcctcagaaatgaccaatcttcatgaaggtggtgttgtgcaagcctgggcttctattaaaataaaaaagtgtgctttgcacctaaggcaatggtgggattaaagcaagtagcaaattgatgttctcatttaaaagtcttgcctggtctgtgagtgccctgggcctgcaaaggtaaaagaagcctgaccacaaagcaactgggcattctggaggttactgggcagacctgagactccagagaaagtaggaagagaaggcagattgtcagttaatgatggcggtgttcgtttctgtttgtatacttttaacagtctaaaaatggggcttcggacacaatacctttcctaaatgaaaccagtgcctgcttcgttacaggcacaaggtatgtactgtgggtgacatccagcccccttcagttttccagagtctttcctggggtcttgcttggctcagggccactggaacacaacccacccgatgacaccagggtgtgtcgagcctgtggtcaaggttcacacgtctgtgtgtgccacaaccactgcagaggggaaagacatcatccacacaacatcccaccctcagcagggacttggaaaatcaggaacccgatagtccatagttggggagactgaaaggttccccaaacaagcaaggctgctccattttacctaacaataccatacctactggcacggtttctccctgtgccccattgctaacatttctccttcgagttggcatgccaaggaaagcacagtgaaaaatgtctgagttccgggttgctcttagcaacatccatgaatctgagtttctaacctccttccctatagaacagtgcctgaaggaagaactggcaatgctcactggtgtcagaattgcccacgatttttcccttttcagcaattatttaagtgctccaaaagcattgcttccttactgttttcaaggcaagatagaaggagaggttaatcttgcttagaatttcctctgctttcaagttccaggttgggggtataaagaggtttgatagaaaagaaccgcagcagcccaggcctggctgcaggagaaagcaaagtggctggggacagggggtgtggagagcaggtggtctcccgtctcctccatcagggtcaggaatgtgtctgctcctttactggaaccatcgccctccctggatggctgtaccgtttagggaggcctgtgctgacaatacaggtgcaattcaaaagaaattccattaaaataaagtgggcagtggggagaaacggggaattctgtcatgaaacataaaacctaaaatactgtctggtcaaaacctagacagcctgtgagacccatgagagctcggagaccctgctttcggagcataggtggggacccgaggggtggggccgtgagcagggtctcaggccagccgtggagaaggcggctgcctctgcggggatgggcaccgcagcgtggtgggcagatatgaggaaggcaaggactttcccattgaccatgcaaaaccttcacgaagtcagggtctgtccaccgtctaaagatcgagacctcatgttgagttctgaggtaaaatgggaaaacagttttaacagtgcagtgaagcttcctgccaataagcaaacctttccaccctccgctcagctacagaaacacatttgggagctccagggaggaggcggaggggcacaggcgctccccagtgtgggccacgctcaggtgtcccttcacaatggcagccacactgcttcgtgaaacggacacactacgggatggaaaacagtgagagggaagccacggcatcaagaagcaataatcacagaatgtttttgtgctgtccacgccttcctcaacatctgcctccacttccaagtcaatcgagacagcctgtttatgtggagctttgagatgacacatacactttactgaccctagaacaataccctttccacatctaaagcaattttcgtgtaaatgactgtgccattaaccttccagggtcattcaaatattttctgagaaattggctgctttcgggattttcttagaatgccatgtgtttcatttttgtgcagaacagatgacaggcgaggcattccaacaggacttcagttgatttaactaattcctgtcaggggaagtgaagtgttgggattcataaagccgatcccagcccggagattttccttttcccaaaacagaaaaaacaagacatgctgtgtggttttgcaaccgggcaagtttcgaaatatttttaagctttctactttgccaagtatttcataaaaaaactattttctttttgtttcgtgccaaaaaatgtcacccctaaatattttttcccatatctggtcacatgtccaggattttttcttttctaagaataaataatttttctgggttataaaaattccacttgctctatcagattaaacatatctttatatagaaaaagcatccgaaacattccccaagtgggtctaagggaggagtcttaatacaattttgttaaattaattttgattaaatattaggccttgaattctttttgtgactctcacaaagttcaggcttattttgttacactttcaagtctccctttttttcactctccacatactgtttccttttattagaaagcattcaagaagaattgattggtgtgtttgaccaaaataatatgttggaagtgataccagtgcaaggggaccctctgggttccattctctatttgcatagttagctggagttagaaggttcagctgtcagggattcaagaactctagcatcaaaaaagtgtgaacttgcaaatgagctgtcaaggttcatagcaagtgaataatgcagctgagagctgacttgtctccaccctggtgttctattgatcttgctgctggataaagcataggcacataggaacactgaaaaatagcaatttgtatgggttggactggtattttcttttttaccagttaaaatgttaattacattcacaaagtcaaaaagctgaataaatagtcttacagttggaaatatagggcaaaacaaaacacaggcttgaaaaagcaataatagctatacacctaaaatgtgaaaaatattcatagagaaatgaattgtagggcattaactcttgcaaaaccaccaaaggcctggtggaattaatatgctacagatttgaaacttaacattgggcaacttaaaatgcatgtatttgttattgatatttaactaatccttgtaagtaaatctactataagcgaaaagcattctaaattgatgttattgctagtttgcagggaaattctgaaagtctatgtgtttgttggtgcatgaggggatgtgcgtattgaggtgtgtgttcaggatgagggcttctggtcctttagaaatggttccctctaagcttcttggtttccaaatcttcatcactctttttaaaatctaaaaatgcaggtttactttatatggagagcacattgctatgaggagatgtgacatttcagaaagagcacatggcactgattctgaaatgctaccaagttgcttcagaatatacccaaattctctcaaagattaatgatacactaagaaactgaaggacacagcaaattattttgcttgtcttcaacccactgtcaccctgccacaaattgaacctaataaaatttccatccctctcccatcttatgatatgacccttccccctcatgcatggggaaattgttatttacattgtgaaaatatcaagcatctccaaacacttacgttttgtggagccgggtctcccatggtaaaatgagagcccaacacggtgagtttgcttcctaggaatggcaaatcagcatcgcgatgccctcaaaccagaaataatacccttcatttgctgcaactggttgagtatcagtgctataaaaaatagatgatggaaaaccggagcccttgacagaaatacaagtctgctgtgtgtggcttgtgcaggaatggagcagagagaagcggtggtcttgtctacacatcatacttgggcttcgcccatgctgacaagtggaagcacatgcacagtggacacacgctgtcaggacattcatccctgctggcacgtaaacggcagggagctaaactgctagaattcaagtggcacagaaacttgagcctatggaatatcactgtggagtgggcaggccaagttctttacagtgctctttgcttttgcaaagaggtaatttccaactcaagaatgctctgtggctttggcgtcaagaaagctgaaagtcagtgaaatagagccttgaaggtcatccaatctgcgctgcagcaggaagtgaattttgggagccccaaatgcaaaataggcagctcagcccaacattaactcagcccaacactaactcagcccaacattaactcagcccaatattaactcagcccaacactaactcagcccaacactaactcagcccaacattaactcagcccaacattaactcagcccaacactaactcagcccagcaccagctcagcccaacgctaactcagcccagcaccaactcagcccagcaccaactcagcccagcactaactcaacccagcactaactcagcccagcaccaactcagatcagcaccaactcgaaccagcactaactcggaccagcactaactcggaccagcactaactcaaaccagcaccaactcaaaccagcacaaactcagcccagcaccaactcagatcagcacgaactcaaaccagcactaactcggaccagcaccaactcaaaccagcaccaactcaaaccagcaccaactcagcctagcatgcactgattctctggcatagactcagactccaaaaatatgtcgagaaagtctaaccaaaatttgcaaaattaggacctgtggtcagtaccttgactaaatatgactctgtctatgaacacaagtaggcataatgtaacataagacagtaaagaggggcatcgttagaaacctttagcattatgtcagaaagggcaagaggactcaagtagaagaaaggcagagagaataacagagggacatgcatgaaaagtacttttttcttcttcagtcctgcaattgcattaggaacagaggtcaggcccaagagctgccctctcctcacttttctttctttcttttcttttttttttgtttttttttttttttttgagggggagtctcgctctgtcgcccaggctgaagtgcagtggcatgatctcggctcactgcaacctccacctcccaggttcaagagattctcctgcctcagtcaccggagctaatttttgtatttttagtacagatggagtttcaccatgttgaccaggctggtctcaaactcttgacctcaaatgcccgccttggcctcccaaagtgctgggattacaggcgtgagccaccgcacccggcctgtcctcactttttatcacatactcctgctcttgtggccctgcttgaacacagcaacagggtctacataaaataaattaaaatacatttaaaaaaaaattacctgctttacttctggtccatagcattggacatacccagccagaaatcatacactgggctggtttttgggagccaactcaaatgcttgtcctttgaggtaagtattagggtgctcgtggcctcccgccccacgggtccttcactcactgaccctgacctgtgctcactttgtctcaccacctacatttcccaacagttcatgtttgatacagctgctggtcctgccaaggctggaggccctccccatccgctgatttgcctttctctgaaatcggcatcttggctcctctgcattatttctgattggacttgtctctctggcttgttttctctgctaattctgatgaagacgataatctctagctctcaggggccagccctggctacacagtttgggggtagtgttcaaacaacccttgagaatcttatttttcaaggctgttggctggcactttagggctaaagcaagtggtgaattaaaacacaaaacaaaacaaagcaaaaaccacaggcctaaataaacatatgcacccaggagcatgactgtgcagacagactgcctggctttgaatctcattgccaccattgattggccacttaaccttgcatatcacaagatgggaataataaggcacctgcttcatagattgttcttttagtcttctatccgtttgttcattccttcagtaaatatccatcgagcacctactactgcccagacatacggatccagaaatgtccagcacagattaagaggccacagcctcgtggattttccattccagggcatttttcttcaaggatccaataagatatccccctaaactatacatcatagagcctttgacacagtaaacactcacatgccattagctgttatcacggtaacaataaaaataaacttttagcaaaggttttaactaaatgaggtgagaatcataaataaagatatatttgctatagtgaaaaggagagaaaatgtaggaaagtcaggcaagaggaatatttgccaaaatcattcatgaatctgacacattagattctgggcgtgtcctaagccttgacctgtgctacttgatgtgggatttgcacacctgggacacacgagcttctgaagttcagactgtctgcactctatctgacacactccacagctgcacaacttgcagcatgagtcagcaccatcctaacctctaaagagccccgcgggcacagcgaatgcacctcccagccctttggacgtggtggcgaccagctggtttcctggagaggcatctcctttacacccatctgtgaaagaaatctagatctaagccttagatctcaaggttagaaagggggtaaggttgaggttccggagtgctactctattagacacattgtcctttttaaattatatttttacaataatttccatttattattttttcgtggcatcctagtgaggcaggctagtttgacaacatgctgcttaggggaaatttgctgttaataagtcttttgagctcactaaattttggtgcagcatgaaaacccagactgttttcaactctctctctggcatacccgcttgattcctgatagggctattaattttgcgcagatttcccaatttgctccccatttgctacctgggatggtgaagaacagacaaatagcccttcggaagcaaaagcagtcccaaaccaggctgagtttcgtgatggcttcttccacattgtccttcattgctgaggatgaaaacatagagctaaaaactgtgatacacaatgatttatcacctcctttccatgtacacacctagtagtttagaactctgttagcttcaaaatctattcagtcacattgcattcccctccccaactcccacaaattctacatgaaagagggttcaggtagcaaatgagtggaaggacagggcaaactaagactctgatggtgagcccctcctcctcctgattcagatgatttcttcctcctcttcctcctcctcctcctcttctggttctttcttctccttcttcttcttattcctcttcctcctccttcttcctcttcttctatcttctttcctcctcctcctccttctattttctttcctcctcctcctcctctttctcctcctccttcttcttctccttctccttcttctattttctttcctcctcctcctctttctcctcctccttcttctccttctccttcttcttcctcccctcctcctcctcctgtccccctcacctttcccctttccctcctctcccatttccactttcttccccttcttcctccttctcccccttcctttcctcctcctcttccacttccccctttctcttctccccctcctcctccttttcctcttcttcctcctccttcccttctctctttttttgttatttgatctccaattttcacttcctaaaatttcatatggttggatgctattataattattcaattacacaatgattacatgtgggctggtggttttgaaacaatgtaccccattgtatgcattattgcattcatgtggaacttgaactgtaggaggtccatgcaggcttttccagggtccccaagagtactttgtgggttttggatccaggtttctgtttcactaaatcagcatattactctagtctacagtgtactgttgggctagaaatagtccattgactattttagactctgcatcacgaaacgagatctatggttttggttgaatttcatagaagaatattgataaattatcattgttcagatcattaatcttctttagctcaaatcaaacaatgaagtgatgttatcttgcaaaccatgcaggcaggtggtggcactaatgagcctgccacatcggattaatctttgaatgttcagaatctcagaatgagaactttccacaaattcaaaactgtttgatgaactgacaatgtccaagtccaccaaatggtccaacattcagagatgaaattatgtcatgacataagaagcctaatggaatgaatggccactatgcattaaagaccagaatgtgaaaacctggctcctaccattcagacttccctgaaattgtgaaacatgattttccccttcaccctagggaagaccctctggcaaaggcacattcactaagggtgagccttcttttggattgggggctcagaagagagagtcatattgaagtcgcccaaactgttctttgccctggctgcccgctgactttgttaggcagctggtgctaaggagagggtaaagaaaacagaagacacttgtgggccggctcagggatggacagtacctggccgctctccctgtgtgatgcaggtggcttgttctgaggtaggtgggcatacaggcagtgagtacatctccattgcagcgggggaaggtggatgtgggactaatcagggatggagagggagggatgctgcaaagatgcccgagcaggtgctgtcagtggggactagggaagcagtgtctctatccgagagtgcatgccggtggtaggggagcaccaacctgaacatggccagtaagaacacaaactagacctcccagattctcccgcaagtaaggagagatcagggactgttccaatttttggcgttcatattttttagacagttgtcttaaaaaaaatgcctgcttcacttgcgttaagaattaactaatcatggtccagacttatgctcaggtagacaaggaggactgaagccacagtgggctccttccaacctcacatcacatcttcctcatagcacctgtgcacccgaggtgcagatcctgatttgatggcgacctattacaaatttccttagactgcaagcaatcacactatacttaatagctatatttagtagaatacttagattaatacttggagagaatttaaatttaaatattatttccacagccaaaagacaaaacagcaatagacaaatgcattctctttttagttttcttcaacggatatatttcatttttaagcctatctaccccctcccccgatttgaagacatccctcgggctacgtggggaggaaagcctgtgtgactgatcgctgcagtgactgctcttggccatgactgttactgccattttggcctctctgaaaagtgaggcagcctaagcctcacagatatgtttcctggtcacatttttgttgtctctacagaaagagaagcaaacgatatcaccaaagtcctaactctatcctcccactctgtgaactacagaaaaggaagcagcagaagaaataatagagggaataacaaagtgacagaagcatagagggaaaagcagcaggtggcttttcatcaaggggcctttgggtaagatttacaggagacaatgttttctctgcgcctctgggacttgaaaggtcatggaaagaggactcactcgcgacagaattcaaacactcgtagttgtgtctcaaagtcctccgcggacatcaccagaaggcatggtttcaggggtgtttttcagaagggcgatggatttctttggatccacgtagtctctcttatctggttagagtttcttctttttctttttgttcttttttgacacagagtctcactctgtcgcccaggctgcagggcagtggcaccatcttggctcgctgcaacctccgcgtcctgggttcaagcaattctcctgcctcagcctcccgagtagctgggactagaggtgtgcaccaccatgcctggctaatttttgtatttttagtagagacagagtttcaccatgttggccaggctggttctcgaacttctgacctcaagtggtcctcctgcctcggcttcccagagtgctgggattacaggtgtgggccaccgcgcccggccttatctggttagagtttcttaggtgggaatggagttagcagtcccagaccaggccaagttaggacaagctgagaaatgcatcctgtggttgacacatggtgaggaatacccaagcaaaatactcttgtgtgaggcttagactctgtaagaatctaccactttatgaagagactttcttctcccatctaccagattttccaccaaatttgttgcagccttgttatgggctgaattgtgccctcttaaattcatgtatcgaaggactggccccctaggacctcagaatgtgcctgtgccctgtatttgaagacagggactttaaagaggggaaaagttaaactgaagtcattagggtgggccttaatccaatctagctggtgtccttaagaagagtgccgggcgcagtggctcacgcctatgatgccactgcactccagcctgggcaacagtgtgagacttgtctcgaaacaaaaaaggaggaaatttggacacacaaaaaagacaccagacaccagggatgcattcatagaggaaaggccatatgagatcacagcaagaaggtggccgtcggcaagacaaggaggaaggcttcagaagaaaccagacctgctctcaccttgatcttggacctcgagcctggagaactttgagaaataaatttctgccatcaaagccaccagtctgtggtactttgttatggaagcccaagcagactaatacaacctgcaggctttaaacgatgaacaagggatgtgactttattgtaggaccagtaatttgaatttcttgcaaacgcttgagtgtaagcattagtcaatagtcagtgatctgactggaaagaagcagagggcacaagttcatggcagtgtgctcaggggtacctggcccctctgtgaagagccccatagaagacaaggcacttgggccctgtctcaggggcagcacaagcttccaggacaccaccgtcactggtcacttgctgctccccactgtggccctggacagatgagtcaggcccatggtggtcagggcagtggtttctcctcgtcctcccccagcctgcactactccgtgcctggagctgtgaaaaattggcctttgctcgggcgcggtggctcacacctgtaatcccagcactttgggaggtcgaagtgggcacatcaggagctcgagaccagcctggccaacatggtgaaaccccgtctctaccgaaaatacaaaaaattagccgggcacggtggagggcgccggtaatcccagctacttgggaggctgaggcaggagaatcacttgaacccaggaggcggaggttgcagtgagctgagaccgtaacactgcactctagcctgggtaacagagtgagactcagtttcaaaaaaaaaacaaggtctttgctgcttccacagatgctcacatttctccctggctcattttaagctgtgctaaaatctggtaacaaagcttgcttttatttaaggtacattttgtaagttttcgggtggcccactgtaaggtagagagccctgctcttggtgacttgctttggaactagaaaattagcatctagctgtaccatatctgggcacatgactggggcttcatcaggtagggctgggctttcatgaagtaagttgcagctcagggcctcggcgtgcgaggagtgcagttgctgtgtgtgactggctctgtcaccaggagccccgcgtattcttcagggagaattttcaatcatgctggttttgatttaggcaatatggtcttgaaaatattttcatagtctagtctccatcaatcttattcttccacactgacatctgcttccagaatttggagtaaggcgagctgggaagtagggctctgaaatcttgaaggactgcctaagcccccccaccacacagaagcaaaagcagcctccacaggatgccagcttagcaagggaggcctcacgagcaattttaaggacctcagcactgatgacgagagatggtgtgttacggattttgcatctgcagttttgccattagtggcattttaggaataaataaggttgatatgttaactacctcaaaataattttcccattcaattagattttgttagtgaactcactcatcagtttggatagttcaagtagtatactgaaaaatgatagctaaacctggcttatgattagagctggtttacattttgccttcggcaagtggaggatttccctaggctgtttctggagcctcatttattgatgagcttctgtgccctactccaagaagcacctttccacctgagaatgaggggccccatttacaatattcttggatgaggacctggggaagaatgcaggagagccccaagctaagatggtattcaaactcagagcacggcagaaagttcccaaaaagatgttagaagtatggctcggcttgctgctgttttggcttttaaaaaaagattatagcaagaaccttttagggaactccacagccaccagtagggatcggcaggcacattgccccagctaaccactggagtggtgttcagggagggtttgggatgtggatgctgctccaagccatctgggagggagacaggtgcagggacagtcagcatgaaagcaactggggactgggattgccatagctcaacagcctgatgatggcctgaggttgttgccaagagcagctcctaggaactgctccttctctgagccaccctctgggaacagcagagctgtcagagaagatttaattgttttgatcttcctgccttcttgatatcccattgagagtcacccttcagggagaaggagatagagtcgtcattttgtattaagcaatgacaagaaagaaaaaaaacttttaagatgaaatcctgatgggattgaaaatcaattaatcaatcacacagacctctgattcctggtcattctggctcagaattacagacataagtgtgtgacactgtgttaccttagggtatatggacttttagaccagtagaattttatggagagaagaaacagtaaagatacattagttcaatgtatgcattagtgtttaaggtaataattttggtgcaaaagcagaatgggccagatagactagtttgccaggagtttatggatctaatgaaatagtttcagttgctcatttagagaaaacaaatgcagaaatagagaccacagctcttaatgcaaccaaagagagaaaatgcatgctgactaaacgtccacccattaggctccttattaacagaaatgagaagttattctttggggactgttgctctcctgctgctctgtcatggggctatggcttcattttccatctataaacaccaaacactggaaggttggttgctaagagaactcactggggaaacagttaactgttcaaatgtccccacttacgtggatatgtgcaaataccaccctctgttcagatctgcatgttgcagaaagacactacgtgcagtggactaaagctggacgccggagtgtcccacagacccaggttagcacccctgccctgccactcactagacatgtaactcacagcaagttcttaagaactctttcgaaactattcctcatgggcaaaaagaaaaggatggcaaagcatgattttttaagtgttcactgtgtataccaattatgaacaaattgtaaaatcctgcttcatttcatcaccatcaaaccataggcttaaatttgctcataatcccgacaacactgtgtgtttggaaacagtggaaacaggaagaactgagagcgggtctgcattcaggatccacgtggctccaatcataggtgtgaaaagactcacatattccgtagcatcataggacccatcagagtataacagctaagattattacacatgctgttccagtgtcccactcacactgcaccacagaaagctctgcagtggatcaattgctgctgtgcagtccccaacatccgatccttgctgaagtttattgattaagctggctaatacactccttacacagttatttggtaccatattgaaaatacattaattctaaaataacaaacaaacaataactttcaacctctattgctagtttgagaataaaatgctccctttggtgcagtgagtagtgctcatgagtgacagacaatttgaataagaaaactgggctcttgatttagatttttggctgtcaattacatttggaaagttgggggtaaggtacaagctgcttaggaacccttatttcttccccctgcccttttgatatcatttctctctcttctccttgaccttaggtgggtcaaggagttggaattcaaatcacatgagcaaatagcattcaaatgtacatgatatataaggcactttagcgatccaaaaaaaatttacaatatagtttctgtctcaaaaagtttattgccttgtttggggagacaaaacataccacacgaaaagttcatgatacaggatttaaacaagggctcaacaaatcatagaggaattgttatataacatgggttcttccattaaatggtaaaggaatgctcttagctctaaatactaaaaaaaaaaaaaaaaaaagagaaagagagagaaattcaggaactgtccaggtaggattgaggtaaaggacagggacgaaatgaactttttgagaagcatgtaggtggctaagtcagtttggatgttaggaactacactgagaatcaagagatgaggaagaccaagggcaaaccgaaacgagacaggctgagacaaagcgagatgagacaaagtgagaagagatgagacaaagcaagatgacagaagtttggtgatcatcttggacattttgctaaattaggtgaaaaaggagcaagaaacaggtatccttaggcaaaggcaacctctgaccaagcttgatgagggcagatgaggactgattctagcatgagagggaggtgcaggagaggcagctgcccagtaggtcctcagaagatggtgaaggcaccactccaaagagtgtagatacatactgaccacaacagagacagaatgtgtgtgtgtgcacacgtacacatgaacgaaagaggctagggcatcagaggggagaggaaatacagggagaagggaagtcaaggaaagatgcctgacattccacaggagaagcttctgcacaggagcagtggggataacaactccaagatgcactggagaggggtttttgctagagagtcagcatcgcaaacaagcagagtacctttgcattaaggtgcgatttaaaaatatgttattatctaggatagtggtgctcaaccatggcgattttgctccccagggaacatttgacaactgggagacagttttggttgccacagctggcagtggggatgggggtgctaactgccatcgtgtgggtagaggacagagacgctgctgaacacccagcagcacgcaagaagatcccacaacctggctccagatgtcaatggcaccaaggctgagaaaccaaatttagaggatcccagggaaaacagaaaagtatcttaaaaataaacattacccagtattgtacagttgacaaatgttaacattatgcatttattaaaaacaaatgtaagcaacatttattactgtagttagaattttaaaatatgtacatatactgcagcagacttttatttatttatttatttacttatatgagacagagtctcgctctgtcgcccaggctggagtgcagtggcacgatcttggctcactgcaagctccgcctcccgggttcgcgccattctcctgcctcagcctcccgagtagcttggactacaggcgcccgccaccacacccagctaattttttgtattttttagtagatatggggtttcaccgtgttggccaggatggtctcgatctcctgaccttgtgatctgcccgcctcggcctcccaaagtgctgggattacaggcgtgagccaccgtgcccagccctgcagcagacttttaaaaagatatattcagcttcatcacccttttcttaaaaaactgaaattacttctgtcaaaatcatgccgatggaaagcaatgacatgctaagcacagtcctttacagaaataattcagatagaataagtggaaaataaccttaaagaagattgaaagaagcgacaacttaatgaaacccagctactggttccattttctatttatccttccaaattgctaatgaattctgacccatttagtcatgcaaaatatatatcctgaagaatctgtatcccttttgaggtacttaatggatgtttagccggcaaggaaatatggcatgcctattattcacaatagttgatctttaaattgacattaatatgccacacttagagtactggggaaattctagccaaatatacaaagccgctgctactaagatgaaagacattccacaaggaggaaactgatctcagaaccagtgaccacggccatgagggcttcgtggctgctacagcacgttagccataaacaatttccatctgaggaagtgcattcagtgcagctgctgatgcatagtaaatatttgatcctaattggacctaatgatgaatttcaattctgtattcaccattcttttataggacaccaacccataaacacaaaaaataaaaaaggttttggggaacatttttcatttccttaagtcatttaataatgatgaattgcctgggaggctctttgaaaagatagatgcggctagaaagttactgggagaattagaaattgcataaggattcaatgcaaaatactttgtaaaaagaaattttaacttccttgtttaacttattttaattcattgagaaattaaaggtaaaatatactttataaaaatataatctggcaaactttaatttgggtaccaatttggaattcgattaaacaggttcaagtctatttttatagattataaaaatgctcctttcagataaagtaaaaaagataattttgttttgggagttaaaagaatcaatgtctgtgcatcctttagtctcaatagaataactcttattctatcagtaggcagaaatgtttaagcagcactgtccaaaagacatacatgtaatttaaatgcttttaaatggaatagaaaagtgaaattctctggtgttttttcttgtattctttcaaaatcatagcaccaatggatgtgagtttctaacattattcacctatctttttaaaaatttacccctgaatgcttatacactgctggtggagatgtaaattaggtcaaccattgtggaaagcatttggtgatttctgatagaacttaaaacagaactatcattgacccagtaatcccattattgggtctatacctaaaggaatataaatcattttatcataaagacacatgcacgcatatattcattgcagcatcattcacaatagcaaagacatggaatcaacataaatgctcatcaatggtagacttgataaagaagatatggtatatacacaccatggaataccatgcagccataaaaaaggacaagatgatgtcctttgcagcaacatggatggagctagaggtcattttctaagcaaactaacacaggagaagaaaaccaaattctacatgttctcaagtataagtgggagctaaacattgagtacatatggacacaaagaagggaataacaaacaccacagcctacttgagggtggaaggtgggaggaggtgagggttgaaaaactacctatcaagtactatgcttattacctgggtcatgaaataatctgcacacaaaccccccataacacacagtaacccccgtaacatgctatcaatctatctatataacaaacctgcacatgtacccctgaacttaaaataaaagttaaaagaataataaaaacagaaagtttacccttgataacacgttttatgtataatcactaaatctactaaggcacatttgcatattatattatagagtctgctagctctacagtttttccaactgtgtacagtcggccaactaccataacccacatcttccaaatcctagtggcttaacaatggaaaatggaatatccagtgcagctcagtggagtgtggggtggggggctgtgttccaaacagccatttagaaatgatgctccttgcagctattactccaccataccatggggtctcacagtccttcacatcccctgagtccagctgttagctgagaggagcgagaatgtacaggatcaggtatgggtttcatgaggcagacctggaagggcaatacatcacttctacgagccagaaattgtcacacgattccttccaactgcagaggaggctggggaatgtaatctacctgtgtgcccaggaggaagggaaatgggctttgtgaaaatgtgcagcattatctctgacaaactggcaggaaaaaacccactaatgtcatatctttatatacctgagagatgtatcatcaatgaccaattctctgcccttggcagaatgccgattggaaatatagctttggacagggccaatattaggctacgtcaagatgaccagcatgtgtcctggcaagctgacaacagactctgtcaaacagtcagcatggccagattaccctcctggtcttccaggcaatcatgctcctcttcccactttgggactgacacctttgcttcccatcgcaagcacagccaattcactgaaaagagttgactagtgtcacttgcattttcatctgaataagggaagagtcactgtcacttggaatgtgaccatagactccactatccttagactacatcaaaattatgctcctttaaactatttggaggtaaaagacacaagaaaataataggcaccagaagcatacacaaatgtgagatgtttggcatggaagacagttttctactcataaaatacacaacttgaaagttggtataaatatcagatcctgaatcctgccagccacatttttactggcaggcatagcaggagacagcacaatgaaaattctcatagaggttggaagtagcaacaagtcttgaaaactcatttgactatcaaggagggctagaccacacattaactcagaccacaaaggctaaaggtctcacttagactctcttatcactcagcatttagaaccagaagaataatcacattcattctttcaagactttccctttaactatacataagaaaggaaatgtctttacattcctcatatctcacttggcataaaatctaatgtttgttcatctcacttatcttaatcccatacctcctcatgtttattagaagaaaaaaatgtaactctgcatgtcagaaaacagatctgaagtaaatatcagttaaaatgcaaaacaaaaagcaaaagaggtctcagatttttacaaatgttgttttatagaaaccataaaattgaggtaacttgatttaaaacaagtgaagacatccaagaattttcatagtatgcaagtgatctggactggtggttggcagcattgacattaaatcagctgaattttcattgacagctcattagaaagatgttccaagaaaatcgaatacaagatgctcaacagaagctcttctctatgcagttcataactgttattttatgtccttacaagtcatgactcatattagaacacgtaactctgtaaaatttaaagatttttataaatcgcatgaaaaatttccccttagtatagctataattttgctgtttatgtcacatggatttttaattacattttccaaacacgaaggcagtcaatttgataaggagaatatttcacaaaattcactcttctgttctaggatcttggttctaggtaactcattctccagaaagaaatcatatcagtcagttcacaaaagaaaaaaatatttaagccacctaaaaactcaagtactattcattgttaattttgtctggatctttacattaccttaactatatggtcagtctataaaaatgtatctgtacatatgcttacaggtaatatgtaatataagtaacatccagggatggatcctgaagcgggcttccatttttttttggcatttgtattttaatgaaggttaataaaagccaaattacagccaactgttaaagctttttttttttttttttttaattctatggtataacaaaatcagttccaggtttttttctgaacaaatgatcctttggtctttcccgtggcatgctcctaaaacaactaaaacaaccctctacgtctaatcagtcacctaagatatcgagtggcaagtctttcacatttgctgcttataattcctgaatggtccatattgagtattttcatttctgggtaagggaaaaagcattttggtccattaattcacccgctcgctcctggaggacgttaaccaattctgctatcacaaagacgtgagtggcatcaatgtcttgcatgatgaacttcgcaggcttccatttttgttcactttgggatggttttcctgtcgaactgcgtggaaaagcaggaagcacactgtccactgtaggggttcctggtccagcagaagactttcagatattgtcaagtttagtccacttctttggatctcagtggcttttattctgacataagatatttagatgttgcaagcccctccaaggaacactattttataaacagaaacatccagttgtgtggccatttcataattagcttctgaaatggacaggaaatgcacctatgtgaaggaggcagagcagggcaaatgcctttactgcttttcaaattttgatttccgggtaggaaacacaactaaacctcctatcaatttttagtctttacctgtacatttctaacttttagagatttctgttaatgttcctttttcttgttaactttgtatttgatattcaagaaacgttagaaatgaatgcctgtataacataatttcaagatattaaaatagcatttatcattaaggccacttgctttataccaacatcacaattccattttaagagttattccatgtcctgggaaattaaatcactgtctcaactccttccaggtgacataagaagacatggaggcatgatggtctagcagagagaagcctaggtggtatggattgttccatgttgtggaacatattacagagacaagggtatacattagttcagcaatttcgagttcttaaaacatctgctttctctccagctagatctatacaactggatggagaagatcaggcttaggtgttctgtaaaatttaaaaatgagacccctaatggcagctttcctattttactcatatttttggaatattttcaagcaattgctgatacaatctggtgagccactgatggaattgagtgtaagaaatggaaactgctatggattgttaacatagagactgatgaccagattacaggtgcatatattttgtttatctagagttgtgtggaggctgctgttcagagcattgctgacaccagggcatgaaactagtgacacagttaatgaggctggtgatgaagaaactctcgggtcctaaccgataatttcacatacctagtaaatcagcattatttcatttgagttacacttgactttttaaaattaaatatcatgcgaaagactttccagaattacagcattccaccaaattgctctagccaggaccccattgaggtccatattgtaaaattatcaggttatatctaagccatcatctttcttgattgcacctccccctctgacatagtttcttctcttggctgtcagcacactgtgcccgcttgccttcctcctatctccctgggcatgccttctcagtttcattgatagggttctcctcctcctcctggcctctcaatcttggaggtttttagccttgaagtttcttagcctttttgtcctctttctgcactcactgcctcattcagtctcaaggctttaaacaccatggagacccagccatctcttgccgtctcctccatttccacccattccaggcaccttccttcctcacctggccgttgcaatagcttcctaattagtctccagcttccaccttccccttcttaccacctactcccttcagtgcaaaagcctcaacctctggcactcaccctttctttctcttggttgcagctatcctggcctccttgctgtgcctcatactggaaggccactcacactttagggcatttgcagaggcagtgccttctgcccccagatgggtaaccctatgggcaacccccttcaacttccttgctcaacatttgaaactccaagctgcactgtcctcaacacattctccagatcctctttaccctgctatgttttgagccccttttactctcttacctactgtataatctcctaacatgtttaccttttactgtgtgttctgcccatgggaatttaagctctgtgggggcagggatttttaccaaggttgttcactgatgtgtctcaagcgctcagaacagtcctttgcctttggacagtgctcggatttgcatgagtgaatgactgtgctctctccagagtgatgaggatgtcaggattgctaggtttagaaatgaagcacatcctatagtatgacagagcctgcagaggagataacagcttctcgcttaaagatatggagtaggcgttaaaaatgatttctgcccaatgtaagaggaggattttccaattaccaaccagaaggagttgcttgctcttgcctcagtgattctcacaataccatatgctatcaagttccattgccctctttgtacatgtgagggtaaggtgctccattggatgtatcttgaaacagaacagagtttgtgtatgtgaggggggtgtgtacctttttctaaggattgagctggatgacaaaggatattgcatatttaacgggtagggagaacgcaggtgcaacaattcacaaaaatctcataatagtgaatgatggtgaatgaatagagaagacctaagaaatctctcaaacgggtgagttctctaggaattgaaagggttttttttttttctgttacagttttaaaagaatgtggaaatggaataatttgatgatattaagctgtggttttgatgaatgctctaagaatcatccccagtgataaatattcaaagataaatggtgatgttttagatagaagtcaatcgttattctattgcctgtaacagggttccttagttataattctgttagttgctctcatggtcttatgttactaatatagtcattatttcaaagcttatcacattctgtaaaatcctgtagtcattagcaataatctaagccaacgttagcaatccattaaggttagacatttaacttctataaaatactctatgccacagcactttcatattcctatggggcaaatttccatcgtagactccacgttggctccttgaaatggtgtgtactcaaggatagcccagcttaggggactccaaatgccatttcaattttaactttatacaacagattctcgttctccatccatgcttagacttcccagctctcaggttcaactctcagatcaggaacaaccatatgtactatgttttgtttccatcgaattggcagtgactcattatttaattactctccatgtgttggccaaatatgaggaaagaatactctgaaaaattaacaaaatgtggctggcattacagccatgcagtgcctcatgcctgtaatccctgcactttgggaggctgaggcaggtggatcacctgaggtcagaagttcaagaccagcctggtcaacatggtgaaaccccatctctactaaatatacaaaaaattagctgagtgtggtggtgggcacctgtaataccagcttctcaggagactgaggcaggagaaccacttgaacctgggaggcggagattgcagtgagctgagatcgcgccattgcgctccagcctgggcaacaagagtgaaactttgtctcaaaaaaaaaaattaacaaaatgcatctgtataggcatcctatgtctgcataatgcgtctacacaggctttgggatgcagcagcattggatagaacaatactgatccctggcaaagatacaccacaaaaaagctcggctgcctttcacaaatacgagttcatgaacacgtccaggaagataaaagtgtgcagtgcattaaaaacacatttccttctcattagttgcatgaggatataaaaattaaatcaaatctgctttgttgccaatttcaagaatgtgactgaggacaaggagcagaagaaagcagtgtcaccaatcctactcggaataatctgtcaccatgttagcagagcagaaaacatttcattttaaatgattgctatttcagttacataataaaagttaatagatacaaccccaaacataagatttaattcattcagacacacatatacttgtgttagtctatgaaggaaatatatcttttatgtcaaaattatgtacttctttgaaatgtagttcaaagtgaagaagaaaactttaaacattttccttcacttttaactccttccatgccccaaagcaaacacctgaacatatgttaaaatacttgaattcatagctgccatcagtaatgtctttattcattcagagattttacttcaatatccctctgttagactttttcctgaatgttgatcttgaaaatctgtaccgaaagcttaagtttttctccaaagtcacattcaacttccatagatcatatcagaataatactcctttgatatttacatagaagcaaatacaacaatatctctataatccatggataatgtatatatgctactatagatagctctcattctgaagatatttttcccaaggcacaaaggccatcacataaattcacctgcatttttagagtggatgttcagggcgatgtcattggagaaaggctatgctcccagtgactgtcacggacaagtacagagtcttgagtaggctctcaacaaatgattgttgtgcttattaattgaagaagaatgatcttatatgtgaatcagaaaggaaggaaattaggagtaagtgacaacgaagcaagtgatttgtgaacattgtgtccgaaagagaatctgaggaaaagggtgttttgaggttagtagcagggctgacattgaatctgagttccatgcccagcagtgagccacaccctttccttactaaggaatctggaaatgttgccagccctgccttttatctttgaaaacacagggctatttatgtctaaacacaatgcactgaatttaccttcattggttgacacagttatctttcctgatcctcaaaacctcaacagacagcaaagtgcacaacttgctatgtaatagaagtttggtagatgggaagtctacatgcaaagctgatttattttggcaagataactcagccgcaaggggttacacggaaggcagagagaatggatgtaaagtgtagtcaggatactactgagaaatcctagtcaaggatgttgcaatagcctgtgaactaggaaaggagtgatattgaagacgtgtatgtaagtagaatcaatgagtagggactaagttggtatgaagaaaaattcgaatgcttgtctaagattctaattctcagtaactgggtggcaccatcgtcaagatccagccctgggaaggaagagcagggtgggagttggaaagtgagttttagacgcattgaatttgaggtactcagaagacattcaaagggaatgttcaccagcttcttggaaatgtgagtctggaactttcacaagagatcagggatagagattagggattatcgtgaaggaagaaacaggtgaactcagggaagattacagagatttagacgagagggacagaacccaagggagtaactttaaggttgggcaaaaaaaaaaaagggcacctgtaagtggaattcagaagatgtaatcagagagactgaaggtaaatcagaagcttccagtgtcacagaaggcaaaggggaacagatttcatgaagatgcgagagtcagcagcatgtaatgccagtaatctaaaagacttgtctccacatttgtttccaataccgctttatgttaattatgtaatatctggtttctcagctttagtaacaatgacatgagaaaattcaaaattattttttgtgtcatttctctcagtgtgtttattattatttaaatatatttatatgctttcatgaactttacttatgaacgagttaagaacatggcatcccaaaatacaccactctggcatattcagtatttttagttaaaggcacttaagaaaaaccaggtgaggtcgggcgtggtggcttatgcctgtaatcccagcactttgggaggctgaagcgggtggatcacctgaggtcaggagttcgagaccagcctggccaacatggtgaaatcccatctctactaaaaatacaaaaattagctgggtgtggtggcaggtgcctgtaatcccagctattcaggaggctgaggcaggagaatcacttgaacccgggaggcggaggttgcagtgagccgagattgcgccactgcactccagcctgggtgacagagagagactctctcaaaaacaaaaacaaaaacaaaaacaaaaagcaggtacaagaagatcactctgaccttccttctgtttctgaaaagcaggagatgacattcccatgtgaaaggtgtcctcccttggccaggtgggaggcatgattcctatgggcaaggaccagaagctgaggctgagggaaacctgtaccacctgctatactggcccttccttcccagccattctcctccaatcacctgccctggcccaagcccccgaccccccacctcatcacatttctgcaatttactgctctttgtctaattccttatataagtggtcaatacaaactgcatctttgggtcttcacaaattctgaaggttttcatgccacataaacttatattaaataaatgtatatgtttttctcctgtggatctgtcttatgtcaatttaattctcaggcacaacacccacgtgccccatcccctaacaaatcctaacagaggagaggtataattttgccttccttacacctagaaacatagaaaccatcttttctttgaatttaatgatttaaaattataaagacttttggcttgcactgaattttcagattacatgtgaaattacttgtaaagaaaaattattcaatattatccattttgtcaaaactcttaaaaagatagtgatgtctaccagctttcgcattttagcataattggaatgagtctatggataaaacaaatagaaaaaattggaataaaaatcctcaaaattaagcactggttcctgccaaatggtaatgaaaagtcactagctttttccaataacattaaggaagtataaatattattaaggaaaagctgtgtgtatataagcttttctgaataaattaaattacacgaaatatataagctacagaatgaagtctttatattaaaaacaggtagtcctattttgcctggtatcgtgtcaacaggaaactcaagcatatccagccatatcactgctctccatagtcctgtagcaactgagaggactgcttgtctgttttactcacttttcatacatttattacataaattctcttaaaacagaaatcctttcttctcaacctgttgacccaaaaccagtgttaaagaggttaagataatgtatacactgctagattcaaagcccattataaattttcataaaacataatgacaaactatttgataacttaaagagtaaatatcagatttataacaatgccatacaaaaagatacacactacaaaaaccatcttgaatgtaagtttacaaaagatgtttgtctgctaaggaactaaattcattttctctttgaattcaccatttatagaagttttgagccctagaccaaaaatatggaagtataggccaaacattatactatctgtgataaattttcagaaaatttgggctgctttaagtaatgtatttatgttttacatagttcctcaatgttagcagctgtgaaagatatttacaatttacttcctatgtagaatttatcttaaatttaagaaatagcaaatagagggaaagatgttttaatgcaggtctttattgagtcgttcaaatgatgaagagaataatataacaaatgtccatgtacccatcatttatcttaaaatagaagatactaattcaattaaagcctgctgcacatgtctctaattggaagtgccttcctacctccagaggtaaccattatctgaatgtaatatttatcagtccatatatttctttacattatgatgatgtaggtttttaatgaatactctttttaaggttaaagtaattccttcctttgtctggttgtgagtttttatcttgaaagcctgtgttgggtttcatcagtttttttttctgcactgattcagactgatctacagtcagaatgtaaagttttaaaccacaaaactcatatgattcatatatggtggtgaaatgccttcaataaataaatgaagcaatatgaaaagaccctcatgaaaatattttattcaatgaaaatgaaattgctttaggcattaaaagtagttatctatggtcacctaaaacactatttggttttactagtgaattcctcatttccttcctttctgatttatatgttagataattcttaaattaataagcacagctgagggttaaacataccaaatagtcttctgccaaatgtttttacacctgtggttttaagtattttagaatattgattagaaaaattatacatgtgaacataaaaaattatgatgtggacacaaatgatttttaacatcaaacgttttttaattttgatatccaaaatacataaaaaattgtaaggggataaaaatctcactgcaatcaagctttctcacctttgcataaaaattatcactttgatttcagacaagtttttacaagctgtggttattaagaggtggatctcaccatgtgagacaaaaaaacacgtgtgtgccaattctaaattaatttccaaatatgaaatacatccgttaattcttaaagatgctcaaacacaaaataaaatatattttgaatgtagacaagtaggcatcatcaatttttttaccacagaaaaaggtagtattttattactttttccacataaaagtctacctctgaatttaccttttcactcggcttttcatttttacttgtttttttagttttccatcataagccagtcttctattatatcaatacaaactttataaacttgtttacacttaatttttgtcttattctgccttgaataaaaatagtcatagtggatataaaaagaaaattctaatgatttaatttgatgtcagaaatacaatttttaaagaaaacatcgaatttctgctgctaagagatgtcactctgtaagttttctccaaaagggagtgttttactgccctttacaaacagagggaaaaaccattttctacttcagaatgaggcgtggatcccttagtctgacatctgacatccttcttgaatttgcactgaacctccatctttatctccaacaattcctggctgagtcccttcactatgggcctactcatagatgtgcacagaaatgaaccatctggtgtgccaggccacaccttccaacacttggctctgctgggaccacaaggatgggctttctcatctcaccgtacatttagatggccatattgggtttcggatagtctcccattcttaaccatggtcttcaacagtttttgttttaaaagtgaatactcttatggtaaaaaagataaatgtgaaatagaaaatactgtagatctacagatcaaagttatatttgaaaaccacatttaattgtatattcacatatttttgtaattcacaaaaaatatacccatctgtaacttttcaacattcttgagtgttttgaaaattaacaatttgttctaaaacttgagagttacatagttttgaaatatttcaaagttcagttcaaacacacacaaaactcctggataccacctggagctaaattcaataccaatcgaattttttaggtttgcaaaattgaactaaagaagtaccactgagttgagggcatgtcaagatctagcattaaaccaattcagatttgtacttggaccagcatattccaggggtcacagtagccaacatgcaatgccttaaaaatacatgctgtacgtgtgtttttctattaagctaaattcaatctctttttttttcaggcataaatttatttgagaacaagagaataatgtttctattctatcctttctaatatcaagctggtctttaaaattttttttaaactgtgtcaatttcctaactcgattcttttcggtatgccgacaggttatttcaaccagcctcgtcctaacatttggctcattatactattggcacattcatgtctttctctgtaatcttcacctcccgtgcttgtttttctctcagtgaagtacagaaagccaaaacttaggatttgaaatgtcgtcttcactgcctggaccaatggttttcttgttttattgaaaatgaaagagctggccgggcgcggtggctcaggcctgtaatcccagcactttgggaggccgaggcgggcggatcacgaggtcaggagatcgagaccagcctggctaacacacggtgaaaccccgtctctactaaaaatacaaaaaattagccgggcgtggtggcgggcgcctgtagttccagttactcgggaggctgaggcaggggaatggcgtgaacccgggaggcggagcttgcagtgagccgagatcgcgcccctgcactccagcctgggcgacagagtgagactctgtctcaaaaaaaaaaaaaaaaaaaagagaaagaaaatgaaagagctatgcatttggtgaaataataaaaacacaacctttcatctctgataatactgagcattaaataaaattataggtgcaattattttacaggtaagttttactttctaggacaaagtctagatacacagggcagtactgactgccccgaggcctcggtctctgcaccaattggtctcatcttatttcaagtgctctcgtctttgtcctcctcttctcagttacatctgtgtaacagggtctgtccagcgtttcatttctctaatcaccttgaacattgctcagcagtattactaacacatgagcctgatggtgagacttttgttctcaataaataaacacaaactcaatgcaccttcccaggggctttgcatgggacctaaatattctttgagtcctgagttttctctcctctgaatctttgctgtccatcaccttctgccatttgaataccctcttatccaaaccaaaatcctaattccagtacagcttttcctttgtgataataccactgattttctagtacaatatacgcccagctcccaattccagctctgagctcctagagttctgggggacttcacattgcccatcttcttttgcagagtgttatatccaggtgtatgtgcccagctctcctaccagactgttcatctgcctgtggcacggctccttgcacacagtacgtacaaggcttggtaacagaatcccatgttcattgaagggcctagactgatcacattttaaataatgcacaatgttctcacgtctatttaaggaagaaacaactgatttctatcttttaagattgcatttcaagaccatatcaaaggctttgaatctctcaccaagactaacaatgaaaaacaaatttggccaagtgcagtggctcacacctgtaatcccagcatcttggaaggccgaggtgggtggatcacttgaggtctggactatgagaccagcctggcagcctgggcaacatggcaaaaccccatctcttctaaaagcacaaaaattagcttgcgtggtgacacgtgcctgtaatcccagctactcaggagggtgaggcacgagaatcacttgaacctgggaggcggaggttgcagtgagccaagattgcaccacagcactccagcttgggcaacagagtgagactctgtctcaaaaaaaaaaaaacaaaaaaacaaaaaaaaatgcaaatttgatcatatttaattgaatttgtttcaaagtaagggaaaggggagtatgcaagggcgacatgtggcctgttcttctgaaaaagcaagaaaggttatctttatacaccagatcaaggtattgacagctacagagtgaaattccatacacaaaaagaaaattttcttcaagtgaaaaaagtaagtggccaataaggtcacattcaaaaattaaaaatggatgccctggtcttgattactgataccatttttcaataaaagtaaccagagctccttgaagaaataattgattttaggactaggacatgaaatgtacaaaatgatgcgggagcatcttgtagtaccagggaaaaaaaaaagtcaacccttagcatgaaggtgtaagtcaaaggcacatgggagactggagatgcattttggatttcagattttttcagattttggaatatttgcatatccatcctgcgtcatcttggggacaggacccagatccaaatgtgaaattcgcttatgttatatgtagtgtatccaaatagcctgaaggtaattttatacagcgtttttaataattttgtgcataaaatgaagtttgtgtacactgaaccgtcagaaagcaaaggcatcaatatctcagccacccacatggaaaatctggtgttgtttggcatcaccatcattcctgactgaatttatttgctaccaataagcaatcattttcctgctcttactcagacgtgagtacttaacagtagaaaatactactatttttgtttttgaaagagtcttgctcttgttgcccaggctggagtgcaatgacaccatctcggctcacggcaacctgtgcctcccgggttcaagcaattctcctgcctcagcctcctgagtagctgggattacaggcatgcaccaccatgcccggctaattttgtatttttaatagagatggggtttctccatgttggtcaggctagtctcgaactcccgacctcaggtgatccacccgccttggcctccgaaagtgctgggattgtaggcgtgagccactgtgcccagcctaatactactattttttaaacagtaaagatacatcctattaatacagtgaaaaataatgtgtttaggtaactgggcagcacaggaaaaagaccgttttcctttctcagctgttagacaacagcagcaacaaacaatgcaggctttcagttgccacctatgatgctgtgtttggagtaaagggcactgtacactgtattttttttcttttttaggtgataagaaacatctgaagcagttgacagatcatgaagcgggtcctctgagaaatgagaggcattctgccggatggcatttttttttttttttgagacgaagtctcaccctgtcacccaggctagagtgcagtggcacgatctcggctcactgcaacctccgcctcccagtttcaagtgattctcctgcctcagcctcccgagtaggatggcttttaaaatgttttctccagcgtcatctgcctcattaacagcgatttttgtcttagaagtctctctttgagtttctaaatggacatgactgcttattctgttaggaatgcactccactctagtccttcaattagcccatcacattgtcactgtggcatctgtatgcacattttctgccgtgttaatgtcatcttcattgtccaattgtggcatcatgttggtgctcaaaacgttgcagattttggaacattttggatttcggacttttagagtagagatgctcaggctctactacttcttatttcagagaaaaacataatatccaaataactaataaaaacttggttggagaatgcagacttctagaaatgactgtttaatctgcttatgataaataatcctctttgctctactgcaaaggggagactactgctgttactgttttgtgtcatcatgtcctgatcagacaaacactgatttaaaaaaaaaataaaacaagtacattgtatatgtaaatttagactgtaataatatatccttgagaaataaatattatatggactccatttttctctgacagtcaattaagcacaaaaagatttttaaagcactgatttttgcattcttaaatgacaaatgaagtcttcttgaaataagatttttaatgatttagagaaatatttgcacatacactagcttggtgttgattctcaatttttaatttttttttaatcctttccctggcattttcatcgtttccttttttttttttttttttttttgagacagagtttcactcttgttgcccaggctggagtgcaatggtgggatcttggctcactgcaccctccgcctcccaggttcaagctattctcccacttcagcctcccaagtagctgggattataggtgtgcaccaccatgcctggctaattttgcattttttttttttttttagtagagatggggtttcaccattttggtcaggctggtcttgaactcctgatctcaagtgatccacctgcctcggcctcccaacgtgctggggttataggcgtgagccaccacgccaagcctatccttcccctttttctgttttgttatggatgatgaatgtcttaaaactactgaactccttataccttgatatggttagtgagagcttccttgtgggatggttctgaatgattttctctagaacctccatttgaacatcttcctttcctctgctcactgtaccagtctggggctatcaaatcacatatgctgataaatgctacactatgactggtgaagccagtgctaaaaagcagcttctacatatggcacttccaaattgtgttattgctagcttttccagtgctttctctactagggcatccactgcatgtcacctgctaaaatgcaaaccacatctttaatgaaagtctgttttattgaatatataagtgactatgaaatttcaaaatgaaatttgatggcaatttaattttataataaatctatatctatgtatctcaccaaagatagcctaaatctttagtgaggccacacattcatttttatgaaaattcttcacatgagtttagaaatctcccaactaagaaaaggacaagtcagatcttagtgtcctgggtggcttagcatttcataactgccagagaaccatgaggaccttcctgggactgactcatgggagttatctgcaatgattttatgtttcccaatgggtcatattttcattggagattatttactatgcctggaatcctaatgcttggtgtctctaatgagaaaaataatacaaaaaaattcaatattcagccaacacaaatttatatgatctacaaaagaaaggaatgttttcagatcctgggcttgattatttttgttttcgatgtgacagatttgctgaacaaagcttacaaatctcccttttcctctctgctcgctactaccccgacccagaaaacacacacacaccccttcccaaccggggaccatctgaccgttcacacccacatcaactctgggtcgccatgcttttctgagggacattgccttcactgagagctcctttattctcagtataccttacattcccagccacagtactgaacttctcaatgcttgcaatgttcccttggagtatatcagttgagcaggcggaaaaaaaatatctggaagtttattatttttccaccaatatatttgacaccacctttggagagggaacaaaaggcatactgtcaagcggatagacctggacaaaatgttactgtttgttcctcacgagcacagaggtatatttaagcaaagaaaggcattccacggctctcccgggacttccttccttcagctgaattataccaacatgttcacaccactgagggccaggctgctggaatttaaaacgcagacctctatctgccagtgcttcgatcccacggctacaaacattcacattaggattgaacctggctttcaaacatcatgagataaatgggagtttactgggggaaaacgtgtgccctcatgaaactatagtagaagatgcggaaataggactgtccctgttcagcagattctatactaatacaataaagcctcaaagtcaccagaagtcacctggccttgggttatgtttcaaatccaggctcactgacattcatgaaacctttggcaacacaggccaagtttcgtgcaaggctgggtagaatacttctttcatgtggaagctgggtgaaactcggtggctttggctagctttcacctgaagtttcacattcaaacaatccaaagtttcaacgtaaaattcaggggtgaagagaaacagaaagaaaaaaaaaacaaaacaaaacagggggaaaatggcttgcctgggaatggaatgatcacctaccattctccaaaaagatttcatcctggtgccatttaattttgccgctggactatcacctctagcaatatatttgcactcagccctgcagaccaaggcttcccagtactaagggagagtgagtattctagctagacgcaccccatccccccaacaaagcccaggctcaaaataacgggaggatttaaaatggtaaccatacacataaatgcgatgattgacatgcttcttataatgtagatttgaaggggaaaagtggcaatgaaatgcccaggtttgggaaacttaaagattagactgaacatctctaggtttttctactataaatccaagttctggagattcgattgcatctgctcctaatccagggagatctctgccgtagctttctccacagctccgcccctttggagatttgtcctgtggccacttgcgtttgtccttcttagcaaggtgcagaggacggggcagactgcgtcagcgctgaggagctagcgtccttgactgggacttaaacagtctcctgacaggattaggctcattctactcctaaccttcaacagaacacgcagggaccgtttgccagggaacgtcaaactctgtatttggctgaggactgtgaaaataccttgtgcttggggtgggaaagaagaagggaacaaatgtcacacacacctgtgctttcttcacaatgaagagaatattccaaagctgattgaatggctagtaagtgctacattttgcccattttaggaaatacatttttaagaaatcccttatcccttacacagcagaagtttcactcgtaaaacagacttctggctactaaggttttttttttttttccagttttcttttgattctaattttctttttctttgttatttcttcccgtttttgttactcagacgatccttatgtggttaaaatgcatgctttcctttgatatgtgctctgtgataccaataaacttttctgaaaaaaaagtatttctgaactccaaagatttcagcatccatgtttttaaaaagcaccagttgggccccaaggcacacggagattctgaggcagcagggcagccagcgcggggctctgtgcactctcatttgctgcttgctcttacacatctgccagacaggggccatgaactgtcctgaagtctgtgttggggagaactttaccagagaacacttttcttacaattgggggtccctctagaagtgaaatctaagacagatcagtgaggaaaactaaagctccaataaattgtttaaaggaaatgctatgaaagcattaaaccaaaaggaaaaaaaaggagactttttactgagcatagtaaatagccacaatcaaagtaaatgctgtgtttgaagttaaagtccacagatcaaagtacttcgcaaaatgtcaagtgcaagcgtaacgagggggagaggggagccacagaaactgacccgaagtatcacattgtcacgttagagaaacctgccagcagatgtacccagcaaaagacagtcagcttagtaaggaatcctcaacactgtcccctaaaatgtgctaggaacatacaaaacaacaataacaaaaacaaaacccccagattcccccaaatcaaccactctaattccacacgagcaatgaacgaaacagtgatgaaaggagaacattatacaatacggctcgctcattgcccttaaagaacaattacttatatatattatctttactcaggtggatggttgcatctttttcctctttttttttttttaatgcccctggaaagttaaaaataaagcagtctaaacaacaaaaatatgatgtctgaaacatcctctcattgctctggcaatcaggcttaattagacctctgatccatggcttagtcatagtcaagcgtgtactgcaggtcactattatgagagctttaagcaaagtttaaaacttacagccacaaaaatgcccagatgctcctgctgtattctggaacaccgtgtttacctgaaaattgttcacaactccccttattattttcactataagtaagttattttaaagacattagttatgaacataccagaaaacaattaaataattccagaataaaaaatcttacctacaggcagctgagttcaacagttgctctatacagaggaagtaggagtcagtggccttttacatgtagagattgtttatttagccctttttaaaaggtcttgaactccagaggtttaagattaagtccaatccaagtgtctgaaggaaaaaaagcaagagagaggcaaatgagagagggaaagaatcccagctgctgggtggtgctactgttctgagagcatttgagctattttcagcattaacagcagccggggttgtctgcaaagggatgaaaatgccttgcccagatcgccaccccccactccaggggggagaaaacaccaaccaggaaacccacaacgacttggttcattgtgcaaatattcatttaaattttgaggaaaactgccagcaccattgaaaacaaaacaaacccaaagttgactggaatcttaaagaaacacagtgctcctcaagttttcaaaatgaattacctgattcactgaaaacgagatgtcctacttatgctttattgagaaggaggcttttcttctgatatttcctagggggtcttaagaaatagttgagagccctctggtagcagtatctgttgtcagtctattcttaagactgaagacaaatgatttcttaaaagagcccgcacctaaatttccagtttcatcaactatgctatttttgaaagctactgggttaagcgttgacatctcttatctattggcagagactggggaccattcagtgacatgaggcagacaaacagtgacccctgcttctgcctccacaggccaatgaagaaatcattctggttgggtcactggcaatgactgacaaactttgagccttcattttgtttctagaaataaaaattaagaagtcgtattcattcattcattcagcaaatatttatttggtgagcacttcagagcttactataagccaagcactctgggaatacagtggtgggcagaatgaagtgtccttgccttcaggggtttagagcacacagatgcagtgagaataaataaaaacagaatttttaaatattttccagactttttcacatgatgagactattcacatcatggcagctgaagactgagatctctttctattgtggatgaaggaagatactgtgtgtcatcagaccaacttcaggcttccattgagtcattgtgcctttacaccaccaccagggaggaaaattacttactttctaccaaggaagcagttaagtatgtttatgaacgctttcattccaatagatgaaatccctggtttttttcaaccccctactccccattacaaaaagaatgcttaagtagtcagaaagtactgctgagaggctttccatcgggagatgaaaagagagtcttcaacctgaattcagtataaaaaactgccggtggctcaggcccgtaatccagcactttgggaggctgaggcaggtggatcatgaggtcaggagatctagaccatcctggctaacatggtgaaaccccatctctaaaaaaaatgcaaaaaattagcaggatgtcgtggcacgcgcctgtagtcccagctacttgggaggctgaggcaggagaatcgcttgaagccgggaggtggaggttgcggtgagctgagatcgcaccagtgcactccagcctgggcaacagagtgagactccatctcaaaaaaaaaaaaaaaaaatgccctgatatattttataattaatgtgagggttggttgctagatgcttatatcaaattcaaattcaattctttctttgccattaaagaaagacactgaaatagattatggaaaatactgaggattatgccatgtgaaaaaaaagggttacatgactactacttcaagtactatttaaaaacagtgaaatcctttggctcaatagaccttatattaaaactgtatttcaaattaaaaaattataaattaactttgaaatctctaatctgaattttataaataagatcaactttgttttaaaaatgtataccaggctttaaaaaatgactctagaataaagcatttttcttttcacttattttaaatggttacattttactatgtcttaaatacctgccaatctaacatgggatatttgtttctcttggcctcaatgtggaatggtaattctactggtaataattggaagcctagctgcagacagacacattttttaattgtttttttctttttcctccttataatagtttataccaaaaaagggtataatgcatttaaatattggctttccttgagaagctatggcattaaggaaacaaagatcaacataacccactctcgtataaaacagggataataatgagttgtcatagggctcataggaataatgcacagaaaatgcttacctgggtaatgtctgacacacagcaagcatttggtgaaagtcagtaccatcatctctgctgtaagtgtaaagctttgctctccaaatatggtggctacatgtggctactgagctcaatgcggctagtcagaactgagatgtcatataagtgtaaaatgcatgctagattttgaggtctttatacaaaaaaaaaaggtgaatgatgagaaattactcagtgggtacgatgttcattattcaggtgatggacacattcattaaatccgtgactttaccactatgcagtccatccatgtaacaaaattctccttgtaccccacaaatttgtacaaataaaaatagattaatgttgtctcttcctaaaacatgtaaactatcatatcatttttatattgaccacacgttgaaaaaagaatgtaaattatgacattaatttttatattatgtgttgaaatgacagtattttggacatagtatgttaaataggatattttgctaaaattaatttcacttgtttcttttttactttttcaaatctgactgctagctaatttaaaattacctatgtgacttgcattctatttctactgggcagtgccatgcaggccaacggttctcaaaaggtagtgagcatcaatgacccagaagcttcgtaaaaacagattgctgggtccaccccagagcgtctgattcagtaggtctggcggggcctgaaattctgcatccctaacaaattcccgggtgattcttgacctcactttgaaaaccgctggtcttgggccttgcttcttaaaaaagtagtccacggaccaacattaacgtcatcacttaggatcttgttagaaacgcaaaacctcaggccccacccagacctactgagccagcatgtgcattttcacaacatccccaggctgcgtgtaaacatgttgaaacttgagagaaatgatatgaagtagtgtctgtcatccctgggtgaatataaggtaaacttttacaaacaccagtaccccggccccgcccctagagagtcagatttaatgactctggatgtgactcgagcatctgcatacgtgaacagctgattccagattaaagcaagcactgagtcccatcagactggatgtggaaaggccaggatctagatcatttgtacatcattaaggcatagttgacacagatcaaaccatattagagggtatttacatcccaaaagaggatcttgttaaccccaataactctacaattgttagaactggtgagaaagacccatattttggagtagagaggccttctgttattcgctccacctctgttccggccttaaataaacgagcacgccaactttaagagtgtgtctgaataacctcattagtttgccgaatgacttctcacattttcaggcggcacctgagcgttgtgtgtttcacagagcttggtaaaaataaaatcctcactgtaagagagaatctgggctcacgctggtaacatttaaaacttccaattctatatgcaaagaccatctgcagctttgcttctcactttcttggttgaacctttcagaaaacttttaaaagtgcataatacttaagagtagagtctggagtcagggtgcctgggttcgaatcctcatcctgccacttacgcgtggctgtggctgtaggtcacttacttagcctccccatacctcggtttcctcctctgtaatgagacctttttttattgggttgttgtgagggtgaaaattgttatttgaaacagccatggaaaaatctgctgctttgtaaattttatatgaatgttggttaaataatcaaaatatatttgaaaaactgtgcagatttccatatgtggctaaatttagtaatttttaaaagatactgtggtgatttccaaggactttcatgggcgtgagtttttgaacacatatatttagagggtttctctgagtgttgttttacatttttttcccaagacagcacagaattctcaattgattcctcatcgcttcctattatttgagaggatcccagtaggaaggaagtaaatgtagttttcccatgagtattgttttctagagaacattctttacccctgcagtcctttgaagagtgagttgtgctatagatgtttagagacctccctggtccctgtcattctagtggcattgtctagtatcccaggagaacaatgtgtcattctcttagtcaaatattttagtgcttagggcgaggcagcaagaccatctgaaacactggcgtgagtttcaaagacatattgaaacagcagtcagattctcctatagaaatcagctaatgctgactaaaagaagggatggggatgaacagggaagtgctgaagtcacgcacattgtaagcaaaatgaaggctagactaagtagagtaacatttttttttttttttttttttttttgagacggagttttgctcttgttgcccaggctggagtgcaatagcacaatctcggctcaccgcaacctctacctcccaggttcaagtaattctcctgcctcagcctcccgaatagctgggattacaggcatgcatcaccacacccggttaattttgtgtttttagtagagatggggtttttccatgttggtcaggctggtctcaagctcctgacctcaggtgatccacgcacctcagcctcccaaagtgctgggattacaggcgtgagccactgcacctggcctggagtaacaccttttatgcttgtctgcttcaaccacactcaatgaagtgaagcatatgcaagaaaaataaggatacctggtagctctgggcacgtagcaagcatccgtcgggtcatctacaggaacctcacccatggtatgccacctgctgaacaatgtaatgcatgcatcgggctggaaactaaagcccatacattgagtgactttagaccagtcatgcaagctccctacacttgtgtcctgaaaggcagatagaggcatgggactgcaactgccttactgactcttaaacctatgctttctcttgggcttatctggattacattcggcagtctgccatgatttacgcctttttgcagcactgtttgaaaggagtcaaatcatacgtccaatgacttctactgcctggttattgatgttaagtaaatactttttagtaggcgatttgtcatcacatgtgtcattttgccatctgggttgaggtttatcaagtgaggtgaaaatcttaacaaaaggttaaaggaccagtatcattgaaagagattatatagaaataacttcttaaaacctctgttagaagctcaattttctagttgaaactttgtttcatttatttatttttatttattcatttatttttgagatggagtttcactctgtcacccaggctggagtgcaatggggtgatctcggctcactgcaacctccacctcctgggttcaagcgattctcctgcctcagcctcccaagtaactgggattacagacatgcgccaccacacctggctaatttttgtatttttagtagagacgggtttcaccatgttggtcaggttggtctcgaactcctaacctcaggtgatcctcctgcctcagcctcccaaagtgctgaaattacaggcatgagccacggcgcccagcctgaaactttgttttaaactggctgcctgaattctttgtgtatttaaagagcacctctgctgtttatgtaaccatgacttagcttttcttgttatttctattccatttgaaattgagcatatgcaacagtcgctaaatctgctatgaaaattgtgaagccttctccatgtggcccactgaaggccctgcacgatctggtgttctgcagcatttctgcccagatctccaccaccttcctcccagtgccattgcctccagcctctctagcctcccttccattgcctcccgcctctccagcctcccttccattgcctccagcctctccagcctcccttccattgcctctggcccctccagcctcccttcccttgcctccggcccctccagcctcccttccattgcctccggcctctccagcgtcccttccattgcctccggcctctccagcctcccttccattgcctccggcctctccagcctcccttccattcctggactgtgcctcatccagggccctggcttgcctggctcaatgtgatgggaatgccttccctgcccagtggcgaatgccatgcagcctccagctttcacgtgtctcttcctcaggaaggacttccctgctccaccagcgtagccccgccaccccctttttttaactcgtaaagaatcaccttcctcattccttctaaattcaggttcagttgcttgaatttgttggagtaattgatcggagcccctctcctccactagcctatcagctcccgcttgcccctcacatgacttacattcctcccgcaggtactgcattctgcctggccctaagtaggggccaatacgtagttgctgaataagtaaatgattaaataagttctgccgaaggcattaagcaacacaagagtacattttttggttctatatttatcagaacttgtgaaataaaaagtatctgatcatgtaaaaagcaaaacattatgtattctaattaagcagctgtttccaaccaagacgattctctgaaacattgctttgtagctacatatttggtttagaagctgtcttaagaggcaggtgccacttgcttttcccttcaggatataatatgttctgttatcttaatttgcatttattctaaaatagatttcaataaaacaagttacttgcattcatatatcatattcctagacctttttcacaaccatgtgatactctactagggtagagtgaggtccctgataaacatttcttctgattagggttattgagagaattatgtatttgtctatatattgcctggcagttataccacctgaaaccatatgtgattatttataatgtagttttatgagcagacaggcagatataaagtaacacatcaaccatgccacctggtcaggccatagtcattccaatggtatgaaactctttcttgtggccatattatgcataagttataaacagacaatgaatggtcactgactgagaagactggagatttgcaatcttattttctggcaaatagccaagtcatgtcaacaggagagataaggagagttttgtgtgtcatacactgtagagcaggggtcaaagcctgggataggagagggcttggtcttcactgcatttatttgaaaggagctatggaaacttttcttctaccacttgggcacaggaaggcttgctatggcccaacaatgttttaaaatgtattctttacacatgtgtaaaacactctgaaatcatcaagatacagcatgaaacgtatcttttctgagacattaaaaaactgaataaattaatccaacaagccatggcacaattccataattactatgaccacagaagttaatttagcagggatagtacataatacacaccgtgctaggaaagtgtccttgaaactcatgacggtgaaggacgaattaagcccaatgaaggacagttgaccagcattcaagaggtagaaggaactatagattccttatatcaagtacatgagaaaaacttcctaaatgaatgaggctggaaacacaaaccctcagagactggacataggaatattttctgcgttgtctgtcttctaagcagactctctctctacttctacttctgtgttagcaacgactacagtgctgcagtaatatagatctcctcagttctcaggtggccaagtgaggccttgggaagctaaagttcctggactggccacctctggctgttagcaacctcattggtttacctctgtgcctgcaaatattcttgattttatgtatagtatattatagagaagtctggaagggaatgctttaaccagcaaagtcaatccattaaacaaaaaggtatgggagagacacgttaagagatcagtaaccatgttgtagtttaaaaaaaaaatgcgaagtctttgttcagaccctcggggtaagcagaagtagactggtctccagtggcaggcatgagagggaatatcctgcccgcagtgatggacattttggtttcaggcagagaggcaggaagctgccctctgaatcagagtaaatgctcacattttgaccttctagcaagggccctctttttcttggcaagaattccttcgaggatcattttcagtttgaggttctgtctgatgttttattttacaattaagtcactattcccatattcattactctgtaaaataagtcaagtaggtaagaggtgtggtagacacttccttctgcctcctgaggatccattttgcagccttcctcactacagaatcctgacagtacggccagttaacaactgacctgcctggattccttgcagtttctgaccaataagctaaaggcaaggcatcctgttgaaaatttcatatgcacagtaacgacactaacctcccgagaagagggcttccttgtccttttctttcttttttgagacggagtctggatctgtcgcccaggctagagtgcagtgacgggatctcagctcactgcaagctctgcctcccgggttcacaccattctcctgcctcagcctcccgagtagctgggactacaggcacctgccaccactcccggctaattttttgtattttagtagagacggcatttcactatgttggccaggatggtctcgatctcctgacctcgtgatccgcccacctcggcctcccaaagtgctgggattacaagcgtgagccaccgcgccaggctgtccttttctttctaaccttgttctgctcctctttttgtagactgaaatgcagatgtcattctgtgggggtgcatgctaacagagagatgatacagcgatggagagaggatagagaggaacctactctgggctacctgtccgtgggatttcttgttatttgaggcaaacccaacctggtgaaatgactgtattgaggtcatctgttccatgaaagctagaaacagaaacaaaacaatcatctaaaaacaaccttccttacattagaccggctgaacgacagcaataaactattaggcctgccattaagatattagttaaaaaatacttccagaagttttgaaagaacttctgggcatcaacaacgaatgcttacaacagttgtggcattaagtctccggcccattatcatttcctaatggagcaaaatctgccatgaaaaatgagccgacatgcctaacgccccgggagctgcatcatttgaatatttttgactctaaatatagtgaagtagttggctcttttttctaaaactacaatttactgatcagtgatatcaagagaaataagaacacagcagtgatcaacaggaaacacaaaacaggaacgcattgtttattctgttctcggtggacactgccagatcattgttcagagagctttcaacagggttgcttcgatggagtttagggagtttttaaatctaaattgaagatgaaatgtgtcctcgggacagaaaaagcaattttgaaaaggttattcaaggccataaggtattgactttgagcgtttaaaaaaaaaaacaaaaaacctgtaagaatcttactgtggtttcttaaaatggtgaatgctgtcagtcataatggaggggaaggtaggtttgattaggcggccggtgaattttcagagttaaacaaagttaaaaatacacaggcaacatgaaaattgttctaagcgttcctgtgtcatggtttctgattaagtatcatgaatggaagaaatgaatataaatcataacgattccgttttataacagacagtctcgtgtaaatattttgtctttctagtcacatgtgccaagagctgtgtgagagtgtaatgatggagagcgtggtctgtacttacccgccaccatcaaacccaactctattactgccagcttctgtggctgctacaatcttcttgggcttcagttctcttacccaccaaataggcactgtgtggcccttgactcataattgttgtgaggcttaaatgagttaacacatgcaaagctcttaaacaacagcaactcacaggaggccctccccacgtgttggctgaggctgtttccatcatcatcttaagagcatgggcttggagaatcaagagttctgagttaagtttctggtacttcctcgaattagctccctggtttgggcataatcgttgagcctcattttcctcatctgagcaatgggaatatcgttcattaccttaaagcattaagaagaggggtgaagaatataatgctggaaaaccacacctggcacactggaatcattagataccattttgtttacattacacggaaaaaaattatttgcaaattgatcttcaaaaatatagagacttttactttgctgttggggaaaatgaaatggattgggcacacctagatattgaatttaatttccttatcatttatttcagatagctcacattcaaagttttatgttttgggtttttttttctattttaattttaaacaagaatacatgggactgtcaaacaactggattaagaaaatccccatatctgagctaatcactttgtcctatgattgacataacagtctccttcgagcaacagcattaccactgcttcatttagtaagtagagaaggctaaagaggaaaggtagtggcgttaaaagaaatgacctggaagaaatagagaagaatggactttgtaaggccctgtgagagtctatcattcctctagcagggggaggagcagagttataatcctatctaccttgttacaaacaaatacacactaacttaacattgattgactatggttataatgaatggtaattgaagaagtatccctctatcacagcagtgattacattccaaggaaagaactgagggtttggaaccaggcacagctgatctcaaggcgtggcttctcccatggcaagccatgtcactttaggagagttacttaatctccctgagcctggatttccttatctataaatagcagacaggctgggcatcgtggctcacgcctgtaatcccagcattttgggaggccggggcgagcaaatcacttgaggtcaggagttcaagaccagcctggccaacatggtgacaccctgtctctactaaaaatacaaaaactagccgtgtgtggtggtgtgtacctgtaatcccagctacttgggaggctgaggcaggagaatttgcttgaactcgggaggtggagtttgcagtgagctgagatcatgccactgcactccaatctggatgttcatccatttttttttttttttttgaggctctgtctcaaaaaaaaaaaaaaatagcagacaaccccatctacctctctgggaggtttctgagaggattaaatgagactttgcatgaatattggctactccatcaagtggttgcagaggaggggttcagtaggctgttgttgctgtttacctctttttcctactacactgcaggctccttgaggataggattcctttaaaaacaaaatacaaccagttcccagcacagtggctggtcgctagaatgtactgagtgaatatacaccaaataaagcaagacagggatactttgaatggaaagatcaaacaacagcaataatgaatagcaggcttgacttgtttaagtgaaaatggttaagagagactggcgtggacaaactgaactgatgcattggggaacagattaagtaaaaagtacgtaaaagacaacatcttcttcacacacatatttagaagggaaagataagccgtaagggacagagaaactgttatacgacccgaggggattataaatagcatccttaaatggggctatttctatatagcctctctattttttactttgtagaaagattgaatgactttgacctatgatttctgagagctctgtctgatttcttttttaatttacaaaagtttttatataaaattcaggtcttctcatttctctctgagcctccctcctcccatctgtctccaccctatcctaagtgcctccactttgggtactcttgggttttatggctaaatccagcaacgcagattgtgggcgggcaggtttcccgtattgttcctaccgcccatttctctacagcatttcttaaatagggcctagtctggagactttcaggacgagtgttatagttctcacttttcatttaaccttgaatcatagctggaaagcacattacgaaacctaggtaatcatcccctacacattttgaaaatttgggagcagaagatgattttacaggtaaagccatgaccagcgccagggtctaagaaacattgttgcggcgaatgggcaggtgacatcacatggcgcaggcagcatgttccagatccagatctgagatgggagagggctttccacggggcctgccgggctgttccgtgagcaccagggctgctccagcgccagctgctgctttgttctgcctgggagcagctttgtcggagacttgctactcaaacccctcatgaactaaatgagctgttaatgctgttcgcaatcgtagactcattgaagtgtcaggtggtagcatcaatggagcaacagaaagaggttttcatagagaaagaaaagagataccgacagagaaaatggggtttgcaataatttcagtaagaatggattcagcgggggaaagaaattaataggctatatcctaaaaagaaaaacaaataaaatttggtgcttcaaagtttcaaattaggcacatttcagttgagtcatagccagacactcaagtacggcagtgtgatctcagaatcagtcaactatcaaaggagaatagcaccatttaagataattagaaaaatgacttcagaaatgagataatctcagagaggaattattcgtacaaggctcgctggtgaaacttctgaaaaagagaaccttgcagctgagttcactttatagcattatattagggtatacttatttggtgaattttataattataccctgtaatgaatcttacctgcaaagacagagaaagactcaattcaagccacccttctatttgcatatataacgttgggtaagagaagaaggaattggaaagctcttcaccaacggtgcccatcactgtggccaaacgtgggttctaaattgcagagcctccaccattctgcaacttgaactctgttttcgtgttacagattaagatctatccacttggcctattttaaaaacagttgcacacatttgaacacaccttcgagactccaaattggacttctgtaccaccttctattttcggtaaccacaagggtgctggaaattcaagtactaacaaacgccacgacctacaaacttaagaacatgagctggagaatacatgattcctgggccgcagaacacacctgcgctctggactccaattattctttggggcgtttgacttacagatcaaggaccaggtcaggtcatctttgtttgggatgtttatactcttttttgtgaagtcttcaacattgcattgctctttttcttaacactcaaaagtcagcttaagatccagtgttaaagcttatttttgtgtttctttgagattaatatgatatttccattttccatgagaaatgagactgccttccttctactcttaagcagtcctgtagagaactcctaatactcattcatctccactcaccttatccagattcgaattagctacaaaggtactcagggattctatgcaataattattcaaaataaagtcataacaattttattatttagcaaagtataatttatgaaataaatcatatttataagtataattaatatataattgtgtattagataatagagtaattgcttatcaaatatggaatatatttatatataatcaagaaattaaatataatttcttataatgtttaaatataaattattaaatataattttagcaaataaagtcataatttcattctatagtctcctctatttttatgtttaaatggatacattggtgtcctcagaatataccatttttttacaacagaatcattcaagagagacattataactttttaattctcttgatttttaatgcaatatttcattaaactccttttaagcattagaagtttttgaaaatgtgccaggtgaggtattgttaggtaattttgctgctattcttgcttcttgaccattttctcactgttttagtgcatttggaaatgagtttgaccctaagtttcttcctacctatataaatacttagaaactcttgtactgtttccaaatcaactggagcagtgcctccatgggctacatttgccgttatctgtttcactgagaaacaatatatctactgtagttaaaaagttcatgaatggtccttgctaatttctaggctgttgaaacatgtctctaatttcacagattttgaggaggcaagagatctggagttttatttctttttttttttaatagcatagtgttggatttattcaggatatgagaagacagtcatctgcgcacaacacatttgctatgaaaaaaaattgttaaactacacttatctccactcactgcttcagtggttatgttaactttgtcctgagagtagctagcattggggtaagatgtaaaacacaaaaataatgatgtattattcgatcagtctattaacccatactgattagtggccacactcaaaaagacatattgtagcgaaaacattcccaattctcactcacatgataaccaccctggctctacaagtacaatacgtgtatctttgccacttatctgttgaatgtgtactaatagcttcctccaatgaataaggactctaaacttcagggatcattacaaggtacctgaggagctgggcgactctacagttggaattattttcacattaaaagagccaagaaatctatgaactcatattttactcaatttatttgtgcagccatatataaatagatggtctattcatgtaaaagaaactattatttcaattctaagaatgttaacttcattattcataaactagtccattggtctgataagaaagcatctctcatctcacagacaaatactctaaaatatgtttatcactaaacaactggctttatttagggaacaattcaagattccctgatcacattttctgaaatgatccaattttgtcactcagcattgactctgtaccacagaaattgcattcctgttccacattgtgtcaatggaaaggaaggctgattttggtacttagctatgaatattccatactctctgttctctgaaaaatgtgaacattgagtagaaaatcatgagtatgggggaaaaataataaaatatatgaatgtgcttttaagagcatggcaatgtagtgaggcttattaaaatgccacttttcataaacaatttaaaaagtttctctaagtactaatttgggaaagtatgctaattttcaatacttaaaacctacatctgtttaaattagaatgagcacatttttgccacatgtcacattttattaccatgcaatggtaagtataaatttaccacctacataagaacaaaatatgggcaatacatttatgaatacattaaatgtttaagaaaaagcttttctgcacttcatatgatcttgttttgtttgtacagactcatgtttgtgagctgggcaagttagcttcagatataaggtatacatagaccttgggtgtggaaggtccaggagggccatgacttctgttttattcatatagcacagtgcctgccccatagaaaaaacctagctcacagtggagaaaagtgaatgatggaataatggacgtacaaagccagccaaggtgaggctgtacagtgtttatcataaacagtggatgttctgaagatgacctcttgacttgttttttatttttcttactctaagtgcctcgggtgaactctttcacctagcatgttaggactaatctgcaacgtggaatttattataaaagtgagtgctcatacttgatatttgtcacactagatactcttaaaaatgtgaaaaaaataagattgtttttcccccacaagtacatgccgtcagagtaaccattttcttctttagatcagagtgctaatagtcaacaaagggaaattgttcaacatgtacagagccccaagactctggattccttttaaactccatgtgaactgtatttggttccaaagtagagctaatcattcttaatccaggggtaaaaccaccactgccagtaaacagacaggccccctggcattgaagatcaagttggtgatgatcagttttctaatgggacagcttctaaataatgtcccaatttaaaattgatgcaaattttgataatggaaattgacaaaatgtttatattcagagggttaaaaatttgttttctattgcttagtcttgtggcatcctagttagatgtctaaacatgattggtgctacctaaatttcctttggccccattctagatacatctccttattttgaaattttcataacgttaagtagatttagaaaatatgggacggcgtggtggcttacgcctataatcccagcactcgggaggccaagatgggaggatcacctgaggtcaagagtttgaaaccagcctggccaatatggtgaaaccccgtctctactaaaaatacaaaaattagctgggtgtggtggcaggtgcctgtaatctcagctcctcaggaggttgaggcaggagaattgcttgaacccaggaggcagaggctgcagttagctgagatcatgccactgcactccgacctgggcgacagggtgcgactccatcgaaaagaaaagaaaagaaaagaaagaagagagagagagggagggagggaaggaaggaaggaaggaaggggaggagggaaggaaggaaggaaagaaaatatgaacaagcaaagagaagaaaataaatcttcagaaaaaaaattgttgacatcctagactgttttttttcttcctccctctttttattgtcgtgctatttctgatcttgaggatacggaaatttggtgttcacttataaataacggtttccatagagcccatgagcaaaaaatacagagagaatgataaaatgagaaatgtaacattttcttttggctgatctgtagttcccacaaatgggcagtctagaaaactgttgacagtgcagggtttggaatgtggccgactcaagctggaatcccactttccccacatgtgtgaccctgtgcaagttgtttaacttctctgcgcctgtttcctcttctgtaaaatgagaataatgtactcatcagagcgtttgtgtgaatagtcaatgagaggtatttaaagaatttggcacgctgcctgacacactgtgcattgaatgaatggtggccattattattatttataagaatacttactgttattttactttcttaactaaccctgcagatcgcaaagctccaataccatgtgatgtgaagactcattttagatcagcccaagaaaaacaccattaagcaggtaaatccaaattctgttgggaaaagatcatatgatgcattctcaagcaagtgcttcaggattgtggcactgcagtctctactagcctaggcagtggcaggatggctgttctttgggaataaggtctttagaaaacagtgagctcccacattctatcctgtcatcatttttgccgtgaatactccacataatttatctccagatgattagtttgccttagtgcaatgtaattaattgggaccagaagatacaagagtgtgtttgttatactctaatgaagtttctttgagttttaagttggacttcaacagttaaagaacaacatgatcacggaaagtcaaatggattgtatattaagaagatttttatttatttatctattatggaaatttatttttattctgtgtatttttttatttttgacccagttgagccttgtttggtcaatacctctgggagatcttgacaaaacaaagcgtgtctgggccaaagatttcctttccatctctggggattttttttattgatgatgaagttattatggactgagagccagttatgtgccaggccctgtgaggtatcctttgcacaaattacttcatataagagaacgactggtcctatgatctatgcacagcatccttcttttacagagaccaagcctgtggttgaaagatatggagtcacatggcagcggccacacctcctcgaaagctaaatccatgactgggccttggtccccgcaggctcctgcctggcctgccccttcctgtcctgcaaaattggaaggacattggtgcagaattggaggagccctgcctttgacaaggcacatacaaagggaaagtctgtcaaaaagcatttgttttactttcttttttaaaagaaaaaaaaatactgttatttactgacttttaaaactaagtgaccaaacattggtgacataaaattgtttcttaagtataacaaatgtcacttcaaattgttttttggattttaaaaataaccaggtaaagaaatgacgttagggtggggagagagggcagcagaaagagagtggagagatggagaaggaggaggagggaggaaatccaggcagtgggtggggcacggccccactgatgagtgtctgagccatgggcgcttggtgctattcagggaggcaaggtcctatgttcataaataatgtactacagggacagtttgaaagtgatcattaaatttacatttttaaggcaggggagttgcagtcacagccacaaatataaaaatctaaataaggtgtcttcaagcattgtcctgggacaagaactgcagatacatggcccagcctcaactctctagatatcctgctgatctcagggaattcagatggtgtttcctgggtccagttctcccccgccacccctctgaggaagcccaatctaaagcatccatgttggatgcttttaccatgacaaggtgtggagaaagaggaatttctataagtagaatgataatgaggagctgccagatttctagcaggctggggactcggtggttccccttgacatgatgcttctgggcatgactgaggtcctgggtgtgtgactgagggtcagggtgatggtgtctgagcatgattgaagtcctgcctatgtgaggaatgtgggaaggatataacaggactggtgcacccagacctctggcctggggagaagctgctttcacctccagccaggaagagtggctcccagcagcaataccccacagtaactcaaagtcattaatcatctcactaagtaaactgtgtttgattcacagtaggcaagagtgttcacagatgatgcctaaaaacacaagtagtgtgtataggcgggcttcatgagcttgcaaactgagcatgtgcacctgaccctgtgcttagaacggccaggtgttctgtttgataccctgctgtcatcatctataacttattcatcatacttttggaattgccttttcatcttgcgctgggccctgcaaatttatatagcagattcttgttgggtaaatttcaacagagataaacaaagtttccaaagtttctgagactccaatctcacatcctacaccctcaaaaatagaagaaagaggtcggggcagcttcggcaattccttcctctctcctgccactgggacaagctcacctctgctgcaccctccctgcctcagcaatctttgatctgtaccttcagagaaggtttttatcctagtccatccccagcagacacctcctgcccagcctctctctgaaggtctacatggcaaccacgggctacatgtggctcccgggcacctgccttgcttgcactgagatgtgttatcctgcaaaatacacacaagatgcgaaaaaaaagaatgtcaaggaaatcattactattttttatacttgttgaaatcatattttggctgtactaggttaaaaatattataaaagttggtgtcatctgtttccttttactttttaaaatgtggctgatagaacattaaaaattacataggtggcttctctttgctgctcaatatatttctattggtctagacattttttttaaaaccacatatccacctaagtgttccacctatatctccatctcagaaagtctcaaaccagtttcactatcttcttcccccaaaacactttttccatgtcttgttttcccaagacagaaacctggtgattaaaccatagcctgcttctactcccaaatgccagctgagaactgttggttctgtctccataatctctccacgccagcacttttcccccagccctactgtcctgtctcagctgagccattcatcttttcttcctggattactgtactgtcctcctacaggaaattcccttattttttttaaattttcttgtagagatgggatctcactgtgttgcccagggtggtctcaaactactgggctcaagtaatcctcctgcctctgcctctgaaagtgttgggattaacaggcatgagccaccccacctggccctatgtgaaattcttgaattcattcccaccctacctcagtggtgctctcacaacagagaaactatcttataaaggaaatcctatttcaccttcctgcttgaaatgtctcacagttgccctgccatctggctctggtctgcttgctcgattttactcactatctctccatatcgggcatcctgcattccagccataccaatggctcccagggccctgcagatttatatgaaatccatcgctccatgcctgggcgctgtggccacgctgctccctggtcacggtgaggctgggcatgcctgggcgctgtggccacgctgttccctggtcacggtggggctgggcatgcctgggcgctgtggccacgctgttccctggtcacggtggggctgggcatgcctgggcgctgtggccacgctgttccctggtcacggtggggctgggcatgcctgggctctgtggccacgctgttccctggtcacggtggggctgggcatgcctgggctctgtggccacgctgttccctggtcacggtggggctgggcatgcctgggctctgtggccacgctgttccctggtcacggtggggctgggcatgcctgggctctgtggccacgctgttccctggtcacggtggggctgggcatgcctgggctctgtggccacgctgttccctggtcacggtgaggctgggcatgcctgggcgctgtggccacgctgttccctggtcacggtagggctgggcatgcctgggctctgtggccacgctattattccctggtcacagtggggctgggcagcttccagagcgaatgtggacatattcttaggccccacctcacgcacttcttcagagaaacctcagaggctcctccacaagccacgggtacccccagatttccctcactctatgcatcccatgcgcctctagcaacgcaggaccacactcgagtagagctgtctgtgccgaagactgtttggcagacactgtttcagatgcgttccagacacttaggagagcgactgacacagagcagggcttgactgattacatccctcgctcatttctcccggccccgtcaccttagttcatgcccaagttttcctcttgtcgaattcatcgacactatcatttcgtaatcttttcttgtgcccttcatttaatttgatactgttaccagttatatatttttcacccacaaatatgatcattacttttcctctgtaaagaagctccaatggttctctctctttctctctttttctttccctaaagaattaacccaaactacttaacatgatgatgatcctgatgctgatgacaaaaataggcatgggtggccattcattctgcctctgacgtgccaggcgctatgccggtcattttgcagtaatctcatttaatcctaatgataatactcagatgtaagtgctattatctcttccccctaagtagggaaataggggtcaggaaaagcccaggagcctgttccccaagaccaagttagcactacagagctgggaatgaattccaactttatgtgactgcaaagctcttccatgcccccacaccaccccacgcccggttctccctactgttcctacattccagacgcaccatccagcctgcaatgtgctttcacaccatgttcacctgcagacaatgctttctccatctaatgcccctgccttcaccatgcacacactgaagttgcctagaagggtcagtcacactctactctgtgccttccttctgcctcggcacttgtgatgctgcgggattatcagtttcccctccctcatcccaaagactgaacagtcaccaagagtagcaagtcgactagtcaccactgaacatacgcagcctggagaatcagaggtgcacggtgtgtgccttttacatgaactcatgcatacaccaagaatgatagtaatgcctgctcacatttgtttagcatctcccacatgccagacctcaccctacacaattagaatacataatccattcaatcctcccaccactctttaggataatgtatcatcttaatccttatttattttttccagaataaacttgtgattctaacaacttcaacataaaataaataacttttgctcaatatcaaactctataaaatcactaaaattggcccaatatcctgggttttttaacttgcattatttcttcctgataatgacatttaggccagtcaaatcctgtattaccgttttaaacaaagaaaaaaagattatgagttgcttttaaaattcacgtgtgacaagcagaaaaaactcgtggaggcagtttcaacatttaacctaagtgtacttagcaactacacttaatagctttttaaaaagcctcgtttttaaaaaaagtggatctttctttgcagagtgacttaaaatacatcatcatagtcttattaattaaacatgttcttatcagaaaaaagcgtctcgaaagctagtatatatgcttaattaagctgtatgcaaccatcagtccatatcttgaattaggctacatgtgaggccctgatttgccccattctttctgctacccagaacagcactgctcactgcctaccagtgtttccagcaaagatataaagttctacatgtctaaacgtttttgccctgatatcaaaagcaaagcaaaacaggtcttctccattcccattttggttaacagcatcaccatctgcccactggcctgatccacccagaagcctgtcttcttttttgaacttgaaatactcatgtgctttatttgtataaattcccattattccctcactgctccaaaaatagagaagaaagtaacataaatgtactgacatcaatttgagaactagaacatgttaccttcccgaagtatccatcttggatatagggaaggagacttagcctcataaaagcacatgaaggaatgctcagaggaaatactctaaacctagttttctggaattggtaagcagaagctctggagtcagttacaggttgtgagccttccaccaagaagagccacctaacataccaaaaaaataagcatgagattcacttaaagtttgacaaatttagcaactcctttccattgtctgcattttagagaacctattgatgctgttgtaacagctacagagaatcgtgagatgcccagtgacattggctatagtggtagcaaaccgggtagtgggaagttttctaacaaatactatgtaaaaggagaagcctgagtcttttaacaccacagatcaaacactgcaaatggtaggacgagcattagagtcccgctgaggtcgctgagacttacacttcacacgaattgtagtggtgcctagatctccctgaagagtggcagaagcagccgcccatcccttaaactacacatgtacctggcttctcaagactccagagtttacttagagatgagtaactagagcacaggaatttggaagagagtctttctataaactcccaggaacaaccaacaccagtagtggctgacgtctgtgagaccttctttgcgtcagatgcagtgctctcatcaacatccaacacacgtgcctttaatgcctgggactatggcgacactcatttagatgagggaactgtggcatagagggtttcgtacctcggcttacttcactgcaatcggctttctaaaccagaactcccacccgacaatgtgtgagtccaaagtccatgtttctaggtgcagtggctcactcctataatcccatcactttgggaggctgaggcagacggatcacttaaggccaggagttcgagaccagcctggccaacatggtgaaacccgtctctgctaaaaatactattagctgagcatggtggtgcacgcctgtaatcctagctgctcaggaggctgaggcaggagaattgcttgaacctggggaggcagaggttgcagtgagccaagatcatgccactgcacttcagcctggatgacagagcaagactccatctcaaaacacaaaaaatacaaaaagtccatgcttctaaccactagcaatcaccctataacatattcccctcaatgaaaaagactgaatccaagaaatctcacctgcgtcagactttctaagtcatagagatttatagtaataattttaaatgagtctttgactttcagacccagcgtatgaaggaggagagtgtgagtcagtgccgttcctgggcgtccgctgggaacttccctgactgtccttctggctctcaggagtggagctcacttgctcaattcattccagtgtcccagaggtcacagtctcccctctgtgagctgggctgtcctcggtccctgggcctatctctttgctgtcctccctgggatcttgcccctggggtagccctgcttcccttgcagctttcttctctgctgctggtgccttccccagggctgtgcatgggcttagctctttcttcatttctctccctctctcctcttttcttcctgctgtcttagctgggccccctccatccttttatttcctaattgtacctgttgcttccatacccttaaaagcatactccattttctccctagatgtattgaggtataattgacaaagctgcagacatttaaggtgaaccacgggctgctttgatacaggcatgcactgtgcactgatcaccacaatcaagttagtgatcacttcttatcttttttgtggatggtaagaacatttggatctactcccctagcaagctgcaagtgtgcaatgtggttttattcactacagtcaccacgctgcatgagatcctcagaacttatttgtcctataactgaaagtctgtgccctttgacctcattttcctccccccaccaattcctggcaaccaccattcgactctgtttctatgagttcaacatttagactccacatataagtgagattgtacagtatttgtctttctctgtctgacttgtttcacttaccataatgtcctcatatgtatgctgttgcaaatggcaggattttcttcttttttagggctgaataatatcccattgtgtgtatatacaccacattttctttatccattcatccatggacaggtccttaggttgtttccatatttattcctttcctttgtatgtatatccagaagtggagttgctagatcatatggtagttctggttgtaatttttgaggaaactctgcacaattttttacaatgtctgtaccaatttacattcccatcaacagcttacaagggttcccttttctccacatcctcaccaacactcgttatcttttgactttttggtgatagccatcctaacaggtgtgaggtggtgtctcactgtggttttgacttgcctttccatgatgcttagtgatgttgagcacgtttccatacgtctgtttgccatttgtatgtcttctttggaaaactatctatgctggccctttgcccattttttaactgaatcatctctctctctctctctctctctctgtgtgtgatgctcttgagttgtaaacacatttcttaatctttccatgtgctttaatctcagcactttagcaactgtcaagaacaaagttcttttcaaaaagttcatctcaaagttggccactgactcgtaacaggtaaaacccaatgagcacttccctgagcctcagtttcttcttttctcatgtgaaacagtgatgatagtgcatacctcccagggctgttgagccagactcaacaatttacatgaaagcactgagggggtgccaaatacatgtgagtggtataaaacaattcttgatgctacaaagcttgcttttccacactattgtcaaaatcccaccttgttcgagccccaattaaaataccattttctctaatccatctttcccgatcctctaacaaacttcaattctctgagcaatttattatcatcttctggaactccattgcttaagacgatcaaagagtttctttattgtataagttacttctgcgcatgtcttttgaaggaataaataaatgcattgattatatctgccttatagcactccatcaccttctatcttaaattacagtaactagcgttcctgtcttcctgcactaaattgtaagctctttcaatggcttcctggcttattctctcatcttttcctccggtccttgatggatgtataataaatgaatgagtaaattatatgaaaatgcaagtatgatttttttaatatacagttacaacttcgacatccacagttgggtctgaccacttgttaagttgtacccagaacttaggtctttctcgctctccacgttccctatcaaggccatcttttcaataccaaacaaattagaaagaatacaatcagctaacttacactaacatactaacaaatgggacaacagtcttcaaggtctggaagaggagagcagagaactcatcattgcctgctcaagcccatctaccaggaggggaaactccagatactgtgggccacttggcacttaggaactcatggtactgatctgtatattgggcagatatagttttttggtgatagtcttaaaaatcatgtgtcacctgtcatgacacttgccagatgaaattctgattttatttcccaagagaatgcactgacaaattaataatctgacctttaaacgggtgatatttctccatgtcaatcaacaagaggccattctgttttgttgaccagataaaatactctttcactctctgaggggttagcgagagtgcatgcagatttctccaatgctttgcttttggttggaagcagaaacatttaaatttcaaggcaacacttttcctaattcctactgaactcaaaagctctagtggttcagtgatcccattggtaacaaatacttagagggccagagtccttctgggtcctatccttacgctcctgttctctcctcctctcaggccttttctgcaccatgcaaacccagcacctcttctcacaggctgggctaaaggcagaatgcaataccatgactgaggagcctgggaatgaggcaattcattaacagaacattccccaggaaacataattttctgatcataatctctttgttcctgacagttgcaaaattaaataccagagccaaaaaaaagtgaggcaccgttttaagggtatgttttcctaattcgatcttcaaaggaagcacaagcttagggttcgaaatcattatgatgtaatattatgccacataataatacatagatccaatcattttaccagataaccgtcaatataaagcactgacaggacatttgggacttcgggtcaacaggaaggtggtttttcaaactaaactatattatttatggctttgattgtcatttacttttacaacataagggtgatggtaattctgctcttctgccaataaatctaaaaattaattgaaaatgtagtcaaaatccttggcacactttagaaggaagatttttttaattaaaaaagccatattaatcattatataaatgagttatattagtcctgtaaaattaaatctatggtggaaaggaagtcagtgagtgatataatcggatttcagaacacatatcatataaaaagttatgtttctaaataaagtgagtgtgaaagaattcaggatatattatcagtcatctgagttactgccctaagacagcccttctcccaaaacagatatggtttctctgacaaagaagataagtgtgccttctcatatttttattattttcttaactgtcagacataactcatatgtagttaagttgctcagaaggttaaattcggaggaaaaattctacaagtggtttaaatgagccaaatcatttttggttgcgtcatgtttcctccgttgaaaaagtctcgatgacttaaaaaggattgctttgatacttagcttagtgttttacccaaaaagcatactgaccaaaaacaaacaaacaaaaaacccataacaaaacaaacatttaaagatatgtagaccagatcagttttctcctgatgaaagtcacatggaaccacacgcaggttaccttgctttcagcaggtccctttccttgggtgtgaattttatttgttacaataaccgacttggcctagttactcagccatccttcgttcactcttggtagtggacatggcaagatggtgggtaaaaacacgtaaacaagactgctctctcgtggaggtcactttcacatggaaagactggacacgtcaaaacacttcattaacatgatataaaaataatacaacatgtaaagtggtatcggcgcatctaagacaaagcgattcaatgttaaatccctctttgggaaataatttaagattgcagaaaatgtttctgagaaattccaatgtaaacgtccttaaaagtccctactttttagtatttggtattatacttatagattttgtgattttccagatttttcattaaaagttaatatgcataaaactcttgggatggtagcaagtacagagtgaaatctatataaattattattattatcaatatcttttggagtgaacaaattgaacattttttgaataatcttttgcgtagttgactgaatactagttaataggtttctattgttttcttgagttaaatcagaagcagatattttgattgactgtgtaaggtcttgcagcttctatggttttttttaacttgaaaaggtcttcccagactgatacctctttctgtcttgaactctctgttcaactatattctaaagccttaaaatgaagatcttcaattttataactctggatttaaacttttctttcttattcttttttattttacaaaagaaaattttaactctttaggttgattatatttcttgatgaatgtgactgtaccaagaggctttaaaaaaattgagattagaaatcagtttttcttatcttctgaattattcaccatatgatgtgttgcatttgagctttatctatgcttctggtaatatttctgtcttatataattgttaaagtataatgcttctcaccaggaagactatatatatatatatgtttaataatagcctttttaaattttcatgtgttttttcttctcctttgttttctgatttttaaaaaatcagaaaaatgtctgaattgtcactttatctgtagattcaaagagcactttctaatcatgtgttggcattagcacaacaccggggaagatctgattgctgtaagccgttcattcattcagcaaatactgactgaatatgcagtatgttgacctgtttgctgagggcctctctgttccggctgccattctaaagcgagtcaagttttccctgtaacttttattctgcagaagtaacctgtacctttttccattctcttgccattcaccactctcctgacctccctttgcgtaaactggtttaagcctggcgctctaggtccatccaacaacaccggtctattcacactgtagcagagcaaccaagcagttatacaattttcatcttaactactagtaatactatgctataaaaattttgaaacctagattttgagatattgagcaaactaaaatatgtagtatttactatagtgcaagaatacgtctgacgggttaaatgcacgcgttttggaaagtgctcaaacccttcaccagatgacacagttatagcacaacaacagctgaggttattgttatctaatctcctttccctcgttaactttagcacagagaactgaaataattgggtgtgaaggcatcttgataatctaccaaaaaggctcatttttaagcagccaagcgttgctctcttaaacttttgttgtttagtagcataaagtgtaggcaacctgtatgaagtataaatatctggtattaaaaagacccagtgaggcagaagtcgctgactcctctcaataggtggaagaggattctccatgcagccgaaggcttaatgaagcacatttccaccagccaggctgctgcctctgtggtgttacctcttcagaggactcagtgcctctgagaagctggctgtcctcagcgagaagtaagtacagggacttctgtttagaggagactagaatgaatatttatactaataaattttctccaacatagccaaaatctcatttgaatatgtttttctttctgtgcatttaaaacacttgccattcttcatggcatcccatgcttgtactcttagaggatcttcacgagtggcacagctcttggctagaatcctatttttttttttttttttttttttttttttttttttttttgagacggagtctcgctctgtcgcccaggctggagtgcagtggcgggatctcggctcactgcaagctcctcctcccgggttcacgccattctcctgcctcagcctcccgagtagctgggactacaggcgcccgccactacgcccggctaattttttgtattttttagtagagacggggtttcaccgttttagccgggatggtctcgatctcctgacctcgtgatccgcccgcctcggcctcccaaagtgctgggattacaggcgtgagccaccgcgcccggcctagaatcctgtttttgctatagtttgttggactccttgcggctaatccttgcagctatattagtctctgagggatgctgaattgaatagaacatcagaagatttggagcctgacgggtttatgttgcccctgtcctcaaattcaactattccagaaaaaatgtactaggacaaggaacctgaaaagaagaactatttctaacaatggattggatgaactctcccattcaaagcagaggatataattcattataagacttgtaatttactttaaccactgggaaaacatctcagagggaagagagaaaaactgaatttctgattaaatttaaaaaatcaaaaatttaataagtaggcaaccgtataaatgaacagaaaaaaacaaaatatcaccgaaactttcagataatgttctttgttaaaaataagtttccctaaattataatatgaatatataaagagaaattagaaaatataatgagaacattaccaggcctttttgttttctttcttttttattgtgtttttgtttttttgaggtgggaaaatctttgaaagtaagacccttgattggattcaggaaagtgaaagctttctgaatttttgctcaaataatgcttctctaaggtacagaatttaatgctgaatttatgtctacctcacctgtatagggaagaggaaaccactgcttttttggccaaaattcctacttggtaaactagtatatttccgttttgaagaccaaggtgcagtgaagtgtggtggagttccatatggatctgttatgctgcaaacaccaaagtaaaaacccgtctttgctggttccccgtcatttattcagcaaatatcatcttaattgaacttaagctgaaacgtgagttcttatttgccaatactcagaactcaacagttgcagaagtgtttccttttaactgcatgtccatgtcttgagtttttcagaaataatacagaaaaacatattttgaaaacatatttatctgtatttttccacgtgacagtggcagtttaggatttaacaggcatatccataattaaattgttagtttgaggaacttccagaaaattatctaatgcaatcatatatcacaagtcttctttataaaatacaagtgcaactcatttcattatgctatccatgtagttagacataactgagacctttaaaaatattataaatgacttaaaatagaaaatgttagaaacagtacaggcatattacaaaatcatggtttctgaaatctaattactatatgcaatttaaaataattaaacatgattagtctttaagatgaatagaaccaattccaactttagctattatttaattatagcatgctgtacattaaaatcagctggaagatagccaaaataagctttaaaggacagcatgataattaagaattgctatttatcttacttttattagaaaactcaatgctggaatgaatgcaataatgtcaagaaatatgaatttaaataatttcctaaatattttactttctaatcccaaatatcaggatattttaaacttcctcatcaattctactttatatacaaaaattcatacagtattaattagaacttttgctttcaacacagatatcttaaagacaaggaattatgtatttataacttcttaataaaactatgggtacattcttatttttgattgtggcagttttttcataaaaaggctactgaaatcaggcttatttaaaaaatactaataatgttatctaatatagaacagagggtaggaagtctctgtaaacaaacctatatctatatcaagagtgattctaagagaatattctctcccttacccaggtactcaagttgtagggtaacataactagtgtaacgtaactagtgatttccagtcaccttttaggtttacttaggaacattaaaagaaatgctgccattgtagacttcatttcaattatttaatctctttccagttcacgacctttactttcttctggtttcagcaagaaaaacaacttcataagtgtcttacattataatcggctactaatcatcatcaactcaacattagttttaaacagtctgattccataacaaatttgtaatagggatattttctatacattttataatagccatggatagaaaaatagtattatttatatactaaaacattcaagttgttttgtttaaaacatacattgtaaaattttccctcgggaaatttggatttattataggacagttgtagcttttatgaaattgggatcctgaagccatattttcaaatcagaaaaatgaaagcctcattgttgtttttcaaatgttttaagtttccttgataaaaggcagtattaggacttctatttctaggtcaagtctatatttacagtaactaataggaaaatattgaagtctgaggttaccagtacaatgtctgaatgcaaaattctggacactggacaaagtactttagaatcagaggccagcaaagctctggaaggctgtgaacagggacaaatgcaatatggttcagcagacagaaagtcagaagtaagattcagatgtagccaagcagggtgggggacagtgaggggggatgtctagctggacttgaagggcgtatgaaagcagctgtccttgcaggggagatttaaaggaaatgactcttcagggggcactgcatttgcaaaaaaaaaaaaaaaaaaaaaaaaaaatctgatatagtatgttttggaaattccaaaatatttgatattgccagcagaagagttggaaagtggcagaaaataagggtctaaaaatagccataagcgaaagtgcaaagtcttgaaggatagagattatgtctctgaacctggttctcaaaattgttgaattattaactatggagatgcgctgtacagaattgaacttaaaatggtcatctgtgtatagcatgtcatcttaaaaggttactaaaataggaaagaacttgcacaggtataaagtgtgtgccattcctcccgtgggctaagggtcttgtctcacttggtgccactatcaatgcaacaggcacagcagtcgggtgtgccctggatatttctacacctcattcttctaaaagctcccccaagaaaaattaataggaaatcaggtgcttgctgcaggtctttgcactgtgtcaattctaagaaatcctttggcagtgtaaagctttgaaggaaattaaattggagagagattttctctacctttcattcagctcatatagaatcccttacttagctgatatttttgctcatagaattggactcagaactaagtctgttcatttagctttcctttgaatgttaaacataatgaagtacaaggccgtcacctcaccattttatcccctacaacccgcataggcgtacacttatcaccaaacgtttgcacatgtttggctccactgagattcttagtctctatctttatattttgactattttgacatttagaacaaaagtttggaaaactattctcctactgctttagcattctcttatcttagggcttatgaacattgctacatctctgaaacaggcggttcctgcccatatctatcagtgaaaattatacttaaaattctgaagagactcatgtcatccagattttggaggaaaaaggtagcaaataaaaatatacttcttagaagtagatctcagttactacttattttaaatttcacagtagattccatcttttgtagataggggttttgttcaaagtttttgaccaaacatttttattaaatattttcaatagtattataagtgatctgacatttttggtaacaaaacaaccaaagaactgacttgagtaaagctgaaatgttgctgaaccagaatctaatccttactccgtcattttcttaccagggattttgatttgactgaccagtttcaatccacagtaacagctttgttcctaagagactataaatcaaggaaatactcactaccaggcaattcctcctgcaattcggggtctgtgctgttattatgaagcaactgacagcaaacatttgctgcaagtatgagcgcagatttggatgaggtgtgcggtgtttttggtttcactctttatctctgaaacctatctgcttgtgagaaaaattgtgcaagaaaagaagttttactgccacatacctcagctgtcctagaactcaatgcagaggcttcgcttcctttctttccttggattctgagccgggggagcacaatgggggtcttgtgctctgggccagcaaggcatgcagatactcggaaaggaggtgtgaacggcttccaatacctacactgtttgctttacaactaccccaactaaatcaaacaggacaccaagacactcagtccagggtaagcaagtacaaaatccactggctattatgacccacatagagaacagaattcttcaatttaagtgtgtacatagctgtgttaagagttaaataaatcatttacgaggcttaaaaagaaatgcttctcatgtagttctttttcatgtagttctctgaatacaagtcaaagtgcaggtcacgaaagaatccattgttcacaagcgagaaatgttgttggctgtgaggacggttcagaacaagccatcgtagtctgctcaaacagtaaatattggttttaaaaccccaaagcatatcggtcatgttttttatcttccaattgctagaaccaaaattcactgaaacaactctatgtctctgatactattttctagaaatgtgtgtgtatgcgtgtgtgtatgtgtctgtgtatgtttgtttggtaaatccaaatcacacaatcaacgtaaatctttcaggctaagttttgccccagttatttttatgctgtgctttcaaaaaggtcaaaaaagcttacctctgtcagtgtactgggacgctcaggaagccccttctccgcctcggcctcagcgtgcagacatatgccctgggagcccacaatctgttaacaggaagcaggtaaacccgagagcgtccgcctgcgttccagtccagtgcccgtcccagcacacacctgctttttcagacctgccgctcatatgccacagccacgcacaggaccagcgttagcagagtgcaacaccctccgtttggatccctcgttttcagggtaagcagctagggagctgctgagataatattgcagggaaagcttgccttcccaagacaaaaacctttgctgctgcctgatagcagatatgcagcattatcactctgcattccacattctccaatcagctaattggaacggcagtcaacagcctgtccaaaaggcagcttgcaggcctgcgtggctgtgatcattgtatactaacatgcccattgcttctctcttccctgaagagatgtataaaagaggcttcttccagggcgaagctcagcagaatatgccacactgttttccataagtaaaatggctggtcctctcagctctgctgcagacagctcatt

SEQ ID NO: 2073 - DNA, 225452 bp, Homo sapiens
atgcattttctcttagtttaacaagttggaataaaatacacaatttttataaagataaatgtcaagaagaaaaactgaagtatacttccaagcaaaatttattagatgtctattcaagaaaaacacaatgacctttgcttgtaagaattcaaagtcaattacctggaagccaggtatgaatagttttttcttttaaaatcagatacagagagtagaaacagtaatttttcttaaatatgacaggcaacagatattgaagtcttttctcataaatggcatcaaagagaattattcatttatcagcaaagctgcatgcagttgacttaatttcaaacctgaagcctttaaaatatgaagctggttatgaacttgacagaaatcaaggtaggctactcaacgatgtttctttaccttcttcctaatgaaattcccttgtcatcagtcagtagatatgtacatttcatttggcttctacgatcttttaacttcatagatttttgcataaatgctatctgacagaatcacactatctaggggtgcttgtgatctgtgagataaggagaggctagtctgctgaaagtgttgtcgcaggataaagaccaaattaggaaacgcccctgttttctcaacaactagtctgtacaaaaaaagagcaaacatatgtacaaaattctagaggctacgtacattgtgaaaagatcaatatcactgtccatgaaagagatgccataaaaagttttatctgtaaggtgctcaagatccaaagatgaacagttcttatgcaaagtcataagaaatacaaagctagttttcggagcaggtgtaattcaggcactgtgaaccatattaaaccttccaggtcccaatatcattttttaaatttctgcttcagggcagaaaataaaacctgaatgatttaacattgcttctaaaaagtgcctaatttattcctaggaaatattttacacacaccaggaaaatcaggctcaacatattcctgtcctcaaatgtagccaggattctgagttccatagaagaaaaataattattatagtaaaaataattgtagtaatcctaatccttgctaaaaccaactttaatacttgtgatgcttctgtactctatttctataaaataatgtgtgagattctattacatttccataaaatgtacaacatatcatatggattatatgttctcatacaatctcaaatgtgtatgtgtacacacagtgaaatcttacctactagtattgcttacagatactttcaggtgtctgttagaataattctttgcacctctcactaacactgcttttacttacattttttcagataaataaaacactaagagctcattgttcatgatgctgatcattacattttaatataaaatagcgatgcaactttacaacacaatagttttcccctgtagcctagctcagcctcttgtattgtcatgattattaccgaaggcttttatttacttactgtttgcacttctaaaaaatgcaaacaaattgcagaaaaagactcctatttgaaaactcacattcaatcagcaaaatcacactcatccaaattaactcgcctcctcttgctttaaaggttgtaatcactgtgcatattacaacatgtatgtgcaggcaaacaatagctaaagtacagttacagttgtcatattgtgtaaaccaagacactaggcaaacttgtgaaaagaatacacactgccaagcgaagaatatgaaaatgcaaaccacagcattccccaataaacaattttctggtcgtcttgggggagaacatcgcctggggggagatgttgaaatggagccacgaggctggacagcctcctggagacactttttttttttttttttgcctcaaatatttgaccatttttaaatatcatgatttttttctttctgatcccacattttgacgtgtcaaagcttagagcaggaagtaggaatccacactttcacggagggggaccagcctgccatgtcgtccccaggctcacagcagcggcggctactctgctggtggtttggtggcaggtggagatggtgacggcgcattggaaaccgtaaggcatgacaacgggaggcccgcggggtgtttcaggcgcgttgacgcaggtgcatggctggcaggcggcctctacagaaggagggagcgcaattcacagcctcttgacgtagtttccggggaaagtaccaaagaatttggttcttcttgaggtccctgaaaatagaagcgagtcatgaaaggggggtgacaacgatatcagttcatacacatgggcttgaatacttcccatttacaaggcctcggaagacagcaagccccgaggggtttggaaaagaaggcaggcaactcacatgaagcccataggcagacaaaataagcagtgttagctggttgcctgacgctctcactgcccctccggcataaatgctgcgctgccatcgcggcaggctaaacagaaatgctgagcctcccaagctaaagggaaagtcagccctgctgaggaggggggcggaggagctcagtcactgaggctgccacaccagagtcgggggtgagggatcaaggcgaggctgacaggtgacagggtgagtggaaaatcctaagagcaaagcttctcagggaccagcaacccgcgcaacacaggtgcgacatgaagacatcatctgtggcaggctgtcgctgttccaacagttttatcatcttacagaagatcatggtcagtgccacatcatttatttaaaaacagcactgccagagtccttcatcgagtatacaatttttcaacaatttacaaatcattaatgaaaaaaaggattaagcactatttgtgtgtgggagttctatcagtggcatgatttttaacatggtgtgtgtttaaccacacgcacaaatggctatcataattatgttcgcctctggtttcaaataatgtaattccttggacacttcttgtaaaagttggtgcactaaattgctaaattcttctttaggcagcgcagatggaccggataagggtctctcaagcttcatctgtctcctatatcctggcacttactgccttggtttgatggctgtttttctttttccttggctaggcaagccattttacgtttctcctccctcctcctcctccctcctcctcctcctccttgtttttgagatggagtttcgctcttgtcgcccaggctggagtgcagtggcatgatctcggctcactgcaacctctgcctcttgggttcaagcaattctcctgccttagcctcctgagtggctgggattacaggcacctgccaccaagcccagctgattattgtacttttggtagatacggggtttcaccatgttgaccaggctggcctcgaactcctggcctcaggtaatccacccgcctcggcctcccaaagtgctagaattacaggcatgagccaccgcacccggcctttttttcttcttttaatggaaataaaatcagaggcttgtggccgcaccagggcctcaattctttcatgattttgccaccgatggatgtctagagtgagccctcctctcctctcacctttcctctcttccattctctgccctgcagcctgtgtttccttttcacctctttctgtggcccagtgtaaaatacttttgtctacaaatgttttcccagaagacctctcgtctttttttttaggatggtaaagatgaagttgccttttaagtgggaagaatggaacgtctctctgcttccaccacaaactaaagttaaggtgagtcactgaatgttcgggcatctacgtcagacctaggaaacgggagagctgttcacttaatctcactccctctgaaattagattctcactgtggacaactaacattttccacagcacagagcgttgatatttctcttctggggaccatttgttgttgttgttcttagatctcaatctttcctggtttttgctatttaaagaaattgtcttctctcagttgagttggaaataaagctcgcagaaaatcacacatagctgaagcagtgaatactaaactatattaaaaatgcaatagccttgggattacattgtgcatatgaatgtctgaaagatcaaaggcattacgaattcaaaggaagctcggccatcacagcaaaccacgggagtgagcaaactcaagcaaattacaaaatagccgaaggtgcctgaggaagaagcgcacatacccacaaaccagccgtcatcacacttttccatgacatcaatgacatcactttctctgagctccagctcatcttcattcctgggagtatagttatacagagcctgaaaccttaaacaggacaagggaatgtgtttaaaaacatcttgacaccttcatgaaatatagaagatagaacaatattcattcttcctttaacattcctattcttaacaacattctgttgggtggtacaagcctggtaagcatgtaaatagcattctattggatggtacaagcctggtaagcaggtacatagcaatatgtagatcttcacaggcattagaacactctaacaacattttgaaactcacgaggaatatccatgaaaattgtaacattcataaattggattaaaatatgtcaacatgtataagtcagacccgcatttcagttgtccagccatctaacgtctatcatttagacattaaataatagtacaaaatataaaataagtgatatttgtattatttaactgtttaaaaacaagaaggaatcacaattttagctagccataatcagaagcaaataatgggggcttgagaattgaattttcaaaggttctaaatggagatagacaaaatgtgtcagacatgtctttttaatcactctgtgtgaattactatacaaaggaaaattattttttttactaagaggaattctttagatcagtttaatgttatggtttggatcagtgttttctgaggatgtagaattggaagatttgatgtaattagcctatgaagttgagtagatgtattctatgtgcagttattactgattccatttcaagcagactatggacataagtctctttttaaaatgagtcccagaaaaattgtatttgattttaaaactctctcttgaaataattttatataaaaaagaattattgatagaatgctatcactttcctttcccggcctgaattctttgacagcatatactgtggtggaaattgatcaataatgaattcagacactgaatttgtggtaagaaaacaccatacattataataaatagtaacatgggctggtgtttttggaaaatgaaggcgaaattactgtagctgagaaggtcaagaagaatttgataggcagttaacatgaaaacttcttcataatagtactaaaatattaccagtactgtgagggggtttttaaaaattgggaatttgtttctgctgctttctgtaacagtcatgtcattctgctaatgtgagaaaataattaccactttctagggtattttagattttttcatgccaacttaaaaaagttgataatcttgactaccgctccggaacaagaatgatttatttttaattactttatgagtcagaaaataatattttggtagaacaaaactattctatcatttaaactcaaatcttatgtcattaataagcaacagtgacctactggcttccccccgttcatccagcatttggactgggggagctggatagagttggcttcagagaatgcctaacaacatcccctagaaaatattgttttccctggcctggcaccaaagcctgaaatttcaacattagaggcttcttctcctgttaaaacttcatccttccagtagaccttacagccacttatatccttttgagcatgggcttctgaggccttttcttgagagaggggtttgtgattatggggaagggcagagaaaggcagctagcatcccagagtagtggccaaaaagacaggcaggtgtggaatacagaaacgtcacctgatttggatgtttgcatgtggccagctttgctaggggtagtccatttattttgttgcttgtgtaaagaatttgatttggaggctgctcaggtgaaggggtggtatcttttgtgtatctgtggggaaagttcacggtcccttttccagtttcacatttgagagagatggtggttcctgggctgctgttttgatggatacacacggcatttctcactttgggaaaactgattcttttattgagcttctcaggcttgaaccctgcccaggctcatctccacccactcatggagaccggttacctaaggctgcaaacctcagctgctggaaagaatctcaaggtctcagagctaacgcaacaaaattggcacagactcctgcttcatttttgtctgatgaaagccagcatgtttgtccaaatttatttaccattctggtttaattagaccacagaaacaaaaacaaaacaaaagaaaacccacggagttttatggaaacgtaaacacaccttcaggaaatcctcctgcctctcctggctttcaaagccagtgttgcacaatgggaaatgaagacaaatccaatgttaaaaaatgctgttgtgaaagatgtgttggtgaggtgagtgatggtggtggggtaaggatgcctcaaaaagaaaggtgtcttttaaacaggaaatgctgagccagactggaagccctctcgataacttgcaactttttctagaacatatttcactaaaactctgaattgtagtgacataacattatgttcctactttggctcaaaacttatttttaaatgaaagcaactaagcaacaccctaaaatcccactaattcaggctataatcaaatataaatttaataaacaatgttttctaatatacaaatcaggactttgaaaatgtaacatatctttcattcataaacactttgaaagctgtttaatataacatgttggtaatgcaataaacctaaacagccctggaatttattttttatcatgtgatcttatcatcgtttgggtaaataagagaacaaacaaaagctttagaatgacaagtcgtatttagtgttttccagttaagcgatctttttgtttgtttgtttgtttgagacagggtcttgctctgttgcccaggctggagtgcagggccatcatcatggcttattgtagccttgatctccctggcccaagtgatcttcccacctcagcctactaagcagctgggactacaggcgcatgccatcacacctgactaattttttatttttatttttgtagagatggtgttttgctatgttgtccaggctggtcttgaactcctgggttttggccttccaaagtgctgggatttcaggcatagtgactgcacctaaccttcagtgagatttcaaatgattatcactgctaacctgttctttccaaaatacagactttcccgcaacaagaacacttttctgcctgtgctctgtgagagccagtctcatccggagctgctttttgctaagtttcaggtctgtgaggagcaaggaaggacttgatggtgataaaggcaccaggtcatatgccaggacctgccgcaaggaggaggctattgttagcctgttctgctccaggtgagcagagtgtgggcagtgggtcaggatccccagtgtgtgctcagatatgggggacaaggggttaggtccatgaataagccttcccaggggtctcactctcgactcacagtgtgggcagaggccaacaggaagctgataactcctgaacgtctctcagggacaaaatgggcccgaaaaagaaacacacagagagaatcttcaagacaacgtgtgacaccttcaggctgatttaactcatgtatcagaaaggagaaggaatttgaaaggaaagtttgaaaaggcattttcctggtgctgtggaagtaatcgcatgtaactgaataacagtgagtgttttaatactgcccttttcaaatgacccttctaagcatgtaactttggaatgatggaatgatcgctttaggtcttttttacactgaggtccacttttaccgtctcccagtgggtgtaaaagtaaggttagaacatgttctgtatgtctttgaagctcgcagttactcgttacacagccagcagagcagagagggagacagagttatccatcttaggaatcactgaagcattgggaagttttcctagtgtgtcaattaaaatcttctcagagaactatgggttcttttaaaaattagtttctggtcactgtcataaaagatggagagactattacaatttctcgtaatttaagaggcctcatgttagtttgatctttcacgtgcaaagccatacatcttacattttggtacagttgtccattttgtgggtcaaggttagtctcaaatttagaagataagaagaatacttacggttcccccccaccttgaatattttcatgagtaaacacaggacgctgtggctgaaatgaaatgattttcaatgtaatcaatgtttaaactggtactaattaaaagataatttggataatggcatggtacttttcttgacatttaatatttcctgttgtaaaaaaccaagaggaagaaaaaaaccaaataaaagctttctgcaggattaataattaaaatatttaaagggagctttaaattaaagcaaaataagcaaggtcaaatgttttgaacatgtctacaatctagtctgctcaagctttaaggaaaagtcagggtttggtcccattgatttttcaaaggccaggaataaggcaagaacatagacggcaaaccactagaataggaaatatagacaccttcatacaaccttattctccagcgttttctcaaacaagcagaaaataaaccacatttagtttaacagcaaagtatccacactcattctttcaatctttccttcacagacaacattttcacatacagcacagaggaaaatatcaataggcagacatcccatgctacatttgaattaacattttctgttctcaatgtggagagaaaacatgcatttttaaaaagagaaaacagaactttggaatgcaacgaacaatatccgggtaacatgtaacattttaccttagaagagaaacattggtagaaatttccagtgcactgaactctcaaaagagtttcttttctttttaaactaagcatcaagaccagtatctgtaatagatacttataatattggaaatgacaagccttagcatcccatatacccacattaatattttcagtgaatgaaagttaacatgtttgttgaatatataaactcagtgtaatttatattgactacctaaactttaccttttaggggagaaatgcaaacaaatcattcataatccatttcaaaagcatttgcttctaaatgatagctacagggtaaaatcagaatttgcatggcaattatataagtgactgtttgatgactactgaaatagctattagatccatgtccttagactttgggaccagttcttagatttccatagttatgagtggattactgataggctgaaatctcttgctgccaattgtccatagaaaccccactgatccaagcttggatggataattctgaggttcctttcagtctacgagtcaatgattcacccacttcctaaattctttatccaccccctttctatcctacttgtctatctagcataagactaggtactcacagtactaaaactgtaagctctgactcggttaactggaaacctttattaacagtgttcttagaaatttcactcaacagtctgtggatagaatatttaaaactagagtgcgtaagaattactgcacacaattatgacttaagagtgaaatagtttactcctgtaaatcaatatgactactaatgatgtatctattattaaaattggaagatattcatattttaagaaaaattatgactaaccagttttccaaccatcttaaaggtcatttaattcaagatattattaaatcaatttaaatatataagatggtaattgtaagtcattgataagcctgtatcatattacctatttcaagttctcttccagtccaataaaactttatatatgtataaaactttcatgcagaagtaagatttgtatacatcaattgccattaatattattttgtaataactttccagtctttttttctcagtcttctttcttatttcaaatgtctgcagaataatgttctcccacgtgtgtctacatatcatagttttcttaaccattcctctcttttttttttagttttgaagttagaattggtctagtctttttttttttgctatcataaacagcaatgctatacacattttttatgcaaagagctattttcttcttttgaactattctttagaatatattcccaggagtaaaacttctggccaaagagtatgcattaaagccatatgattttgagaatgtacatgttagtcactgaaaaatactgtactcaaaagtaacttgaaaatgtctaatatgccagactgcatatcatataccaagatagctactactctttccccaaaacaatcatagcaccatttgcagtgcataataaagttatgaataagaaaatattatttattcttgtcttaagagaaaatgttgtgtaaaatatatttcattatgctctaaaattggcatccctgttttcacacatttaaaccattttaatattttaaaattgagtaaaagtttcaacttctacatcatggcatccaatgctttgtaaaactggttagtttcatttcattgctcttttgttaaaatgtgaataccactttaaaaatcaaattgttcattaatgtaaaacaatcaacttttaaagtccgtatatccctttttagttatcatcattataattctactagtttaattcctttaactcaacccacctcatcaatcatttaactgaactgtcccattgaccattatgaaaatttggtgattgctgcaaacctgcagcttcctggatcccacgtccatggctggagaacgtatgttcctgtgtggggcagccagcaccgtccttgctttttttttttttttttttttttgagatggagtctcactctgccaccaggctagaggtcagtggtgtgatcttggctcactgcaacctctgcctcccgggttcaagcgattctcctgcctcagcctcccgagtagctgggactacaggcacgcaccaccgtgcccagctaatttttgtatttttagtagagacagggtttcaccatgttagccaggatggtctcgatctcctgaccttgtgatcttcccgccttggcctcctaaagtgctgggattacaggcgtgagtcactgcgcccggcccccgtccttgcttttacctgtttcccaatttctcttttcccttccttcatatctttcaaaccctgcccctctttttacacacaaatcatcagttttctatactgttcacatcctgaggccagaatcaatcaagacttttcgtagcagagaagttgtgtgtgtcttataatggcgagttttagaacttttcaaagcttacctttaacaagaatcacctccatgttaatgtggataactaggagacagttttgaggaaagctgactaattacagtacttgaaatagtttattttaaaggcatttgactagtagggaatgagtagcaagaacagttatctaagacggctcatctgcgtctttctgttttgggcgttaagcaccatataaccttggggatgcctcagcttccctatctctgaaatcaatgagttggacaagatgagggttaatcgggtcccctcagggattccatgaaggatacacatttccacagatgtatttcctctgctgtgtaaaggtgtccgtcatcagttttacacagagagctgggacactgacattgattggttaattctcatgtgtctcggtcacgtaaaaaaaaataatggttacaattcaactccattttgcagaatggtaaaccaaaacccaaagatactggataatttcttaatacgacaaataggtaaaaaacaaacagaaaaagaaacaaaatggtaatttcgatgtgcacgctattgcatgaaagattactatgatggactacttggcctaccttggctaaaatcagcatcttaattttgacgctgaggtaggtgcaaatgtcctataaggtgatgtaaatagattatctggggagactgtctttcgccctttccccttggtgatgtaactcaaatggcaagtcgcttaagcagagatttgtaatgcagctgcactctgtcgccacctagtggtgagcaatggcagcaacaagctgagagttgtttctgctttatctgcccctttttatccaagttcccaaggctggaaaaattttaaaagcctattttaaaggccgcagagtgatgtggaatagacagtcatctgttttcctaaccatgttcttccctccccacgttttaaatttttgagaaagcatcccttgtaaagccaccagcatttttggtccgtgtccatttctattttgactatctgtgcaggcatttccatttcccctaacttcttagcagttttaagataaatatagaacaatatacacttgtgacattcagagaggcttacatgagctgaacctagaaagatggctttcaactgacacattacaatcactgtgctgggcattttgaacaagaattatattatgcttatatttccttgatgaatcttaagagtagaacaagagaaaaatccagtgaagcatgctgcggttttcatcgtatcctaaatatgtatttttttctgtagccctgactatgtaagtatttttctgtagctattttttaatgttgtcaaaaacggatacaaaagagacaagttttaaacacatgctaatttccaaagccagaaccaatcacaagttgctgttcataaggaagctggtttgaaacatcatggagtctgtaacatcagtaaaatatatactttccgatcttagtgagctacagtctgttgaaaagccgtctaatttatcaaagcttctgcagttatctctggaggattagctatatttagtatcaaataattcttaaagaaggattgactgttactttaaacactaatgcaaaaaaatctctgaaagcaatataagcagtgctaaagtgtttttatctttttttataaaatattagttgtcatatttgcccaccagaattcgatgaaattctcctaataataccacgtttatgtttctagaggcttatttttccttcttaaattatgaaggtaaaacacaactttgcataaatctaaaaaaatagaatatttatggttcacacaaacacacgtgtaatctgacatacaaatacataatgtaaaaatcaggcaaaaaataaaaaaaaaaccttaaggggaacacaagcataccatctcgtggacccacaggagggttatagatgggtccttttcactgcaaaagaagcttatgttttgctttggctctggaaggccattcgggggagtctaagagtctctacaaattggcatttctgtctctatggcaacacaaagctctgcctcagcaacaaaatgaggtcttcctatgcaatgcaaaaagcacaaagtggcatgaatgcagaataatatcgacttttctttagaaataaaaaatgaagacttctgtgaaatcaagcccttgagaacttcttgaaatgcagaagcacggccatgcgataggccagtcaaggttgaatccgggtccattaaaacagaaatgaggaaaggaatcctgacttatgtccagatgaaaatttccaaactccttggctgcattccttagaattgatagtaagtaccatttagagtccatgtattttaaagtactgtagatactatggaacgaagtagctaagggaaagtaatttgacctttaagttcaatcagagctggcaagaaataggaagtggatagaatccagacagcagtatggggacaaaaggcagactgagaggatgtagtgcacatcaccagagaaacagaagatgttagacaagaatcatggatttaaaaaaaatccaaattgaatgacacagaagcaaacatgaccggaagtgtgtgagttcggcactgtagatgcttggcaacagttttttctttgcaggagaaacggtgactagaaagcagtgatttagtgtagaaccatgagacagatgtagaccacaaaacacacgacactcttatttgtagagtagagaatctgaccatgtctttgtggagtttggaaacctcacacacacctaaaagggaagcacatcaccaggtggtcgcttcatcttcagggtgtctccagcctcactttaaggccagttcacagcaaagacaactaaggaagagccagccctgggggcgggggaggtggccaggatgcctgccacaaagtgggggcatgctgaccctaccctgtgggaaccgctgagccctctgacaggtgagccgcagaatctcctagacatcactgggctacgaggaggcttacccaggacacatatctcgctttttacgtcagcctggaaaatgtacaagaagttagttagctctcatcttcgtcacacagacttcaggaggagctttcctggctggctttttccatgcacacacagcatgccaaactcctgcacaacagcagggcagggagggtccacagcttctccagctgcttatacagtttccacaccacaggcaccagctgccatcttaacatggcacccacaggcacagcagaaaaaggttcacagaggaaagctggcatagggaagaggccaagaacatataagaaatgttatatctttttttgtcttttatttttttgagacggagtctggctctgtcgcccaggctggagtgcaatggcacagtctcggctcactgcaacctccatctcccgggttcgagcgattctcttgtctcagcctcccgagtagctgggatcacaggcacccgccaccaggcccagctaatttttgtatttttagtagagacaggatttcaccatgttggtcaggctggtcttgaactcctgacctcaagtgatctgcctgcctcgggctcccaaagtgctgggattacaggtgtcagccactgcgcccggccaagaaatgttatgtctttcatagaatgcttagcaattgggttcaagatgctctcaaacctgccctgctttttcatcttattgaagggatgcaaggtgagatagaggagaatttggcttaatgcctgtcaaatttcatggactgtatcagacatttgttggaggcaaaattttctaacacataagaagaaaataaggcctttttggggggaaacatggtgaaatttgatgaactactgaagtgccaacctgtgggctggactgttttggtgttttttttttattttcagagtaagatctttcatatgacagtgagtaagctgaccttcttttgtgtaggttttattttccttccaatagcggacaggatctggcagtgtactgcctggtatttgatctggcttaagagaacttccggaggaataaaacacgcttaaataaaagcatgtggttttctcaactctcatttagaaaagttttcctaattctcagtaatgattgacctcaaatccccagcctctcgggatgaaatgtgtttggcaccgttgcttaagtgtcgtggcagacgatgcttgatgctctccacatccattctcttcttggtcctcagtaatggggccaggctgttgggtaggcacatggccattctggataaagaccacatttcctgacttgtagctggatgtactcatgtcataagctgagaccgaggggatatatgcaattctgggacttggccttcaagggagaaggtgtaatctcccatcttttctccttcctgctggttcgtgtgagaagggaactactcgagctgccacctgggacccatagcggaagcttctctctgaggatggcgatgagcccacatcagatggaaactcctgggttctctgatgactgcggggccaccataccagtcccggacacccttcatttatgtgtaagagcaatatatttctacgttgtttaagctataattattttgagttttctgggactgtgcttatcccagtcttgactaatacaggggttcaatgcatatcagagctcttagagaaaaaaaataaccccatttagcttttagaatgatgtggatcataacagctggaaagagcacgtgaacatattaggaaaaatcagggcctgatttcatgttgaaaaccgtgcgccggggatccccttctgatgggactgctttagggtgacgagacttcctggtgggaccacaaccactgagttacttggaagaaacctaaaaaagagcctctcactctcctcacagagcttccgctgcaacttgagaccacatgcggcaagtctcttgcaaaatagtctctcggatggaaatggaggctcagcttatagaggagctgagatttatactattttttttgagatggagtctcgctctgttgccaggctggagtgcagtggcacggtctcggctcactgcaacctctgcctcccgggttcaagcaattctctgcctcacccttccgagtagctgggattacaggcacctgtcaccacgtccggctaatttttgtatttttggtagagacggggtttcaccatcttggccaggctggtcttgaactcctgaccttgtgatccacccaccttggcctctcaaagtgctgggattacaggcatgagccaccgtgcccagccaatttatactattttttgttatgaaaaaatcattattttaaaagcagatgctcagaagactgggggaaatattggattcagatttatacattaaacataatttatgtatctttcagtcatctgtaatctataaagtggtaggaacttttacgtttatggaagattctggattgcatttacttttatggagattgtcattgtcttagaaaacactttaaagaatgaaattgcactgacttaacatgagttaactaaacaatggttgatggggttgataaaaatgttattacaatgatttcatgcgtgctatactatgtcattaaaacattactaagagtttattttctctttgctttcagtgctgggttatttcttttctttacaatgagcatcagcattcttgaaatggaagaaataaaaaggcttcggactcagattggcagagtttgtaactgggtcagatgcagaattaaactataatggcctaaaattacgagttgattcaatttgtacttaaatttacaagcacaaataacttcagtgaatatattctttcaatgactacaaaatagatttataaggtttaaaaaaactcagtgggagattcaaaaattgagatttcctcctaaataggagataaaacagagaaaatcactttgatttgctggagttagtcagaagtatctcatgtggtcattaaaatattcttttaaaacatagttattgtgaatacctccattctctcatgtcattctgcaaacaacggaaacttaaagaatatacgagaagaattttgttcttgcagaagagtaaacctttttaaatcctggctttgtcctgatgctacgatggtgcgtcctccgtctttccaaattagagaactcagattctaaggctactttccctcttattgactaagcttaaaaaccgaagaacaagttaaaaaaaaagacaagaaataaataccttggccttaaaaataaaaccacagacagaagagaaaaaaagagaaattcttagccttaggcatcatataaagtggcattatttaaaacatttcctaattattttctgccagctaagaaaaaaaacctcaaagagcaaaagcaattaaagtgtttcattttttacaaagttcctttcacgcctaacaggagcacatagatagactatgtcagcgaatgggtttggtggtagtggttttgagattgtataaatggcacttcctaatacagaaccttagctgtattagagccctaaatttttacttatgtgcagaggctctcatttcacattcaaaagactgaatgtgagggtgagctattgtttgaagtctgtcaccttttttccaaaggaaaatgttttaggatcattctgaacatagaaggaaaacatttcagtgatggactaatttcatgctgtggttgtcattaaatctctttccaaggccagtcattaattttgttaaaataattttttaaaaatagtatctttaggttaaataccagcggaactgtcagcctgcaagtctcagagatggatgctttgtgaagtgctacaaaaggatgatccttcccacatcctcatgaatttacgtcacttttgtggaagaacaaggctcaagacagtcaatgccaaagatcatcctgtctccaggctctgctgaacctgccgatcggtgggaaatgacgggagacaatgagtccactgagaggtgatggagaatggcaggcactgagctaagataccttaaatgtgatgcttctcatgctgacggccaactgaaaacaatctcatcattacttcttattatgatatacattttaatttgtttttctcctcaatctgggtatagctgctatgcaaatatgtcttttaaatgtttggatagaggccacgcccatgatgttaaaagttagcaatcagtatttatgtaacttcgtaggtcttgtgagagggcgcaaatctgaatgcatacatcttactaattaagctcattgaagacatgcaataaaccacactcaagatgcagttacctttaattttggtggattgatctcctgttgataagaatatttagggaggagaggaggtgagcagggctgagaaagtgtagagtccaggtcagaaacagaggcgaagagagaatgaaatggaggggaggaaagcaggtggctgggaaagggtgtgggtgcttgctctcccgaagaaaatgacggaggcttaaatatcgaggaaagacgagaggtgattatgcttgtctcagaatgaggttacatgctctttacggaatttcctctcaacttccaacattttaaagttactaataaccttgggaagttatatttatgacaaattttttgctttgaaaccactaacttcctcttttgaatttgattcaaaatccccaatggtatgatcagtttaatttttcgcatgggggtggctggagataggaacacctatattctatcattttctcatatatttatatgatggctccttctaaaagtgaaggaaaaaagtatttaaaaccctgcaatgactgtaacttgcgtgtaaagtaggttgccaactatagtcagcgtgtcacaaagctggggaagccgtggccccgcgtgcagggtgtgagctggtgctgggatgagccggcctagggtactgtctgtgtcagcaaagccacacatctaatcacaccttcagattgattgaattgaaaggaatattagttactgaaataattgatgtagagacacgtttggctccttgcaatgaattatctatctgttattaaataaggtgtttgttttacacaaatgcaggcctggccgggttattttgaaatacaggaactatgaaagaatttgacttggatagtagcgtaataggaaccatcctttctgttatttcataatttctataattgccagtaattatacttgcttcttaattcacagggtacatttgtgggatcaagtttctttttatttttgaaatggagttttgctctttttgcccagaacggagtgcagtggcacaacttcagttcactgcaacctccgcctcccggtttgaagcagttctcctgcctcagcctcccgagtagctgggattacaggcacccaacaccatgtctgactaatttttgtatttttagtggagatgggggttttaccatgttggacaggttggtttcgaactcctgacctcagatgatccaccagccttgggctcccaaagtgctggattacaggcgtaagccaccgcagctggccttaagtttctctttttttttgagatggagtctcgctctgtcacccaggctggagtgcactggcacgatctcagctcattacaacctcctcctcccgggttcaagtgattctcctgcctcagcctcccgagtagctgggattgtaggcacccaccaccacgcctggctagtttttgtatttttggtagtgacggggtttcaccatgttggccaggctgatctcaaattcctgacctcaggtgatctgcctgcctcggcctctggaagtgctggcgttgcaggctcgttttttgttttaagagagaggtttgcaagctaaagtttctggatattttctgcctttgttgattaaaaccactgttcaagattcttcataacatgaagatacagtacccagttcttaagtagtcaatgtgaagtcaacacaaagagaacgacctctttagaaaatcgaaaggggacagaagtgctgtttttcttttctgttgtctttgtttattattagcattattatttttgcaaagtgccgttatgtcaaaggtatggtgtacagtttctcatcctggaataggacaaatttctgggcatcaacttcctcttctctaaagtggggatgataatgtcacacacctcactgggttttgacgattaaagatgtggagtttttagaatagtgtctgatactcagtaagagctccactattagctatcattgttaatattggaagattacaaagactatatcaattacaaagacttttacaatataagtttatggtcctgaagaaaaatgggataatggaattatatcacatatttacatcatttaattaaatatggtgtgttttcatatacccactccacccccatcttatatagtatttgtgttttttgtttaaaaaaatctgttagtcaaaataggtatttattaatatgattaactctaatagctaatcatggtaaggccggttagttcttccataatcagacaaaattaaaatacctcattactgggttttgctgcattgctgtcctccttgggggtcctaggatctgtgggggtggctatggggtgttttaggcagttgggtttctcctcctcctcctcctcttcaatgtgcaggtgtggggtgccctctgacccatcgtggccacaccaccaggcgtctccttcctgaggttctggcggccctctctggatgcctgacacaatcccctcatagatgccctcatcttcctctccaatgaccggaaggggtacaggcaaggaacccacgctggtgcacgcagaggccacaaaattatcccctaggacttctggtgcctttttagggtctgagaagccccttctcatttttctcaactctgcaaagttgctttgagttgtcgttctgggatcctgaagaggctctgcatggtaaggctgggctgcagccgaggccacacccgcgtgagtggaaggtgattcggcaggtgcagtcgctggggacaatgggaggaggacagcaggttcctccttaatttccaggatggcgtcctctaggatggttggtttggcttggtcagctgacaaggttaaagcaccaagcttctccaattcacccaagaagttgtccaggaaacgaggtggtgttggggccaaagggtttgctggtagacatgaggctgtcagggacaaccagccctggccagttccctggagagctcctttatctgagccaggtgagactttgtgggtgggaggaggggctggttcactggaagccaacttggaaatgagcacggattatgaagttaagaaaaaataaactaagaaaataataataatgcatcaaaacatagcgatggagaaatgcagaaaagatgcggtggtgaatatgaaaataattttatgtttaacatagatttgaagacatttagaagatatctagatttgaaggtattttgctgaaatttaaatacataaaatcatttatgttaattagaaaagttacttcacaaatgaaactctactagttttggaaggggtcttaaatgtcaaacaagataaagatgatatagagattaccaggacagtaaaaccttgagagatttatttttatttatttttaattttttaaaaaattttttagagatggagtctcgctgtggcacccaggctggagtgcagtggtgtgatctcggctcactgcaacctctgcctcccaggttcaaacgattttcctgcttcatcctcccgagtagctgggactacaggcgcatgtcaccagtacagctaatttttatatttttagtagagacgggtttcaccatgttggccaggctggtcttgaactcctgacctcgtgacccacccacctcagcctcccaaagtgctggggttacaggtgtgagccaccgcgcctggcccttaagagatttaatgcttacttactttaaactatgttgaaaagatattacaggtttccagatactgacttagtagagtataaatgactccagagaaatgttaatgtagaatgaaaactaatagtgaagtcattttatttcctgaatgtgtgtagtgttctcttgtcctgcaggatagcccaatcttttaaacgctgacaattttctcacttatgtttgcaaggtgattacaacatatgaataaagtattttagatcattatatgttaacaaatttctaagtgaataagttctgaaaactatgtctcaaagacaggaacccatgatcagaatgaagctgagcttacataactacggcttcaaagttttaaaaaatccaaagtaaatatttacatagaaagctcatttgatgctaacgggagggaggacttctgcttcagctcccgttctctttcaaagcttgacatttatgtaaatcagaggaggtatgagttatgaagcttaatcttctgaagtaaaatatacttacttctacatacgtagtattactgatgtattttggatatagtaaatgaaacaatacatttgaaattttatgcaaaggtattaaaagtagttctgataaatatatacaccccatatgtacccataaaaattagaaattaaaaaatgtagttccagaagtgccacttactaacattggaatacgtttatctacccttaccggactagagaaaatgctacctgctatgtgcctaaaagccttgagaagggacctttcactttaggtctctccaggtagatgtctttgatttggaaagaaaaacatctccaaaaagattctggagatacactttccagctgattgtttaggataacactttacacagggaagcagccctcttgctcctggggacttagtgtgtgtgagtgggtgatgcatttcctacttaacttttgactcctgtgtcctatagtaggagtggggtattaattagatttatttagctttttttttttaagtcatcttatcgtgggatgacataaatatcacaaaactcatgtgagcatcttaatacaggattcaggacctgggctgcttagctgctgacacacagtgagactgcacgtgtggtttgcgcctaggtagacagccactcctgttaagtcctgtagatgctgagttttcaatgatataaaccactcaagtctcattcagcagtctacagaagttcccttactagctagagttctagtttataccccttgttacataacacagaagttttcatagttagatttggaaagtctgtgaaatatataataatttcagaccatcaggtttccactttcactttctgttatgccaggaatattatgtagatgagaaagaaagatcttgaattcccttgtcattactgccaccatcaccattgctatctgatgctgcgactacgctgtgccgtcaccaccacagtcaccgaaatacatgtcagcaggttaaactgcttagctttatgatggacttgcttataccgaaagccaaatgaagcatcctggtataactagatcacaaacctatacctataatacaaaacccatacaattattttgttttccaaaagcatcagaattggattctaatgcactaaaagcagaaatatcagaaataaaatcaacatacattttagtctcccctaagacaaagacagtatgtcaagaaatgtgatttaaatgtgtcaccagagtgatttataaattattaatgagttctctgtttgtaaatatcagttagaaaataggttctgtagcgtttagtatattttggatgttatcatttagaaatacattatatttatctttctaaaaatggttgtcacttccgggaagttttcttcattaagcctgtgacatcacagcatggattaccagttgggataaaaccattaagtatttcttcctaattatggacataagcttctcaacatattttttccccagcagtgagcaataaaaaactggttattagtgaaatttgtacatgcctctgtttaaaatctggtattactttaaaaacttgaaaatatattcaattacagttaaattgtattcacatcaaagatgaaaacattgggatcaaaaatattatattgccattaaatattatattaggacatatggaagaatttgttagatgtttaatgagcttttgtacatacatgcttttcttccttacaacattttatttgaaggtacagttgctttgaaatttctgtgatagttatttaaagatgactgaatggtggataagacaaatatatgcatgaagattcttatcttttctctttatcaatagaaaatactgaaggaaggatgctgatctgtaaatgctaaggtctggtaatgaagtaaatatacttaagaagattctggaaaactataaccaatcaagcaaacaaaattggatagtaccaaactcttccatatattatccatgaatacagggttgagggtaattatttgcaactgaaactcagtcttcaaagaggatcacaataaataaaatgccaagacttcagccttctaaaaaaaaatgcctctcttaagatggcagattcttagatcatttcctcatataaaatccttctcaggctcattttcaagaagtagtttaggtcactgggatgctatcttgaaacagttttttcatcggaacatgaagtgacttcacactttagtaacatctgatatgttgattttattttaccagctctcgatggtttagcttttcatgtcctagccttgatctcaattaaaataattaataaattaggcaacttaatacattttttgaatgttgagaagtacttaaaacattttggaagtcattggcaatttaaagttttattcctagaagttaatgagaaaaaagacccttacatgcctttcataaaaagaatataattcatcagaaaaataagaaaaaatttcacattgtgagtacagacaaatagcctttttacattcaccaattaaagaagcaaagcctcttttaaattacgtattgagaaagataatcatctttagcccgctcaagtgaaacagtagaactggcatataactgtcctaaaactgataaaacaaacttgaggacttataataaccgacaacattttcatttaaactaataaacatcttgacttatagactctaattaaaaatttttgctctagctcattttccatataaaaaacttgtatagatttgtcaacctaataacccggtgttcttgtgatatactattttgagatatacatagtattttgtgttgtgtatatttatatttcaaattataaatcacaattgtatatacatgtatgaatatatgattatatttatttatatgtaaagattatattatatacataaaatttacatatataaaaatgaagctttaggaaaaaattatttcagaaaacatttatgtacacaggagtacagatatatatcatacgagacttcatgatactctcgttttctctttctctttcgatattttaacttgaaaatgaaatgagcaaaattaatcattaaatctttatgccagcacctatttgagaaacactgacttatatttactgatgtggcactcacacatgtagaaacataatatgtaaatctctttctctgcaatagatatgatattctaatctaatatcctaaagtcacacaccgattatcttacttggagcttccaatattacattaacatgatagagtatgttcttaccttatttgagctcaagctgtgaatcctatcactagaatagctgtggggtattggagggtcagggtagtcctcagcaccttttgtgttcttcttgacgacctccacataggaaacagggaagatgccttgtctgttggttcctgggattttaccttcataccagttttgatcaactcttttaagaagaataactctatctccctgttatgaatatgagaaaaatgcattagaaacagagatagaataacatgaaaatataattgtcaatgttttctatgaaaaaataggtttccatttgggcaggttttataccttcagtttttgtttaatcaggggagggcaagtaaggtactagtgcttactagaaaaatacacatgatcaacatatatgtaattgaaatgtccattcaggccatcagaatcttccctaaggatgcctgattaatgtgaacgggtttatacttgtttatgctggtattgtgtgaaattatttgtctaagttatttcaaaaagcagaatagtgtaaaaggtaatgtctcaatgacaataggattattttatctctggcaggttcagtgcattggccttctgtaggaagagcttcagaaagtgcaccatagcttgctgtgagggtctgtctgaaatgggttacagaaaacacctctagaagggagaacatcgaatggtacaccgttttctttttttatttctattttttttttttttttgagagggaatctcactctgtcacccgggctggagtgcagtggtgtgatcatggctcactgcaacccgcacctcctgggtttaagaattctcttgcctcagcctaccaagtagctgggattacaggcgcccgccaccaggcccggctaattttttgtattttagcagagataggggtttcaccatgttggtcaggctgatctccaactcctgacctcaagtgatctgaccgcctcggcctcccaaagtgctgggattgcaggcatgagccactgtgcccggccccttttcttctttaatctacatgcgctaagtagtgacagagtgaactaaagggatgggggaaagagagcgccctagaatatcaatagctgtgacaagactggcattcccctggtcttcaccctgacaatggaaacccagcatccatctgagtagttggtgaccattccatacttgtcattaaagatttgaatagaacccttggctttcacaatgatagaactttctagaatcacttccacctgccatgaccgagccagtgctgcagaactcagtttaaactttaactcaaaactacacgtagcctagaagtaggcaggcaagttgatgctaccgggcaaaaactgcagctgcattcagcaggtgatacagaagctcgggcagcggcacctgatggtgtgatggagctgaaacagtcattaatctcagcccaacagggcacccttcttcaggtgctacccaagaagaacttcgaccttgagtagcacttggaagttctctttgtgttgaaacgctggatggttgattttgtgtgcttcaccaccgctgagcagaacatactcaagaaaagtcagtctcaggctggatgcaatcgctcacgcctgtaatcccagcactttgggaggccaaggcgggcggatcatgaggtcaggagttcgagaccagcctggccaacatagtgaaaccccatctctactaaaaatacaaaaattagccgggtgtggtggcgggcacctgtagtcccagctaatcgggaggctgaggtgggagaatcgcttgaacctgggaggcagaggttgcagtgagctgagagcacacattgcactccagcctgggtgacagagtgacactccatctcaaaaaaaaaaaaaaaaaaaaaaagtcagtctccccaaatctgaaaattgcaccgattttctagtataccaagaacaggtagttgctaggctgttgtgtgagctgtaagaggcattggtgaagcctttctgtagaacatggaacaggagacagagttcatgtaatgctctgtggttctcatgctaggtggggcagcccagaggataggaaagaaggaatcggctgatgatgcagaattaagactgatgggagagaatgagacaaggttctgccaggaccagaacaaaccaggactgtggtattgctcttcatcgcacctggctaaggatttcactagtaggtgtgggaggtcctagagccactctaaatattactacctcgcctgtgttgtgtgcagaggcagttacctcaaacaaatatatgtcatatttagaaagcaataagaataattcatttatcattctcaattatgtaaactagcaggttaaaagaggtttttgattgtttttttgtgtttttttttttttttttttttttgagatggaatctcgctcacctgccttggcctcccaaagtgctgggattacaggcgtgagccaccatgcccggcctcgaggcttttgatattattaagaagagatactaggattggatgggctgctagagaaatttgggtcaattatgaggcccaaagaaggatgatccagggaagagcactgcagagatggctcttaaagcggctcccccaagaggaaggatcttctttacctaggaccattcctagattccaagatagaggaagataaggattggaatatcttgtttttaaaagactgaaaaataaggcagcaaaacaacatattttgaagtgtatcaaactgctttttccttttgtgctcccgaatgtataagtccttgattttcagccccatgcccggcttcccagactaagccacagagggagaagcctggtatcccacggggaactcctctaaaaggacacagggaccagcagggaaccgtgactctgggctgccttaaagagtcctttgtagaaaatagggtaaacataaaaatgtctaaagaaaaagataacctattttagttttgaaaatatacagccttttcaaacccactgaagaacaaacaaacaaaaacaaacaaacaaaaaaccagctgggctacctttctcagtgacagctccacatttgtgtctgcgttgaagttgtatttggctatagcttctccgatttctccgggctgggctggcggaggtggtcttgcaggctgtgctttctcaggaggtgtgagtttctatgaaggaaatagtcatttattctcaaatctgcggtgacctttgaaaccaccgccatccaagagagaaagggagaggacctacctctacgtatgagatcgggaagatgcccactctcccgtggtgttctccctcataccaattttgatcaattttcctgaggatgtagacagtatctcctttcttaaatgacaactccctggaagagacacgttgacatggtctttttgtgatgtacagcaataattctcaagatcaacaccctcgctagatctgcatttgtttggcaaatatacttacaatattaaaaaatccaattgatattgagtccgattagataagaatgatccttgcaaattcttagaatgcacttaaaacattataactttagaaatgatttcaaacagagtaagtataaacattccattggatataaatcacagacagattaataagaagtttaaaggaggggacagactcttgctactttaccattagttcagagaagaggcattttgaagcttggaaaaatgatggaatagttctgcactgattttttttttttttgtcctgaagctagttggctagttagttactagccccccagccccttttgatgtactgaagcttacatgaaggaaaacaaatatcatgtagcctcagaatagaagtgccaacaccagaacaaattttatttgtggatctttgaagttggttgacaggtattttaatagaatatcttgataaggaatttattttgtgtaacagaaaagatcttacacttttaattttcagtggggcaagaagaatgtgttttaagtgcaaagacatatgccaatgcttgcctttctatcttttatttacaaaaaataaaaatatttttaagacactatatttttcaattttggctgtttctaagaaaattgtaggtatatttgatttgggtatttataattttaagttataatgacattatgcattttgaataattcacacctaaacttatcaccttcactacatcaatttttcctggcttaatcacccaggtgattaggttggttcattattttgcctccgcaattattcttggatggagggcgattaatttgtatcttctcccaagagcctcattttgcaatacatctgccctcccactctggaatcttctgcattgttttgttcagaattttcattttttaatctttttttaaaaaattttggttcagaattttcagttggatcatttattagtataggccgtttgatggagagagatttatacctgatggagaacacttctcattgattaaaagaattaatcgaaaaaatggtggtatattaaaagaatgatcacacatttagaagtgctaaaatcttcacaattgaaaatgtgttaaattttcagtaaccctaaaaacaaagaagattcatggagctttacattcaaatacagtgcttccttcttttgtgcaaatgcctaatgtaaaaaacagaaaacaaagcaaagcaagatatttaatgttcacaacacaacagtttcatttgtactaggtatgttttgtttctggaaatgagactagctttttaaaatataatatgaacatatgaatcagaggcaaccaatttttcaaagctatgaaaaagactcttttgtatttgtataggttgcatttaaaattttgaagtccttaagacacaggaaagtcttactcttaagttttcaaaactgtgtccctctcatctcagacctagaattttaaagtcccatttgcttttttcccctcacttttatttttatttgtttttgagatggagtcttgctctgtcacccaggctggagtgcagtggtgtgatcttggctcactgcaaccttcacctcccaggttcaagtgattctcccacctcagcctcctgagtagctgggattacaggcacccaccaccacccctggctaatttttgtattttcagtagagacggggtttcaccatgttggccaggctggtctcgaacttctgacctcgagtgatccatctgccttggcctcccaaagtgctgggattacaggcatgagccaccgtgcccagctgctttttaaaattaagacttctcagaagacctcgtgagccttgggtggacacccttcctacttcacatcccctgccattcctcaggtttttatatatttaagaaagctatggattgatttttacaaagaagaaatgaaacgtgtgctccgtaacattattttataaaactgatatgcattgtacaaattgtcacaccatatccacagaacagtagttaggaccggagtacagtagaaacaaagcatcttatttctctaatttgaaaaaaaaagatgtaagcttttcttcaggccagatttaagccatgttcaacatcttaatttctaaacaggatttttcttatctagttcatttcctatctcagcagcattaccaaattctgagtgatttatttatatatgtcttctgccagagacagtttctagagctattaactcatattatatgcatttttatgagtaaattattttggttattatatatatatatattcagtgtaaacaacatataataatttaatgacaatttacaatgaattcaatatctgtcttgaattctactggagaacaaagtttcttaaaggtctgtgcacataggccacaaaaaatctgggcaacaccctcttatatataagtctgcttatgtgcttccgcaaccacatgcctatctgctgagcaaagaataaaggcaaaagaaatattgcaattcaggatggtgaaaacaccgacaccaaaagaccaaaggagaaaactttgctcagaatctctgagctttgcaggctgaggatggagacttcaatacaggaatctttgtactaagttctagtcatcaaccccacaaactatgcttggaatatttggataaataaatgttatcaaattcccccagctagtgttaattactccccaatactttatttatttacttattcattcttttttttgagacagggtcctgctctgttgcccaggctagagtgcagtggcgcaacctcagcttatggcagcgtctacctcccggtgaagcgatccttttgcctcagcctcctgagtagctgggactatacaggtgtatgcccccatgcctagctaatttttgtattttttgtagagacatggttttgccatgttgcccaggctggttttgaactcctgggctcaagccatctgcctgccttggcctcccaaagtgctgggattacaggcatgagccactgtgcctggcccccaatacttcattaattcattattgacacaaaattctaaaaacaaatattcctaaattctttttgtttttcctatcctttagaattcattgtgttctacctaacatgtttaatgtaatttaaaactcagtaattctcaactaaacttaaaataaaaggtaattctgaaggaaccatttaattagagtagattgctgcattgggaattagacctcatttgtaacagatcctactgcaatgcttatctcttaaagcattactaacatttaaaaccaccttaaatcatatgatgagtatttatcttacttacttagatgtctgagccttaaaatcataaacagcttttgcaggcaatttctgaaaaggaagataaacaattagcactaatttaaaatttgaattttctacaagaaagtagtttaatgtgccttaaagaaaaaggaaacctcagggaatcatcaaacatatgtaatgttaatcctgtaagcaatttataaataagtccattcattcttcatttagatatttaagctataataggaatataatagaaggcttattcaccatcatatttaatcttaggaactaaggtagattaatgttataatgagagaataaaatgcctgcagaggtttgcatcctaggcatcattttggctgttacaaaggctcttcctaggataaatgtggagggtcaatggctctatgttctatggagattgacacagctccctctgaatcataataaaaggaccagatgtcataaaagaagtaatcattcccttcattagacacttattaacatattagcaaaaaatattagctcaattatcactgggaggctggttagtgggcaaaagtataggtgtgatcatcttgcattccctagagggctcaggaatccttcaacactctgtccaccagccactcgtcttttagttgtgatgtgatgtgacacgtgcccatcctcaaactctgggggccacagatctccctgaggtaccctgtaccctatagctagctaggccagctcttccttcctcaccaaccaacaatcccttcactccattcttttcccccatgactctggtgaactttaggaatcctggaccatttctaacttctttggggatcccacaggctctggactacatcagacgcctataagatcctctggagcggctaccagtccaagtccagcttttagtttccatccagccgtcatggctccaaggcagtttgagcaagaactctagccccggctcagggccctggacagagttcagttggtgggtggttcccaggggcagtatcccgagaactgggctggttaaaagctctttttagggatcctctccaataaaaggaagccagcaaaaatgatttctgtaggctctgtattgatttacaacacagttgacatcaggctttctcctggaccagcgggccaagaaattgtagaggaaacctattgcctccacgaggtgccctaactcaggacacttttaggtcataatggttaagttcatgggcatcaggtcaagactcggagaagcctcatggccaaaactgggccaccactagggaagacccacagctagggtcagggtgtggactgcttctagggtcagagttgctatgctcaggccccaaggaaaattgtttctagtttctcagtattttcacatttcctgtccgagttcgttactggtttgggataatttttggctggtaagtgctgtatcaagtgtgttgctgtgaaagactccaatgctattaaattaactacctctttttctggagttcctcttctttcccttggtgcacttctccccatgtcagtcaaagtggatgagtaacttctaggggactcacggtctattggaaagaacagggccagtcatggtgagtatccacttaattacaagccaacctgttccgccattttccctggtggccactacttttttccccaaatttggagagacaccgttatcgaacacatgggcataaaactcatagttcattacaaagttgtgaaataagacacaaaacaagagcatttcaaaaggaaaaatatctgaggttgcagaattataattgtctatataaatatgattactacattgctgattaattatattgccacacccagtaagacaatttatagttagagggatttttcatataaattttttccaaagctttctgtttctatgcctttgcttcttatttataattactattataagatttacagaggatggagaatttgaaaatagcaacaatttgtagaaaaagaaacattttgtggagtaatttaagactgtagtaatgaaaaagaaagagataaaaccaaagaaagtatgaggatgacaggagggtggtgatgaacattctccttctgccttactctcccctcttcgctcttcctctgtttttaaatacttattgaatctcaagatgccatgctgtttatctacgaccttcctttgtgcccagatgataaacaccttatcagaaagcaaagaaacaaagagatattgtttcttcttactccaagcaaaaaagggataaacagaaagcatcatgtcagttgccaaattgcttatgaaatattgaattatttttgttcatcttaaagcaaagcataaataatcacattacaaaattttgattgcatgtagttcttaatagtatcttataccttttgcacttacgtgacttacatatggagatgtaactagacattaaatgtattccagtagtctatgttatagaattttatcagtacaactgggtcaatatttgtcaattctttcttttatcccttaaatatatctagttatccagactaacaagaagcattaaaaataaaatttattttatccatctatgaaagaatttaaagtgctgattcataataagaaaacattgttttaggattttgactactttgatgatgtaaattctaagttaatatacttttatgatcatagggcctcataatgatcataaattttaaattactttttctaacccagggaatataagctatttttcacttgggtgaaacacaattggaaagtaaatattttactaaaaaacaaaatacttttaaatgcatttcaaagcccttccaagttacgtttcaaaaatgtactcctatctgcacataaaattgagagatggttatattaggatattaaaagcctggagaaggtagctaatttattaaaaaatgagattctgacacatttcaattagtgaaaattttgaattgtagaaattgattttttaaattctaatttattattttgaagcatgttgcttcagcctaagggtaggcaaagataaacgtaagtgtatagtgtagcaaaagtgaaagcaaacataaagactaagtagatttgtgcaagttaattaacaatcgagccatatttgacactagtatgaactgtgaattatgtctttttttttgtctgagattatattttatactataaattctgaattattaggggtttgaatctcttttctgttatctactctctgtgtgaccttggacgaatttcctttcctctctgggcccaacttccaaaattgaaaatggcttttgaaataacacccatttcataggcctatgccagttttattagataatgtatgtaaagcactctgtagtgtctggtgcatagaagtttctctgttgaccaactttcagcccggaatgttcattccagcctcttaaaatttacgtagtgaacagatgtgctgtaagaattaatgaaaataattggtcacaaatattaaaacaccctgggctgtaagttatataaatctcaaaaatagtcctctgcctttcaattgctatttattcttgtgttgccacttcaaagttatctatgaaaatagagtttagagtcactgttagcctgaatagtgtaattcaaatttcaatacaggactgttttagcagaaagagaaagtgaatgaattaagtaatggaaaagagaaaatgaatacactaaatggtggaaatgggacttttatatatatagcttaaagatacattcacaaaaattttatcaccattgtgtccttgaaatggagaaagctattaaacaaaccctaatttctttgtgtccatcaattactaatcacatatttcagttttgcttcttgaatgttttgatatagtatcttctatatagaatgtgacaaattatttattaactgaatgaatataaagttttaacgttaatataaacatttttaaaaggctatttgtggaactataggttttgattcatgtcacaacgtaatttattgtctcaatgtgagtagtggttgtttcaaccctaatgctgagctacaaaatggccttccctctcgttttcgaaagagtaaatttttgtgaattgatgatcactttaagccacacatcaagtccaaatatcacatgggcaaatgagaaatattcagtaagacatatttgcacaacaagtttttgcttcacaacacataacgacgccaaatggtctcccagctcgggagtgatgagatgttggaatggaaaatgaaagagctggagggtgggtctctgaaccacaaggaaaaagaaagaaaagctcatccaccttggagtgcaccgccacggtcttggtggtggcagctgctgttggctgtgtccacgtcttggaaagaggcactgcggggcattctcccgcagtcattctggtagggtggacaatgaatagcaccatcgggaggcagtgggtggagaggctggtgcagggggctcctcctcagcgctctcagggatgagttcctctcgggaacatctggcagcagctcactgatgaggcggtgcaggatgctgttgtccggcaagctcccccttttcttttcagctttaatttggtcacagatgtctttaagggcagagtccagagcctcaaacacagatgctttacattttgccttttcagtctgtttcttaggagccgaattttttttcctccggaaaggcacaggactgactagaaaagcaagtttagaaaggccagggtccatttcttgccttctgggctcctcggtgttttcgtgtctggctctttcgtgttttaacattgtggtaaatcgagtgtaggaggccgggcacctgcctttgcaggagctgatgaggtggcggtggtggtggtggtggtgatggtggtggtggtggctggatccgtaaaagctttcggaggatgtgaaggaaaagtgatcaaagtcactttcactgcagaaggatgacccctctaggtgaatgtagtcactgtggtcggacacaaccccgtcctggtcgctgtcggaaaactccacgtgtgctcggggctgctcatcgctggtgacttcaatgtgaatgggcaccagggcgttagactggcagcctcgccggccccgagcgggggggccgctttgattttcttcctccagcaaatactcaatggaaaaccgcctcttgggacataggccattttgcggtggttctagggttacgggagacagcatgtcatcccctaaatttggcatggatttggacttctggatcagcttttcgaattcggagatgcgtgtgggcaccatgtcccggggcacctcctccgtggagcactggctccaggcgcgcagcaggtccttgtgctgctgctcgctctcgtactgcagaatcctggacttcacggagcagatcacctcggagttcatcaggtccttgcggttgatgcggtgcattttcttgtacatcttcaggaaccccggggcgttgcgggctgacctgtgtctgatccttgatctgccgttactgcgaacctccgggacgtagggggacccccacgccatggggcagctctccttggagtcctcctcacataacagggagcccatgctttccgacttgactttcgggtccgggaagctatcgcagtcgtcgtttaggagatcgtcacagctccgggatttgattttgggagagacggtttcttccgtgctgctccagatttctgcgttttgccgggccatttgccagccgttcttgaaactaatggctcttggtgagtcccgagggacatccaagtgctgtctgtaagtgctacagtaatctaactcactggaggggttgccgttgagccctgagtaactgcaaagggatggacatattttgctatcatccccaccttttaatccagagcagcgtggtagaagagagacatttggagaagttaaaaggttcacaaagagaggagagcatgtcagtaaagcatcagacagcatagcaaggagaaagcagttagtgtgttttaatctaggtgctgattgttcacacatggagcttcaactctagagaagaaggtctaattctaaagcgagctaatactttttcagtgaatgtagctttgcagagagagttgacaaaactgtgtataagaagcaaccgacgtaagcaaatacacctactcctactgcataattcatacacctttctgacaatattgtttgccaaaacacaatagtgctgcttcagctgatagcatgatctggtagtgaaggtttaacaattagtgtcaaaagtgttatacccttacgcaatttaatagggccggaatttgagcctcatttgattcgtaatgatacataggtgaagaagggtttatacatttacatcgaattaatactctcatgactatatcaaataattttttgtgggttttagattttaaaagctataaggcaaagtattctccaaaattgcaaaatcaaaatgctgtgaactattgctgctaacatttttctagaaaaaaatagctaaagctctttaaacaaacgaatttacctcttaaattgctctacctttaaccttttattaggtacaaaattctcataggaaaactgaatataatgcaaaactttcatcagaggtgcatataccatgctttttttctcggaagagttctttgaaaaatcatttgcaatttgataatagagatctacatttggcctcaattttgaatagctatggaaatgttcttttgctttgctgagtcaactaataaatgaggagccaaattatatctaataggacattttcttcctagaaataaaatctaatggaggaaaatatctctattcaatacttataccttacaatgttctctaaattctttaaaagtagataagcacattaggtagatctgtactgtctgggaaaggaagttgatttaacattccctgtgatgaaacaaatatctacatttatcagaacccttttaacttttggctagtatccaagaataataggtcaatggcatttcatgacctacttgttaccttaagatattcatttgaataagtgagttgaatctgataaggcatctctgctcctcagaggaaagatgtgatggatggggctcacacgccctgaaccatcagctgatatcacagctttacaaggccttaaaagggctaggcatccacctactcagagtccaatcatcacgaccagaataccttttgcacacaaatcagctaccacttttaactaccatgtggcaatggttttagtgactatagttgataggtgtagctgaattggtctggttttatagaaacttacattagagctcaatttctttacacatttcaaaatctctttctcttctctttcaatcccaagatattagaggagattgtggggtcccacatttggtagagccctagctccctgtaggggctggttcaatcctcactctccatctcagaaatattcctgtcctcaaggaataccactaaatggtcttccagaaaccagaaggagtgacttctttcaacagtgagctccctacacttgcagagaggagacgggccatccagaaaaaaaggcttggtgattcctcagtgatatcattatggtttgggaccaattagtcctgactgtgagctgctgtgaattgaccactgtgttacatggcaggaggtggatgctccactgttcatgtgaaggtggcccaaaatatacagcaaatggctaaagaaattaataggtcggatttttttaaaatctagaattgaataattttttaaaaccctccaaaccaatgtatattttagccaacaatttgctctgttgctgcttgtaatttttatcctataaatttgactaatttgctagttgtagaaacattagaaaattttgactatatgtcaatgtttacaaaatacatcttttagtagcctgatgatacattatttgatactttcaatttgtttagaaagggatctatttgggggaaaaaagcattagcagatgctagtcagagttctttaagcaacctaagtggctcgccagcttgagtcagtctgggtgggaagaaggctattgttctaaaactatattttattccagacactgtaggtgagagctggcacatgccactatcactgggccagctttcacacagtgctctaggctaaaacgtaaactagtaaattgttgtgttttcatttactatgctcaccttttgctcttgatggggaagaaggagaagagctagtgaaagactttgtaagagtggtgcttgatcctgggaggtccactcggcctgggctagtcctgctcgcactttgatctcccaagccccgtggtggacccactgcaggctcgctcttcctccgcttcctgaagtcactggccatgcttgcagaactgaaagaaggaatcagatctgtttgattggcactggaggaggttcgggtgtgcaccagaaaaaccggtggaacgtgctagtgacaatggcgtaactcctaaacctctatccccaaaactgcattgctaggaactcatcccttgatgttcaacatgatttctctagaaggatcttttaaaaaatgaatagaccttattatttattttgagatggcttctggctctgtcacccaggctggaagcgcagtggtgcaatcacagctcactgcagccccaaactcctgggctcaagggatactcccgcctcaacctcctgagtagctgggaccacaggtgggtgccacctcacctggctaatttttttaaatttgttatttatgtagagacagagtctcactatgttgcccaggctggtctcaaacccctgagctcaagtaatcctcaagcctcagtctcctgaagtgttgggattacaggcgtgaaccactgtgcccggacaactaaatttttttagggcagttttaggcttacagaaataatgactggaaagtgtagagagtttccttatagtccctttcctcttgcacagtttcccttatcatttacatattcttttggtgggtacattgtcacaattgatgaatctttcctgatgcgtcgtcaccccaagtccatagtttacatttgagttcatgttttgtcttaaacattttaggggttttgagaaatgtataatgatgtgtgtccatcattaatgtgtcaatcatataaaatagtcttcccgccataaaaagcttctgtcctccagcttttcatccctcccttcctcccgctcatcctggcacccactgatctttccacacggcctccacagtttcgccttttcaccatgcccagttgatatcatgcagaatgtggcctctcaggttggcttcctgcactcggtgatacacttttaaggctcctccatgtgttttttgtcacttgatagctcatttctttgtattgctgagtcacattctattattacatggatgcgccacagtttatgtatccattcacctattgaaggacatcttggttgcttccaacttctagcaattataaataatgctcctaagaaaaccacctgctggtttttgtgtgaacctaagtttttaaacatctttgaacgtcaaaattctcctatagtgtaatatgttgattgagaattcagtgctataatttgtatcttgtatcttttctctataaagcggagttctaacaacatgaatatatccagaggggcataccaaatacaggaaataactgaaaaaaaaaaaagacatcaagagaggaaaatctctctcacctcaagggttgcctgcagcttgtcctatcatctctatcatcttagctttagaagatgttatattggaattccaacattttttatttaaataatgaatgaaggctgagtatgatggctcacgtctgtaatcaagtactttgggaggccaaggctggaggatggctcaaggtcaggagtttgagaccagcctggacaacctagtgagactctgtctctacagaaaataaaaaagttagccagttgtgtcatgtgcctgtagtcccagctattcaggaggctgaggtgggaggatagcttgagcacaggagtttgaggctgcagtgagccatgattgcaccactgcactccagcttgggcaacagagcaagaccctgtctcatcagtcagtcaatcaatcagtaccagtaatctggtcagcaaattaactattaaagattccttcccctcagttgcataaaatactgtcaatagtctagaacagcagggagtttctgtcatggttttgagtttgagtacagtatcatttaagaccaatgttaatgaatgaagccacatatggcacagcacactgtgcatgaaatcactggattcttagacaagacttgtgtagacaacagtgataatagcaacagcagcaaccccagctcctatggagcccagcagaatgctatgtgctttctttatgtttttgtcttatttagcccacacagcaaaccgatgaggtatatgctgttatctcagttttacaaatggtaaagtgaatacatgtgtctgggatgtacggaagcaagcggagaggcagacctcagaactggtttgtcctcttctgaagaggatgcatctcctagacctgtttttgctgggactgtcctgtcatgtgagggtctgtgtgtctttacggcaatctgtagattagattaaaactctaaaattcaaatattttaggtgcatagatagaggcagaagataaaaaggaggggttccagagttcctttctcagggatgttattgcagttggatggcactcagaaacccaatttatgattgacccaattcacaaagaaatctacatagaagggtaaattaatgctactagataaatatttgttattgatgttacaatatggctgggagtttgtattattcaatattactattgaactatgtctgaatatgtctgaattttgtgatttgtttttttttttttttttagactgagtcttgctgtgttgccaggctggagtgcagtggtgcaatctcgactcactgcaacctccaccctcccaggctcaagcgattcttctgcctcagcctcctgaatagctgtgactagaggggcatgccaccatgtctagctaatttttgtagttttagtagtgatggggtttcaccatgatggccaggatggtctcaatctcttgacctcatgatcttcccccctcagcctcccaactgctgggattacaggcatgagccaccgtgcctggccatgaattttgtaatattttttaaaaagtgtgatatttaaagctaatggaacttacttcaggcgaactctgagggaagttaggcctagcggtgacaagctatcttgcctcaatttcttttttttctctctccttgccaactgtgtaaacttggtaagttactaagcctaggtgtcactttcctcagagataaagtggggacaatagtatttaaccatagtgttttcttaggattgaatatgttttgtacttatgcctcatttattggtagtattaataacagtatttctgatttgtgtggtcaaagtatgattaacaaatacgtgtataacactttttaatctataatttttttcaaatatattattataagggccatttaacaacattgaaaattagttacttataattcccatctaaagaaaagaaaactgggtataggggactaagggaagagaaggatttctcagtctgtgaaggaatttataattagttcactaattttttagaaattcttgaaatgatcatataaaatgatgctgaaacaaaataaaacaacttcatgaggcatggtacttcaaataaaaatgagtgatacatgatactcattactacttcactgaataattttattgttgaaaaagaaaccactggtatagaatattctgctacaacataataagattcttacctcatgggtctttccaggcttctgtctatagaggactgatacaaggaggcctgttaagataggataatagtaccatgaaaaattttaccgtggcaaaattttgttcacttgtcaacattaaattaggtatcctaaaaagaatattataaaaattgaggttgaaagtaccattcattatgactataaaaatgtcttcccaaagagagatcatgcgacctgatttctacttgggacctatctgctttcccttctgatataatgcattgcagttctctgtgtagctcaaattatccacaacccaagcattgcatggggggaaattaataatattttctcagggacactgaaataagagctaaagttatcctacagcctgaactgcagaatcttacctgttgactgtaaatagaaatttcctacagaaaggaatggtttgatgttttaaaaaatttgtagtcatcattcaatccttataaaacatcacattttaaagtttttgttattgttgttaccaagtattgtcttcagaatgtaacacataagcagaacttaagacaccattcatctgtcaacatagacatgacgtttaaataaaacccacagagtttgacttgaagaaactaaataaagtacctggtacttcaatcaggtaaatagttatacttttacaattaggtgagttcagggctagtttaaaataaatgagctaatgaagcaaaatataacttttttaaagtgcgcttttaaatttttccttcattctgaataatacactgaaatagatagtaagcaaaaatgataatatgaattttttattttccatggcatctgctgggataattgctaaaatatctaaaaggcaagagaggacactgagctatcaagtgtttgaggtgacactgtggtatgatgtccagaaagcacagggagatggctgggtgcagtggctcatgcctgtaatcccagcactttgggaggccaacgcgggtggatcacctgtggtcaggagttcaagatcagcctgaccaacgtggtgaaaccctgtctctactaaatatgaaaaacgagccaggcatggtgacacattcctgttatcccagccacgcaggaggctgaggcaggagaattgcttgaatctgggaggcagaggttgcagcgagtcgagatggcgccactgcactccagcctgggccatgagagtgaaaccccatctcaaaaaaacaaaaacaaaaaacaacaaaaaaacaaaacaaaacaaaacaaaacaaaagtataaagaaagtatagggagatgtataccaagtatagatagttttgcctttggtcatatttgatgatcaattcatcacagataaaatttggtttgatgaagaactggaattctagtttaaaaacatttgtctgtatgaaagcttaaaaatgtcagccagaaaggcaaggtttgacaaatgttgtcttaagttgccatcatctagaaacattttatcagagtattaaacatctacttagtggaaatcaaatctcactttacaaactatttctataactcagttttctattaattggtaaattagcaccaattaatcaattaaaacaatacaattttgcaattctgtatgtatatcagtcttacaaggtcccttttgcataacttacgcttctattaactaatattttaatttaattctatcttactaaatgaaaatggaatcttgtctagaaacaaaagcatctctgcatgagaatattcccatcctccttttagacagaaaaagtggattgtaatatttttagttcctagaaaatatttagatttctaggttctcaacaaatataaaatcaggagaaaagtttggtttgctagtctgatatgtgtacatggttattttaatttgctgagctctgaatcagacactgggaaggtagaaaaatagatactaaatatgaaagaaagcaaacaagtaaaataaaatcagatcgttatattacaattaagaaatattaattctactcgtttgcagaagagcgacactgaagagcctgagagcatcggcgtctgtgcagatcacggctttcgtgggacaccctcacacacagctgatcaccaaaaagtgtgaagttcacaacactcttagaacaaccctacagtgatcagaaaatttgaattgtcaacttataatgagcctaaacaatattgtaatgtgaaataaaacatagtgtaagaactgattgtgttttagggttaggctaagaaactactatttctccttgtactggtttctacattcaaaataaatgaaaaccagttttgcggtttcatgtacactcagagaaagttcagtattaaattgtaagataagagtaaaaaatctagattgatgactgagagaaaaacttgtacaataattgtaagaagtgtactcatcccaaaatgaaaattatctccagaaaagaggttacaaattttaccagttatgatctactatttacatattaccattattttaacacacttagaaggtcaatttagtgaagtacagatactgaatcactctttctgttaagtagctatgagattaaattttgcttaaatatccgtaactgttcttcattaatgccagttttccagttatggattaaaatctatgttattcatggtatataccaggcagttgataaacggtagctaaggtaatgtctaatcaattacatttgtttttaccagaaatgtttaataacaaaaggttattaaagacaaaatccagaaccttaagagaatatattttcttacattctgaaaaactataatgtgaaattaataacatagttaacatatgctattagaatcatacagcaccccctctcaatcccagagataactggcaaatagatcaactactggcaaagtgctttttatgtgttgtttttttttttttgccactaccatcacataatagaatgcatagagttaagtttctactatttttatgcccaagaattattgtgtaatattaattaacagaactcttttcacaggaattcaatagttaacaagaaataatattaagtaagtaatttgtttttaaaagatttatcctctaaatatatatcttggaagtgctgaaaagtgtgatataaaggaaatagcacagaaatgaaggttaagagagatatatttttttttctgccactatcttaccatgtgattttggacttatttcttaaaattattgcactctacttttttttttaactgaaaaatgagtgaattggacatgatgcactctaaattccatttcagttatctatgaaccaactaccttaaaaacaccctagaaatatctgagaaaaatatctgaccacattgaatttcaaaataaattcttgggttgttcatatgttgaaataagactctttctgcagatattaaggtaacataacatacagaatataaccccttgttttatttgattttcttcagattacatgcctgcctgcctggctataaaatgtaagcctttagaaataactgaattcaataacccagaatgttcctgattactctattttaccttttatttaatatataaatattttgatcacttctcagttttaacacacactctgatgtttaccacagggtaaataatttgaaattgcaagttgagacgctagaaatttgcatattttcttgagactctatacctgcaattccagtggtcaccactatgtgtcagtagtacctcctacaacacaacggttctactggttgtgtttcccagttgcacatatttaagacttttaatgaaaataagatatttattgtgttatagtattcacttaagaccacagagcaactaatgtgcaaaaaacagtttatttacttcgttcccatgctagttgcttctaagagttccttgcaaggaggcttttatatagctgatggctagcaaaacagtgccatttctgcttgtgtcttctaatgagtcatttatccactttctaaagtaattttctgcttttctttgcagagagcaggttaacaagcttttgactctgaatcatttctgcctgtatcattctctctttcaaataaaactctgattcaaataaaaatatacattggctgccataaatttttcacctagttgattattataggctcttaagtagagattgcaaacgcatttcattttatatgccaatgataatttgttatagtggctgcctggattacagtgttgaaaaggagtagtcatgtctgtcatgggtatgaaactgggaagttgtgatacacaatttccaggtatttgccagccctattcttgactgataatacaatccgtaagttgtatttaggaaaatgaaagaacaaaaataaattttagaaatatatgggacataggcatctgattatccacactccaagcattataatagaatggttctaagaagccttcttgtagtattttactctgtctcataaaaagaggtggttaatatatgcactaagactaatacttttgatttttaattttcacgctgctgaataccagaactacatagaatagtataactagcagttgtggttggaatgattcttcacccagagtccagagatagccaacaactctggtataattaatgtccaggcaatgatactggatgcaacataatgatgcaaagatagatattttttcaaaaatagcttagacattacagagaattgtaaaacacagatgtgcagaatcacagtcacagcctctaagggagatatctgaaaaagagagaataacgtgtttttacctcattgaaaacaccagaagaatgatcttgaacatagtccagaggctttttaggaggctgggtgtagacgcaccacagaagcagaagtgtagggatggaatggaggagagtcaatggcagcaaggaatgaacatgtggaaaaggtgacaacagttagaaattgagtgttgacagcaccagctacacaaacagaatgacatgaatggagcaaaatgggggcagctgggaggaagtgtgcaacgtctgcaaatattctcaagcactgggaaaattggctagtgttcaattagtatatttataaattcattttgtcaaatttcattagcactcctagtctctggccacagaggaatgcaaggtaaattaaagaaacattaaaggagcaagtggatagcatgctggtgagtttccatgtgtgactgaaaatgattatggaaaatgctgataacttaggctcagtacagaatagtccctataagctttctttttgaattattttattttattttattttatttttttgagacagggtttcactctgtcacccaggctggagtgtagtgacaccgtctcagctcactgcaatctctgccaccagggttcaagtgattctcccacctcagccccctgagtagctgggattacaggcgtacgccaccatgcccagctaatttttgtatttttagtagagaaggggtttcaccatgttggccaggctggtctcgaacccctgacctcaagtgttccgtctgcctcagcctcccaaaatgctgggattacaggtgtgagtcaccacgcctggccgtccctataaactttctaaccaacagcaacaatacatataaaataaagctagagaatgtttttccttgaaataaaatacatttacattcacactaagatacaaatgagaaaaaatgagagaaaacattcctcctatgagataataaccctaagaaaaatcctttggtttatattcgtttacagtcacttttgattcagttcaataagctaccttgagtctaaccaagtctcctttgcagtttaatggacaaaagagactaccatcaccaatcagtaaaccatatatggtccatatgcaagtatataaatcagcatatggtatagaaatggttatatcctgatttctaaaaaaactatcagtgtaattggtaggttatttaagagtctaaaacgcataaaaacgtgtgtaactgacacacatcaaatgcactgctgttggtggatacagttcctaatcagggaagttgttaactgaacctccagttgactattttttttttttttttttgagatggagtctcactctgtcgcccaggctggagtgcagtggcgtgatcccagctcactgcaatctccgcctcccaggttcaagcgattctcctgcctcggtctcccaagtagctgggactacaggcacccgccaccatgcccaactaatgtttgtatttttagcagagacggggtttcaccatgttggccagaatggtctcaatctgttgatttcgtgatccgcctgcctcggcctcccaaagtgctgggattacaggtgtgagccaccgtgctcggcctcaagttgactctttatcccaaacaggctaagcaataaggcccaacctctgggcttcctctggcgggagtctggggattagagaagctgtgatggctttcactagcaagtctggaaattaagatccacaggacttcctgatttttttctttccttatatccctaatggtaaactaggtacagtcatgtgttgcataatgacgtttccgtcaacgatgcacctatatatgatggtggtcctatgggattataagactgtatttttaccatgccttttctatgtttagatatgtttaggtacacaaatacctaccattgcattacagttgcctacagtatggagtgcaggaacctgctgtacaggtttgtagcccaggagcaacgggccatagcacacagcctaggcgtgtagcaggctctagcatctgggtttgtgtaagtactctgcgatgtttgcacaatggcaagtccacctgatgacacatttctcagaacccgtccacatccttaagcaacacgtgactgtattttgtagtgggattactctggcagtatattatagtgagaactgcccagagattttcatttttctttaacaggctctgcgtttaacttcttactctgccatttactattttgtgcacattacttaacccctccagtccccattttcttcttcttggcgggacatcaggaggcctcgaggagataatgaagacagaagcccgcactctccaggtgcctgatgtttgctcagcaaacaggactcaatgtcaaggtgctcttctgcttgaactagaccaaatagactgtaaacaaatacaaatcttctatacagctgtaataattgtctgaatattccatcacagaaactacctcaagattttgaacttgtaatgaattagatgtaaagaaatcttaatgaatgacctacaaaccacataggaaatgtctgagcacatttgaccatttggtacagaaatgaatctggactacgctgtaccaagtgtgtgtatacattatgcattcggcctttgttctctgaatgacacccacgtctactgataattgtattttagaaatcaaacagtatactcctagttttcttatattaatagtctagcctcacttaccgggcgtccaaactccagttctgaaaagaatttataccagggctcattttctaaatctatgtcatctggatttatgcgatcagtctagagcagatgtgaaggaaaagggaaggaaaaggcacactgagcaaagtgagggaaacgctgtgtggcatgaaaaactcacgcgcgcattgacacgcaaacatgcatcaactctcaccccacgaacctcagcaggagagaacggaggaagtaaagtaaaacgagtagcatgaggatgtgaaggcgagctccatggcagggggtccctagctgtttcctgcgtccatcgtttctgattggcataagttgtgggcaactcttgcttgagttgatccacttacgcttgaggcatgaactatggaccactctctgcggcagcgagactgggtctggctggcacgcctgatgtttggaataggctcaacccagtcaccaaatagctcttttgggcgagtcacttcatcgtccctgccctcattggtggctagcagtcccagcatgggagcccgcagtctgcagacaattcactcgggtgcaggcaggtggtaagcctgggatggggaagggtgcgggaggggtgggaagacaggcgagctggggggagggggacagggcattggggggctctcaggggcctgtggatgagaagattctggggcctggatgggtgcgagcgggacccgggggagtgggagtcgccaggctctgagcaagcaagggctgcacctgcacctctgccgggcatgaagaaaggtaaggaaggaaggagctcacccgggtgggagacagagccggggcgcgcgagcttggtgtgggggcgccactccggggcggaggggaggggctaccagtgacttctccgagtcgggagctagaaagaggcttccggccaggttcccttggaacaggtgtcggagttgttgggagagggggctgcaagaaagaggggtgcagaaactggttcattagatggaggctctgggcggaaccgcgaggacaccctggcagcgcgctgtgcctgcgttaggccgggaggggagaggcctccggacggcgaagtgtccctagggacccagacgcctcgggagcgatccgggccgctgcgaagccctgcccaccaggagtggatccccaggattcacctcccggctgcctgctctgagctgagaaggggatctggttcttcacaataccgtggatggcggggaaggggagggagcctggggtaaaatcccatcttggtttcctcgatgttctaatttagagaaaaagccagttttataattgacctgcttccctgcagaggtttctgaatgttgtttttaagatgaaaaaactagcagtgttaatataaacagttggagaaaatacatacaattattctagtaatagaaaacagatgtagagtgtttaccttacccagcagtgtccttaatattttcaaataatacatggctgactagattgatttaggctgctgattttgtagtaaatctaagagcttaaagtactatatacaagttattacttctttgataattactatatgacactaattaaatgtggtacaattgaagagtacagtatcttaagtcagaaaaaaaattctaagaaaaattatatggttccctaaaagccattcactctggctaggagaggagctgtgactcccaagacatattctaggaggactattaagtgctcactgcttcagaacaattcaatatcatttgcttacaattcttaaagaaactcagggacttaaactgaatagcgacatcttggttgtgaaaaaaatgctatgtaaccttcgcagtgctgggagcttgaaatgttccatattccaacaaaagccatgattttgacattgttctactgttttattgactcgttgcatttacaagttttgctaatgatacacagtctacacttactaataaattatactcacagtgtttttagtgatgtgactttgtttcaatattttataataaaagattataggagtaattacagacaatgatagaaaagtttgaggcatcgtgacaaaatagtgcaaaagcctaagttatccaaaagatgtagtgatcataattataaagactgtgtagtgtccctgggaaatgcttacaatgagataccaagcagtcaaaacggaatctaaccacgcacctgtacagtagttacaaaggtattacaaagcttgtctctgcatgaacacagtaaagaagtcacacatacacaaacgactacaatggtgttctggtattgcgactgtttgttttttctttcttttaaatattattttgctttattgttgtaatgttatttttgtaataaataaattcagagagaacatcctactattagacataggaaaatgcctagaaatcttgagatatttttccttctttatgccagtattatatttggtttacacctcagaagtaatagtgaaattggtagagacaaaatattctagtaaccaatttgctattttctgttgaatttaaaaatttaattcaatttatatttgattcaatagttgcaatagtattaattgagattttaatgtccataaaatactatttttctccaattattatttagatcattatagatgcataattgttcgtgaaatggctttgctggagctggtttttagggtaactgacaggagagagaatttccagtaatttctcttctgtttagagagacatactatttcttctacaggaaaactaacctctgactcttttaaacttcatagtttctaatgttacacactgaatgatatcattaattattataacttctgttttcaagaatagtattttgttttgccaaggggagatagaaacttctcttagaggaaacgaatctgtttaagaaacattatgaacagcagagggcagccaacttactaaatgaataagacttgttagctatgtagcttcactttgactcccacattaagaaaatatgtaacaaatggatataccaagtcctgatttatagtaatgcatctctatgatagaatatggaaaaggaagcagaatatctaccatcttgcatcataccttagaatggcagttttccatgaattatgcttttgtttatttaaatagtcaatttatagttacaatgggcaactatctagaatgcatgccaatagaaattagcagagaaaacacccaaaacaatgatagctggtaattatcgataactttggaatgcaatgaaaggcacatgtttgagcagagttgtgttaaaggaagtgttagtggcagaactagaattttctctttgctgtggttgccgtattgaatcttttaagtcatgcaataattaaatgtcctatggtgacctggaggcactgctaaggaacacagaagcctcgcaacagtcagtgacacacatacagatggtcagtcaacagatggatatacacacaaatcactaatctcagtaatttaacactttccatgtggaacatggacattcctttgagtacagcactaatattaacactcagaaactcatttaggaggtatgattatggtttactctaattgctcataaaaggcaaaagagcaaagatactgatatgcatctttctagccttggtgtgatttttttgttgttgtttcttttcattaaaaaaaaaaaaaaacccaccagcaaacctccgtttaaaactaactttgttagtcatcagtgcaagaggacgtgttcaagaaaagctacaactataaatcacaagtgatccttacttaaaagctaccaagggtgaacaactttaaaaattttagtgttttctataatttaaaagcatttaattgcttttgtggttatcgagattccactaagtattctcagtgaggcatgtgctttctatacgttgttctaaacaaaaagaagtgccagggctattttgtttttcaaattacgctcattccattttaagttttaatgacattgactaccgtgttttatatttattgtggtttcacaataaatgctatatacattattagttgggataattcttaatggtcatcagatgaaactccttaaatttttatagttaagtattgactgacaatctttattgataaagaagcttaagttcattaagggtttaagttgcatttcaactctgctacagtgttttcaatgactattttcttctgcttttatcattatgttcaagtttagttattgtaggttagggtaacattttcatatattttttttttactttatcaagcatacagaggtcctaaacaaatgctttattaatttttttttttaaatttaacattactcacctacaaacatatccaatgcaatgggatataaaggttttagtaatataatcccagcagagtttttatgattgtctcatggaaaaattaaattgtggaaatacggttctgatttgtggttcgagtcagttcaaggcaaattcctggtgactgctaagtacttttccagatcaaacattaggcccaattaattaacatttctaaatttacagtcacatgagtatttatgagcttcaaaaaagtgcgctcacttttactttccctgttaaagaacataaacgcatatgccactgattcctaaggaagatctctttgccagggtcttgggaagatttttgttcaaacagtactacccccctgccttctctgtatcccagggaatcgtggaattatgagtcactactaatagcagtgtgtcaaacccctccaagaatgttttgagacccactgggccttttgcactagaaatatataggcttcatggataaacaacagaacaaggattcagtccctcaccaactttttccactgactgcaagggtgaaacctgtgttccttcattcacttagaaattccacgaatgcatattcactgaacacctgctacaggccaggcatcgtcccaggtgttgggatacaactggtggaccagtcacagccctcgccttcaagaagctcaagatctcatgaggaacacagtgtgccatgggcacacagcagggagagcctccaacctaatgcagaggagtcaggcacattccctgggggaggtgggactgtgctgggacctggaggatgggatagaattctccatgtgaaggaagaggtggtggggagagcttttcctggtggggaggtgcagcctttacagaggcccagcaatgcgggaattgaaagttctctgtgcagctggaacctagcgaggcagggagggtgggaggagagatgaggctggagaggtcagctggagcccagtcacaggtcttctataaattatgctcagggtttcagattttgctcgaaggacagtgaagagccagagaaaattttgagctggaggttttataaagattttctaaagattgccttcgctgtggtgtggagactagactggagaggtagggaaatgaatcaggtggctgtcactgtagcccaggcacggacaattgtgggccagaagagaggagcagcagtggcacttctcctggcaggcgacactgagtccactgcaggagaggggaaaacccaagatgaccctttggaaaagtgggcagatggagaggccatgtagagattcaaaagagcaacacagaattgcccaggtgttgtgtatatttttcaaaaattgaaaatgaaaagagcaaaggaatgcttccaaggcatcttggagtcaaaagacatgagaatgcatgaataagaccttgatacccctcagcgctggccatcgctgcgacgccactctcattcagcacgcctgctcttcaacctctagcctgtattttcaacacttcagaatcttatgtaaactatatcagtacgcggccagtctctacatcaccacggcccacttggctctttttgttttctaatttatagaggcaattgaaacgaagtcaggactaatttttttaaaaagatgatgagctggtcctacactggaaaggctggccaacatgtcccatatggccagctcaaaccattctgcttaaggctggtcctctccaaaattgtttaggagggttaacatttttggttctttctatttctccataagatagccattctcacttccttccaagtttctaagttccttctacttatcttctcctgtggctgcagagacctatccacactcgaatctctgtcacactcatggctccagagtttcctgtcttacaaccagtcacatctactggtcctgtgtggtaactacttagggcctaagtttctgataaagtaaatcaagtatactttattgtaaattagccaataaataaattaatttatactgcaaaatcatcaaataagggaatcaaataactgctacttcaatgtgtttcctgctcagccacacctggagtggctgtacagcagcgaccaagtgcaccaggcatcagtatgcctgggctcaactcctagttctggctcccaccatgtgtccctggggcaaggcgagctaatgtgtgtttcagtctcttcatctgtaacatggaaatgccatgtgtctgcttaatagggctgctggaaactttacatgagataaggcataaattactaattacagcgcctggcatatagtgagtgctcaataaagatttacaatgattgctattgctattattattgctattgtaaaacgaggagtctttaaagtcttttttaacccaaagacaagagtaatgtgacaatttcaataacaatgatagggtcaatgtataaaccctaaagggagcaaagggagggttttttaggtgtgcgtctgttttaaccatataagaggctgtttactttgcacaaactcagatctagtcttgcatagatattaaatgatagacttgaagttcctcaaggtagagagtgtgtcctgttccccgctgtgcacctcacataaagcctggcatgtagctggtgctcagtcagttttactgaatgactaaataatagaaacatcgtggtgggagagcgtctaaaaccaatcctgtttcctgacaccacggctaccaaagcattccaataccattaccatgttcgttatcctaagagtctcataaattactagaaagatcattaaaattttgttatttaatttaaatctgagatatattatttcactgttttcaattttctgcaatgatgacattgtgtttcactcaattctcattctggaaatttcagagtagcatgatactcaatcacagaaactagtaaatgggttacaagtttgcaatggtgcctgcaaatcagtgattttttttttctttcagtttttcttttgtagtcctgttactctaaaagatatgagttatttaaagaaagggtaagaaggcttagacaaatatcatgtatgaattatctgatgataaggttttgaacatgcttctccagaacacaaccgcaaacacagggtttcaaagactcaatcaaggacactcatgttgggtgtggcaaggctagagtttccaattaaaccacagggctggccttggattatatatgagtgtgatttcttggagactcttgaaggagctccacaaagaaaactctctttttcctgttcactgacacctaaaattcttttaaagcaaaaatgagagtaaattgcaattgattgcaaatgttttcctagaagtaggcttggaaggagatgcagaggaactgtggagtttcaaagaaaatcctgaggacactgatttctgaggggaagcaaaggacatgcaagggagtattggggaatcaaaaccaaagaaggccaagggaagacctatgtgtgaacctgcgcttcgaggaggcaagtggttcttcttaagtgtatagatatttttgtttgcatataattaaataattggaaaaaatcctgcaaagtgaaatataatcttgatccattagaatgacaatcaatcaggaagcttgaggcttggtaacctgaggagggatttaataagaagcaattaaaacaacttgttatgaaaagggcatttggaaaattctcccttcatccaaagaaatattaaaaagccaatatggaaaacaagggatggaactgcctgggtccatgtatattggggagattaattaatgatttttctcattagcaagctatgatagcaattaagtattgcacttatgaacttttttaaaagttaaactctgattaatgattaggcacagttagagttacatgcaaatgaatcttgcatataaatatatatatgtgtgtgcatacacatgtgtatatatgtgtatgtatatacacctgcatgtgtgtgtgtatatatatatatataaatacacacacatacacacacacatacacttgtatttggtcagtaaagacaatatattagaacatgtatctttcaattctgagatgagatgtacaaatcattatacaaaataaacatgatttctaagtgattacctttgtgacaaaaattgctaatgggtctgaaattcaggtttattggggagccctgggagcccagcgagctggcatattctgtttaatgacaagtgcttactggtctttcatgctgaagaattgatgacttgccaggttcatattcaaaaatactccttggctcagaccgaaattttcttgtgtccacttttctgtctggaggatcccagtcatgcctagaaataaacaataaatcacacattaaaataatcctttttgcttaaagcaattgtgtaaaaccagttatctgttttcaacattacttttagcatagttttaaaaaaaatctctcaggataaaaagttaacctgtgaaaaataccacattcccccgccactggctccaaaagtcacatgaggggtttgtagacgcgcagagagtgagtccctgggttcctaatggcagctgtgtatatttgtgcttaaaataggtggcagtatgctctgctgaactatgagcatttaacccaccactttgtgacctttgggatccttgatccaaagtgacaaggagtaatgcacacaccatgtttgatcttatttcttgaagtgggatcatcgcttgggaagagcacagaagtgtcatgtgggttggcgtgcaccagagcaggcagtgtggaacaggaggtcgtcttttggtgtgagccttgaaaaaccagagtcaaacatctcattcatgggaaccagcacttttcccccaaggaatatcttccaagaggctgtcagaagacttacgaaggaaagcttcaaaaaagggtttcacaaaattaagcttttctaggctactgagctaaagaagaaggcttctttttttttttttttttcgagacagagtcttcctctgttgcccaggctggagtgcagtggtgtgatcacagctcgctgccatctcactcaaactcctgggctcaagccatcctctctcctcagcctcccaggggccatgatttttaggaggaaggattttctgactgtagataggggtaattctgcttccatggaatggaatgaaattcttgctccatggcccgttggaaatagaaatactctaagagacagaattagggacaagccctagctttctactaaattcatgactgatatggagcaagaccccttaaactttctcagtcttcatttttttccatttgtgtaaaacacagacagcaataatgtgttgttcttccttgcagaggagttttgagcattacatgagataatacatatgaaagccatatggaattttttaggaggttatcatatgttttaatgagatatttaattttaacaaaacatatcagatgggtaatacctttaaatcaaaacgttaattttggttattttttgatgacaaagataacaatttgtgtctagaaaactgtttctcaattttaaggcctcacataattcatcctgaggagattggtattaaaatgagacccctttcacacacgatgtgtgtgttttggtgggatgctgtgccctatatgatcatcaattactctattataaaatttttatttgttttttttttttagtgaagatgggatttcgccatgttggccaggccagtcttgaacctctggcctcaggcaatccacacaccatggcttcccaaaatgctgggactggctgggtgcagtgactcacgcctgtaatcctagcactttgggaagccaaggtgggtggatcacgaggtcaggagttaagaccatcctggccaaggtggtgaaacaccatacaaaaattagccgggcgtggtggctggtgcctgtaatcccagctacttggtaattgcttgaacccgggagtcggaggttgcagtgagacaagatcacaccattgcactccagcctgggtaacagagtgagactccatttaaaaaaaaaaaaagtgctgggactacaggcatgagccaccacgcctggcctgatcatcaattactcttaatggtacaatagggtgttgaatacaatttttctggaatgggtatgataacacttaataaccagtattaataagaaataatttttatattcttatttattaattgctaggatagcataggccttgggtttaatcagagctgagcttggaccctggcttggacataacgagctgcatgagctgagtaagttcctaccattttctaaactgcagtttcttcctctttaaaatagaaagtatctcactgggttgttctcggaatcaaatgatatgacacagaaaaagcacttagcctagtgcttggcttgtaatgagcgctcaatgaaggttacctataagtagaagtattagtcataatcccagtaaaaataacacaataaaaaagtgtttataaatttttattttcatgtagatagtttgtataaaaatatttcagtggagaaaggaaaactcgtattagcttgaaaaactggtagaaacaagtcacagacacttattaactaatgcctcattatgatttttgaataactttccctgctttcaaaaatgtctcttattaatagacctggggaaacagaaaatgaactgcatagcctgtaacctggtatgccaaaggaagtacatgtccattatttctatttacttgtctcttatatgtatgtattgatcaaaaagcagaaaatgtgtccatattacttcaagtctaatttagggcactccagtatcatgaaagaagacagggaaaacatttgctacaatcccagcagaggaggtcaatatggtatatgtatagactagcaagattacacatccgctctctctgtggcaggtgcactgattcttctactgaatgccatgtagacttatttttatcctaagcgaaacataggccaccctggggggaaatgccttacttttctgttgaagaccgatctcttggtcgaagcggcgggactggaggtggaacatgtgggggaggcactggggaggacgcatccttaaaggcattggggctgttgtcggagtggcttttggaaagaggtctgtaggtttgggtctttgcagcagggtgtgactgagcactgtagggtgggttgtacagacctatcatgacaaaaaacaaaagcagacaaaaaacagaagcaaatcacctcttaaaaatgaattaaattatttgtccccctcaaaatagccaatgattgcatagaaattattatcaataagcatattcataatgcatacattagaaggtagtttcttaatttattaatattaatgtactaatttccattaatttattaattacaaatttattctgtacctaagccctgattacagtaaatctttgtcaattatttcagaactagtaataattcagactggtactaggaatagacttataagcactcagcaaattttctcttcaattgtatacactaagaaaatagttcagttttcagagcaagattaaaaacggaactgtttccaaatatcttctaatactttaaaaaccctgatttacatatgaaaattgacatgctaattgtagtcaaacaaaatattgcacacagttgtgtttataaagtgctgtgcaaggtacaaggaaacatgagtcctcaatatgcttagagtgcacctgggaaaatcagacacaaatagaattatgatggaaaataattggtaaaagataataaagaccaaatgaagaaaacacatagtaagaattaaaggatgctagtaggtggtagattgctcagagaaggtattatggaacccacgagtccagagtcagccctgaatgagtttcggtgagcagggcaagaggggagcagggatggtatagaaaaaaaggcagaaaagtgcaaggtgtgaagccatggcttgcacggttagtagagagcaaagagactagctgcagttgactcgtccactgatcaaatgatcagcttgtagggctgtacaaagtaatatatcactgctgttccattcactaatcactaatgtgacacaaacctcaatattaaaacagttataaaaattctaaattttcctgcacccaatcattggagctaattctatttgtacccgttcgcttctcctgaaagtccatgcacatttccacagcaaatgaaaagagacaacatctacacttacagttttgcttggattcaacagtcggacttcaacttttgagctaaataaaggaggtgagtttggtgggcgtgggagcagggatgaaattaagggaaacatctttgtgggcctgaagctatcagtggggcgagccaagacttaaacccagagggcttgctgagtttgttctactgattttccctctatcaatttgtctttggagataggagcacaatcccaaatagttaaagggcctgaatgtggtctccaggggtgcagaacaggaggatcatgcgaccccaggctgcccagaggaccccaagtgaggttgcagctgctgaaggggaggggagcagtgccagcctccgagcctggtctaaagaaagaagaaaaaaaatagttgtgcacctgtcctgagcctgtgactgggcagggagaggagccctgggcagaatcccgaggcaacactcaggagaaagtgatgaagggaaaaacatttgtcaggggtccctccttccagcctgcagacccctgcacgagataccaaggctcgccaatccaagtggcagtgcctggaactgaagccattctattgtgaccactggcaattctgagtcagaaaagtggccccgccaagggggatttttaaactctttcaatgaatggttgcattttggagcaaaaggcagggacaaggtcacagaatactttgtttgacttgtttttggtgaagtgtatctgaaagatcttacacaattgtaatcattctctctgctgataaaagatctttatcttattttgtaccctgggttacagtgtgtcctttcagcctatccttcacactttggttaaacattcctgaagctgagaataaaccaacagtgggaatgaatgagataaaccagtattagttctcatttccatgagaaaagtcaatccttttgttatgcacgctctgagaaaagaaaagaaatcctcctcctaatatatgaactgaaaacatgtgctcaaacagaaggggaaaaaaggtgaccgtgtcgttcttccaaacattgctgagcataaaatagtcattgcgagcaaggaaacccatcctacctgcattgtatgtataaggagtattatacatgtctgtgtcatcatctagaaaatgaaacataaatattatggtaatatagattgtcaccaaaggacaacgagacagcagaacttcagacaaacaacagaaatttgttagaaaagcaacgtatttttcctagttcataatgccattttctttctttttttctttttttttaagagacagggttttaccctgtcgtccagtctggagtgcagtggtgatcattgcttactgcagcctccaaacctccaacccctgggctcaaatcattctcccacattagccttctgagtagctgggattacaggtgtgtgccaccacaggcctctgcaaactgcccttttttatctgtaacatattcgtcttgctgccctcttcgtagcatgcaaagtcaggcccttgtcctcgcttccccagaaacctctctgctctggatcgcaaatttcctttactaagtgctttagtggtctcctgtctacagagcaggctcaggcagacccgcgcaggctcactctcctgatgagagcagacaggggtggacagaggaacaatgtgtttttcacccaggcaacacaccaatttagactgtggacaggggaggatggagggctgaggccagagtgcctggttgtcctccatggggaggcttcttggcagctcaggtgggaggcagaggcacagggatctgtcaccggaggggtgacagaaggagaacaggaggcatgctgaaaagaaaggggacacggagtttgctggggtcttgacattgtgtgtgaatcaaaccgatgcaaaagacgaatgtagtcccttcaacccacaaggacctcatcagaaagcagagcagcagacatacccggcttgtgcaccatgtgaatttgcttaaacatcgtcttgtaccagtccttgggccggtcgactgtctgtaatgaagagagcgtccaatggttacaaactggcttccaatcaacatcgcttctcagtgttttcatttctctattttatgttcttaataacagagtcccattctgtgataaaatgttctgactctttgctatggcttcatgacagtttcagcaatttacttagttatgtgtgcagtttgtaaacatatggccttgtgtttgaatttaggctgagttggaacattagatgctatggttttattttttcaagttatagctgtaccctgcactagagagttgatatttgcacaaatatataaagttcacttaatgtaagttattgttgtactaatttgtttaactccttttggtagataatgatcattatccttagatgctttttattgaatgttctgtaagacagtgttttcagaattaactggggaatatttttgactcaaattgtattctgatcagtgtggctctagagaaataaatttgctatttactagtctaagctactaaaatactgaatgtagtaggcatcccagagtcctacggaaaatttaagaatgtagatattgcttcaaaaatgctaatatgataacagagtgtatacaacatttgctcggctaaaattgtaggttccttgagagtagaagtccttacggatccaggcgtcggacatgaggggagcagtaggctgtagtggaaagatgaaattaatgtagagtcttgaactaagattcaaatcttggttccttaaattgctgcttaatacaccctagcaatacgaatctgggcaagtcatgtcaccttcttgagcctcagttttctcctctctaaagtgacataattatatctaaatcataggattgttatggaaatcgaatgagacaatgtatacacaagacctagaacaatgcctagaatataacaactactcaataaataataacactagggaactgcaaatatttgtagaatgaaataatgaatgaacgtagcctattggatagagctctgcctttctggatacctgtaaaagtagacacatgcttttataatcgtactcacagattttgcttggcaagatcttaccccaactctctgagagctacctgggcaacaggcttgatgattctgcttatagtaactaaacacaccagacgttccaagacagatctcgatttaaaaacttctgttaggactgatacgaaagcattcttatacttactagactgagctttgggttagattttattgcctgatctttttttccccagaaatgtggtcactgcatttttcctctggacattaagggttttgtgctatatctaaatttattttgacctctgagaatatattattctgaaaaatcaccccaaatacaggttaacatgaagggccacttgacttcgttatgagtcagctcttcattctcggctctttctccatggaagagttgaggttattgattgactattcagtcaaaggacgggacatggtggaagggattgcagtggtgaagcaaaggtctattatttgctggttcaaagttgctaaacatgtatctttcaagaaagtttatttttataaaggactgatttctctttcattaaacctcatttcttttactgtaccaaagcaacagaaaatacaacatagtgttgtgcaaaaatgttttcctggacgtgctgatggcaacaaggaagcctactaagtaagtcctatcactgtatatggcaatacatgttgacagacaggtttttttttcttcacttgctggagggcctatatcaggtaggatctcacagtgatgccatctgctagctttatatggtgagcacaaagatgccagaaaatgccctgctggcaaagggaaatatgaagctggaaaaataaaatacgaaaactctatgtccctttctaaaagaagtactctaagcatttaaagttccttttgtaaatgccatcatggagatcgctatgcctaaggctgagaataagaaaatagtctactcaaatttcaggaagtttacttttgtacgtaaaatcattttgcatgaaaaatagctactagcaattcactatgccgttttttctacaaccttgactaaatagacctgaatttttacattcctacagttttcaaaacatcagaactctacactgatttaacacgcagagatttcaaaaaagataaaaaaggacatattttctacatagcagtatacagtgactctgttctatttttttctccttttcagttttgaaaatactcaaacaagtgttatattggaagtagaagaaaagaatcttgtatttcacttaactagctggccttaatgacacaatctcatgggagctgagccctggcgatttttgttgttttgaagaacagcactgaaaggttcacatagatgtcccaggtcacatgagagagggcaatctggagagctgattccctgcattaaaatagctcaaaagtactgtttgttgactcttggctttctagagtttctggatgactttacaaaattctgtttcctcggcataggctggctgtctaaaacgatactgcagcatggtacattgtgacagtaccgcctttggcaaatacactgaatctgatcatcattactttctacacatgagaaagaaaaacaaccttggagagtcttggcctgctgtggctcagagacagcctgacttgacatttataaccacagctatacatggggatgtactctggagggctgtatagtcagtgtaagaggagagtcctcatagacctggaccttctttgtcaagttttaaaggtccaagtaagacaacaattgtgcataaaaattacagttccttataaggaacttctgcattggttatattgtgttttctattttatagaagggaaactggcattaaatgtttagtgtgtttgcttatgcatacccaaacgtgcttttgatttggcagttgataaacattttaaaaattttaagatgatttaattttcatcaaccatctctagcatctcagtttttccttttgaaactaaccaggcaaagtctggttagttaaggaaattatgtcttataaaggaagaaaacatggaccaggcttgcatgtccattatatatcatttattgacctaaaaacatacccagatatctttgataaaatcctctcagacagaatctataactacatagaatcagggctttcttaattttgtctatactatgcctcaagtgccagttacacaaaaccaatgacaccatttctgtctgactgtctatccctatataattagaagaaagtttcaaatttaaccattttgagtcagaaatcttagaagggaaatgaacaagaaaacatcatcaccagaaacatgtaatcatcataaaatgaagaatattggtcataatccctgaacttttctttggcacataaatatggcaatcgtcagtttcaagacagattgttagaatgtcatatcacattcaacgtttcctcaatctaaagagtctaaaaccccagtaactgctgtacagatttactttttggctttcaattgtaatatagatgctgagaataatccattttaaactcttctgtctgtatataaaacacataatccccatataagaatgtaaagtcaaggagagaagaaaatccccacactttatcgttagttctttttgactgtttccaatcttaccacggctttttttttttttttcctgctctctttcccattctttgcctctatcccttattgtcttggctgcccaggtctgcattccaggggagcagctcttggccacaccccagctttacatgggtcttgctgcaaagtatatgcagctgcagtccctccccgcatggcccccaacttcacctgcaaaggtgttgttgctttcatcctgtccccggcttccttctcccggctggcacaagccttctcttccagtggacttggtcagccagctgctgcctgcccaggctctcagaagctgcctctgctactgctgcgttttgccggaaggggctgcccagatacactgagcaatgctttggcagagttttaaaacttaaaaaaaaatccaaacactttcacttatcatcccaggagagctctcagcaggcacggctgaagagggacattaaaatgtgtatttttcttcagacagcttttcctttccatgacattaactctcttcactccaatcatctcacctcccaactcccaaatcacagcttccaatctcccggtgttaacacacatctatttcaaaaaacgaacacatcactgctttattcgcaatgcatgtgggaattcaatgcagccaaagaatttccattgtcttgttccttctcttttctctctattgccctaagcctccttggtaaaaggtaaaagaaaaacaaacaaacaaacaaactaaaccacacaacacagttttaccatttaacaaaatcgcaatgttcatgatgtttcattcaaatggaaaaacagattgtgtaattctctcccatcaacagctttctttctctgccacacacagcataacattcatgagaagtcggatggcacggagggcaatcctccttatataagaccctaggaatgcacaaagccgtggacaatccgtcctttgtggagtctgtgcacagccccagacagacgcacacgctggcatttcctaccgttctaattgctgtggggattccggattcatccacgggcccgatccctgggtaatgcggggctttgatgactgtcactctcttctcttcctctgaggatcggtacagggggatagagctgctggtggtgccatccagagactgcgcatgctggggatatgtgtctgtggaatctgcacagaaaatttggtaacatggaacgtattcgttgcacagggaatcataaattcatgtgtcttgttgtatatttatgccaactgtaacacagagaccatattgccatcactgtcccttttaactcatttactttccatctgagctggtggaaactgtgtaggtgtgcggggaacagacctataccaacaagggcctcaccattttatgaagaaggctgagggaagaatggcatttgttaaatgactgtgtggaggcctctgagttaggaagtgctctaaatgcattatctcttcttatccttccagtaatctttgagggagggcaggatagggggagcaagaaccagtgttatagataaggggcaggagctgagacaagttcagtaatttccctcaggtcatcatttacatcaatattattcttgtgatactgctactactattatttataggttttgaaatgtatttccagacaaagacatgactgttgagtcagtaacagtgatttcataaaaatgaagcaaaaccaaaaatcacttaaaaaaatcttcacatccaagcctttggacatgaaagcttctgaataaataaatgctgtaaaattattagtacgatttcctatgtgcatttttaccttaaaatatcaaaaactatgactttttactctttgatgacaaaaactgccctaaggatataatttagatgaggcttatcgagttcttcatgttttttagtaacttctagaatactttcagaagcaacagagtacagacatgcagtatatagtccatttacttctaatacacaggaattttaaaaaaatcatcattattaccgttcctctggtatgattaataatatgcctttatatttttctgcaattaatttgaaaatgttggtgacaaagaatgacactttgtatatactctttatatcatggtttgtcaggactgccactcagaaagtcctttaaggtggaaatgaaaaaaattctcatgtttcagggtgggactcattgatatcattatgtgtatatgatatatatcatgtataaatgtatttttcatgaaaaatttgtataaaataagtaagctttttttttttttttttgagatggagtctcgctctgtcacccagctggagtgcagtggtgtggtctcaacctcagcctcctgggttcaagcgattctcctgcctcagcctccagagtagctgggactacaggtgcgtgccaccatgcctgtacaaaaaatttttgtacaaaatacaaacaattttttgtatttttagtagagacggggtttcaccatgctagctaggatggtcctgatctcctgacctcatgatccgcccgcctcggcctcccaaagtgctgggattacaggcgtgagccaccgtggccggccataaggaagctttttaagaaattttaactcatcaatataagggtaattaaaattcagatctctctgaggtaaaatccattgtaacatttgtaactgctattactatgattatgactattttcaatttagtttgcatcagaaagtcatttttaatacattttttgatgaagaatggataaggctagttataaaactgctttatgtgcagtttatgtgctggatggtgacataaaatgtccctgaataaacgaacagcatcatagcctttcaacactgaatcagtgctggggaaggaggtgtgctggctgctgtcaaagaagacatggtggttgaagtcccgggttgtagtttctttccccctgctactggccccttgaatgtgaaaataacattcaagctagtccttatttttacttctttattttttttgagacggagtcttgctcagtcacccaggctggagtgcagtggcgcgatctcggctcactgcaagctccacctcctgggttcacgccgttctcctgcctcagcctcccgagtagctgggactacaggtgcccgccatcacgcccagctaatttttttttttgtatttttagtagagacggggtttcaccatgttggccagactggcctcgatctcctgacctcgtgatccacccgcctcggccttccaaagtgctgggattacaggcgtgagccaccgcgcccggctaagctagtccttattaagacacggtgagatatttgacactaattgactttctatttaattccaaaaaggacttgagtgggcctccatgatactagtatttttattagcgacgaatgttttttgaacaccagcatgtgcaaagtcctactctaagcaaggagaatcaactctgccttcacatctgatccattacattctatgaacccataccttatgcaatataagttaaccctttattttattattctcatatatggtccactagctgtcatcttagcaatcttttgtcctaaactaagtgtaaaattcatctagggcaaggtagatgtacatattcctccgaaaccttatcacagcactggccagctggaatttgttcagtgtttacattgggaatttcttcccatgcagaatattttatatgtaaaatctacttatcaatatattctaaaatcaaagcctatctacattcaagtatttttgttgttgttgttgggtggggatagggacaaaactgcattcactaagacaggcaatgagacagagtcaggctttgttaataattatttgggaaaaagctgtggctagaataatttgtcgagttttactttatatgtgtgtaaatgcatagttccattttaaacaatctagatataatggacttccattataacaccacactatgggctgattgttaaagggcaaaatttcggcataaaccagttttactttcttaactctaaaaggacatcattgtaggattcacagatgatcctcaggcatagcatcagcgaaggcacagatatatttagactttaataagtcccgcggctacctttaaagttttatagttatagagctttggttgacctcagaagctgagttccaccatgcacatgctggatggtgacataaaacatccctgaataaacgaacagcatcatagcctctcaatactgaatcagtgctggggaaggaggtgcactgtctgtgtcaaagaagacatggtggttcaagtcctgggttttagtttctttccccctgttgctggcccctgtggccagaggaccaggcctctccttttctgggaggtgcaggatggtgctgctgtcctgagaattcccctctgctccctgctgtcctagaagcttcctagtgagtcgacatcatggaaacttgtacagcctgaattcctatgatagttcaatttcgtattttttttgatattttaggtttttaagttacatttttacaaactaagaaatatttatgggccgggcacggtggctcatgcctgtaatcccagcacttagggaggtcgaggcaggtggatcacctgaggtcaggagttcgagaccaacctggccaacatggtgaaaccccctgtctgtactaaaaatacaaaattagctgggtgcggtggcgggcacctgtaatcccagctactcaggaggctgaggcaggagcatcactggaacccaggaggcagaggttgcagtgagccgagatcgccccattgcactccagcctgggcgacagagtgagactccatcttgaaaaaaaaaaaaaaagtatttatcacattattttctgaactatctgaacatacttgaccatgtaagagcatttctatcactgtacagcaaagcttctttcacaggaggccacaaaaagtccatgagccccaggaaattatctgcttacaattttttatgaacgtccgtatgtccatttgttttctggaggagagctctatctttcactgaattcctagtcctcagagggttgagaacgattgctctatacaatgacagaaccttcatttaagggaacacttaagtttctcttgtgtggcttcctgctaccatatccctgactgcaggtcttccagccttggtttgaatggtggttttctccttgtgtgagccagtagatgactgcgtccctgctatgtgggacagcctgtcctcctgttacactgttttaactgtcaaacgattctcccttatatagaccccaggaaatagtccatggtggaagctcttccaagtccgaacaagctgccctagtggaaaacctgcattcatgtcctccagtggcacaaacccccttgccctaagtagccattttctttttctttctactccaccacctcagacatctaagtgcccacaccaggctcagacacaggtggagacatggtcttggaatagcatggtgcccatttcctcccatgttgggtcctctgccccagtttctccctggggatagggtcatgagtgctgagcgctcccgcctcaccttgatgccgcatatctttctcctgtggttgtacttgccgcattgaggttgccatggaaatcacggtgagtaaattacttaccgagggatgtgccgtgctgcatgacaatgctggagttgagtgaggctgggagagaatatgccgagggggaaaacggcctctgatagtaactcatgggactcacggcacctcctgagtttccattcactgttatctggctctgagaaaagcgcaaaggcatcgagttaaattagcacatagttccctgtaaacatcattccattaggtgataataaaagacttccaatcacatgagagtaatcagctgccaagctcttatttattttgaaaactgatgtcagagggcatgctacattctttgccttctctctattcccttatttctgaaaatcactctcttgtgtatctgagggtccagggagtggttaggaagaatgaaagtggctgactagtgggcatgccactctgccaacagaggtgccaaatggtatcagtaggagtcagtaccaagtaaatgtggaggacgactttgctctgacagtcgtaacatcagcaatcagaacacggtggtgctgttccgcatgcagcattgacgtggatgtcctttgacatgaggcaagggattggttctcagacttagtcagggatatcttctagtgaatgaatgtttccagagctggtgaataacataaggaacctagttgtttggatgtatatatcatgaagcaacctattctagaaggatcaaatacctggtaaaggatcagagagacatgttcaaccactggcttctccctacttcagcctcattgagcacttcatgaatctctgtttgatttcttaattattcattgtttcgattgttccgtatctgactattttatatccccaatggtatctcaagcttcttgttgaagatggtcatatatatgcttctttaatattttgtataacatgcagcctagtgctgatgacagagtagatgttcaataggtatctattctgatggaactgaatcggcttagttcacagatatcgagctcaggactattaagcatgcctgtctacccacagcacagtactgatcattacagggcgcacacaatgcatgcaaataagatcaaacattagtaagaacgtttagttaaaattatagctaaatacacacaacacacataggcacacagataaagaagcataatttgtgaaacttttctacttattttaaaacaaaacaaacttctattccacaggcttgaaacatagatatagtaactgtgtatttctatgatttcactttaaagcaaatgggttttcaaatgacctagaataagtctaatttcattactgtataaccataccacttatgtccccaaatcaataaacatttcattacaagccttgtgcttattgattaaataattctctaagctgttagaaaaattacactcatatcataaccagccacatcttgaggacctgctccctggagagagctggacgttcaaataactgtgaggcacaggcctgcccaaatcttcagagcttttatgtacctctgatggatgatttgagaacactttcacctccttgcccaagttaagtttggtggatctttgtcaatatcattgtaatactattataacatgttataattaatgttaaaagctgaagaatccttcttattaaaaaccatcaggttaactatattgctaaacctacaaacttgctctgaatcctattttgatggtttcaataatattgactaggggttaaaaaagtaaacactgagagtagatttattcttttttttttttttttttttttttgagatggagtctcgctctgtcgcccaggctggagtgcagtggcgcagtctcggctcactgcaagctccgcctcccgggttcatgtcattctcctgcctcagcctcccgagtagttgggactacaggcgcccaccaccacgcccggctaattttttgtatttttagtagagacggggtttcaccatgttagccaggatggtctcgatctcctgacctcgtgatccacccacctcggcctcccaaagtgctgggattacaggcgtgagccaccgcgcccggcctagatttattcttttattgtgttcaaccaatcaggattttatgactaaaatactatcattagcattttagaaaatactgtattgttatagtgaattcattattaggaaaaacatgtcatgaataatctatttgcaattttaaactgataattgcaattaatttcccttacaagtagctctgctcgtgcccacaagactgtatataagacagttagtctcctgtaaagtcttaaaaacagaaaattgaacaggttagttggtagattgataccctctcactgccttctttttttggttaaaggtcctggtaaagttttaaaagctaagaaccattgaagcacagtagggcatgggaggaacccacacctgctgtgctcctggtgcccgtagttgggctggtcctctgtggcagggagggactcgctatggggttaggcctggaaaatgaggctccttctgtagccagtctctgaatggagcatttgaatgcaaagtgttagacacagccattgggggaataccaaatcccattaccaaaaaaagcatcttttactttatgtaaattgtagtgtcttaaaaaacatatggcttattataacatttctctgcgcataaaatttgcagacttatcagcttgatagaacataaaacaatgtagcacaaataaaattttgtctatgacagtgcttattcggaacttcattataatatcaatttaaaaaaaaaatctgatttttttgcctgaagctatgtgtctcttaaatggaagccattacttagacattatatgcaatatagaatctgtgccataaaattttgaaacattttagccattcacagatcatttattagggattgcttatcacatagatatatttaaataatatatgtatggaaaagatgtatatattgctataaatgaaagacaaattattgataaacaaaataaaaaatgtattcataaatttctgtcctgaaatggctcaggaagaataatttttaaaaatcgtacagctaaatttctgaaaggtagataggattatcgacatcattcactcctggacaatagatgagttcaaaagttgtagctgttagagaaggaggaacaagaaaaattagcctcatgcagtcagtaatcatttatgtgagaaaaaggatatagaaaagagtcacacaggacacattaatgtgagtctgtgagaaaaactgctaacatgtattaatactgggttaaaattttttgaaaaattttagactttatgatcacaacatattgtgatgtatacttagctaataaggcaaatcactgtagaacttaccagctacagtaacacgggaaaccgtaagtaactattttagagtaactataagtaattctaaaatgaatgaagagaatgaagtgactttttcagccttaagcaagcttataggatgactaatgatttccctgacagatggcatagaattggtttgggaatcaacacctatgtaaataaaaatgtcagccgaaaaatgagatggcacaacaaatcagtcctttcaaggaaacggtggaggcaaagaaaggcagaataattacatgagtggccgcaggggtggttaaggtggtgccatctgtcacagcagacctctgaccccaggtgggggagggtgtctcagaacggccagtggtgtcagagtcaccaatctgcagctcctccagcatggctgtggaggactcactctccgagcgggaggagtgctcggccagggaggagtctgttgtcagagagcctgtgtcgtggctgtggatgaggctttctggagctgggagcaggtgtttgtataagcaatgggaaaggctctggggattatgcaggcgtgaagaccccacaccatcggggggcggaaggctgagtgatgctgagctggtgccactgcctggtgagaaagtggctcggttcaaaggtaccacggaaggagggcacggaggagaagcttctggtgtggtttgtctgtgtgtctgtgaagcatttacctccaacacactggcaggtaagttctgatttccaagctgagtatgaggaaaaaataataagagataaattatccaattaacaaaagtacctctttttgcgatgtggcagagaaggcaaagcatcggttttatttgcaagcactttaaggagttacattcagatgggttaggtgccaaccacacagtgcagaaaaagtgtgaaaacaggaagaaagtgaatccagtcggtgtgttttgaaacaaggccggttttcacacagcactgcaatgtaattctggttaggggcttgagagtgttggcataacgaaactgtttcctcaggagttttagtttttgtatttgtgacaatgataagatatcagactatcggtcagcagaattggtttgtccttcactagaaaaatctaatagcataattgcctcccccttgccaaaatgtccccaaaacataaatctgtttgtcttattttttcctggtttatgaatctaaacactgataatactaaacacaactaagcagaaaagataaatggaaaagatgttttatttcctttccactaattaaatctgttctttgatttcactacaaaatacgaaaagaattggactttaaaatatcctagcaatgcaaatagaggtaccatgtgtgaaaatgaaaaccagccactgataatagttagaatgtaccctagttagttagaactatggttggcactaaatcttaggtaaaggagaaagaaactgaaggaaaaataaaagatttaacagctccaaggctatatatagcccaagaggctaaacatagcgaagggatgctctgtaggaggaagagagaagatgaccatttgaaattttacaaccacctgtggtagcctggatgacgtttgaccacacgtgacaaataggatgataagtactcaattcaacgtaagtgaataaaactccgaagcaacttttcttacttattttttctacctttcagaacagacactttttggaggggatgtttgggagaggaaatggttttaagatagatggccagaggtattgtgagatattagtacaaagatgggaatgaatgaaggagaactgtttacacttagaaatactgcctagtaaatgtttaagttaaacaatttggtgttctttggcagccataattttcataatgactgatgtcatgcacgttgttagcataataaaaaggttgcaataatttttttctcagacttttacttgaatacttttaaaaaatccatcatataaaaaggtctctctgaatcatagatcccttagaaatctgataaatgtgactgatccttcttttggggaaatgcacaaattcatacatacagaaagttctgcataaacttcagggggacagagacactctaaagcataaccttaatctaatgggttaagaaaccccaaccttggataaaaagacagattttcttgtcctaatcttacttaatatgattttttttcttgtttaaacatagtcattttaaatgtgatatatatatatatatatacgtatatatataatatatattttactgttcatggttgtttaaatctctagaaataactgacagaaatcttagttacccagaacttaaaatgttttggtggggatgcatccttattattactgagtgtttacaataattgcaatcttattggaggtgaaactttaatattatgaaattatcataattctaacttaatgtattaaaatgttgctataagtctgaatgtaattcagtataaagcagtctttggatagcgtcaatgaaatttcccctaataattcagctttactaaggatgtttccatgtaatacgaatctctttttagttttatttatgctaaatgaaaactatgaaataatacaaatcatacaaaaggatttgagttatctgctcatgagacttttccctttcaaattaaaagaaaaaaatctaatgactttaacccccattggactgacttgtccatatcctatgacttgaaacatgtcaaaagctaaagcgtattctaaaatcaccattgtcacgggtaatatgatcattagtttgcatagcactgtgtctggggatggtccttacccattcaattgttcttccaaatagaatgtccacagaaaacaaaattattccacctttcgaatttctttcaccacctcctgacatgctcctggttttgagtcttttaatgcacgtgtgtgtatgggtgtgtatgtgcgtgtgtgtgtttgtgagtgtaaggcatgaaatgcctcgtggtgagtcacatcacacttaaatttctacagataaaactcaataattcaacagttatactggtcacccacaaaaaagctttgacaagaccccaatcttcacatgaatggaatataccctgtagacccaaggggaaagaaagaccatgttacacgtgtttctcctgaggaaaatcagaagagcagcaggaaaggtatgaaaggggaagaaggcagtattttcccaatctggactacctcaaaaatagggaaaactggctttaaacaagtgtatttttttcttacttcatgagtggcaagtagatgactgcaggtaatcatcctaattgttttaggtctccttcttttcaagaccatggaaggctaaggtgtttgaatagggatcaagggtcaccaactttttgtgagtataaattgttttttctttccccaacccttgagctagcaggaagagggtaatgagaaacaccagctagcagccaggggctgcctggtcttctgcaaaggacagggacggtgcttaaaccttaatatgcttcatataccaagagagagcacctgcttactcaaactagcactgagcttcttcgtccaaatgactccaacccagaatgctaaagagagcctgtggatgagagtgctcaccaatcaacactggagctcctgaggaatgaaggggcacagagattcaagggagggtgagcttcagcagtggaaaaagtgtattgagttggatgaaggcattgcaaactcaagtgcccatcatgggtcaggaaagtatccaggatgtgcaaatcaagcccgtgttggatgacagggaatgatgggaccgatggcagaatgcggaagtcatgttccccctcaaggcgggcgtcattgacccatatcctttgccttgaaacacgatgaaaattaaagcttactgtctctaagaccaccatagtcatgggtaatatgacctttagttcgctcataagctcagtgacaacacatctatagtcataagcccctaagctgtcacttgctgacacagcagatgtggaagctggaggtggaagagggtagctgtggagcggggatgtgaagaaggagtgcatggccaggcctcaggagaggaggggaaagtgctcgttggggtgcaaaacttaaagagtgacaaaaaactcagtaattgagataaattctgtttcaatgcaatctttgaaagaaaatcaacatcaatgcaaaaaagcaaaaataccccatactgaacaaaaatgtcgaaaatataaatgaagaccagcgcatgccaagccataggaaaagagagtctgggtctggcgtttttaatgcaagaaaactcatcaataatattttcaaaatctacatttttgcttatttcagttttagttgagagaatagacatgtttgacaatttccaattaactgatggccatcttaaataatttgtaattaatttaaggtgaagtaaacatgtaatagggcaagcgcagtggctcacacctgtaatcccagcactttgggaggctgaggcgggcagatcacctgaggtcaggagttctagaccagcctggacaacatggtgaaaccccgtctctactaaaaatacaaaaattagccaggcgtgatggcaggtgcctgtaatcccagctactctggaggctgaggcaggagaattgcttgaacctgggaggtggaggttgcagtgggccgagatcacaccactgcactccagcctgggtgacagagcaagactctgtctcaaatttaaaaaaaaaaggtttattttgctttaaataaaatatttaagcttaaaataatgtgtgagtgttaataacgtgcgtttcaacttttcaaaaaaattctaatgacttaaacattctaggaaaaagctcattcccaatatatgaaaacaggtataaggaagcacagaatttccttccacctcaggttccagttggcttgacatggccctgaggtcaaggatcctaacatctctctcttaacacctttagtcattgagcttctaggcctcatttctcaaggaacataaggaatatatattaaatgtcaagcaaagaaatctgacaggcttttgttctcttttttccaatgatagtaatttacttgaaaagaaaatatctaggaaggggtttttttttttttggagtcttgctctcgacctccaaaagtgctgggattacaggcatgagccactgtgcccggctggaaggggttttaaaaaaaccaatctttacctcccatccacacatcctttagggaaaatgtgccccctcttttcatggcctgtcctggtggtatgaggagacctgcctggcagctgtgtctgttgccggatcatcattttgctggccacagctgattaggaagggggagtaactggactatgctgggccagtggggccctgcctccctcctgggaatttgaattacgtgacactgaatgcccctcaggtagctgtcgggtacccaaatgcaaggagtcagagagtatcatggaaacccatgggcaacttgaagtaacgacagagcagaaactaagagacagacagggaactatgcagttcctacgactgagaaggatggagggtagctgcctggccattgccccgtttccctaaggcctggctgtattgcctgcattgtaatgatgtgagattgtctgacagcctcataataaaaattattttaaccatatactccccacccaagagctgggtgacaagtgatctaaaattgtcacacagattgggcacactgacagcatgtggcatctgaatcaggggagtaaatatttctactgtactctgtggtattcagatcgggaatatggttttgcatctgggaaagtgtcatattttaagaacattatcaaaatatgggatttaaaaatcagcttgtgtgagagcatagaggtagcagaggctagtggctgagctgtggatcttgagtcagacagacttgggcaacttgtttaatttccttggcctcagttccttcatgtgtaaaatataggcatggataaaacccatctcttaaagcctgtaaaaattaagtagggcaatgtaaagtgcttagcacagtgcctggtgtgctgtaatagctctcaaaaaaaggagaatcatgttttacaaaattaaaatgctgggaaggaacaggaatgctctgcacaaagccagtagcagggtagggaagagaaggatcacgtgaacactgtcagatagaggcggaagaacattctgtctcttttgctctgtggataaccatgcagaagttaaggaaggcagatcatgacgtggtattagaaattctttccaataattcgatctcagaaatggccaagcactggactgctgccttggaatgtaactgagctcttcattaagtgtattcagaaaaggctggatgcccatctattgggagatgttgaagaggacgttttatttgtaaactcatgttggactcccaagtattctctaatgttcaattatttaaatacatgcatatgcatgcgcatgcacagacatcaaatggagaaattgccaaagacctgatcaactaatagcattacgagcccacagaaaggaagccatactaatggaagacatcaatgattggggccggtcttgatagcaatgttccagaaagtgcgttctgcagttctgcacctattatcccacactgctgacatgtctgcattactctgtcctccttagtatctacatactgatcccatggagcaaaagaaatgagtttcctctcccttctacatgacagtcgggcaagttcccctgtgagtccccagcatatgtgcagtggcagctgtgaaggtgaggctttggcaaatgattgattatgttatttcataacggacaggacaagcttatcttcctgaagcaaggaacatagcacagatgccatagaaactgtttgggggtgtagctttttgctggctttccaaagtgtctggcttataccttcacttacttgacattgagaacaatgtgacatttttagcaacaggatatctgatcacacagtgccataaggataacatgcctcatttctggtctgtttgtaggaggtcaattaaagcacatgccgtttagaaaacactatgaaaaattgtcaaatatgaagagaatttctaacagtgacctgtagttttcttcttaaattaatgagcagacattaataataacaaaactatgtaaataaaacttctgaaacactgaaatgtacttttcacatcttggtgtacttttatcgcttggacctgctaattcctgggagcctaattctttataatggagcacatatttggctgactcacagggtatagcttacagtgcttggcattggctgagacttgccagaatgcggagtgcaagtgtttaaaatggaaaggtcaccattgtgaaaggtcattacatggaaaatgagacttaaaaatgaagcatatcacaatcatcaagatgtagaaacaaaccaaatgtccattgatggacaaatagataaagacaacgtggtgtatacgcatactaggatactattcagccttaaaaaagatggatgtcctgccacatgctgtaacatggagcaatctggaggaccttataccaagtgaaggcctgtctcagaaggacaaatatctgagcagagagtagactggtggttgccaggcgcttggggaagggggatatgagttgctattcggtgggcataaagttttagttatgcaagatgaataaatcctagagatctgctgcactgcatggtgcctacagttaacaatactgcattgcacacttacaaatttgttaagaaggcagatctcatgttaaatgttcttaccaaaattttaaacagagaataaaaactgcaacagcttcatgctaccttttttaaaaagccttagaaaagaggacacgctatcttggaacaaactgaaagtctgttgaaataaacttttacctaccagtaaaaaaaatgaagtattgttgaaaataatatatttctttttcccaatcagatgcataatttggaaaaatattatttaatgatgatgacagctactgtatgttgaagaattaccatgaagcaggcaccatgccaagatccttatatgccttactcaaacctcccagcagttctatgaatggttgctatcattgtccctgttttatagatgagaaaactgctgctcggggagggtgaataactagatgaatggttttatgttaataagatcttgaaacagctgactgcccaaccactttcttcccagtctctctcatacccactccaagaaagcctccttccccactatggaatcaatggtaagttttcagatttcatttcaaacctgtctcatcaacagcatttgtgcggtgaaccatccctttctttccacacattttcctcacatggcttttaggatgccacattttcccagatttcctcctcccttagaggacactgctttcagtctcctccactgcttcttcctcttaatgttgagattcactcaggctcaactcttggtcctccccttttctctgtccttcccctgctgatctcactctgtctcatggccacaaaacccatcgactagccaatggctgatacctccaaccaggacctttcccctgaagtacaggctcttacatccaaatgctcacttgaccacttaatgtgggtgtctaagaaatgcctcaaacttcctgtttcccaaatggaacctctgaagtttccaccaacctgttccacccacagctgtccagtctcagctgatggcgatgctatcttccagttggagtcaaccttgacttttctcttcctcacatcccacatgcaatctgccaggaagtcctgtttgcttgactttcaaaatacattctcacagtctgatttctcaccacctcctctgctgccccctgctttgagccccatcatttcttacctaaaggactgcagtagttacctaactggtttgcctgatctcctccttgccccactatggtacgtttttcactgagctgccagaatgattttgttaaaatataagggaaataataatggtggtagcctcaacatcctccagtgacctccatttttattgagagtaaatgtcaaaatccttgcaatggcttataaggcctcctgtcatctggtctttgttacctctgacttcacttcctatcactctcacctcacttacttcctctccctccctcaggcttccttctggtcctcccacagccccagcatgatcaacctcaaagcctttacataagacattccctctgcctagaatattcttcctccttcaaagctgttctcttttcagtgaggtctattgatattgagttaccatacttgacatgatatctggtctccacatctctactttgcatggcataactcaatttccataatcttctaatatatgtaatttactccagttcttattaatgcttgctcctcctgccacacacagacaaattttaagcaggaatggtttcaaatccaactctgttactagaacagacttgacataggttaggcacccaataaatatttcttgaataaatagcagtgacaggatctcaaatcttaacttttagatggtgccgataccctggggataatataatcaaactaaccgtctctgcgcagcctggataaaaccatgcaaaacgaaaggtatcagcttgttttcaaacatcacaaaaccattctgaagaagcaaaccaggttggatgagtccaatgactgatatgtgttcctatgacttctcctacacctgcttcctggcgtgcccatcctgggacactggcgagtctgctcactgacactggcacgggcctgtctgtacagtcacagacggattttgctccctccgaccttcctggactcctgaacccgatcaagatgcatctgcctcagctcccaccatcatggcaccgtgtctcgtcactgctgagtaacgacttcacaacgagaagtagcactctttcagagtggtggccctgcagccagcctgccagggtgtgtattctgtttctgccttttgccagctgcatgaccctgggggagcaacttacttctgtgcctcagtttccttagccataaaataaggacagtagtaatacctactccatgagattgtggcaattattaataaacataaacaagctgcaacagtgcctgcatagagtaaggccttaatatttgttagctcctattaatgttattattattattatcatctgatttcataggtgctttcagaagatattaccttaattagaagaaattgctctactgaacgaattttgcacatcttgattggctgatggagaagatattttagtagaggtatgataataccagcttgtcctttaatcatttctgtttaaggctcgtctgctttatgagtgggtggggggatcttggtgtcaattagttatcttttggagattttctgtacagtttaaaagtatatctcctcgaggatatgttttggatgatctttattaacacagatacaaaaaggagtattatacaaattatttacttaggcaccactgttttcaatattaacactagcgctgttgctgctactattatatcttttattaacagctgtcattgagtgcttgctctagcctagtctatggtaattccctagtcttaccataacctataaattaagggttaattagtattctcatttctttgttcggactcacagaaaagtttagatgaatgtctcatcacatagtaaatgatgcctggattaaaatctacagcttatccttaaagtttgtgcttttagcactacattgttctatggagaagtcaaaaagagaagcacatttctcctgttaacagactaatacatgtaaacagaaggatgctatgagagaattctacacacatggaaagttttacttcctgaaagtctggataataaaagttggctaatacactttctgaaatgataaattaagttttagtgaaaatgaatattgagttgcaaagaaatagacattgcttaaaattaagataactattccctgccaaagcaaattataattgacaattatctgaagaggttttacacatgtaaataaagtaaatctaagtgcaaaaagatctaatatgaaaaatatttctttgaaacctaaacatgctttaagtcctgaagtagtctgcaatgtcttaaatgataactgacccctcaatgatttcccataaacatctagaagaaaaaaaaaaatttagaacatgatttctggatgaaagatctgtatatgcatatttacatttaaaaatacctagacatttgctgatgaatttagtagggttttaaattggaaaatggtttctttctcctttcccttcctgcttggaaactaagaaagcattaggtcatataagaagcccaaaccaaaggagttagggtctctacgatacgcatgtattaatacgaagagactgagaagcttaaggtaccactctgcagtctgaggactgagaggccgctgcaactgcagatttttgtctctcttgctgaagaggtatctttgcagtctctggagaaagctcaggtagctgtttgtggctttcaagatcctgtcctgaaaggggagctatctgaatggaaagagatgctgtgtgtgtctcaggcactggattaggggtcagtgagcggggccttttgagaaatgacggtacttcgacagatttggagaactgtggagtactaatggggctgctacttcctagatcctggttatgggttagtttcaaggtagaaatcctccgagtttgagaatcttgcctgtagtcctcttgtagaactggggtgttgatgttagcgaatggtgcaggatccgtgctggaagctgctggtagtggattagtgattttttgtgtatatgacatggttgtgttagattcttcagaatatacaattgtctgtctcgaatcttcattggaatacatagttccctgaagaggttttttgttagcaaagtactctgtactggagggaatttgtgtgttagttactaactggtctaaaatgacaccctttgtgtgactggttatcaaagagctatgaaagctctcttttctttctggtggagggggtgcctggattgacaatgggatccagagaaagaaataaagttgaaagaaaaacagagaaagtccaagttagtcatgaaagaaaccagtgtcaaccttgcctttacagaagtaaagcaatgccacaccttctgattatgctatccattttgttagctagattgagtgatcattttcattccatttagaatgcacttatgtttattatcaatgtttgcccttggggaaaaaagtgttgccagagaatacattataacatttgctccatctacattcagggaaattatgttaaaagtgaacatatgttctcttggcatattttattagactttgacatatatatatatagtttatttaatagcattgttttataacaattttcatgcttgtggcacaattttactaatatctccaacacagagcccttttagttaatataatagttgcatactcatagttattgaatacataatgtattgctgacctcatcagtttaaatccaaagcatcagctgtcagcttttaaagaattagaatatatcctagagattatgttaaaaaccgacatactttgataagcttaatcagaaacaaaaccaaaccaaacccttgtttgttaaaatttgttctccatgttgtaaatacaaacctggcaagcaaactaaatacaaaagcaaaaacatattaaaaataaaacgtattgaaatacgcacattaggaaagaggctgtaagcagtggtctaataatcatgccttaaaataatgcagtagccaagagtgtgcagggttacctgagttggtgatcttttatcttgtaggtttggtcgaacgcttctaaaaccttttgctgcaagagaggaatatgtagcatctccgttcagtgtctcctgattgccatcattgtaagatctccaagctttcattaagggaaaacaattggatacaaaaatatctacgttcacttaaacattttttataaaatttatttttatttccaaaatcatttttatttccaaaattgtagtgttcttactagaggtttaatttaatatgcataacagtacatgaaatttaaatttaacatgaagtcagcgatgtggctatgaatatgttttctaaaagtcacaaataatataataattattcagaatattttttctgtacctgagtctggtgactgagaatcacgccctgaaagaaaaaaaaatgttgaaattaagactaaggtgaaataaatgaacaacccagtaaaaataacatggcaaagaactatatgcattgtttttgcaaacattatttcagttttaaaatctgggtatgtcaaacatgccaaagggaggcttgtacatttatttttacttcaattagaatgtcattcattaaatatctataatatataaatatctatatagtaaacactcatttttcccctcaataatgttgcaacatgcaattttaatcttattatggcaaagatgaatatatgaatttctaaatatcaaattaaaggatcaaaagagatctggtttataaacagcactaactcaaactgccagatccttagcttccaatgccctgctgttgataagcatatttaactcctgtgttacagaactgtattctgtagttcgcatttttttttaccttaagaaactgtagacctgtctaccatatcatgtgacattttcaaattattctcgagactgagtttttttcctattgcaatataaaagtcattttatactcaaatatgaaaaaactgttacaacatgttccactgtctttcagctagtaagctgtggaaaataaatttcaggactaataaattgcttttggtaaggcagttggcaagttatcagtgatatatttgttatcaattttattgaagttatatattccaaaatcttctatatgcacatttgaggtaatcagtttgcacgtttaactcatgtgtattttaagtcatcagcttgtgttgcctggtttattaaagcacatggtcaactttacttagattcattaagctttaactttggaggtgatcctaggggttggatcattagcccaacctgctgtccagtcctggattccttctacgtgttccccaggaccattattagattcccatttcaattcataaaacaggaattttacatgctggaaaagtctttgtttttcttttagtgcttcagcacagttattttcaagtttaaacacatgaacttagaatgataaaaatgggctgagaaatgcgagcatctgatttttagataaaatatttgatatgggttctttccaaatcaaaggaaggaacacaaatgtgagtcagcacagagtacattagaatgattccagctcaggtgagctagagaagactaatgaattcccattctttatgatcattgataacttggtatggattttatctccaatgaatttaaaattggagtaataaaatgggtaccatagagaaaaattactttgaagaattatgcatgaaatgtttattggaccctacttctagaatttgtacaattttttgatttttattttattttttaaagatggggtcttgctattttgtccaggctgtccttgaaatagtgggctcaagagatcctacagcctcagtctgttggttagctgggactacaggtatgtgccactgggcctggcccttcttctaggatttgatggaagcagaaatgattgaaattcttaatcagctatatgatgaagataaagaaaaatacagtttgacaaaaaatacagagcaatcatcagaatgctgctttagggcactcaggagagagatttaataaccatgaggctgccatccactgtggacaatgaacaaattttgggatttgggaaaggacaacgaaaagcaaattttggaatttgggaaaaagcaataaaatagcccaatgctactttatgaaaagagaagcagcattaataacaatgattatattctgatttttttcttgaggatagggagtttcttttatgcttggtttggtaaaactgagataaaaaagaaggctgtgtgttagcgctggggacgaggtaatgggacccagaggcttggaggtgcaagggtgcaggtgcggtgagaaagaagaaggtgtactgggcgggtctgaaggacactagaaataaactccctctaaatgatagtctgtagggggcaggctctgtttcttcacgctggtcaccgtgttgaagatgaggagccccaggagacggtaagtgtgagaatcagaggacagtcactccaggctcaactgtgggtttcttcctgggacactgggcccagggatttccaaatgaatctgtccctgtgccactggaaacattagacagtaagaggggtgggctgttctgaagggtcttgcatcgcacagtggacacgagtgtgcagaattaagagaaaggagaaaatggccattgagtcgaacttcaggatgaaccagtattttaataaagcttatgttgatgattaaagtctgccttgaagtggctggtctctcaaggagactaaagtacattcatttctctttctttaaaataaatccaattacagatacttggaacacccagtcctgatttgctcttttattatagtcttctatgtggacactttttagcatagccctgcttttattttatccctgcaggaaagactaggagagggaggacacctgttctttggagcaggtaatagaaagtatcatggatccacatcaagtaaagagaatataggttagaaaaaaaaaaaaaagtcgcccaggtaaatggcttggcagatgtgtggggaaaatggatttccccagatctgcagcattattggtgcacattcacttgtgaaaaaaacacaaagctaggactaggggccagagtccttaatttctagtgttctttagtagacagtcactgcttcactgaaaatccacgaatgactaaatggtgtaagttttcccctttcctggctgttttgcatgtgaatattttaacaaatagggtcttgaagaatgaagagctccacgtgctcttaccagcccttttccttgtgtcgaggcacaaactggtgagtctctgtctgagattttgtgcaagacattcccggttccatgtcaggggtggaactggatgccctccatggccctttccactgttatcattctaacatgacagctttcgtgtagctgtgtttgtgatacgtgtcacatcgtaatctctactctcaggttttatttaaatcccttttaactgatatgctctattgacactatcactatatttttcttgaaaattattattttgatgcctataactcatttctttagaagactcaagtgctttttaagaattattttaaaatgttgattaaattcaggtcaactaattgagtgcctactgtgtttctatgtacaattataacccttttcatttattttcttcatttattctcatttattctgacaaatccttgtgagtctgggaaacgattaagctttcagagaggtaagaaatgacaaacaatttttcattggaaagaaaggaaatgagatctagacagactaattttcttaagggcatgaaacatgcaggtggtatcgacaagaccctgtctcttggcggagtggtccccatactgcggcattcctttaggctgacaaggggttttggtgaaataaaatgttttcaattgtttctcaatagtcattgtcttggttttggcataggtttaaaatatccgtgtgtgctctgatggattgtccagtgggaatttacttcttataaaaggaaaagagaaagacagactgactcaggggacaaataggtggtgactcagattgactgtctgatcagagaagggagtgaaaatggcttgggaccttttctggaggttttacataaaggctgttgtattttaacaatatcgaaggcaataaatatttatcaattcccttttgattcacatatagacactgtatcatataagttcttatgaaagctacatagaatgcagttgtgcatattaatgctaacttctttattcaaaaatataatggaagcttctttgaaaaagggggccaggtgtagtggctcaggcctgtaatcccagcactttcggaggctgaggcgggcggatcacttgaggtcaggagtttgagaccagcctggccaacatggtgaaaccaggtctctactaaaaaaaatacaaaaattagccaggcatggtggcaggcacctgtaatcgcagctactcaggagcctaaggcaggagaatgcttgaacctgggaggcagaggttgcagtgagccaagatcgtgccacagcactgcagcctgggcacagagcaagacccacccgtctcaaaaaaaaaaaaaaagaaaagaaaagaaaaagaaaaagggatcttactttacgtctaattgacacaaaagagggctgtttttaaacaattatgtccaaaattcagtggacttcattctctagaaatcatatgcctagtgatagaaaacttaaaatagcccaaagctacattgttattactgaagattatttcatattcctaaagtgtgaaatgttttttttttcttttttgctgttgtaattccgaagcattaaatcttttctatgaagtcgagttatatgaaattgcatgtagttcagtttcgactctccacatgggcactgtggaagcagtgtggcgttccctggtacgtgcgtcaaggttcacgtctgagtaggttggactgagatcctatttggttgaaatgtcaatgacattcagggtattggcattccaattacacgatggccctgaactcttacggttattgtcttacttgccttcattcctgtttctcatggtatccaaggtaaatacatctgtagtttttctaacacctttttatgttcatacgtgcatgagccactacatacaaatagagatttgtatagagatttttttttaaccaaaatgaggtcatactataaaccttgcaatgcatcttgcattttcttttaacttaatatataactgaactcactagcctggcatttaaacttggacgttgaaatccatttgtggattagaggtggtgaacggaagtgggattctgcatatggaagttcatttttttttctcaagaaaaactcagtagtttagaattaagtggctgtaaagcgaagaacaccctgagtatttaatcaacttctagatgtatgtgtgtagaagactgtgatatgcataatgagaattaaaattatttaaagatgccccatccctttctcacttctgctgtaagacccattaatcttataaataaaaaacaagcagtccccaaactgcagctaaccaaccagccaaccaaccaaccaacccaccaaccaacccatcaccaacaggtgtgggtctatttcagggtctggaggcactgggcttgctggcctccctttgaccttctaacagctgcaccccctcccagtgcagactgtgccttaggtactgtgcctaacttcggtactgtggcttaggtagtcacaacagagatttattaaaaagagaccacctgagtggatgctgaaatctcgcacccccagtgacttcctatctgtgggtacatgtgaatcttaattggtcaagattttggtatgtttaaatatatatagtagaagggtatttgctgattggattaaaggaaagcaaaggtctctttcaaaactaatgttctatcattctgttcacaacctttgacaaagaatccagttaatgaagattcagtttcctacaaatcccttttttcatcctgtacccctgtacccctaccccaaaagtttttaggttaaaaaaaaaaaccccaaaacctctgagttatcttaatgaaatattatgctacttaagttcatgagataacaaaaacgtgaatagttattaacactcgcagttactcaacctatttttggcaagtgactgctgtttttaattacacatttaaaatgtttcctacaagatctcattttcctttgctttttacgtttagaacaaaaacagtcagaagagctagaagccattcaagtgcgacattgtgtgagttagtgatattatacctgcagccaataggtttggagaactttgcactctcttcacagatgttagcgtaacagacatggcggcacgtttgcgagcacacccaccgctatctggaagcaaaaaaatgatatagcagaggccaaggcaacgggaaaagcacgtgcaatatcatgcgttttaagagaaatgtgccagacatccatgagaaagatgaacagttagaattagtaatcatggaatgcacctgccaatttcacaccaccctcaaactaaaacaaacaaaacgaaacaaaacaaaagaagaccagggatctgtcttagaaataggtatcactgttttagtgaaagcatggaagacttaatacttaacattttatggttttctttgtgaaaactcaggcacagaactcaactttgtttataccatttaaattcaatttatactaaatctataagcactggatctggcttttagagtcaaggattagctccatgtcaggattaaaggctatggtacaacatacttttaagttaatatcatttaagttttaccatcttctagctgttataattcccaaagagagcttgaataattcttgcagtaaaaattattagtgacacaggtatgatacatttttttaggattcatagaggaacacatggcatcatggaaagtccactcttcctgtagttagtgttagttatgcaaataactagccttattaaaataaaagtattgatatatatggtatcgaaatgaccatgtttaaagaaaggagtatattgcttttactttttaaatttttatttttagggccggagtcttgctccatcacccaggctggagtgcagtggtaccatcacagctcattgccatctcaacctcctgcgctcaagcaatcctcctgcctcagtctcctgagtagctaggaccacaggcacacaccggctaacgttttaactttttgtagagatgtggtcttgctgtgttccccaggctggtctcaaactccctggctcaagggctctttccgcctcggcctcccattacaagcatgagccaccgcacctggcctcatttattgcttttatacttttaacaatatgtgtactatgattcatatctttaaacttatgcaagtcataatgtgaaataaaatcagtgtaagttcatcagccattttaatgtgctatgagaagtttagacttctaaatttggaagagaagtcttttaaaattggaaggccaatgttctatttatgaccagattcaaattccattcttacattcctctgtaatatggcatggcaataaatagttttgctcattctcctcattctgcttattgagtaaaaccaaattaaattaaatctttttgaaagttataaaaaaagacaatataaccaccgatataataatataatcattatatattgtcacatttccatttttcctttttctttattttcataaggaaagtatcaagtttgtttattggacatgacagaatttagattggtaaagatgctcggaagtataatttgaaggaatttttcataaaatttataaatagtaagattaatagaacttaaaagcagtggagtgattcttacttcacttttttaaagtatatgtttaaagtaacaatttcttaatgtagaaaatcattaaaccagaaaaccaacttgaaagaatattaaaagaaaatgaaccaaataaatcaaaggttataattaagaacccaaagaaagtgacacaaatgggagaaacaactgaagattccttcaggaaaggctccaaaaggattttagcgaactcagcaaactgaaagtgcttagagacaagtgcgtctgataagatggaggtgatgttattgcttccaggagctggaaactggttgaaatggttgtgtagtcaaaggtgttgaaagtaaaaactgacatcactctaagagtgattttatttcctagttctgttaattctgaacatctcacaagcacataggtgaaaagagaaaattccagaatgagaagatccagggtcacaggttaaatctctggtgttcaaactgtgggctgcgatgccctgggctgcactggtgcattcatgagggtgttggggggtagttcctgtttttaaggaaaacacagtgctaactgttggacactcaatgaactacttgcttggggcagtgcctggtttcaacataatagacgcgctatattccttttgatgacatcatattttggaaaaactgggattttgatacttgctatgataaaaagcaagtaccatctgaagaacattttatttatttatgtttagagacagggtcttgctctgttgcccaggctggagtgtagtgatgcatttggaccttactgggctcaaactgatcctcctacctcagcttccctcatagctgggattacaggcacatgccaccacgcccagctaatttttaaaatttttacagggatagggtctcactatgttgcccaggcttgtctccaacacctggggtcaagcgatcctcctggctcagcctcccaaaatgctggaattacaggcgtgagccaccgtgactgtctggcctgtaaatcattttagatcagtaaatgagagtggtcatgtacaatcgaattctaaggtctgagaaatttttcagtgtgcaacaggcacacacataatattagtaagtaattcttgttataaagaaagaaataaaactattttctttcaatttatgtgtactgttctgtcaaatggcttctaagttgttagaacaaagtatttataaagtaattattaagttattaagttgttagcacctaactacttaataaatagaagtgttacatatttttgacctaggagcacagtgaagaaattactgagacattaaaggtcactgtaaaacaagaaagtttgggaatccttgggttagacaatttatgtattttaggaagctctaagtcttagatgaaataaatggaggctctgtctttaataaagtttaataaagggctgaattctaaaacttgaggcatttgtaaaattgctggaacagaatgatctattatattgtgtttctacttccttttgtattgatactttctgatactccttgaagatatttttaagatcttaaaacaaggatgctacctttcatgtgtcagtttatcctaaagaatcctaacgctggtcttgccttttgtcctcattaatgacctgcagccttgctaggctactcttcccctgagctgcaagattcctggaagctgttcctactgctggaaacccctcatatgggtaaattatagatggataattatttgatgtctttccttctctcctttcttcaatagctaagatatgcctaagaaagtaatgtgttaaacattctaaaagtggacatataacatgttttgtatatattttctacattgtttagacactttagtatgaaaaattaaccacattccccatggctagtttattatgcactgattaaaagcaaatacttaacttaaaagaatgctttttagccgtggtgaccaacacatgaagatttaaataggaatatatatttttaatgattgatatattggatagatatatctatcaataaagagatatattcctgtttaaatgaatattgatatatatatcaataaaactggcctgtattatttatctatatagattatctgcattgtctatccatatattatctgcattatctatctgtctattgatagatagataaatagatagatagatagatagatagatagacaaaaaagtcagaagagctagaagctattttggggatgagaaaaataacttgtggggccactttattcatctatctatctatctatcatcatctgtctatctgtagatagataatgcaggccagttttattgactagctctttaggaacaaattcctacttcattttgtaaacacagtaacaatgctttcaaattcctaaggcaatatatgtgtgtatatatatacatatatatttaaaagtggtatgtttttataaaaacattataattattattttggaattttgagcaaaagttttcagtcacttttgatcaattttatgcatatgtttgaataccatattttccaatcattatacattaagtggaagttcatccaaataagcaaaataatcctatacaaattgcatcccatccagagtcaagcttactccttagaaatgagaagatgctttagaaggttacatttatgctgctaagcagtaacttgggtcaagtaccttagtgacttaaacaaatttacaaatttgtatgtgcttattttgctatgagggattgaattatatgaataggaaggttaattattgagtgtactgcccatcaacacagcatattcagtatatcatgtatgcatatccctgtcataatagtgttataataaataggaaaatcagcactcagtaaaatgaggaatactgggagttatgatccacttaagtctacagggaaatgtcttggaaggatcaggaaatatcacttcctcatgtggaacttctgctggagtgactttgtagctccaaaacatggctgatgctagtccagctgtgggctctacattctatttgctttcttctgtctcctttacctgctaatattttctacttcattccccatgtctacttctgacatctccaatcatcaagttgcctttgtgtggtgcatatgcagggttataacttctcttgattgctgagccttccttgtgtgttttgactgtctccagtatcctcatcttgcctgttgtccacatgtctgcaaggtgactgcatccccaggagcccgcccgcacagccttctctgaggccactacggcacatggcacatgacgcaaggctctgcactcgacctggggattaggtattggtcctcgccagtggctgggtaatcctccttgtagcacttgatgcaacaagagacctcaaaaaggcaaccagctggacatgagagaatatcttgggccatcctttctactctgccatggcgcgacggctcaaacaactttccagtgatcacttgtggataggaaatggtatcgtttaaacacaagttacaaaatttcaacgagaaagttgtttcttgaattactttgtattgtatatttcaaggtggggggaaggcaaaattataagccaaattatttctactgtggaaaaaagttcatatgtacaaagcatgtatcatgaacacttttacagttaaaatgtagacaatacagtttagagacacagttgttaagttatttggagatactactctcacatctacacatataatgcttataacactatgggaattgtgactataggttaattaagctgattttgtataaaactttggcactctatctgctgacttcttcaacataaagagtttatagaacaggtaagtttgaatattttcttctagagcaacttgcctttgaatttagcctatttttaagtgagagatttcaaaagtacacaaacaaacgacatactacctcttcctattgtttataggagttagttttaacatgtgattagagaaaaagggagtaggagcaagtaatagaagagaaaattctatgtttggtggctataagagtggggcacaaatacaaagaaagaaagtaatgaatctatgctatgtatctaatcagaaactcagaatcacatttaggatcagaagagtgctaaactaatgatttagggccaacatgatttttagagagcaaggctaaaagagtttaaaactaacagacagcatacctgtgttcattttcaccttggagagtttgttattaaagtcttcagttttcctgtaggaaaaaaatggtgcataattgttcactagcatgtggaagaaaatatcatgaaagtgtgtcgcatttttgtttttgatgtacctgtaagttaatatcacattatcattagtcttatttaaatcagtgtttaataaggtaggaagaatttataattctgttcatgttaaactttaattattggtcccatgctcataaaacagacatattctgtttttatgcttttgtttaatggtgagcattaatggatgaaaatggagacgttttgtgcttgtttttctttttttctttctttttttttttgagacagagtccgccactgtcgcccaggccacagtgtagtggtgcgatcttggctcactgcaatctctgcctcctgggttcaagcgattcccctgcctcagcctcccaagtagctgggattacaggcacatgccaccacacccagctaatttttttctatttttaatagagacggggtttcactatgttggtcaggctactcttgaactcctgacgtcgtgatccacctgattcggcctcccagagtgctgggattacaggcgtgagccaccgtgcccggcctgtttgtttcttttttagagagagggttgtgctctgttacccaggctggagtgcagttggtgtgattgtagttcactgtggccttaatttcccgggctcaagccatcctcccacctcagcctctcaaggtgctgggattacaggtgtgaactaccgtgcctggttgagttttccttttaaaaaattaaatttcttttacaaatatttatacaaatggtttttgttctctaagcctgaaatgattgcctgttaagtgtcctcttccagagttttaaaagtgaccctggcactttaaaatcattgccttacatgtgcaggtcagttgactaccggggaatatgtaatgaatgtaacgcatattttcaggacactgtcaagaaagatgagattcatctttctcttttttaaagacacaggaaatagatggtcactacaaaatccatctctgcattagtattgaatgctgatttttcccagtgaaatgttggatgcaaagcaattgagattaattcgctagaaacggttggcagaaaggggttgtctcagaaaaaagtttttttttttgagatgagtctcgctctgtcgcccaggctggagtgcagtggtgcgatctcggctcactgcaagctctgcctcccgggctcacgccattcttctgcctcagcctcccaagtagctgggactacaggcacccgccaccacgctcggataatttctttttgcatttttagtagagacagggtttcaccatgttagccaggatggctacgatctcctgaccttgtgatccgcccgcctcggcctcccaaagaaaaaggttttaaatattgtgtatcgttttatgacatgtgagatgacttagttctttctctggcatattctcttagcccatttatggagtttcttatttacccataccctgaaaccaaagaggaaagacacgctgataaggtagcaaatctcctaagtccaagagctccctgcaagagctgtctgaccccggccacttggcctttgctcctgagtgggcctgttgttgagtatccacaagaacccccccgcacagcacaacacactcacagcttccaggcgcatcagtactgcaacatccgaacattttcaagaattttatttattccttttggatgaatgaggataaatttgaaatgaaatcattggcatgatcacctgtcaagaaagacttttgataaataaagattttttagtctctaaaaagagcagcaaatgagcttcctggctttcttgcctttgtctgccaaggttctcaccctcttctcccttctgaccatttcctctgctcaactcacaactattattttctttcaatgtggctattggagttcacctcttttggaaagcctggctttgttcattactgatgaaaaattataataataaaatcaaaatgtgaatattagctaaatataatggtacttctctcccagtggggggaaaatgatgaaagaaaataacattaaaaatacacttaagtcctatgaaatataattataaagcaagattttatatatagatatatatgtatagtgtaatcctcgttttgctatatacacatgtatatgtgcacacatacacacacacacgtatatttgcctagattgaattactaataccttaggactcaataaatgctaaattaatgaacatttaaaataggtaaaatcacagtactgataatcacctcagtatatgtttttagagctctacgctgaaaacaatatagacgatatccttactatatggtgtttaatttttgtgtggtctgtgttcagtgtcatatcgttgtccgtctgccctgggcatcattgcagtgtagggagcagggcaggagccatgcttagcgtggccaggctagaactgagtttccacagggttatggggaacttcactggggcatttcataggccaacagactctgaaaaatgattgagggaaattttatgatggtgaattttatctcctatttttcagtgtatgcaactaaacaggcacatttctgttttacttttttgttttgttcttctccagaattacacagaaaaaatgtggcgtatttctaaaaactcagcttggtagccttaagaccgcctgtattgagggataccgatgaagtcagggaagagggcagcggccagcacaggagctttgggaaagctccttcaaacgtatttagtttaatctctcggtagctcttggtagcaaaactcctaatatgttaaccttaaatggacaaaataaatggaaaagaaaagcctcaggggatgtctgtgactgagactgaggcaacttctaaaacaagaagggataaacaacctccagaaaatgaggattatgaggacctttcccaaattcgacttcttcattccttttgaaaccaggcaacgctgtgcttacaactgcttaaggttttaaaacggaatgaggaagacagtattcgggctagaataatagtgattgacaaagaaaacatcaaatacagaaggttaactctcagaatacaaaatctgctgacagacaataataatgtttttgtaccaagttagagaactagttatcaacacctattgtttgaattcaaatgccgatatttacagaatatctaacactcaaaaagtaaaataggattaacgagaacaaagaaaggcgccacaaatccttgaggttttcatctttaaagtgatgtatcctgttacttataaatgtaatttgtgaggctttttaacttcccattgttttagatgtcaaaatgtgaaatgactaacttcctaatcaagcaagacattttccaagtcgttaaaagaagaatcccagtgattgagctctcaagaagaacctgaaaccgaaaggcttcttgggtgactaataaaaatgcacgattctatttcccttatttgtgctaagtccattaacaaatccacgactgagaactctctttagacagttcaaactaaagcgaatctaatctcttttgttctgctctgaaaaagtgtccttgattgtacttacataacaagcacagattattctggaaagcatcaaattcctagagtctttgcatgctgctagacaacagcatctcaagtattctcttaacttggaattgaaccagggacgagactatgagaactgaccataacatggagactaccttgagccttagcagacaatccacggagcaaagaagtctccgaacatgaaggtgtcagcatgattttcaataggtgctaggggattgtgtttacttttgtcaaagtttcatataaaaagcaacttcatatgtgtcctaatttgtgacaacaatggattggttttacttatggattagagtagcctccactgtcaaaatacatatggcaatagattgtgttgattgttcatggaagggctgtaaacagcatgacttcgggtctatagtcttttaattttgcttgaatttcttttttttctttttctttttccttttctttcttttcttttcttttttttgagacggagtctcactctgccgcccaggctagagggcagtggcatgatctcggctcactacaacctccacctcctgggttcaaaggattctcctgcctcagccttctgagtagctggaattacaggcgtgcaccatcacgcctggctaatttttgtatttttagtagagacggggttttaccatgttggtcaggctggtctcaaactcctgaccttgtgatcctcccgcctcagcctcccaaagtgctgggattacagatgtgagccaccacgcctggccaattctgcttgaatttctttggattatcagacatctcatttttctcggaatcagagcaggctgtgttctcaatacgtataagagaatagaatgggtaatttaacttttgaaagaggatcctaaggagtttgatcctgcatgggcatgaacatgcctttgtgcctgttgtctcataattctgcttgaattgttttgattatcaggcatcccattctgaagagcagcagagacaaaatcctttccccagttttggctaagaattctatgtaggtcattttatttttgtagacctgaatttaagcaccaagaccatgtatgaaactacaggactgaattttagctcagttaatgggaggagttgcccaaaagattttccacagacgaaccttaagccaatacattgctactgttattttgaaattaacatattcacagttcatatattattcaaaaaaggacatattgatgtttaagtagtaggaaaacattgcaggatgttagtttttttttttaaagagatgtattttaaacatgaacataaaaatacaatcatattaaggttatgcaccagattttaacttgaatttacttatttattttgaaatgggatcatttgtagcactctctttggataaactgccctaagtgatcaatgtattaatgcatctctctctatctctgactgtggtaaaataagaagtattcataaatgccaagtgatttcacttttctattatagtcaaatgacttaattcaggttgacatttatcttcacctatctttcctatatgtcaacatgctgctttgaaatagtcacatgaaaactccaagtagtttgttttgtgagtttagaaactctcttctgactagtttctctaaattggctcagagactcctctgcctgagtgggtggcacacaagtcaacagtagcggcatgactgtccatgctcataagaacaccaagtacctcccagaactcctgtgctaacagtgcctgaaaatgttccttattattcaggagccgaattacccgcggcatctatttatctatgctgaggccagaacacattcaacatcatttctaggaataaggagacattattaccacaaataataaagaaataaatgaacatgaggccgttgataattttttatgagaatacgcggagtgttagttttaattagaccaaatgtcctgatatttggaaaaatttcctgaaaaaagagcactatatgtcttccaaggaaactagcaattttccttttgagactttacaatgtaagctgttcaaaatacttatcaattttccctaaagactttactgattagaagttgatcacctggtaaatgattccttctgatgttattccaaggtctcaaagttggtgaatcactcatttcactatttgctttaaatggtcatgtgacttaacattggtccagcaccttactttcttttttttctttaggtggaatctcactctgttgcccaggctggagtgcaatgatgcgatcttgcccactgcaacctctgcctcccggggtcaagtgattctcctgcctcagcctcccgagtagctgggattacaggcatgcaccaccatgccgtatttttagtagagacagggtttcaccatgttggccaggctggtctcgaactcctgacctcaagtgatccacccgcctcggcctcccaaagtgctaggattacaggtgtgagtcactgtgcctagccaccctactttcatggagttccttagttttatattgtaatcttagggatcattacggaacaacatctaagtattttcaagtgcatcttttttctaagactaagtcatttgttcaacttgatagtacagtattaggagaattccattggcttataatgtgcaaatcaaaagccaaaaaaatttctaatgaaaataattcagattctgactgaggatctcataagtcaggcaccttatcaaagagacatgtgaggaattaattagaatatccctataacacatgtataggcaaactgaatagcgttggaagaatgggtcaagaaataggcaaagcttgactcaaatcccagttctgcccatttctatgcatccgaacaatttataccaatgtcattatcatcgactcccccgctagacagcaaagcatccccaatctggcaaactggcattattcccattcactaatatttcaaatattttgaagcagatctttacctttgattgagtcttaagaagataatctagactttcctgaaaatacatggggcattattgtattgctttagattgaagcaagccatatggtttattagactgatttctatggattttcccgtctcccaattgtcccacacccagcttagcaacatgttggaattgaaaaggaattctactttccaggcagctttctttcttccttaaaaagatcctttatttagctaagattttcccccccacacattgccatgaacaagagaaaacctaagaaaatagttgaatcaaacccttgccttctagcccagctatagacaatgctactggatctaagggaaagtgacactataaaggttttgacgattagcttttttaaaaaaatcattctctttccctttgacagctgatagccgaaagcgatggctgaatggaaagagatgtctataaaatgtcacataacaaattgtgtgacaaattgcagagtgataacatcctgatggcagcctactcctgcttaattcaataagggaaagtgcctctgatttcccaccttgtactgagaagcacacatttctattttgaggagaaaagccttgatctttttaaagaaccattttttaaaattttatgctttgctaagtttctcactgcttttaattttaaaatcttccgttttaatttttatatattgaaatataaaaatcatctgatatcaaaagaattatgtaatctagtctagttttgcatgtctcatacttagactttaagtagaagcaagcatcaaaggctctggtagggattgagatcaaccaactcatttttagggttagacatttgaggataagataaatggatgccccaagcagatactcaaaagtagttcatctctcctgactcctagcaaataataggcatcctcctttaaggaatcttaaaacgtcatttgaaatcaagatcttggccaggcgcagtggctcacgcctgtaatcccagcactttgggaggccgaggcaggagggtcacttgaggtcaggagttcgagaccagcctggccaacatgacgaaacccctgcctctactaaaattcaaaaattagccgggcatggtggcacatgcctgtagtcccagctacgtgggaggctgaggcaggagaatggcttgaagctgggaggtggaggttgcagtgagtcgaaggttgcagtgagccgagatcgcaccattgcactccagcctgggtgacagagcaagactccatctcaaaaaaatgaaacaaaacaaaacaaaacacaaaacagaaaaacaacataggaaatcaagctctttccctttaaaatattacagtaccctgcttaattaagtactgaatcatatgaggcaggggttagggaaaagaacaaaatatgagaagacggtgtggtagaaggcaaaactgtttgataaataaaataagaactgttaacatagaaccatatgtttcttcctctaagactaataggaaaacagtggttgattatgacaaggattccttttgcccaatcacagcacaagtccaaatggaaagtgttaatcaggtctactaaacccaaagcatattagacctccttggtctaagcctagaccaatagccattgattttttttttctgaaatccttagaattttcagttagtaagtatatctattttaaattattttcatggtaatgttacgtggtgaaagtattacagtgaaataagcctgcttattgttaattcactgttcttaaaaagccacacttttcttctgattgaatacacctgtttcctgagcacctgaaataacatttatatactttagcaatgtcaaggtttgtcagaatttttgacagaatatactgtcagaattattacaaattcatgtttatatgtgtctcagatatgcaatggtgaaatcccacttgctatgtggaatttaaattttggggcaggggaaaatttgctctaatttgatcttatagtcttaaaatttaagtaatacattacttacaaagtttatccagaatgaaatgtaccttttttttttttttttttttgagacagagtctcgctctgttggccagggtggagtgcagtggtgcaatctcggctcaccgcagcctccacctcccaggttcgagcaattctcctgcctcatcctgcagagtagctggggttaccggtgtgtgccatcatgccaggctaattgtagtatttttagtagaaatggggtttcaccatgttggccacactggtctcgaactcttgacctcaggtaatctgcccgccttggtctcccaaagtgctgggattatgggtgtgagcctccatgcctggccagaatgtatcttaaattgtacatcttaaggcagtttgattcattttagaaaatttgaacgagaaaataataagccaatggaggaaaaatatcatctgaagaaattttgaatgcattaaaagttggaaacttttgatatttgtgttgaacagtggatagtttattacattattctttgggatctaataaaagtagacaataaagacagatatcttccattttaatggaaatgtattattcagaaatgtattattaatatttatatactgctgctccattgttattcagacatttgaaaaaattctttacatttctctatgtactaaatgtacaagtgttaagcagaatcataggtgaataaaaggtactcaatttgaggagtaccctgttccgactgtgtctgcaacatttttattttagggaaaaacaaagtggtgtgtttattgattctgcagaaggcatacacacgagaggggaataggtaataagtagaaagatgatcttgacaggctgaattaaatttggctaaactaaatttcatgattaggttgaagagactggcttttcaaaaatttatatggaataagtctaagggctttaatgcaattgttgaaaaatataattaaatcaatgtctaaatgaacagtggtttcatgaatcaaggaagattgggctccagctgcctcacttttaaagtgtccacatgagtctgtgcgtgagtcaggctggcatgaacttgagtctctaggcaggctttggaggctgtgctgggtggggggagggtcacagaacgatatggtagagacactatggtgagtttccaggtgactaccagcagcaacaggaaaagttactgacatgtacttgaggtttatttttttctttcatctcgtggaactcatcccagtggcccttagggttaatgctcttaaatataccaaatttatgctttaaattgacaagaagatgtataaataacagttgcagctagaagcttcaatattccctcaagatgtacctgaatttaagaaacataatatctaaataagactgtttctcagtgctgggtttttaaccatctggttcacaattgtcatcagaaagaatgaaaacaagtccatcctagaaataaggggtttaagacttcagaactgtacaacaaaatgggatgtggtgtctattgcccttttgttcagcaaaatgccaactcagatgacctcacttctagttcttaccccccacatatgttcccagcattcttcatttttcatacctaatatagtccttcatgctctgccactatttaaagctaaaactttcactcaatccaccaaaaataggcaagaaaaacaacatacaaatacaaatttatattccacagttacacagtggagaacagtgaagcttatttgaacaaagtttttgttgtttcataatactctaacttatttgacgtactggctaaaggtagaaatgatcagaacactttttgagattgttagttggcatattttaacatatgtagtgaaatcctactcagtctgatctttattagccatttctcccccttttatctacagaaataaactctcaacactctttcttttatcttggacttttgccactcttggaaaagcagaaaaatttccttttgacttcccaactacacgaactctttcagggcagcctggttttagctccagggtagtctgccatgatgctcagggccatggatcaccttacagatccaacctgggcctcttgttcgcatcgactctaccctgggactcagcctgttctccttcaggtccacaggtagagaatgtctgtgtggacatcttcatggacagagatacccactgacttctgatctgatacctactgacttcatttccatttcttcttttataatggagcgtaaaagcactttgtcatctgtgctgcagcatttggtaaaggaaatccagaacccacgctgggaccacatgcatttacattgattctagttaattatgtttgagtggagtgatcgcttttctatagtacatagaaaatgttaacatgaactattattattgggatgttggctgtctgccattcctaacacagagcagagggtaagaaaatgtcactcatattgggagagggcaaacaataatggatgggccaaaaagttagcaaatttctttcttttttttttttttagacggagtcttgctctgttgccaggctggagtgcaagtggcgtgatctcagctcactgcaacctctgtctcccaggttcaagtgattcccctgcctcagcctcctgagtagctgggactacaggcacgtgccagcacgcccagctaattttttgtattttagtagagacggggtttcaccatgttggccaggatggtctagatctcctgacctcctgatccacccacctcggcctcccaaagtgctaggattacaggtgtgagccactgtgctgggccgcaaatttcttttttgtgggagaagccactttagaagtatatatctacataccttgtctaagtcaatgtgttgctataaaggaatacctgaggctgggtaatctatacagaaaagagggttatttggctctcggttctgcagcctgcacgggacgcatggcactgacatttgcttgggttttagagaggcctcatgatgcttccactcctggtggaggggagaaggttaaagggagccggcgtgcagagatcccatggcgagagcagaagcaagagagagcaggaaggtgccaggctcttttcaacaatcagctctcaagggagctcccccaggaatgaatagagcaagaactcactcactctccctctgccagggaggacactaatctattcatgaagtatctggtcccaagactcaaacacctcccattaagccccatctccaattggggatcgaatttcaacatgagatttggaggaatcaaatatccagaccatagcacacatcaatagcgaggaagtggcagagtcagagttcaacaacctatgttttaggggacttccaggtatgtgctcttaatgttacatgactttttttttttttattgtactaaagtgggagtcggtgttaagccttgtgtgggaaggtatgcttgggcaaatcacttcacttcgatgagcctgagttttaaagtttataacatgaaagacttgatttaaaatataaaagcacataagggacttttatggtttgaaattttgctaaatctaggaaaggtatattcaaccaacaaacatttgttgacctttaatgtgcaaaccactatgctactgtcatgattgtacatatcaagcagaaactaactggaagccaatatttaatgactcattcacatattaaaattcagaaaaaggagatggttaaagacccgtgcttctgatagcatcatgatgagatggggtacatattaacacatgtccaagccaccatcctgacaaccaagctgtctccctctttgttgtctgctttacttaactccagatataagatctagagaattgtttatatattacatgtctttctatattatctccagtgccctacccttgagcttctcaattttagaatttgatcgttcctaaaatagaatccattttataaatctgcaccagaagaaacagacagaacttcagtccatcaattttcattaatttttaaagcttttttcatgagtagtgtggtaggtacattggaggtaacaagaatcattgattctttttttattctgttagaatttacagtagaggagaacttcaaaacaggtatctcaatcatggaggcagcttggcattccaaatattacgtttttgcatagctcctattttaaagagtaaaagtctattggcttttgaaggaaaaaaaactaaaagatctaagcagactgtactcctagccaatattctcatcacatttttcttactggctgaatcagtcatgccataacttgctaaatgacaatagcatgggaagtacaatgacaatttgagttatttttcatgtggatggttgttgttctgtgctttgattactgttgagaaatgtcggcatcaggctcacaaacaattgccaaggtcctatgacccacaaaaacttcaatcagcctgttcccatgttcagatgttttggaatttggatgtttactttacataaattatgatttaatattatggctatttgtaaggctactatgtgataattgtatcattaacttcaaatgattaagaaaagcaatctgaattagggagaagtgagttataaagtgcttgtgaaaaaaggcaacgtattttccttcaaaaatacagattaactctaggtcaaggcaataacacctaaaataaatcctccagggtcctagtttaatgaatacataagaatgatttgtacttctaacatcaattcatatggaatgaatgcttctaaaaaggtttattttgtgtagtataagtatgctagcactttgcttaagaatctagcttttaatattatcaaaagtaaagacagcctagactctcactgaattacctcaatttctaaattggtatgtctaagttacgattcagacataattcatatttatttcccatttcatgttggagtcaggatattcgcttctccccaaacctcaccccatttttccagtattcctcacctcagagaatgctatcattcattcattattttttacaattttatttatttatttttttgaaacagagtctcactctgtcgcccaggctggagtgcagtggcgtgatctcggctcactgcaacctctgcctcccaggttcaagctcttctcctgcctcagcctcctgagcagctgggatcgcaggcatgcaccatcacacctggctaatttttgcacttttagtagagatggggtttcaccatgttggctaggctagtctcgagttcctgacctcaggtgatccacccccctcggcctcccaaagtgctgggattacaggcgtgagccaccgcacctggcccattcattcattattcaattcattaatcaaaaagtttgagagcccattctactccacaaattaccctggatgttccctctccctcaactctccatgttttgagaaataagacaagaaacattcagctctgggaagggcagcatgcttctatctcagtcccacagttcatttgcccaagagacttgggcatgaaagataagcatttctagtccttttgattttgcacaggtcagatataggttaggcacaggttaacacagagtgggcagatgggagtctctgaccagctcatgcggtgcaggagttatactgttgcttcactttcccataacagcaatggatccgaaatggatgatgatgttccagtgtcacacaggtaggggcagcatggcagataaacgtgagagaaaaagcagtgtgtgcatgcacatgtgcacatacacaaacacatgtgcccatgcacaggcacacgtacacatgctgttgtgttccccacccagttgtctcaaaggccacgagtttgtggattttatcttcctagttcagtacaggactacccagaagttggtcgatattaaagcctcaaaggaatcataatatcacttttgtccagattttattttccaatcctctctttgttttatcaaaaacattttaggagtacattttttcagatggattatgtaaacactggacctgttcgttaaaaaaatttcttagagatcaagaccatcctggccaacatggtgaaaccccgtctctactaaaaatacaaaaattagctgggtgtggtggtgcgcacctgtagtcccagctacttgggaggctgaggcaggagaatcgcttgaaccgagaaagtggaagttgcagtgagccaaggtcgcgccactgtactccagcctggcgacagagcaagactccatctcaaaaaatatatataaaatcaaaaataaaaaaaaattccttaaagtttaatattgatatgttctatatgcaaacatgaatgggggttttccgttttttcactgctatacactcagcctctaacaatatctggtacatattatttacccagtgaatatttatagaaagaagatgtcctcatttacagacatgatggaatgactcccatcgtgaagtggtttgtcagggagagttagacaaaggggcttgaggattcccctcatttgccattacagtccaccccttggctcttctagtctattgagggcctttcttctgagttgctattggacatcttgaatgtaatggtgtccctagacaccagtttacattgtcttccagcatatgtcacttgaggaatctctagatgatttagaggtgtcaggctaacaaatccacactcattcctgaaaatccctggaaaatggcaaagataattgagctgatattttggcaattggcaggatgattttgtttgagtctgaagtgtattttaagaagttatttaggtttcctgaataccaacagtatcatgaaaatattatgcttgccacgttgatttaatcaatcaattctaaatcaccaaattatatcatacattttaaacaaaagcatttttactattgaaccctaaacatgaatgtgacttgtgatttttgtttttccaagagaagactaatacaaatattcattttagaaaaattctcagtacatgggctgtttgtatatatcttaccacttcatatcccaaccaaaatcagatccacaaacagcaagcaaacaaacccttgactcttttctcttttagttagttgtaatataacataagtgatattgattgtagcaatggagaatgattattgttactttgggggttgtgtctcaagtatacacaaatggataaaccacaatccttggtgcatgacaaggtcatgtacatccccctccctcctttccttccttctgtcactaaacatctacacaccaaccatctaaagccaaagatagaccttcgtaaggacctgtgtctatccagatgacttctgctgttataacatccctcagctccatgcatttgagtagccatcattctgaattccatgcttatcattctcttcctttcctgttcatataatttcattgtatttatatgtcttctaaaagcacatttattttagttgttttaatctttataatgatataatgctgcatataattacattgctaagattcatctatattgttggttatccctgtagtgtgttcacttggtctcctatataatatttaattttgtcaaaataccacattttgtacatccacttcctgttcaggggcatttgggttgcttctagatttttgctatattggagagttctgtcataaacacgtatgtacatgtttcttaatgcttttcttgtgaattaactgcttggcagataatttaaatgatatagctcctacttaaaaagtattttctatgtgccaaaaactgatctaagaatatttacagatattacatgtatattaattacatatgtgttacatatatattacatattacacatatattaattgacctgaggcctcacaacaaccaaacaagctaaatactattgttatcttattttactgcaaagaaacgccaaaccacagggaaggtacaaggtcacacagctattaagtagtgagtgaagcttgggaatgcaggcagtttggcttcagagtttttgtactataatgtctttcttggatctaaggacataaaggattgcaacagtttataacacataacttagttattgaccagaatttgagtgtgagtctgtcataatcaggattaatcaggtacagtacaccctgtaatgagcaatattggaaatgctcatgtatactataattactctaagacaaatgtcataaacatctttgttttttttttttatcatgggtacaaggcacataaatttatttcaataggacagctgctgcttttgatgcttgttctcacaattccgtggtggtagttgtatttgtttgttctcatgttcctaataaagacatacccaagactgggtaatttataaaggaaagagatttaattgactcacagttccacatggctggggaggcctcacaatcatggcagaaggcaaagggcatcttacatgacagcaggcaagagagcttgtgcaggggaattcccatttataaaaccatcagatctcatgagacttattcactaccacaagaacagcacgagaaagacgcaccccatgagtcacttacctcccaccggatccctcccatgacacgtgggattatgggagctacaattcaagatgagatttgggtggggacacagccaaaccttatcagtatttctctgtgtttctcacaaacatccctgagcactttattgttatcacccaccataggatggtcaggcccatctttcttccccttgaaggagcccaggcttctcctaggcttcagtgttaagggcacagtgggttctgggtgaccctcataaaatcagatcatgaatttaaggcagagccgacttgggctctcactctccaggggagatgttcttagatgaacaaaaattctccttagtcagaaaagcagcatcctcatcaatgtatggaattgtggcaaacatattaagcatgtcattccttaagttaatatctgtcactacataataactcacgataaataaatgtggtcaagaaactatattgtcacaggtacatgtaatagataaagacagggagcacaaccagcgtttgtttaactttgcaaggatcaaaccatcatcagaaccaccctttgtgtcttcattaattttttgttcatgctgattctgaatgtttagtctcaagaggaattatgagccatcagattggatgagtcaccttttagttataatcacaggagcattcaaaaatgaaatcactttattcagctggatgaaccttataaaaagtaaatgacttcatatacatttggcataaggctaatgagctatttttagtttttcctggaattatcttagcccttctttccgccctccgtgatgcctgcctccattttaccccttcccagtgctttcttggtcatgctaatcaaaaaggaaagggggaagaaacatgtggttttgataaccttcaaatcattaaggcaagggggaaaaggcccacaaaaggtggctctgaaacgtggagcgcctttccaagatccaaataaagtgttttctagagagtttcatgttatttttatcatgacttttataatctactactatcttttaaaatctgcattagaatattatttctggatctccaatctttatatctatttctacgtgggtatgactgtatgtgtccctcaaaaaatttcaattcagttcttgtgaaccagagaactcttcaaccttttctctttttttgagacggagtctcgctctgttgcccaggctggagtgcagtggcgggatctctgctcactgcaacctccgcctctcgggttcaagcgattctccctgcctcaacctcccaggtagctgggattacaggcatgcaccaccacacccagctaacttttgtattttttagtagagatggggttttgccatattggccaggctggtcttgaactcccgccttggcctcccaaagtgctgggattataggcatgagccgctgtgctggccaaatcttttttttttttttttttttagtaaaaggaaactaaagttacaataaagaaataaagaaacttacattttgttgacactaaatggcaggtttcatacaaagactaatcttttttattagggtaggaataattattggtgactttctctgccaattttccaagtgttggtaatacatgttgttactttttaaatgtgtttttgttacttttaaaatgaaatgaaaaagacatataaattatagcatacatgtctacccctacatttaaaacaatatattcctatgataaggcagaaaaattaacctacccttccctaacacaaacttccctttaatgcctgtggccatctgtagatcctgtcctctgttagcaaactccactcatttgctttttgaagttgagttcaagatcctcccatctcctcacctgccccgtcacccacatctctgcattactgtaggctcactgcatgtgcccttcatctgacattgaatctaggctgtcttgcaacatttctgatattactgccatttaatttaactttttatatgcattgccttttttttttttaagactagtcaagtgcagtagtgagaaggaagaaagagtggaacaaggagttcagctgtaattgactaaggtgactcactctgtggaccagcctgcattgcctttctggctacattggtaagtatgttaaggagagggacaaagtcacttgaagtttttggcctcggtttcctcatctgtaaaatgaagggaaccaggcctccgaatgttgttaatccaacacctataactctttttcccaaggttgaagatccccagtaatatttcagcttgctttcactcgatgttaatccaacacctataactcttttccccaagactgaagatccccagtaatatttcagctttgctttcactcagtgttccctgactcagagatctcaaaccctaagggagaggcagagtgtccttcagtcttgacgcctgggagctgtggatgcctcattgttgctcgtcttgcgacataaaataacagcatgctagtggccaaaaggcatgaagtgttcaaacttattcaaagttcaaagtgttcaaaccttttatgtacatgattctttaaaacgagggaaaagggaattgctctgttctcaatcgactgtgtctgagttcttaggatttatattagatccacactcccccccaaattttgaagatggaatgaatgtgttttctcctatatttaccactcaagttttttctttcctacatgctgactgtttgtgttatggtcattagattctagtactgaaggggttttggtttttgcctttgttctctgtgtgagctatgcagtggcttttgtgctgaaggagggagctcccgtctcatcagtttcagaacttgagtgatggattcgtcgtggctgctgatggtaacggtgggcactggccagcctgttgctcatgcagcgtgggaggtgagcgggcacagtgcccgtggagaggtggtgctgcctgatgagcttagggaaacccggtaaacaccgatgtgctctcccagatgcaaactgagtcacatccctgtcaggaaactgcaaataaatcgtgtgcaaaacggaacaaggatcctattaattaatttgggataactttattttattttttattttttttagagacagggtctctctccattgcccaggctggagtgccgtggtgtgattatggctcactgcagccttgactgcctggattcaagggaccctcccacctcagcctcttgagtagctgggagtacagatatacaccatcacactcagcaaatcttttcattttttttttgtagagctggggtcttgccttgttgcctgggctggtcttgaactcctggcctcccatctcagcctctcccatctcatcctcccatctcagcctctcaaagtgctgggatgacaggcatgagccactatgcctggccctgacatgagactcttaaccaggccattttacaaccaatttcatgcattctacaattaaacaagatagtaattgtgtaacagatctagacaactttttcatacagatatttattttcccaagttcaactagggctagagcggtttgtagaaatgtataggtctaaccaatgcttcagttcacatggtctcttgctgtacagcaacagccaggtgagttctaagtgtcaaagtgcccacaaaaactgcagtgtaagtgaagctaatctttggtgtctaacatatttttactgtgtattcacttcccttcatctttttgcattattttctgtctcaaagcaatctgttctacatccttccccatccaaattcccaacatatgttggggtttaggcaataatatttgaggcaatcgtagaggaatgtccaaatgtgtttgaatgaggggctgtttaacctcatgtagagctatttgaagattcagaaatgtacttctgaagcccgggtctgtctttaaaaggccagacttggtatatcagcacctattcagcacacgcacaagctgcccaacaccacactcagctgaccgtgctccccgccacctatcctctccactgatggagtttcatttttctatcaagagcatcaccattttgcttgtccagccccaaaacactgacatcatatttgactcataactcctcctactatcctcatgttggagcagatcctactgatatgaacagaagccagagaaattctaggcagaaaagggtgattccccagcaaaaccccaccctcaagctgaaaagcctgaaaccatggcccaaagtgagaacttgtatccctctttacccgctaaaatgttgcctttcctaaactacctataaccatgccccaccccatcctgtgcccataaaaaccccagacttagctggtaggtgggactacagatgaatgtcagagagaagcagcttgactttggagggacagcttgacggcgtaacttcggagaagaatccagccagagacagctggattcaaggggaagactacctacctgcccatcccctgttcagctccccttcccactgagagccactttatcggcaataaaatcccccacatttatcatccttcaatttgtttgtgcaacctcatttttcctggatgccaggcaagagctcagaagccaccagtgcaaatataaaaggctgtcacactggcctttgccctcgctggcgggggtagctgcctcatgcgaaaaggcagagggcccactaagctgttaacacttaagccgcccgtggacagcagagctagaacagcactgcaacacgccctctggggctttgggagtcacaggcacccccacctggatgctcgaacggggactgcatggagttcgctcctgccagtgccaaagcggccagcgggttccagcgctcatgcacgccagcttccactctgcttgctggtgcactccctcctgtgaggagttgagaggggcaggctgagtaaatgaggcacccccctcgcaagtgccgtgaaggggtcaggggaatatcctgcatcgctactgtctctttaaaatctctccagaacctgcacacctctcatcaccaccttctgtttaccacctaacaccttagtctagctttccagtaaccttatggtttttctcccttcctccattgacatcacctgcgttccactgttcccaaagtatccagagtgatgctcaaacatctgagagacatcaggcattctcctattcaaagccctccagtcacctcccatctcccctcctttgctggccggcagcatcctctgtgtcctgggccctcactgcacctctagctcatggctaccactcttcctctttgtcctccagcctctaatgaggctggctacctcgttaagccttggacactccaagcccacactgtcctctccctggagccccaggtctctccttgagttcttcagatttatgctccagcacctctgtatcagagacctttcctaactgccccatataaaatgcagtcctccatgtttcctttgtcttttaaaagtttttctgcagaacacttcttatcacctctcatcttacgtgtttgctttttatctctttcccaccacaaggattagctcagaagagcagagactttcatcaggagaacgtgattcagaggcaggaaatttaatcatggggtggaacctataaggacgttcagtccacgtactggcatcgtgtggctctacacagggtagttaggggaagggatgagtattacaagttgctgaaaacaatatatacttttttcctttagcaaatgcaaagaggtagtcagcttcaccacttaggcaaatgcagaaatattgctgctgtggaaaagggtgcaagagaaagtcagagtgaaacaaatcggtgctttataatttagtgagtagaatctgtaatcattactataatttaatcattactatcatttagtttcccactgtcatgatattgcagcctggtacacattaatattgccatatgttcatactgcacaccattatttgcctttgtcgttttgtgtgaaactagacaaacatcacaatctgactttggactctgaccattagcattgatttcaaacagtgctgaggcaattctgtgaaatatggaatcaccaccactacacaggatcttaaacttcaattctagaaatgggatggaacagctacccacctatccttaagtataatgaaaaaattactttcctggtgataacataaccttcattatttaagtggatatatggttgattttctatcttacatttaatttccttgggttttgttaaaattatgaatgatgaggcattgctttatcaaaataatacatttgcattttaacagattttcttccattctttctaaaggagtatctcaaataatgggaggagtcagcaggctagagtgtaggatattttgcagcagtgtcttgctttcagcttcacgtcatcccattgctccctcagccagcctctgaccctacacttggtctataccaggtttatatactgagtttcatggatacacttaggtggcattaagtagaataatggcagatgtaatgtttatataacttcacttaaatttagtttaggcttttttttttcacctcatcaacacagaaaacctataacctaaaatttgtgcagaaatgtgtttcacaacagcaattaggtatacaggtgtattaatctgttctcgcactgctaataaagacatacctgagactgggtaatttataaaggaaagaggtttaatggactcacagctccacatggctggggaggcctcaccgtcatggcagaaggcaaaggaggagcaaagtcatgtcttccatggtggcagacaagagagcatgtgcaggggaactctcctttataaaaccgtcagatctcgtagatgtattcactaccacgagaacagcttgagggaaaccacccccatgatccaattatctccacctggccccacccttgacacatggggattattacaattcaaggtgagatttgggtggggccacagagccaaaccatatcaacaggcatgctacctaaacctctcaaatcatttaaaagtttcacttatcttcagaacacatgagtctataaagaaataagcaactgtgttttgggttataagttaaaggcttgtaaatcattaaaaagaagaccactttaccatggcatttttcacgacagattttttaaaaatatcaacattttctcattaatctccatgaatttgtttgcaaagaataaatttacttaatcattagctttattctgcttttggatagcatgactaaataagttgcctaaactgaaagagtgatgttaagactaaaagtagaagttatcagtatttatgctgatgtaacaggcataaaatgggattatgccaggcaataaggcgaaaaagagatgatgtaacaaaattccttctattttgatattaatttagtctccagcaatttatagcttttctctccaagaaacaccactcctgtaccccaaggagatagtaaagttgagaaaagccctatgaaaaggccaaaggaacagacacgaaataaaaaataaaataaatatttagtttaaaaaataaaaagaaataatttaacctagaataattaagactaaagaaacatgagactgaaaatttaaaatcagaaaaaaactggtaaagttaactctatttttccctaagccctaacttaccaggattaaaagacactccattatatttcaaaattgtttttgatagaaatagattaaaaagtactttatgtagcgagtagaacatttctggaactcaacaacttgaaatacaacagaccaaaaatgtagacagaatctaaatcctttagaaatatgcaggagtgacagctccatccatgttttcctccctcgactacaagtggcttaaagacagaggtcataaaaaaagagtgaaaactactaaatgctcaatagataaataataaatcttaagtgcttaataaatgttgctggaatgtgtaacagaatattctgaaaggaaggctattcttaacagtcatgcccactgtgccatgtcctacaatgtgactgctggagagagattagaagtaacatctttttctatggcaagccacacagtcagagacctaagagaaagtagtcctcttcctcttctaataaatagaaatagacagttcctatatcatcagaggatttcatagaaaaagtatttcataacgaaggcttatgatcctgattatgggctacttttaagaactgtggcatcacctgctgctcaactcccagacagagatgggcgtggtctcccgtaacacctgctgctggggcaggctggcgaggtagtcaagagtgtagatgctggagccaagccagctttgtgaaaagcccattctaccatatccagatggatcacttcagaaagtgacttatcctctctctgaacctgcccacatttcctcctctagaaacagggataacaacggtgccaacctcctggggtggctgaaggacccagtggatgcgtatacacgaagcacttagaagtgagtctggcaggtactgccaaaaatgtgactcctgctgctattaaacaggggatgttgccttggcaccgacaggtgtgactagcggttgaaatatttcagatacggggccccttcttgccttggtccctcattcaaatgaattcacgaatcaggttttctcttgtataaatgagttttttttaagggcgtctactaaatcttggtttgaaggatgaattcttctgggctcacatttgcttctttactccacagatggtggagtaaaatctgtgttcattgcaccttccgctggtgctttaggctccaggagcagcagctccctggattgagtgggagccagttctgcctgactggtctcaccagcacaccagactgcgcaggcgggtcagaggcccacggggaggaaacatcagtggagggaggatgctgtgagcggtccacccctgcatgacagatgtccctttacagaaaagaagtgggaaacagactttggcaaagggaaacggcagagtagcaagatgattttgattactagtgacatttaattgcaattagatttttaaccacaaccaagaagatgataaagcttttccatgtattttccataaaactgtccgagcttaggacactttagtgctcattcttcctgcaacactacccaccacaggttcactgtattggaagtatactgagaagagctcgtggctggcgtgggagcgccgctgtcttcaaacctggaagtgaagtgcacccacacccagccacagcagtgattccccgggagcgaccttcagggagttgctaggagatggccgctctgtgtttcctttgattatagggcataaccctgccactgtcaaaatgccagaagaaaagggcagtgattgctggacataatttttttctgttacttcctgtgagatattgttttgcacaaagggaggagactaagggagccatggatatctctgtagcagaaacatggcaactattatctgaggaaggccgacatcctccaatagcgatcctgtgtgcaacgcgtattatttgcttcttcaaattgagtcgtatctttcagtaatttcttaagacgctagacggtattacacataggcatggggggtggcttgtggtttaaaagcagggcttacacatataggtagaagccgcatgtggtcaaaggagataaagtaccacaaactgaggagtgtagttagctgggcgccctggattgaggtaaagtagaaaaagactgtgatacttctgagcccaagacatttcactctgccacactatctcctgtatatgcagttattagatagacaattctttttccgtgacagccaatatcaggtagggcttaaaagtcacaatctgggtttacaacacaactcttctgcttattagccgcatgacctggggtgagttactttctctctctgtgccttggtttctacaactataaaaccgaaatacgttacagtaagcacttgataggatcaccgtgagaatggaatgaaatcatatatgtatggccgggcgcagtggctcacgcctgcaaccccgacactttgggaggtggaccacttgaggtcaggagttccagaacagcctggccaacatggtgcaaccccatctctactacaaatacaaaaattagctgggtgtggtggcgggcgcctataatcccagctactcgggaggctgaggcaggagaatcgcttgagcctgggagacaggcgctgtaggaagccaagatcgcgccattgcacttcagcctgggtgtcagagtgtctgtctcaaagaaaaaaaaaaagaaaatatgtaatatacttagaaaaatagctggcgcagaacaaatgattacagaaatatgagctatcattttcattattattattagcatcataaacattatttcgttgtgctctgaatgcagctgaacagtactcaagagtttcaggatcagttgtataaaattacaaaaaattagaaggtcacccatcttgagaaaagacaagtttgtataaacaggacaaactactgaaagcaggagagttcaaggaagccaagagaagctgagaaagttttcttaaatctgctgtcttgttggttgctgatcaccacctcattctccatgataggtgcacagttggcgtacaggttacctagggctggatactgattgagcatatcctgtgcacaaggacacctatgtttattccacttagaagtctgaggttgttctgaatgtcaagcaacaaaacaatgcacttctttgggagagctggggcattccagattctggtcattaactgggtgagtgtctttaggcatcattccacctttgtggacttctgctccctcgtttgcaaagtgagagagtcagacactcaggttatgttcccttaatctccacctttaaaaaaaataatgttctgatctaccttcataagagcagttgtgtgccttaattttctttgcaggtttgctctatgcagacctgtcatgtggaaactcagagttataaattagaaacaggtaaatgatttatttttgccctgcaaatgagtcacactctctacaagtggattattaaattccattaaataacaagcttgcccaataattctaaaatagaatctggttttaaaaaaaaatcggtgtacctgttctctgttgtataaagaaaggtatgtgatagcatcgttaaagtatatgttttagaaactactctggcaaataattttcttagagagaggttaccgagaaaagagaaaagaaaaatttagtttttctggcttggagaagcagcaagtaaaagtcacagctctggaaccaaagcaagaaagctccttgaagaatgaggtaatcagacttgccggtaggtactctcaaaccagcgtgaactgtacactgcaattaattattaaatgtgctcaggctaggtcaggctatactaacagaattcagacacgtttttctctccagcatttggttatcagttttgtgacatatagagtaacagttataaggatcagtttctgcaactccatccctcaacctacttttttattgtaaatagactgaatgtggggaaaaggcaaagagaaaaagtgctatgcttcaagaacatttgtcttgatattttggtggcaagcatcatcaaactaactatatttggctctgactagcttagcatgagatgttagtttttagccgcaaatgagtagcacttgacaaggtgagaaatcttccttcaattgttgaaatcatccaagacgtgtttctaatctacattttgaaaacaaaagccctagcataatgcaataggaattcttcttgcctgtataactggattctgctctagggtcttgtgggatggttattacacatggcagagaaagctacgtgtcctcttgcacccagtccctcttcttaatttataacggaagtttcagctgaacacatggctttagccaggctaagattacatttttcagtttcccttgttttatcaccaaattttgaccagtgggtgtgagaggaaatgctgtgtgcatcttccaagaggctgtggccttaaaggcaagaggtgccctctttgcttttccctttcctgctggctggaacgcagaactgatgtcaggagctggggcagccctcttgaccaccaagggaagccatgtttagcgctgagaaagacagagcaataaatggaaggagcccaggttcccagaattgtgaagcctccgtactagccttgcaccaccaatctgtacttttacatgagtgagcaatacacatcttttatgtttaacctctgttaatttgaatctctgtaacggcagctgaggttttatcgcaataaatgtattcccacagtcagaatccagacaatttcaatagttccattttatatttatgtataatcataagaagaaagtccccaattttacattaaactctgtattccttctaactgtcttgggttgagtgacacggcggctattgaacgtatttctgtggcactgtaacccagtagatcacacccatgcaattgctttctcttccttaggcccaggtcacttcacctgcacctctttaaagactgtatttcctttctgtgtccctccctccctctctccctttcttccttccttccatgtatctaagagattggcctgggcctccggtacccaggtgctctgccttgtgactccatcttatgtgaaaactgtgccaggtgctagaaaacagtttgcaaattatattttggtttggagaccttgaggatgcatttactgaattttttgactggtatttacatgatcatctcaaagaatgaattgcagttttttcacagtggaggtactgataattcaccccttgaaatgaggccgtgtgggatgagcaaccttgaaccaggaccttaaaagcttagattccagccacggctccgacacaaagtgacagccgcgtgaccgtaggcccatcgctctgtctccctgggcctcaatcttctcacccttgcattgggaatgatactaaagttcctcatccacctgcctcatgggattgctcagaggatagtgtgagacaatctaccacaaagtacaactgtgagccacttcctaactcctgctttcccacctattcttttttttttttttttttttttgagacagaatctcactctgtcgccctggctgtgatctggctcactgcaacctctgcctctcgggttcaagtgattctcctgcctcagcctcctgagtagttgggattataggtgcctgccaccacgcccagataatttttgtatttttagtagaaacggggttttgccatgttggccaggctggtctcaaactcctgaccttgggtgatccgcctgccttggcctcccaaagtgctaggattacaggcgtgagccagcatacccggtccccacctactctttaactatgacagatgtgaacgtttgatctctttgcagacaagatcagcacggtgactgggtctttgccctaccttcctaagcaaatgacagaactggtagcagaactggagcccctgaagcttctgcaggcaaacttcctggagcagcccaagaaagtcagagcccctccttttcgtcacattcagttggaattttggaaaccaagcataatggagaaataacttttttggtatagccggaagatgaacccttgggcacagtttcaaagtcaaatattttactgtaaagtggaagaagaaaatacccagatctttctgcatagtcaagtggcttatgttttgcacgcattggaaagaagggaaaacaaaagctgtcttagaagacgaaatcaatcacatgaggagtggcactgctccagagagctgaggtcttcctcttaggaattacagactttggttccgtataattaggccctgtgttgctcaacttccaaataatttagagagaattatcatgtgagagtgcacatatatacatttttttccaaaacaaccttctcaatatgtagcaaaatgtagtcaaggaagaaaaaaaatgagaagttctttagatttcagccaaaacaatcacttaagctccaagtcactatataaacaccattaatacctgttaaaaggtcgtgaattctgtaagagatgtttggaacaaacagtgcttcagaactacccacaaaaataaacaaaaaagagatcatattatgtcactgggtccagacaggatgatgaaacggctatgatcacgtataagctttatctatctttccagagaacagtgtcagggacatatgggttactttccaaattttgtttaaaaaatatgaaaaacatctgtgaaattctggtaagacaaaaagagtttctaattctttggatcgcaaaatgattcttcagttctaattagctatgataaattatgttaattctaaattattatcattcatgtgggcatttaatttaaaaagtggcattatttggaaaacagtctctgcaatttattctaatgtagtttaacacgaagcagctacattgcctttttggatattttcagaagtgtgaaaactgtgaatatcacttcaggctttgcagaatggtactctacaatgaatctgtgtctggcatctgattggtgataaaaaaaattattgggaatagattattagttattctgagacagaattttgagaaacttgttgaaagagtcttgtttgaagagcccataaggaacctcctccttcacacccatactctggctaagaatgttgactcttttttcttaattaaaggctgaatcactgataatattgttgatattaagtgcctactaaccagcagcatgagcttttaacacttttaatgtcacccaaaagcctacccaaagtgcccaggaaaataaacagttttctaagattcagtataattttattttgttttgtagctaaaatgcgccagagctgtattcatgtcatcacagtgggaagaaggcaaacatctgagaaattaataaatcccacagccgatctgagctgtcacccaaccccaaagggcctcagtatctgcatctgtatatggggataactcagttctccagagtttgtaacaggcctagcacagtgcctgcacatgtaagagctcagaaagttatttgtaaattagtaaattaatttataaaattgtaataaatcaataaccattaaaaaaaaataaaataaaataaatcccacagccactaaaagcatatcgtatttggggcacaactctggccatagaggcaagcacctgacataacacagatggcttcttgctggtagcatggtggcaacttcgctgaaaacacagagacaaggactgtttcactctgtctcccttaagaactttgaaaacagttttatgtctttggagaaggagcaccaatttagcttgcatcatggatcatatagaacagggtatgttttaatgtgctaaaacctaagcaatgtatttaacagagcaatctatttccatgaggttcgtgagaaaataattcagaggctctaagggaagttgggagaagaaaggacagcccgtaccagtgcactcaaatagccagaaagagcagagatgctgattgctccaagcagtagtctgagtcttattctattcatttccttagagtaatttccagtatttgttaaggcatacagaatttgggggcttgaggtagggagtgtgtcttatccatgcttggaaatgtaacagcttttgaagttttgtaatgtttcttttttaaagcaggcatctttctagttccactatctctgtggagttgaggaaagaaagtaattcatagacacagggcagcacgctgacctttcttcagtgaacgtcaaggtcctgggctcataagggaataaggaagaggaacctcagtatattaatccatgggctccagccacgtggcagctacatattttcaatcactttgcttacttcaaacttttcttggtgtgccatgtacattaagaacagataactaagaagcaacccttctcagtgtttttggcatctactgatcagcacctgacattccaagttatttcctcctctactcggcatgccgatttctgtactgttgaacagcaggaagtgctttcaagggtctaataaattagcctttcgttgtttcaacttccaagtgaagttaacaataaaagaagcttagtatgaaaaagatccagggtttcttaacctacctcttgtttcttattttctttcagtattggcttttttttgatgatgtttgggtgtttggggagtggaaacaccataaatttgatcttaagctgtgctgggacaacttttgcatgtttttattgaatacttgggatattccactgcccagagagttaaaaaaaaaaaaagacaaaaggatgagcagctagttaatagtcttcatagccaccagttatcctttaatctagtattttctagagtgctgtgatatttgcagaattaacccacaaaacagtatcctatgggccaaccggtgatgagactgagtttgcctttgagaactccggtgggtgttctaacctaactttcctacctctcttcactgtcatttatattgttgcctgaggactcttcctaatacctagccaaagtatggggggcctctgctgtctgagaggtcaacttctaacaatttagtgtgacctcaaggccaccccatgacctgactccattctcctttttcactctcgtcttcggccacctctctcaatttgccagactatctgctctccctggaatccaccatggacgctcatgctgtttcccgaatctggatgtagaatttccctgacctttttatttacaaaattctacccatctttcaagattttccttttcctgagttgattattctttgtttctgtgttctcaaaacactttccttgagcaatgctaaatactagtttccttcacgtctgtttctctcaccgcagcatctgtgagattaaggatagtgtctttttcaccatttatctctcactgctcctagttcagcaccttgcatatctttcatgctcagtgtacttaaaaacaaaagaatcatacataagacggtgttgccagtttatcatttaatgaagaggcttttttcttttatcaattatggtaaatctttgactagttcaaaaagggatttaggcagatctatttttgagcatttctcctgttaatatttatattgaacttcagccttttggggtcaacagctagaaaccatcacagcctgctataatccattagttacaaaaggatggaaattatcctgcaaaaagcgccaggctgcagaggttcttgtttggaattattacactgctgttggatattctaactacccacttgtgttcaaaggagaagcggcatttgagaaagcttctaaatgtgggttctgccacctaccatgtagaactctatgccagtgggtcaaacatacttgccgtctaatttagcatcccaatatagattctagcagagcttctttgacatagctaatctctctgagtttcaatttcctcacctataaacttgggagtaacgactttgtgtggcaagaaccccaagtaattaatcaaaattctaactttgtgcttggacatagggattgatcataaatgtgggctattattgtcttgatctttgtttttgctgttgttcatatagtacttattaatatggcttctaatttcaggtttgtcatttctgtcgttttaattttattttatcaaataaattatcataataatcttttcattggctctcctgtccctagttctccccctaatattgatctctctccttttaattccaagctgcaattgcaaggctaatattttgaaaggaacactgacttcacattatctattaataaattctaaaccaagcccaacacaacatgatcctaacctaattttcaagaatttattttccttctcagtttttttttgttttttagtcaaactgaactttttgttgctcctttttttgtacatttcatgttttagccttcatttgagtttaattagcacattttaaccagatgcctacattgtgtcagatattttctgggtagtaggagtgtcaggataatccaaaagaatccctgccttccaggagcccatgactggtgtggcgaggcaggtgtgattttgattcatcttttgtgagatgttttattcgttgagattacctctaattactcttaaaattacacacagttttagaagtccatctcaaaatagtcccctatgaaaaccacataaatccctctcactcatttaaactaatatagttccttttctgtgccacttcatcttgtcttactttatgttatttatgttggtgttttcttgagggcagggatcatgctttattcacatctgtgtctttcatcgtaccttatgtataacaggcttgcaataaatatgggttaaatatcaaaggaatgtaatagtacaatttgactttaaatagaataataaccaaagttttcagggaccatttttcaaaagacccattcccccaagatacttaacctacaatgcttactttgtataagctctgttacttaagctaacaaacaatagttctggaaacctcatatacagaaacataaggatatttagatgtataatatattatatatataatatattttgttacaccactagacttggcttgaatgaaccagaatattgcttgcttatttccttgatgttcttttcttacacggtttgttctacaaatgtataaatattaatatattagaaagttatagaaacagatgaaggaaaaatagacacaaatatagtatggaagcctggacataaaccagggatttcagaaatagaagctatggagatgcatccgggaggagggtctgttttagcacatttgggcatgcatctttaaataggagacacatttctggaaggaacatagggtcctgtgggtaaagtattgggttgccttgttttatatttacttgaggctattacagagaatcaactacagtgtaaagggagagcaaaaccaagcgagtttggatttagggacattaagtacgctttgaacagatcagaagccctggacagacgccaccacaaaagcagcagcatctggaagtacacgtgctcatctctttgtattgcttggtgtgatttccatggctactaaacgagtcattcacttcaacctacattgatgtgatcaaaatagtttcatcagagcaaattctcatcccctctgaagagtggacagattcttaaggattgtccacgtttgtattaacgaccctattgcttatgccgtcacaattacagctaaccagataggtgcagtcaatggattttgtcaatgatttaccttcaaagtaacaatactcacatacaagtagaagttaaaaggatttcaataaatttggtaattgactttttaactatacgtttgtgtcaggcatttatacttagcaaatcttatttatttcaatgtatttgattgttctgaaatcagtgacaggttaataactttgttatcagattactaaattaagcttttatcagatcatgtttacattaaaaaagaaaagcctgaagacattattaacttcatttcaacaagcttctgtaaataaataggctttcattaggaaaccagccctatttatcaaggttattaaaccattttgtaacaaaaagcatgatttacaaaaatgtcccatgattaggcttattttattttgatacgaccaggtttgctacacattttaacataaatcaagataaacagcttgttcagaaaaaataaagcttcagaaaaatgcaccttaatcactgttttgagttactgattaatgtttgtccctgaatctgctccagacagattttatgttttctttgatgactttcactggaatatggttggcttttatgattaaacccatccttatggtataatccttgactaggagttagacattgaaaaacacttaaaactatacatggtcaatttcttataattgatttttttcagtaaactcatggagaataacttttgtggtgattattagaatgttcaaaaacatatttctattgtgaaaacccagtgcttgctttctgagtctgcgggtctatccagcctgcccaagaactcgattcagctaaggttctcccttccattatggagcctggaaggttttatgcaaaaccagtgactgtgctccccgagaaagtccactgagtagcgtgctggacagaacctgaccaggactccatgctttcaagctctggttctaccgtctgttacttaggcaaatgttttcacctgactgtagggttgattaaggcttttggcttgccccaaaaacccctgtatttctggatgggaatcagttggaagtattttgctagggtcctgtctttgccattccatctagctctagtaatcttgatggctcttatctcttatgctctggatgaaaactggtaatacttctttctccatttgttttgtgtaagcatggtggtcggtaagatgatttctggtgaagcagcaaaaccacaggctcttgtttctaaatctggttaactgaatgccttctgtgttcacctgtcatcacaaaaggatgcgcaggagcactcattattttaatcggagtcgttcctaattctaaagttaatcatggcgattctcagatcagggagaaaattaattaagatgcaatgctattttcttctctcccagggtgacatctcccaggtttctcattaaatcgcccatttagtgtttggtttcagtgctttggagccaggcagaccagatgcaaaccccagctgcatgtgccatttgctccctgaggggcagagatgatggccttgctgccagtggcatctccagccctggaactgtgctgggtgcacacgaggagccaaatgcatgttttctgaggggagtaagtggaagaatgaatgaagtcagcccttccatctcttcttccttagctgtcaaataggatgacaaaatacctatttgccagtggttgttgtgaggattaaatcatagatgtaatgcatttagcacagtgaatgggcacatgagaagaattctataaatggcggttgttcatcttcctacaggaagggcagatctctgagtcatagaaattgcttcttatttcccactttcctttatttccttatgtggtgaagtataagttccactggtattcaacaagtaaaactcttgttcagggtaatgtgctactaacttttaagtctgcatattttaaaatgagagaaaatctagttttttcattaactttctactcatctctttctgggcccgctcagcaaatccccggtttcagaggactgccctgtaaggaactatagacagggtttccatccgtatttccattttctgaataagtaacaaggggaactagactctcagggcctcctctgcctgcttcgtccttatggagctgatgtggggagaacactcctcactgtccagtctagtgatgaccacagttctgtagccacgtggatctgtgtactcgaggtcagttagttccagaaaatcatccagtctaacatttgctcagattccctaatttctactctgtgaaagacaaggaatagtacagctcttcagtttcctgggggagtgcttcattacttttcctctttttctttctacttagtctaatgactcagattccagatggttctgcctaagtttagaattatcatgatctactttgtagagagaaaagaaaacatttcttgtacagtacaacttatgtaattttttttcagggaagtgagaaaaatataacacgcagtgtagaagaacttttggctctaacattagatatcaatgtttcgtattctgtcattggggtgtattgtaatttacttatttactgtctaattccttctgtagctagtgaagtttacattttcttttttctttttttttgagatggagtcttgctctatcgcccagactggagtgcagtagagccatctcggctcactgcaagctccgcctcccgggttcacgccattctcctgcctcagcctcccgagtagctgggactacaggtgcctgccacggcacctggctaattttttgtatttttagtagagacggggtttcactgtgttagccaggatggtctcgatctgtgaagtttacattttcaaagaatgttttaatgatatggaaaaatattctccaaacaatgatgtgcaagtacaaggtacaaaccaggaaagtgtaattctaattttttttttttaaaggtcaatatactttcttttttttttttttttttggaaaagaaatattcctaataattcatttaatcatctggagagtgggttgaagttttgtaaaatttaatttcttcattatagactgtattattttaataaaagcttttctttggtgtcacccattgtgtgcagcactgagctggggccctggagctctcactattgtccatctggccgcaccactgtcagcactgctttcaatgaactgtaacagaatactgatgactcagcatttctgctgctgacaggaagtccttgagcgagtctctttgtagttcctccaagaaaggatgctcaggcactccttgggtgaacagctgcaggccatggagaggacaaccgggttgcagtagtaagtttgcactgggctatcccagagctagaacaagggaacaggtcagcccctagagtcccagaggtcacagacttgggcaggtccaggcgttaaatgcagctgtgcctttggagctggacatccaggtacctggctgcctgctgggaacaggtgagtatgtatcagccattgtgaagcctcaaaaggctgcagcctgacgtagctgcagatcaggctgtacccaaattgcattgttactgatgaaataattttttaaaaaaccaatggtatctatttgagcattttcctcatggacaccattcaacagaatgctgttctcggggaacaaatgactcatgcaaatgactattttctaggtttttctcatggtcaagcagccatgatctttttatagctttattttattttaactcagtcccaatggttaatttaaatcctttctttctttcatcaatgatacaaagagctcactttactacagtctcatcttgacagagtcaaatgcagaggctgtaaggctgcccacctgaggaggaggaactggaacttaggaaaacagctcagatgcttcatgcaaatgaggaagctcaattggcttctattgaaaatacctcacgcatcattttctcttgtctctacttgccaaaatatttataaaatatctttgccctgccatacctaactaagcctcttggaatttattttttcagtgagattctctgatgcaataaccaagcactggcttttagaaagtgttctctccccctccctccctccctgcctgtctctctccctccctccctgcctgtctctctccctccctccctgcctatctctctccccctccctctctccctgcctctctccctccctccctgcctatctctctccttccctctctccctccctccctgcctatctctctctctccctccctgcctatctctctccctccctgcctatctctctccctccctatctctctccctccctccctgcctctctccctccctccctgcctgtctctctccctccctccctgcctgtctctctccctccctccctatctctctccctccctccccgcctgtctctctctcttcctccctgcctatctctttccctccctccctgcctgtctctctctttctctctctctctctctctctctctctctctctctatatatatatatatatatatatatatatatatatatatatatgtctgtttctctgtctcactctagatatacaatcaaatcagtgtgcagatggaggacaaagagtatcacaaaattattattgtaacttgtggataataaatttcaaaatctgatgtctgtgctccaatatctgacctccttttttgcaaaatatgcacatgtgaaacctgatttactactgaggaagttaaccctttccttttgaaagtaatgcatcagtagaagatggaaagttcagtggagatgggtgatcttctcaattatgtgcatgagaataagtaaactcccaggcattccgtcactctccaaagtcagaacaatcaagaggacacatcaggctttagaaaaactcattcccttggaagataatctcaatagcatgtgtgaataggaagagcatcaaagtgtgaccgagagagtgtcagagaagagtcacctattacaagcatgatcatagtacttaggaaaaagtaagttccaggcttatgtggatattcatatagatattttccagggttttagaggttcatgatttctcagggagaccaaagtgcctatgtgactgtgaggggttattagtcctctgggttctggctttactcagaaatagcctggaccacatgggtcagtcctgccccacagacattaggccccctcctggggcccctgcagagtgggtcagttctgcagatgtgggaagggatgagtgttgggtttgggaaccaaaggctgtgtgttgagcttacagtagacaatttggagctgcttcttgcttagagatgacccaatatccaaaagtagctattgcgggcaagtggtgttccccaaaaaggtatgttgaagtccttcctcacccccagtacctgtgagagcgatcttatttggaaacaggatctttacagatgtaatccagttaattgaggtcatactggagaaaagtgagccctaaatccaatgactggtattcttacatggagagagagatttggagacagatccatagaaagaacattgcgagacaatgcaggcagagatgggtgatgctgccataagccaaggactgccagcaaccaccagaagtgggaagaagtgaggaaggattcgctgctggagccttcacaggcaacccggccctgctgacaccttgatctcagacttctacacccccacgtagagtgtgagacaatagatttctgttgtttcaagccacccaattggttgcactttgttgcagcgctctagaaactgatacagtggctcaaacagagcctctaggtgtctcttcttttgcaatccaaagactgcaccagtgctacttgaaggggtaagagagctaaataaatttgcttttggggagatagatttgggtaagtttctccatgctgagttagatgagtgatatgtggtggtggtaaaatccagataacccttgagtgtgatgatttcagaaagagagagccaggaggcctgggagccagcaggccagcgggggtccgcccactggccccgaaacagcgaacagtgacattggagcaagggcccatcccgtgcttctctggagccccactgggcagagccaggtggagaagcaggaaactgcacattggtgggctggaggggcttggaggggctgagacaaggtgtgtgcttggggataagggcgttcctggtccccggtgaagcatcagtgaccaagaggcatcctctagaagaggtagacactacatgggaagggagaagcagcatgaaggaaggcgctttaggacaaggggatcagttacagtttcttcgccatgtgccttagacctacagcttgctattccactctgaaataaggcagagtgaagaattcaaaaacaatcactctgggagaaaaaagcgagttctcttgatatccttgctttctcctggcctcatttcctctgatgttcccctgccctcttgcaaatcaatcagcctaaatcaagggtgtctgtgcaggttctcaagacagacatgctgctgggagtggcacgtacgtgaacgtcaaggagatgtcagggcatgcgcatattctttggtgcccaccgtcttattttcttaacttactgggaaatctttttgttagagtgcacgcattaagtttcttcctggcctcatcagccccaaacccaggcagtggcgggcggtttcccgtgaggacagcgtaccttctgaagaaatgcacccagatcagaatggtatacgagtctgtcctattctcgctctagaaaagaaatgtcacaataaataggtgggtggggtctgccccacactccccaaaacaaccaaaacagcggcgagatcaaactgaggacaacgttatcatcatatattcttttctttacacagtttgatacctacctacttctcagaacaaacaccgcggaaaggaaactgggtggatacttactgtttttagtttgttacatactacaattagtcaccattagctaattatatagaaaaggggaaattggggctgttttacccagagttggttttaggtgggggtgaagcaggcagggtgatattggcagcctcatggttggttttgctgattcagttcctctttccttgccccctatttcatacaaaattcctctgacaaagcttcctgtgtggccactggtcagcattttaatagaatggaagggtgcagcacagcaaaggccatagtgttaatatccctcgcatctgccgttcccacctcctccttgcttttccagtcctttccaactctgcataggatgatggggagaggagggagctaggaagggtgagaggcaagcaaagtcatttccagcattttaaagtcagctctcccaaaatgctctctctctccatagccttctccctactggggcttcaaagccttccctctacctgaaaccactcagggtgcaaggaagcctcttcaggtccccctcatccttgatcattacaccagctcttgaggatcctttctttctctaaatttggcaacaatcttctgttgcagactcttttcactattggaattccctttcagggactgctctctacaacttatatggctgcagcagcagcttatctgaccatttaaggctctacactgtgcagacagaaaaggatcacactcctctctcagacacattataagaaattttatacaaggcctgtgcattttcaaaacacaggattgacctaatgagcaggaatttgagaccaggtaggaaaagagggtcatgggatgtggggagctgcctgggggctggtgggaacttgccaggggtcctcatatcccttcatgagacagttgcctaatcagcctatttcaagggatggccctgatttcacggtgaaaagcaaggcatgtttctgcagatacgtcagtgctctaacagcaacatgtcctctgctaggaggacatcctaggagattcgcttccattgaatcagagtaaactatttttttttttttttgcttcttggcagaatattatttgcagatatctgcaaatttggtaggaaagcttttttttctaaatggaactatcctgaaaacaaagggaaaaaagggcaaacacacacacactcacacacacaaacaaacacacacactcacatgcgagccttcccccaaatccttccaagtcttcattctatttaagctgttcataaataatatctgatgataatctcattgaaaatgcatctgtttttatgttaatttttgttaatttgacatccctagacgatatcatgaaaatatttactgtgtgtacgtttgtgtgtgtgtatgtgtgtgtgtgggtgcaattttgtccccttagtccatgatgaattaaaataagtagtttacctatagataactaaaattctatacatgtcttcatgaagtttaccttatttaaccgttgcaattaacacatatcccagaaaaatctttaaattttatttttaatattatcctaatgttgctgagttcccagcaacacaattatttattgcagccaacatctaccatgcttactattacagcaagctcttttccaagttcttatatcaataacacacaaggcagggcctgtgatatttcccatttgtggatggagaagcagagccgtggacaggtgccaagtcacccaggtctcaggggtggggtggggtctccccacagacagcctggctcagacacactctccactgccgcagcgcgagggacccttgtcatcatcccacagagtttgccttgtcattgcttctgaagtgcttagagactgtcaatgaaggagcaatctcaataaactttgtggttttgtcatcctcagaaatgaccaatcttcatgaaggtggtgttgtgcaagcctgggcttctattaaaataaaaaagtgtgctttgcacctaaggcaatggtgggattaaagcaagtagcaaattgatgttctcatttaaaagtcttgcctggtctgtgagtgccctgggcctgcaaaggtaaaagaagcctgaccacaaagcaactgggcattctggaggttactgggcagacctgagactccagagaaagtaggaagagaaggcagattgtcagttaatgatggcggtgttcgtttctgtttgtatacttttaacagtctaaaaatggggcttcggacacaatacctttcctaaatgaaaccagtgcctgcttcgttacaggcacaaggtatgtactgtgggtgacatccagcccccttcagttttccagagtctttcctggggtcttgcttggctcagggccactggaacacaacccacccgatgacaccagggtgtgtcgagcctgtggtcaaggttcacacgtctgtgtgtgccacaaccactgcagaggggaaagacatcatccacacaacatcccaccctcagcagggacttggaaaatcaggaacccgatagtccatagttggggagactgaaaggttccccaaacaagcaaggctgctccattttacctaacaataccatacctactggcacggtttctccctgtgccccattgctaacatttctccttcgagttggcatgccaaggaaagcacagtgaaaaatgtctgagttccgggttgctcttagcaacatccatgaatctgagtttctaacctccttccctatagaacagtgcctgaaggaagaactggcaatgctcactggtgtcagaattgcccacgatttttcccttttcagcaattatttaagtgctccaaaagcattgcttccttactgttttcaaggcaagatagaaggagaggttaatcttgcttagaatttcctctgctttcaagttccaggttgggggtataaagaggtttgatagaaaagaaccgcagcagcccaggcctggctgcaggagaaagcaaagtggctggggacagggggtgtggagagcaggtggtctcccgtctcctccatcagggtcaggaatgtgtctgctcctttactggaaccatcgccctccctggatggctgtaccgtttagggaggcctgtgctgacaatacaggtgcaattcaaaagaaattccattaaaataaagtgggcagtggggagaaacggggaattctgtcatgaaacataaaacctaaaatactgtctggtcaaaacctagacagcctgtgagacccatgagagctcggagaccctgctttcggagcataggtggggacccgaggggtggggccgtgagcagggtctcaggccagccgtggagaaggcggctgcctctgcggggatgggcaccgcagcgtggtgggcagatatgaggaaggcaaggactttcccattgaccatgcaaaaccttcacgaagtcagggtctgtccaccgtctaaagatcgagacctcatgttgagttctgaggtaaaatgggaaaacagttttaacagtgcagtgaagcttcctgccaataagcaaacctttccaccctccgctcagctacagaaacacatttgggagctccagggaggaggcggaggggcacaggcgctccccagtgtgggccacgctcaggtgtcccttcacaatggcagccacactgcttcgtgaaacggacacactacgggatggaaaacagtgagagggaagccacggcatcaagaagcaataatcacagaatgtttttgtgctgtccacgccttcctcaacatctgcctccacttccaagtcaatcgagacagcctgtttatgtggagctttgagatgacacatacactttactgaccctagaacaataccctttccacatctaaagcaattttcgtgtaaatgactgtgccattaaccttccagggtcattcaaatattttctgagaaattggctgctttcgggattttcttagaatgccatgtgtttcatttttgtgcagaacagatgacaggcgaggcattccaacaggacttcagttgatttaactaattcctgtcaggggaagtgaagtgttgggattcataaagccgatcccagcccggagattttccttttcccaaaacagaaaaaacaagacatgctgtgtggttttgcaaccgggcaagtttcgaaatatttttaagctttctactttgccaagtatttcataaaaaaactattttctttttgtttcgtgccaaaaaatgtcacccctaaatattttttcccatatctggtcacatgtccaggattttttcttttctaagaataaataatttttctgggttataaaaattccacttgctctatcagattaaacatatctttatatagaaaaagcatccgaaacattccccaagtgggtctaagggaggagtcttaatacaattttgttaaattaattttgattaaatattaggccttgaattctttttgtgactctcacaaagttcaggcttattttgttacactttcaagtctccctttttttcactctccacatactgtttccttttattagaaagcattcaagaagaattgattggtgtgtttgaccaaaataatatgttggaagtgataccagtgcaaggggaccctctgggttccattctctatttgcatagttagctggagttagaaggttcagctgtcagggattcaagaactctagcatcaaaaaagtgtgaacttgcaaatgagctgtcaaggttcatagcaagtgaataatgcagctgagagctgacttgtctccaccctggtgttctattgatcttgctgctggataaagcataggcacataggaacactgaaaaatagcaatttgtatgggttggactggtattttcttttttaccagttaaaatgttaattacattcacaaagtcaaaaagctgaataaatagtcttacagttggaaatatagggcaaaacaaaacacaggcttgaaaaagcaataatagctatacacctaaaatgtgaaaaatattcatagagaaatgaattgtagggcattaactcttgcaaaaccaccaaaggcctggtggaattaatatgctacagatttgaaacttaacattgggcaacttaaaatgcatgtatttgttattgatatttaactaatccttgtaagtaaatctactataagcgaaaagcattctaaattgatgttattgctagtttgcagggaaattctgaaagtctatgtgtttgttggtgcatgaggggatgtgcgtattgaggtgtgtgttcaggatgagggcttctggtcctttagaaatggttccctctaagcttcttggtttccaaatcttcatcactctttttaaaatctaaaaatgcaggtttactttatatggagagcacattgctatgaggagatgtgacatttcagaaagagcacatggcactgattctgaaatgctaccaagttgcttcagaatatacccaaattctctcaaagattaatgatacactaagaaactgaaggacacagcaaattattttgcttgtcttcaacccactgtcaccctgccacaaattgaacctaataaaatttccatccctctcccatcttatgatatgacccttccccctcatgcatggggaaattgttatttacattgtgaaaatatcaagcatctccaaacacttacgttttgtggagccgggtctcccatggtaaaatgagagcccaacacggtgagtttgcttcctaggaatggcaaatcagcatcgcgatgccctcaaaccagaaataatacccttcatttgctgcaactggttgagtatcagtgctataaaaaatagatgatggaaaaccggagcccttgacagaaatacaagtctgctgtgtgtggcttgtgcaggaatggagcagagagaagcggtggtcttgtctacacatcatacttgggcttcgcccatgctgacaagtggaagcacatgcacagtggacacacgctgtcaggacattcatccctgctggcacgtaaacggcagggagctaaactgctagaattcaagtggcacagaaacttgagcctatggaatatcactgtggagtgggcaggccaagttctttacagtgctctttgcttttgcaaagaggtaatttccaactcaagaatgctctgtggctttggcgtcaagaaagctgaaagtcagtgaaatagagccttgaaggtcatccaatctgcgctgcagcaggaagtgaattttgggagccccaaatgcaaaataggcagctcagcccaacattaactcagcccaacactaactcagcccaacattaactcagcccaatattaactcagcccaacactaactcagcccaacactaactcagcccaacattaactcagcccaacattaactcagcccaacactaactcagcccagcaccagctcagcccaacgctaactcagcccagcaccaactcagcccagcaccaactcagcccagcactaactcaacccagcactaactcagcccagcaccaactcagatcagcaccaactcgaaccagcactaactcggaccagcactaactcggaccagcactaactcaaaccagcaccaactcaaaccagcacaaactcagcccagcaccaactcagatcagcacgaactcaaaccagcactaactcggaccagcaccaactcaaaccagcaccaactcaaaccagcaccaactcagcctagcatgcactgattctctggcatagactcagactccaaaaatatgtcgagaaagtctaaccaaaatttgcaaaattaggacctgtggtcagtaccttgactaaatatgactctgtctatgaacacaagtaggcataatgtaacataagacagtaaagaggggcatcgttagaaacctttagcattatgtcagaaagggcaagaggactcaagtagaagaaaggcagagagaataacagagggacatgcatgaaaagtacttttttcttcttcagtcctgcaattgcattaggaacagaggtcaggcccaagagctgccctctcctcacttttctttctttcttttcttttttttttgtttttttttttttttttgagggggagtctcgctctgtcgcccaggctgaagtgcagtggcatgatctcggctcactgcaacctccacctcccaggttcaagagattctcctgcctcagtcaccggagctaatttttgtatttttagtacagatggagtttcaccatgttgaccaggctggtctcaaactcttgacctcaaatgcccgccttggcctcccaaagtgctgggattacaggcgtgagccaccgcacccggcctgtcctcactttttatcacatactcctgctcttgtggccctgcttgaacacagcaacagggtctacataaaataaattaaaatacatttaaaaaaaaattacctgctttacttctggtccatagcattggacatacccagccagaaatcatacactgggctggtttttgggagccaactcaaatgcttgtcctttgaggtaagtattagggtgctcgtggcctcccgccccacgggtccttcactcactgaccctgacctgtgctcactttgtctcaccacctacatttcccaacagttcatgtttgatacagctgctggtcctgccaaggctggaggccctccccatccgctgatttgcctttctctgaaatcggcatcttggctcctctgcattatttctgattggacttgtctctctggcttgttttctctgctaattctgatgaagacgataatctctagctctcaggggccagccctggctacacagtttgggggtagtgttcaaacaacccttgagaatcttatttttcaaggctgttggctggcactttagggctaaagcaagtggtgaattaaaacacaaaacaaaacaaagcaaaaaccacaggcctaaataaacatatgcacccaggagcatgactgtgcagacagactgcctggctttgaatctcattgccaccattgattggccacttaaccttgcatatcacaagatgggaataataaggcacctgcttcatagattgttcttttagtcttctatccgtttgttcattccttcagtaaatatccatcgagcacctactactgcccagacatacggatccagaaatgtccagcacagattaagaggccacagcctcgtggattttccattccagggcatttttcttcaaggatccaataagatatccccctaaactatacatcatagagcctttgacacagtaaacactcacatgccattagctgttatcacggtaacaataaaaataaacttttagcaaaggttttaactaaatgaggtgagaatcataaataaagatatatttgctatagtgaaaaggagagaaaatgtaggaaagtcaggcaagaggaatatttgccaaaatcattcatgaatctgacacattagattctgggcgtgtcctaagccttgacctgtgctacttgatgtgggatttgcacacctgggacacacgagcttctgaagttcagactgtctgcactctatctgacacactccacagctgcacaacttgcagcatgagtcagcaccatcctaacctctaaagagccccgcgggcacagcgaatgcacctcccagccctttggacgtggtggcgaccagctggtttcctggagaggcatctcctttacacccatctgtgaaagaaatctagatctaagccttagatctcaaggttagaaagggggtaaggttgaggttccggagtgctactctattagacacattgtcctttttaaattatatttttacaataatttccatttattattttttcgtggcatcctagtgaggcaggctagtttgacaacatgctgcttaggggaaatttgctgttaataagtcttttgagctcactaaattttggtgcagcatgaaaacccagactgttttcaactctctctctggcatacccgcttgattcctgatagggctattaattttgcgcagatttcccaatttgctccccatttgctacctgggatggtgaagaacagacaaatagcccttcggaagcaaaagcagtcccaaaccaggctgagtttcgtgatggcttcttccacattgtccttcattgctgaggatgaaaacatagagctaaaaactgtgatacacaatgatttatcacctcctttccatgtacacacctagtagtttagaactctgttagcttcaaaatctattcagtcacattgcattcccctccccaactcccacaaattctacatgaaagagggttcaggtagcaaatgagtggaaggacagggcaaactaagactctgatggtgagcccctcctcctcctgattcagatgatttcttcctcctcttcctcctcctcctcctcttctggttctttcttctccttcttcttcttattcctcttcctcctccttcttcctcttcttctatcttctttcctcctcctcctccttctattttctttcctcctcctcctcctctttctcctcctccttcttcttctccttctccttcttctattttctttcctcctcctcctctttctcctcctccttcttctccttctccttcttcttcctcccctcctcctcctcctgtccccctcacctttcccctttccctcctctcccatttccactttcttccccttcttcctccttctcccccttcctttcctcctcctcttccacttccccctttctcttctccccctcctcctccttttcctcttcttcctcctccttcccttctctctttttttgttatttgatctccaattttcacttcctaaaatttcatatggttggatgctattataattattcaattacacaatgattacatgtgggctggtggttttgaaacaatgtaccccattgtatgcattattgcattcatgtggaacttgaactgtaggaggtccatgcaggcttttccagggtccccaagagtactttgtgggttttggatccaggtttctgtttcactaaatcagcatattactctagtctacagtgtactgttgggctagaaatagtccattgactattttagactctgcatcacgaaacgagatctatggttttggttgaatttcatagaagaatattgataaattatcattgttcagatcattaatcttctttagctcaaatcaaacaatgaagtgatgttatcttgcaaaccatgcaggcaggtggtggcactaatgagcctgccacatcggattaatctttgaatgttcagaatctcagaatgagaactttccacaaattcaaaactgtttgatgaactgacaatgtccaagtccaccaaatggtccaacattcagagatgaaattatgtcatgacataagaagcctaatggaatgaatggccactatgcattaaagaccagaatgtgaaaacctggctcctaccattcagacttccctgaaattgtgaaacatgattttccccttcaccctagggaagaccctctggcaaaggcacattcactaagggtgagccttcttttggattgggggctcagaagagagagtcatattgaagtcgcccaaactgttctttgccctggctgcccgctgactttgttaggcagctggtgctaaggagagggtaaagaaaacagaagacacttgtgggccggctcagggatggacagtacctggccgctctccctgtgtgatgcaggtggcttgttctgaggtaggtgggcatacaggcagtgagtacatctccattgcagcgggggaaggtggatgtgggactaatcagggatggagagggagggatgctgcaaagatgcccgagcaggtgctgtcagtggggactagggaagcagtgtctctatccgagagtgcatgccggtggtaggggagcaccaacctgaacatggccagtaagaacacaaactagacctcccagattctcccgcaagtaaggagagatcagggactgttccaatttttggcgttcatattttttagacagttgtcttaaaaaaaatgcctgcttcacttgcgttaagaattaactaatcatggtccagacttatgctcaggtagacaaggaggactgaagccacagtgggctccttccaacctcacatcacatcttcctcatagcacctgtgcacccgaggtgcagatcctgatttgatggcgacctattacaaatttccttagactgcaagcaatcacactatacttaatagctatatttagtagaatacttagattaatacttggagagaatttaaatttaaatattatttccacagccaaaagacaaaacagcaatagacaaatgcattctctttttagttttcttcaacggatatatttcatttttaagcctatctaccccctcccccgatttgaagacatccctcgggctacgtggggaggaaagcctgtgtgactgatcgctgcagtgactgctcttggccatgactgttactgccattttggcctctctgaaaagtgaggcagcctaagcctcacagatatgtttcctggtcacatttttgttgtctctacagaaagagaagcaaacgatatcaccaaagtcctaactctatcctcccactctgtgaactacagaaaaggaagcagcagaagaaataatagagggaataacaaagtgacagaagcatagagggaaaagcagcaggtggcttttcatcaaggggcctttgggtaagatttacaggagacaatgttttctctgcgcctctgggacttgaaaggtcatggaaagaggactcactcgcgacagaattcaaacactcgtagttgtgtctcaaagtcctccgcggacatcaccagaaggcatggtttcaggggtgtttttcagaagggcgatggatttctttggatccacgtagtctctcttatctggttagagtttcttctttttctttttgttcttttttgacacagagtctcactctgtcgcccaggctgcagggcagtggcaccatcttggctcgctgcaacctccgcgtcctgggttcaagcaattctcctgcctcagcctcccgagtagctgggactagaggtgtgcaccaccatgcctggctaatttttgtatttttagtagagacagagtttcaccatgttggccaggctggttctcgaacttctgacctcaagtggtcctcctgcctcggcttcccagagtgctgggattacaggtgtgggccaccgcgcccggccttatctggttagagtttcttaggtgggaatggagttagcagtcccagaccaggccaagttaggacaagctgagaaatgcatcctgtggttgacacatggtgaggaatacccaagcaaaatactcttgtgtgaggcttagactctgtaagaatctaccactttatgaagagactttcttctcccatctaccagattttccaccaaatttgttgcagccttgttatgggctgaattgtgccctcttaaattcatgtatcgaaggactggccccctaggacctcagaatgtgcctgtgccctgtatttgaagacagggactttaaagaggggaaaagttaaactgaagtcattagggtgggccttaatccaatctagctggtgtccttaagaagagtgccgggcgcagtggctcacgcctatgatgccactgcactccagcctgggcaacagtgtgagacttgtctcgaaacaaaaaaggaggaaatttggacacacaaaaaagacaccagacaccagggatgcattcatagaggaaaggccatatgagatcacagcaagaaggtggccgtcggcaagacaaggaggaaggcttcagaagaaaccagacctgctctcaccttgatcttggacctcgagcctggagaactttgagaaataaatttctgccatcaaagccaccagtctgtggtactttgttatggaagcccaagcagactaatacaacctgcaggctttaaacgatgaacaagggatgtgactttattgtaggaccagtaatttgaatttcttgcaaacgcttgagtgtaagcattagtcaatagtcagtgatctgactggaaagaagcagagggcacaagttcatggcagtgtgctcaggggtacctggcccctctgtgaagagccccatagaagacaaggcacttgggccctgtctcaggggcagcacaagcttccaggacaccaccgtcactggtcacttgctgctccccactgtggccctggacagatgagtcaggcccatggtggtcagggcagtggtttctcctcgtcctcccccagcctgcactactccgtgcctggagctgtgaaaaattggcctttgctcgggcgcggtggctcacacctgtaatcccagcactttgggaggtcgaagtgggcacatcaggagctcgagaccagcctggccaacatggtgaaaccccgtctctaccgaaaatacaaaaaattagccgggcacggtggagggcgccggtaatcccagctacttgggaggctgaggcaggagaatcacttgaacccaggaggcggaggttgcagtgagctgagaccgtaacactgcactctagcctgggtaacagagtgagactcagtttcaaaaaaaaaacaaggtctttgctgcttccacagatgctcacatttctccctggctcattttaagctgtgctaaaatctggtaacaaagcttgcttttatttaaggtacattttgtaagttttcgggtggcccactgtaaggtagagagccctgctcttggtgacttgctttggaactagaaaattagcatctagctgtaccatatctgggcacatgactggggcttcatcaggtagggctgggctttcatgaagtaagttgcagctcagggcctcggcgtgcgaggagtgcagttgctgtgtgtgactggctctgtcaccaggagccccgcgtattcttcagggagaattttcaatcatgctggttttgatttaggcaatatggtcttgaaaatattttcatagtctagtctccatcaatcttattcttccacactgacatctgcttccagaatttggagtaaggcgagctgggaagtagggctctgaaatcttgaaggactgcctaagcccccccaccacacagaagcaaaagcagcctccacaggatgccagcttagcaagggaggcctcacgagcaattttaaggacctcagcactgatgacgagagatggtgtgttacggattttgcatctgcagttttgccattagtggcattttaggaataaataaggttgatatgttaactacctcaaaataattttcccattcaattagattttgttagtgaactcactcatcagtttggatagttcaagtagtatactgaaaaatgatagctaaacctggcttatgattagagctggtttacattttgccttcggcaagtggaggatttccctaggctgtttctggagcctcatttattgatgagcttctgtgccctactccaagaagcacctttccacctgagaatgaggggccccatttacaatattcttggatgaggacctggggaagaatgcaggagagccccaagctaagatggtattcaaactcagagcacggcagaaagttcccaaaaagatgttagaagtatggctcggcttgctgctgttttggcttttaaaaaaagattatagcaagaaccttttagggaactccacagccaccagtagggatcggcaggcacattgccccagctaaccactggagtggtgttcagggagggtttgggatgtggatgctgctccaagccatctgggagggagacaggtgcagggacagtcagcatgaaagcaactggggactgggattgccatagctcaacagcctgatgatggcctgaggttgttgccaagagcagctcctaggaactgctccttctctgagccaccctctgggaacagcagagctgtcagagaagatttaattgttttgatcttcctgccttcttgatatcccattgagagtcacccttcagggagaaggagatagagtcgtcattttgtattaagcaatgacaagaaagaaaaaaaacttttaagatgaaatcctgatgggattgaaaatcaattaatcaatcacacagacctctgattcctggtcattctggctcagaattacagacataagtgtgtgacactgtgttaccttagggtatatggacttttagaccagtagaattttatggagagaagaaacagtaaagatacattagttcaatgtatgcattagtgtttaaggtaataattttggtgcaaaagcagaatgggccagatagactagtttgccaggagtttatggatctaatgaaatagtttcagttgctcatttagagaaaacaaatgcagaaatagagaccacagctcttaatgcaaccaaagagagaaaatgcatgctgactaaacgtccacccattaggctccttattaacagaaatgagaagttattctttggggactgttgctctcctgctgctctgtcatggggctatggcttcattttccatctataaacaccaaacactggaaggttggttgctaagagaactcactggggaaacagttaactgttcaaatgtccccacttacgtggatatgtgcaaataccaccctctgttcagatctgcatgttgcagaaagacactacgtgcagtggactaaagctggacgccggagtgtcccacagacccaggttagcacccctgccctgccactcactagacatgtaactcacagcaagttcttaagaactctttcgaaactattcctcatgggcaaaaagaaaaggatggcaaagcatgattttttaagtgttcactgtgtataccaattatgaacaaattgtaaaatcctgcttcatttcatcaccatcaaaccataggcttaaatttgctcataatcccgacaacactgtgtgtttggaaacagtggaaacaggaagaactgagagcgggtctgcattcaggatccacgtggctccaatcataggtgtgaaaagactcacatattccgtagcatcataggacccatcagagtataacagctaagattattacacatgctgttccagtgtcccactcacactgcaccacagaaagctctgcagtggatcaattgctgctgtgcagtccccaacatccgatccttgctgaagtttattgattaagctggctaatacactccttacacagttatttggtaccatattgaaaatacattaattctaaaataacaaacaaacaataactttcaacctctattgctagtttgagaataaaatgctccctttggtgcagtgagtagtgctcatgagtgacagacaatttgaataagaaaactgggctcttgatttagatttttggctgtcaattacatttggaaagttgggggtaaggtacaagctgcttaggaacccttatttcttccccctgcccttttgatatcatttctctctcttctccttgaccttaggtgggtcaaggagttggaattcaaatcacatgagcaaatagcattcaaatgtacatgatatataaggcactttagcgatccaaaaaaaatttacaatatagtttctgtctcaaaaagtttattgccttgtttggggagacaaaacataccacacgaaaagttcatgatacaggatttaaacaagggctcaacaaatcatagaggaattgttatataacatgggttcttccattaaatggtaaaggaatgctcttagctctaaatactaaaaaaaaaaaaaaaaaaagagaaagagagagaaattcaggaactgtccaggtaggattgaggtaaaggacagggacgaaatgaactttttgagaagcatgtaggtggctaagtcagtttggatgttaggaactacactgagaatcaagagatgaggaagaccaagggcaaaccgaaacgagacaggctgagacaaagcgagatgagacaaagtgagaagagatgagacaaagcaagatgacagaagtttggtgatcatcttggacattttgctaaattaggtgaaaaaggagcaagaaacaggtatccttaggcaaaggcaacctctgaccaagcttgatgagggcagatgaggactgattctagcatgagagggaggtgcaggagaggcagctgcccagtaggtcctcagaagatggtgaaggcaccactccaaagagtgtagatacatactgaccacaacagagacagaatgtgtgtgtgtgcacacgtacacatgaacgaaagaggctagggcatcagaggggagaggaaatacagggagaagggaagtcaaggaaagatgcctgacattccacaggagaagcttctgcacaggagcagtggggataacaactccaagatgcactggagaggggtttttgctagagagtcagcatcgcaaacaagcagagtacctttgcattaaggtgcgatttaaaaatatgttattatctaggatagtggtgctcaaccatggcgattttgctccccagggaacatttgacaactgggagacagttttggttgccacagctggcagtggggatgggggtgctaactgccatcgtgtgggtagaggacagagacgctgctgaacacccagcagcacgcaagaagatcccacaacctggctccagatgtcaatggcaccaaggctgagaaaccaaatttagaggatcccagggaaaacagaaaagtatcttaaaaataaacattacccagtattgtacagttgacaaatgttaacattatgcatttattaaaaacaaatgtaagcaacatttattactgtagttagaattttaaaatatgtacatatactgcagcagacttttatttatttatttatttacttatatgagacagagtctcgctctgtcgcccaggctggagtgcagtggcacgatcttggctcactgcaagctccgcctcccgggttcgcgccattctcctgcctcagcctcccgagtagcttggactacaggcgcccgccaccacacccagctaattttttgtattttttagtagatatggggtttcaccgtgttggccaggatggtctcgatctcctgaccttgtgatctgcccgcctcggcctcccaaagtgctgggattacaggcgtgagccaccgtgcccagccctgcagcagacttttaaaaagatatattcagcttcatcacccttttcttaaaaaactgaaattacttctgtcaaaatcatgccgatggaaagcaatgacatgctaagcacagtcctttacagaaataattcagatagaataagtggaaaataaccttaaagaagattgaaagaagcgacaacttaatgaaacccagctactggttccattttctatttatccttccaaattgctaatgaattctgacccatttagtcatgcaaaatatatatcctgaagaatctgtatcccttttgaggtacttaatggatgtttagccggcaaggaaatatggcatgcctattattcacaatagttgatctttaaattgacattaatatgccacacttagagtactggggaaattctagccaaatatacaaagccgctgctactaagatgaaagacattccacaaggaggaaactgatctcagaaccagtgaccacggccatgagggcttcgtggctgctacagcacgttagccataaacaatttccatctgaggaagtgcattcagtgcagctgctgatgcatagtaaatatttgatcctaattggacctaatgatgaatttcaattctgtattcaccattcttttataggacaccaacccataaacacaaaaaataaaaaaggttttggggaacatttttcatttccttaagtcatttaataatgatgaattgcctgggaggctctttgaaaagatagatgcggctagaaagttactgggagaattagaaattgcataaggattcaatgcaaaatactttgtaaaaagaaattttaacttccttgtttaacttattttaattcattgagaaattaaaggtaaaatatactttataaaaatataatctggcaaactttaatttgggtaccaatttggaattcgattaaacaggttcaagtctatttttatagattataaaaatgctcctttcagataaagtaaaaaagataattttgttttgggagttaaaagaatcaatgtctgtgcatcctttagtctcaatagaataactcttattctatcagtaggcagaaatgtttaagcagcactgtccaaaagacatacatgtaatttaaatgcttttaaatggaatagaaaagtgaaattctctggtgttttttcttgtattctttcaaaatcatagcaccaatggatgtgagtttctaacattattcacctatctttttaaaaatttacccctgaatgcttatacactgctggtggagatgtaaattaggtcaaccattgtggaaagcatttggtgatttctgatagaacttaaaacagaactatcattgacccagtaatcccattattgggtctatacctaaaggaatataaatcattttatcataaagacacatgcacgcatatattcattgcagcatcattcacaatagcaaagacatggaatcaacataaatgctcatcaatggtagacttgataaagaagatatggtatatacacaccatggaataccatgcagccataaaaaaggacaagatgatgtcctttgcagcaacatggatggagctagaggtcattttctaagcaaactaacacaggagaagaaaaccaaattctacatgttctcaagtataagtgggagctaaacattgagtacatatggacacaaagaagggaataacaaacaccacagcctacttgagggtggaaggtgggaggaggtgagggttgaaaaactacctatcaagtactatgcttattacctgggtcatgaaataatctgcacacaaaccccccataacacacagtaacccccgtaacatgctatcaatctatctatataacaaacctgcacatgtacccctgaacttaaaataaaagttaaaagaataataaaaacagaaagtttacccttgataacacgttttatgtataatcactaaatctactaaggcacatttgcatattatattatagagtctgctagctctacagtttttccaactgtgtacagtcggccaactaccataacccacatcttccaaatcctagtggcttaacaatggaaaatggaatatccagtgcagctcagtggagtgtggggtggggggctgtgttccaaacagccatttagaaatgatgctccttgcagctattactccaccataccatggggtctcacagtccttcacatcccctgagtccagctgttagctgagaggagcgagaatgtacaggatcaggtatgggtttcatgaggcagacctggaagggcaatacatcacttctacgagccagaaattgtcacacgattccttccaactgcagaggaggctggggaatgtaatctacctgtgtgcccaggaggaagggaaatgggctttgtgaaaatgtgcagcattatctctgacaaactggcaggaaaaaacccactaatgtcatatctttatatacctgagagatgtatcatcaatgaccaattctctgcccttggcagaatgccgattggaaatatagctttggacagggccaatattaggctacgtcaagatgaccagcatgtgtcctggcaagctgacaacagactctgtcaaacagtcagcatggccagattaccctcctggtcttccaggcaatcatgctcctcttcccactttgggactgacacctttgcttcccatcgcaagcacagccaattcactgaaaagagttgactagtgtcacttgcattttcatctgaataagggaagagtcactgtcacttggaatgtgaccatagactccactatccttagactacatcaaaattatgctcctttaaactatttggaggtaaaagacacaagaaaataataggcaccagaagcatacacaaatgtgagatgtttggcatggaagacagttttctactcataaaatacacaacttgaaagttggtataaatatcagatcctgaatcctgccagccacatttttactggcaggcatagcaggagacagcacaatgaaaattctcatagaggttggaagtagcaacaagtcttgaaaactcatttgactatcaaggagggctagaccacacattaactcagaccacaaaggctaaaggtctcacttagactctcttatcactcagcatttagaaccagaagaataatcacattcattctttcaagactttccctttaactatacataagaaaggaaatgtctttacattcctcatatctcacttggcataaaatctaatgtttgttcatctcacttatcttaatcccatacctcctcatgtttattagaagaaaaaaatgtaactctgcatgtcagaaaacagatctgaagtaaatatcagttaaaatgcaaaacaaaaagcaaaagaggtctcagatttttacaaatgttgttttatagaaaccataaaattgaggtaacttgatttaaaacaagtgaagacatccaagaattttcatagtatgcaagtgatctggactggtggttggcagcattgacattaaatcagctgaattttcattgacagctcattagaaagatgttccaagaaaatcgaatacaagatgctcaacagaagctcttctctatgcagttcataactgttattttatgtccttacaagtcatgactcatattagaacacgtaactctgtaaaatttaaagatttttataaatcgcatgaaaaatttccccttagtatagctataattttgctgtttatgtcacatggatttttaattacattttccaaacacgaaggcagtcaatttgataaggagaatatttcacaaaattcactcttctgttctaggatcttggttctaggtaactcattctccagaaagaaatcatatcagtcagttcacaaaagaaaaaaatatttaagccacctaaaaactcaagtactattcattgttaattttgtctggatctttacattaccttaactatatggtcagtctataaaaatgtatctgtacatatgcttacaggtaatatgtaatataagtaacatccagggatggatcctgaagcgggcttccatttttttttggcatttgtattttaatgaaggttaataaaagccaaattacagccaactgttaaagctttttttttttttttttttaattctatggtataacaaaatcagttccaggtttttttctgaacaaatgatcctttggtctttcccgtggcatgctcctaaaacaactaaaacaaccctctacgtctaatcagtcacctaagatatcgagtggcaagtctttcacatttgctgcttataattcctgaatggtccatattgagtattttcatttctgggtaagggaaaaagcattttggtccattaattcacccgctcgctcctggaggacgttaaccaattctgctatcacaaagacgtgagtggcatcaatgtcttgcatgatgaacttcgcaggcttccatttttgttcactttgggatggttttcctgtcgaactgcgtggaaaagcaggaagcacactgtccactgtaggggttcctggtccagcagaagactttcagatattgtcaagtttagtccacttctttggatctcagtggcttttattctgacataagatatttagatgttgcaagcccctccaaggaacactattttataaacagaaacatccagttgtgtggccatttcataattagcttctgaaatggacaggaaatgcacctatgtgaaggaggcagagcagggcaaatgcctttactgcttttcaaattttgatttccgggtaggaaacacaactaaacctcctatcaatttttagtctttacctgtacatttctaacttttagagatttctgttaatgttcctttttcttgttaactttgtatttgatattcaagaaacgttagaaatgaatgcctgtataacataatttcaagatattaaaatagcatttatcattaaggccacttgctttataccaacatcacaattccattttaagagttattccatgtcctgggaaattaaatcactgtctcaactccttccaggtgacataagaagacatggaggcatgatggtctagcagagagaagcctaggtggtatggattgttccatgttgtggaacatattacagagacaagggtatacattagttcagcaatttcgagttcttaaaacatctgctttctctccagctagatctatacaactggatggagaagatcaggcttaggtgttctgtaaaatttaaaaatgagacccctaatggcagctttcctattttactcatatttttggaatattttcaagcaattgctgatacaatctggtgagccactgatggaattgagtgtaagaaatggaaactgctatggattgttaacatagagactgatgaccagattacaggtgcatatattttgtttatctagagttgtgtggaggctgctgttcagagcattgctgacaccagggcatgaaactagtgacacagttaatgaggctggtgatgaagaaactctcgggtcctaaccgataatttcacatacctagtaaatcagcattatttcatttgagttacacttgactttttaaaattaaatatcatgcgaaagactttccagaattacagcattccaccaaattgctctagccaggaccccattgaggtccatattgtaaaattatcaggttatatctaagccatcatctttcttgattgcacctccccctctgacatagtttcttctcttggctgtcagcacactgtgcccgcttgccttcctcctatctccctgggcatgccttctcagtttcattgatagggttctcctcctcctcctggcctctcaatcttggaggtttttagccttgaagtttcttagcctttttgtcctctttctgcactcactgcctcattcagtctcaaggctttaaacaccatggagacccagccatctcttgccgtctcctccatttccacccattccaggcaccttccttcctcacctggccgttgcaatagcttcctaattagtctccagcttccaccttccccttcttaccacctactcccttcagtgcaaaagcctcaacctctggcactcaccctttctttctcttggttgcagctatcctggcctccttgctgtgcctcatactggaaggccactcacactttagggcatttgcagaggcagtgccttctgcccccagatgggtaaccctatgggcaacccccttcaacttccttgctcaacatttgaaactccaagctgcactgtcctcaacacattctccagatcctctttaccctgctatgttttgagccccttttactctcttacctactgtataatctcctaacatgtttaccttttactgtgtgttctgcccatgggaatttaagctctgtgggggcagggatttttaccaaggttgttcactgatgtgtctcaagcgctcagaacagtcctttgcctttggacagtgctcggatttgcatgagtgaatgactgtgctctctccagagtgatgaggatgtcaggattgctaggtttagaaatgaagcacatcctatagtatgacagagcctgcagaggagataacagcttctcgcttaaagatatggagtaggcgttaaaaatgatttctgcccaatgtaagaggaggattttccaattaccaaccagaaggagttgcttgctcttgcctcagtgattctcacaataccatatgctatcaagttccattgccctctttgtacatgtgagggtaaggtgctccattggatgtatcttgaaacagaacagagtttgtgtatgtgaggggggtgtgtacctttttctaaggattgagctggatgacaaaggatattgcatatttaacgggtagggagaacgcaggtgcaacaattcacaaaaatctcataatagtgaatgatggtgaatgaatagagaagacctaagaaatctctcaaacgggtgagttctctaggaattgaaagggttttttttttttctgttacagttttaaaagaatgtggaaatggaataatttgatgatattaagctgtggttttgatgaatgctctaagaatcatccccagtgataaatattcaaagataaatggtgatgttttagatagaagtcaatcgttattctattgcctgtaacagggttccttagttataattctgttagttgctctcatggtcttatgttactaatatagtcattatttcaaagcttatcacattctgtaaaatcctgtagtcattagcaataatctaagccaacgttagcaatccattaaggttagacatttaacttctataaaatactctatgccacagcactttcatattcctatggggcaaatttccatcgtagactccacgttggctccttgaaatggtgtgtactcaaggatagcccagcttaggggactccaaatgccatttcaattttaactttatacaacagattctcgttctccatccatgcttagacttcccagctctcaggttcaactctcagatcaggaacaaccatatgtactatgttttgtttccatcgaattggcagtgactcattatttaattactctccatgtgttggccaaatatgaggaaagaatactctgaaaaattaacaaaatgtggctggcattacagccatgcagtgcctcatgcctgtaatccctgcactttgggaggctgaggcaggtggatcacctgaggtcagaagttcaagaccagcctggtcaacatggtgaaaccccatctctactaaatatacaaaaaattagctgagtgtggtggtgggcacctgtaataccagcttctcaggagactgaggcaggagaaccacttgaacctgggaggcggagattgcagtgagctgagatcgcgccattgcgctccagcctgggcaacaagagtgaaactttgtctcaaaaaaaaaaattaacaaaatgcatctgtataggcatcctatgtctgcataatgcgtctacacaggctttgggatgcagcagcattggatagaacaatactgatccctggcaaagatacaccacaaaaaagctcggctgcctttcacaaatacgagttcatgaacacgtccaggaagataaaagtgtgcagtgcattaaaaacacatttccttctcattagttgcatgaggatataaaaattaaatcaaatctgctttgttgccaatttcaagaatgtgactgaggacaaggagcagaagaaagcagtgtcaccaatcctactcggaataatctgtcaccatgttagcagagcagaaaacatttcattttaaatgattgctatttcagttacataataaaagttaatagatacaaccccaaacataagatttaattcattcagacacacatatacttgtgttagtctatgaaggaaatatatcttttatgtcaaaattatgtacttctttgaaatgtagttcaaagtgaagaagaaaactttaaacattttccttcacttttaactccttccatgccccaaagcaaacacctgaacatatgttaaaatacttgaattcatagctgccatcagtaatgtctttattcattcagagattttacttcaatatccctctgttagactttttcctgaatgttgatcttgaaaatctgtaccgaaagcttaagtttttctccaaagtcacattcaacttccatagatcatatcagaataatactcctttgatatttacatagaagcaaatacaacaatatctctataatccatggataatgtatatatgctactatagatagctctcattctgaagatatttttcccaaggcacaaaggccatcacataaattcacctgcatttttagagtggatgttcagggcgatgtcattggagaaaggctatgctcccagtgactgtcacggacaagtacagagtcttgagtaggctctcaacaaatgattgttgtgcttattaattgaagaagaatgatcttatatgtgaatcagaaaggaaggaaattaggagtaagtgacaacgaagcaagtgatttgtgaacattgtgtccgaaagagaatctgaggaaaagggtgttttgaggttagtagcagggctgacattgaatctgagttccatgcccagcagtgagccacaccctttccttactaaggaatctggaaatgttgccagccctgccttttatctttgaaaacacagggctatttatgtctaaacacaatgcactgaatttaccttcattggttgacacagttatctttcctgatcctcaaaacctcaacagacagcaaagtgcacaacttgctatgtaatagaagtttggtagatgggaagtctacatgcaaagctgatttattttggcaagataactcagccgcaaggggttacacggaaggcagagagaatggatgtaaagtgtagtcaggatactactgagaaatcctagtcaaggatgttgcaatagcctgtgaactaggaaaggagtgatattgaagacgtgtatgtaagtagaatcaatgagtagggactaagttggtatgaagaaaaattcgaatgcttgtctaagattctaattctcagtaactgggtggcaccatcgtcaagatccagccctgggaaggaagagcagggtgggagttggaaagtgagttttagacgcattgaatttgaggtactcagaagacattcaaagggaatgttcaccagcttcttggaaatgtgagtctggaactttcacaagagatcagggatagagattagggattatcgtgaaggaagaaacaggtgaactcagggaagattacagagatttagacgagagggacagaacccaagggagtaactttaaggttgggcaaaaaaaaaaaagggcacctgtaagtggaattcagaagatgtaatcagagagactgaaggtaaatcagaagcttccagtgtcacagaaggcaaaggggaacagatttcatgaagatgcgagagtcagcagcatgtaatgccagtaatctaaaagacttgtctccacatttgtttccaataccgctttatgttaattatgtaatatctggtttctcagctttagtaacaatgacatgagaaaattcaaaattattttttgtgtcatttctctcagtgtgtttattattatttaaatatatttatatgctttcatgaactttacttatgaacgagttaagaacatggcatcccaaaatacaccactctggcatattcagtatttttagttaaaggcacttaagaaaaaccaggtgaggtcgggcgtggtggcttatgcctgtaatcccagcactttgggaggctgaagcgggtggatcacctgaggtcaggagttcgagaccagcctggccaacatggtgaaatcccatctctactaaaaatacaaaaattagctgggtgtggtggcaggtgcctgtaatcccagctattcaggaggctgaggcaggagaatcacttgaacccgggaggcggaggttgcagtgagccgagattgcgccactgcactccagcctgggtgacagagagagactctctcaaaaacaaaaacaaaaacaaaaacaaaaagcaggtacaagaagatcactctgaccttccttctgtttctgaaaagcaggagatgacattcccatgtgaaaggtgtcctcccttggccaggtgggaggcatgattcctatgggcaaggaccagaagctgaggctgagggaaacctgtaccacctgctatactggcccttccttcccagccattctcctccaatcacctgccctggcccaagcccccgaccccccacctcatcacatttctgcaatttactgctctttgtctaattccttatataagtggtcaatacaaactgcatctttgggtcttcacaaattctgaaggttttcatgccacataaacttatattaaataaatgtatatgtttttctcctgtggatctgtcttatgtcaatttaattctcaggcacaacacccacgtgccccatcccctaacaaatcctaacagaggagaggtataattttgccttccttacacctagaaacatagaaaccatcttttctttgaatttaatgatttaaaattataaagacttttggcttgcactgaattttcagattacatgtgaaattacttgtaaagaaaaattattcaatattatccattttgtcaaaactcttaaaaagatagtgatgtctaccagctttcgcattttagcataattggaatgagtctatggataaaacaaatagaaaaaattggaataaaaatcctcaaaattaagcactggttcctgccaaatggtaatgaaaagtcactagctttttccaataacattaaggaagtataaatattattaaggaaaagctgtgtgtatataagcttttctgaataaattaaattacacgaaatatataagctacagaatgaagtctttatattaaaaacaggtagtcctattttgcctggtatcgtgtcaacaggaaactcaagcatatccagccatatcactgctctccatagtcctgtagcaactgagaggactgcttgtctgttttactcacttttcatacatttattacataaattctcttaaaacagaaatcctttcttctcaacctgttgacccaaaaccagtgttaaagaggttaagataatgtatacactgctagattcaaagcccattataaattttcataaaacataatgacaaactatttgataacttaaagagtaaatatcagatttataacaatgccatacaaaaagatacacactacaaaaaccatcttgaatgtaagtttacaaaagatgtttgtctgctaaggaactaaattcattttctctttgaattcaccatttatagaagttttgagccctagaccaaaaatatggaagtataggccaaacattatactatctgtgataaattttcagaaaatttgggctgctttaagtaatgtatttatgttttacatagttcctcaatgttagcagctgtgaaagatatttacaatttacttcctatgtagaatttatcttaaatttaagaaatagcaaatagagggaaagatgttttaatgcaggtctttattgagtcgttcaaatgatgaagagaataatataacaaatgtccatgtacccatcatttatcttaaaatagaagatactaattcaattaaagcctgctgcacatgtctctaattggaagtgccttcctacctccagaggtaaccattatctgaatgtaatatttatcagtccatatatttctttacattatgatgatgtaggtttttaatgaatactctttttaaggttaaagtaattccttcctttgtctggttgtgagtttttatcttgaaagcctgtgttgggtttcatcagtttttttttctgcactgattcagactgatctacagtcagaatgtaaagttttaaaccacaaaactcatatgattcatatatggtggtgaaatgccttcaataaataaatgaagcaatatgaaaagaccctcatgaaaatattttattcaatgaaaatgaaattgctttaggcattaaaagtagttatctatggtcacctaaaacactatttggttttactagtgaattcctcatttccttcctttctgatttatatgttagataattcttaaattaataagcacagctgagggttaaacataccaaatagtcttctgccaaatgtttttacacctgtggttttaagtattttagaatattgattagaaaaattatacatgtgaacataaaaaattatgatgtggacacaaatgatttttaacatcaaacgttttttaattttgatatccaaaatacataaaaaattgtaaggggataaaaatctcactgcaatcaagctttctcacctttgcataaaaattatcactttgatttcagacaagtttttacaagctgtggttattaagaggtggatctcaccatgtgagacaaaaaaacacgtgtgtgccaattctaaattaatttccaaatatgaaatacatccgttaattcttaaagatgctcaaacacaaaataaaatatattttgaatgtagacaagtaggcatcatcaatttttttaccacagaaaaaggtagtattttattactttttccacataaaagtctacctctgaatttaccttttcactcggcttttcatttttacttgtttttttagttttccatcataagccagtcttctattatatcaatacaaactttataaacttgtttacacttaatttttgtcttattctgccttgaataaaaatagtcatagtggatataaaaagaaaattctaatgatttaatttgatgtcagaaatacaatttttaaagaaaacatcgaatttctgctgctaagagatgtcactctgtaagttttctccaaaagggagtgttttactgccctttacaaacagagggaaaaaccattttctacttcagaatgaggcgtggatcccttagtctgacatctgacatccttcttgaatttgcactgaacctccatctttatctccaacaattcctggctgagtcccttcactatgggcctactcatagatgtgcacagaaatgaaccatctggtgtgccaggccacaccttccaacacttggctctgctgggaccacaaggatgggctttctcatctcaccgtacatttagatggccatattgggtttcggatagtctcccattcttaaccatggtcttcaacagtttttgttttaaaagtgaatactcttatggtaaaaaagataaatgtgaaatagaaaatactgtagatctacagatcaaagttatatttgaaaaccacatttaattgtatattcacatatttttgtaattcacaaaaaatatacccatctgtaacttttcaacattcttgagtgttttgaaaattaacaatttgttctaaaacttgagagttacatagttttgaaatatttcaaagttcagttcaaacacacacaaaactcctggataccacctggagctaaattcaataccaatcgaattttttaggtttgcaaaattgaactaaagaagtaccactgagttgagggcatgtcaagatctagcattaaaccaattcagatttgtacttggaccagcatattccaggggtcacagtagccaacatgcaatgccttaaaaatacatgctgtacgtgtgtttttctattaagctaaattcaatctctttttttttcaggcataaatttatttgagaacaagagaataatgtttctattctatcctttctaatatcaagctggtctttaaaattttttttaaactgtgtcaatttcctaactcgattcttttcggtatgccgacaggttatttcaaccagcctcgtcctaacatttggctcattatactattggcacattcatgtctttctctgtaatcttcacctcccgtgcttgtttttctctcagtgaagtacagaaagccaaaacttaggatttgaaatgtcgtcttcactgcctggaccaatggttttcttgttttattgaaaatgaaagagctggccgggcgcggtggctcaggcctgtaatcccagcactttgggaggccgaggcgggcggatcacgaggtcaggagatcgagaccagcctggctaacacacggtgaaaccccgtctctactaaaaatacaaaaaattagccgggcgtggtggcgggcgcctgtagttccagttactcgggaggctgaggcaggggaatggcgtgaacccgggaggcggagcttgcagtgagccgagatcgcgcccctgcactccagcctgggcgacagagtgagactctgtctcaaaaaaaaaaaaaaaaaaaagagaaagaaaatgaaagagctatgcatttggtgaaataataaaaacacaacctttcatctctgataatactgagcattaaataaaattataggtgcaattattttacaggtaagttttactttctaggacaaagtctagatacacagggcagtactgactgccccgaggcctcggtctctgcaccaattggtctcatcttatttcaagtgctctcgtctttgtcctcctcttctcagttacatctgtgtaacagggtctgtccagcgtttcatttctctaatcaccttgaacattgctcagcagtattactaacacatgagcctgatggtgagacttttgttctcaataaataaacacaaactcaatgcaccttcccaggggctttgcatgggacctaaatattctttgagtcctgagttttctctcctctgaatctttgctgtccatcaccttctgccatttgaataccctcttatccaaaccaaaatcctaattccagtacagcttttcctttgtgataataccactgattttctagtacaatatacgcccagctcccaattccagctctgagctcctagagttctgggggacttcacattgcccatcttcttttgcagagtgttatatccaggtgtatgtgcccagctctcctaccagactgttcatctgcctgtggcacggctccttgcacacagtacgtacaaggcttggtaacagaatcccatgttcattgaagggcctagactgatcacattttaaataatgcacaatgttctcacgtctatttaaggaagaaacaactgatttctatcttttaagattgcatttcaagaccatatcaaaggctttgaatctctcaccaagactaacaatgaaaaacaaatttggccaagtgcagtggctcacacctgtaatcccagcatcttggaaggccgaggtgggtggatcacttgaggtctggactatgagaccagcctggcagcctgggcaacatggcaaaaccccatctcttctaaaagcacaaaaattagcttgcgtggtgacacgtgcctgtaatcccagctactcaggagggtgaggcacgagaatcacttgaacctgggaggcggaggttgcagtgagccaagattgcaccacagcactccagcttgggcaacagagtgagactctgtctcaaaaaaaaaaaaacaaaaaaacaaaaaaaaatgcaaatttgatcatatttaattgaatttgtttcaaagtaagggaaaggggagtatgcaagggcgacatgtggcctgttcttctgaaaaagcaagaaaggttatctttatacaccagatcaaggtattgacagctacagagtgaaattccatacacaaaaagaaaattttcttcaagtgaaaaaagtaagtggccaataaggtcacattcaaaaattaaaaatggatgccctggtcttgattactgataccatttttcaataaaagtaaccagagctccttgaagaaataattgattttaggactaggacatgaaatgtacaaaatgatgcgggagcatcttgtagtaccagggaaaaaaaaaagtcaacccttagcatgaaggtgtaagtcaaaggcacatgggagactggagatgcattttggatttcagattttttcagattttggaatatttgcatatccatcctgcgtcatcttggggacaggacccagatccaaatgtgaaattcgcttatgttatatgtagtgtatccaaatagcctgaaggtaattttatacagcgtttttaataattttgtgcataaaatgaagtttgtgtacactgaaccgtcagaaagcaaaggcatcaatatctcagccacccacatggaaaatctggtgttgtttggcatcaccatcattcctgactgaatttatttgctaccaataagcaatcattttcctgctcttactcagacgtgagtacttaacagtagaaaatactactatttttgtttttgaaagagtcttgctcttgttgcccaggctggagtgcaatgacaccatctcggctcacggcaacctgtgcctcccgggttcaagcaattctcctgcctcagcctcctgagtagctgggattacaggcatgcaccaccatgcccggctaattttgtatttttaatagagatggggtttctccatgttggtcaggctagtctcgaactcccgacctcaggtgatccacccgccttggcctccgaaagtgctgggattgtaggcgtgagccactgtgcccagcctaatactactattttttaaacagtaaagatacatcctattaatacagtgaaaaataatgtgtttaggtaactgggcagcacaggaaaaagaccgttttcctttctcagctgttagacaacagcagcaacaaacaatgcaggctttcagttgccacctatgatgctgtgtttggagtaaagggcactgtacactgtattttttttcttttttaggtgataagaaacatctgaagcagttgacagatcatgaagcgggtcctctgagaaatgagaggcattctgccggatggcatttttttttttttttgagacgaagtctcaccctgtcacccaggctagagtgcagtggcacgatctcggctcactgcaacctccgcctcccagtttcaagtgattctcctgcctcagcctcccgagtaggatggcttttaaaatgttttctccagcgtcatctgcctcattaacagcgatttttgtcttagaagtctctctttgagtttctaaatggacatgactgcttattctgttaggaatgcactccactctagtccttcaattagcccatcacattgtcactgtggcatctgtatgcacattttctgccgtgttaatgtcatcttcattgtccaattgtggcatcatgttggtgctcaaaacgttgcagattttggaacattttggatttcggacttttagagtagagatgctcaggctctactacttcttatttcagagaaaaacataatatccaaataactaataaaaacttggttggagaatgcagacttctagaaatgactgtttaatctgcttatgataaataatcctctttgctctactgcaaaggggagactactgctgttactgttttgtgtcatcatgtcctgatcagacaaacactgatttaaaaaaaaaataaaacaagtacattgtatatgtaaatttagactgtaataatatatccttgagaaataaatattatatggactccatttttctctgacagtcaattaagcacaaaaagatttttaaagcactgatttttgcattcttaaatgacaaatgaagtcttcttgaaataagatttttaatgatttagagaaatatttgcacatacactagcttggtgttgattctcaatttttaatttttttttaatcctttccctggcattttcatcgtttccttttttttttttttttttttttgagacagagtttcactcttgttgcccaggctggagtgcaatggtgggatcttggctcactgcaccctccgcctcccaggttcaagctattctcccacttcagcctcccaagtagctgggattataggtgtgcaccaccatgcctggctaattttgcattttttttttttttttagtagagatggggtttcaccattttggtcaggctggtcttgaactcctgatctcaagtgatccacctgcctcggcctcccaacgtgctggggttataggcgtgagccaccacgccaagcctatccttcccctttttctgttttgttatggatgatgaatgtcttaaaactactgaactccttataccttgatatggttagtgagagcttccttgtgggatggttctgaatgattttctctagaacctccatttgaacatcttcctttcctctgctcactgtaccagtctggggctatcaaatcacatatgctgataaatgctacactatgactggtgaagccagtgctaaaaagcagcttctacatatggcacttccaaattgtgttattgctagcttttccagtgctttctctactagggcatccactgcatgtcacctgctaaaatgcaaaccacatctttaatgaaagtctgttttattgaatatataagtgactatgaaatttcaaaatgaaatttgatggcaatttaattttataataaatctatatctatgtatctcaccaaagatagcctaaatctttagtgaggccacacattcatttttatgaaaattcttcacatgagtttagaaatctcccaactaagaaaaggacaagtcagatcttagtgtcctgggtggcttagcatttcataactgccagagaaccatgaggaccttcctgggactgactcatgggagttatctgcaatgattttatgtttcccaatgggtcatattttcattggagattatttactatgcctggaatcctaatgcttggtgtctctaatgagaaaaataatacaaaaaaattcaatattcagccaacacaaatttatatgatctacaaaagaaaggaatgttttcagatcctgggcttgattatttttgttttcgatgtgacagatttgctgaacaaagcttacaaatctcccttttcctctctgctcgctactaccccgacccagaaaacacacacacaccccttcccaaccggggaccatctgaccgttcacacccacatcaactctgggtcgccatgcttttctgagggacattgccttcactgagagctcctttattctcagtataccttacattcccagccacagtactgaacttctcaatgcttgcaatgttcccttggagtatatcagttgagcaggcggaaaaaaaatatctggaagtttattatttttccaccaatatatttgacaccacctttggagagggaacaaaaggcatactgtcaagcggatagacctggacaaaatgttactgtttgttcctcacgagcacagaggtatatttaagcaaagaaaggcattccacggctctcccgggacttccttccttcagctgaattataccaacatgttcacaccactgagggccaggctgctggaatttaaaacgcagacctctatctgccagtgcttcgatcccacggctacaaacattcacattaggattgaacctggctttcaaacatcatgagataaatgggagtttactgggggaaaacgtgtgccctcatgaaactatagtagaagatgcggaaataggactgtccctgttcagcagattctatactaatacaataaagcctcaaagtcaccagaagtcacctggccttgggttatgtttcaaatccaggctcactgacattcatgaaacctttggcaacacaggccaagtttcgtgcaaggctgggtagaatacttctttcatgtggaagctgggtgaaactcggtggctttggctagctttcacctgaagtttcacattcaaacaatccaaagtttcaacgtaaaattcaggggtgaagagaaacagaaagaaaaaaaaaacaaaacaaaacagggggaaaatggcttgcctgggaatggaatgatcacctaccattctccaaaaagatttcatcctggtgccatttaattttgccgctggactatcacctctagcaatatatttgcactcagccctgcagaccaaggcttcccagtactaagggagagtgagtattctagctagacgcaccccatccccccaacaaagcccaggctcaaaataacgggaggatttaaaatggtaaccatacacataaatgcgatgattgacatgcttcttataatgtagatttgaaggggaaaagtggcaatgaaatgcccaggtttgggaaacttaaagattagactgaacatctctaggtttttctactataaatccaagttctggagattcgattgcatctgctcctaatccagggagatctctgccgtagctttctccacagctccgcccctttggagatttgtcctgtggccacttgcgtttgtccttcttagcaaggtgcagaggacggggcagactgcgtcagcgctgaggagctagcgtccttgactgggacttaaacagtctcctgacaggattaggctcattctactcctaaccttcaacagaacacgcagggaccgtttgccagggaacgtcaaactctgtatttggctgaggactgtgaaaataccttgtgcttggggtgggaaagaagaagggaacaaatgtcacacacacctgtgctttcttcacaatgaagagaatattccaaagctgattgaatggctagtaagtgctacattttgcccattttaggaaatacatttttaagaaatcccttatcccttacacagcagaagtttcactcgtaaaacagacttctggctactaaggttttttttttttttccagttttcttttgattctaattttctttttctttgttatttcttcccgtttttgttactcagacgatccttatgtggttaaaatgcatgctttcctttgatatgtgctctgtgataccaataaacttttctgaaaaaaaagtatttctgaactccaaagatttcagcatccatgtttttaaaaagcaccagttgggccccaaggcacacggagattctgaggcagcagggcagccagcgcggggctctgtgcactctcatttgctgcttgctcttacacatctgccagacaggggccatgaactgtcctgaagtctgtgttggggagaactttaccagagaacacttttcttacaattgggggtccctctagaagtgaaatctaagacagatcagtgaggaaaactaaagctccaataaattgtttaaaggaaatgctatgaaagcattaaaccaaaaggaaaaaaaaggagactttttactgagcatagtaaatagccacaatcaaagtaaatgctgtgtttgaagttaaagtccacagatcaaagtacttcgcaaaatgtcaagtgcaagcgtaacgagggggagaggggagccacagaaactgacccgaagtatcacattgtcacgttagagaaacctgccagcagatgtacccagcaaaagacagtcagcttagtaaggaatcctcaacactgtcccctaaaatgtgctaggaacatacaaaacaacaataacaaaaacaaaacccccagattcccccaaatcaaccactctaattccacacgagcaatgaacgaaacagtgatgaaaggagaacattatacaatacggctcgctcattgcccttaaagaacaattacttatatatattatctttactcaggtggatggttgcatctttttcctctttttttttttttaatgcccctggaaagttaaaaataaagcagtctaaacaacaaaaatatgatgtctgaaacatcctctcattgctctggcaatcaggcttaattagacctctgatccatggcttagtcatagtcaagcgtgtactgcaggtcactattatgagagctttaagcaaagtttaaaacttacagccacaaaaatgcccagatgctcctgctgtattctggaacaccgtgtttacctgaaaattgttcacaactccccttattattttcactataagtaagttattttaaagacattagttatgaacataccagaaaacaattaaataattccagaataaaaaatcttacctacaggcagctgagttcaacagttgctctatacagaggaagtaggagtcagtggccttttacatgtagagattgtttatttagccctttttaaaaggtcttgaactccagaggtttaagattaagtccaatccaagtgtctgaaggaaaaaaagcaagagagaggcaaatgagagagggaaagaatcccagctgctgggtggtgctactgttctgagagcatttgagctattttcagcattaacagcagccggggttgtctgcaaagggatgaaaatgccttgcccagatcgccaccccccactccaggggggagaaaacaccaaccaggaaacccacaacgacttggttcattgtgcaaatattcatttaaattttgaggaaaactgccagcaccattgaaaacaaaacaaacccaaagttgactggaatcttaaagaaacacagtgctcctcaagttttcaaaatgaattacctgattcactgaaaacgagatgtcctacttatgctttattgagaaggaggcttttcttctgatatttcctagggggtcttaagaaatagttgagagccctctggtagcagtatctgttgtcagtctattcttaagactgaagacaaatgatttcttaaaagagcccgcacctaaatttccagtttcatcaactatgctatttttgaaagctactgggttaagcgttgacatctcttatctattggcagagactggggaccattcagtgacatgaggcagacaaacagtgacccctgcttctgcctccacaggccaatgaagaaatcattctggttgggtcactggcaatgactgacaaactttgagccttcattttgtttctagaaataaaaattaagaagtcgtattcattcattcattcagcaaatatttatttggtgagcacttcagagcttactataagccaagcactctgggaatacagtggtgggcagaatgaagtgtccttgccttcaggggtttagagcacacagatgcagtgagaataaataaaaacagaatttttaaatattttccagactttttcacatgatgagactattcacatcatggcagctgaagactgagatctctttctattgtggatgaaggaagatactgtgtgtcatcagaccaacttcaggcttccattgagtcattgtgcctttacaccaccaccagggaggaaaattacttactttctaccaaggaagcagttaagtatgtttatgaacgctttcattccaatagatgaaatccctggtttttttcaaccccctactccccattacaaaaagaatgcttaagtagtcagaaagtactgctgagaggctttccatcgggagatgaaaagagagtcttcaacctgaattcagtataaaaaactgccggtggctcaggcccgtaatccagcactttgggaggctgaggcaggtggatcatgaggtcaggagatctagaccatcctggctaacatggtgaaaccccatctctaaaaaaaatgcaaaaaattagcaggatgtcgtggcacgcgcctgtagtcccagctacttgggaggctgaggcaggagaatcgcttgaagccgggaggtggaggttgcggtgagctgagatcgcaccagtgcactccagcctgggcaacagagtgagactccatctcaaaaaaaaaaaaaaaaaatgccctgatatattttataattaatgtgagggttggttgctagatgcttatatcaaattcaaattcaattctttctttgccattaaagaaagacactgaaatagattatggaaaatactgaggattatgccatgtgaaaaaaaagggttacatgactactacttcaagtactatttaaaaacagtgaaatcctttggctcaatagaccttatattaaaactgtatttcaaattaaaaaattataaattaactttgaaatctctaatctgaattttataaataagatcaactttgttttaaaaatgtataccaggctttaaaaaatgactctagaataaagcatttttcttttcacttattttaaatggttacattttactatgtcttaaatacctgccaatctaacatgggatatttgtttctcttggcctcaatgtggaatggtaattctactggtaataattggaagcctagctgcagacagacacattttttaattgtttttttctttttcctccttataatagtttataccaaaaaagggtataatgcatttaaatattggctttccttgagaagctatggcattaaggaaacaaagatcaacataacccactctcgtataaaacagggataataatgagttgtcatagggctcataggaataatgcacagaaaatgcttacctgggtaatgtctgacacacagcaagcatttggtgaaagtcagtaccatcatctctgctgtaagtgtaaagctttgctctccaaatatggtggctacatgtggctactgagctcaatgcggctagtcagaactgagatgtcatataagtgtaaaatgcatgctagattttgaggtctttatacaaaaaaaaaaggtgaatgatgagaaattactcagtgggtacgatgttcattattcaggtgatggacacattcattaaatccgtgactttaccactatgcagtccatccatgtaacaaaattctccttgtaccccacaaatttgtacaaataaaaatagattaatgttgtctcttcctaaaacatgtaaactatcatatcatttttatattgaccacacgttgaaaaaagaatgtaaattatgacattaatttttatattatgtgttgaaatgacagtattttggacatagtatgttaaataggatattttgctaaaattaatttcacttgtttcttttttactttttcaaatctgactgctagctaatttaaaattacctatgtgacttgcattctatttctactgggcagtgccatgcaggccaacggttctcaaaaggtagtgagcatcaatgacccagaagcttcgtaaaaacagattgctgggtccaccccagagcgtctgattcagtaggtctggcggggcctgaaattctgcatccctaacaaattcccgggtgattcttgacctcactttgaaaaccgctggtcttgggccttgcttcttaaaaaagtagtccacggaccaacattaacgtcatcacttaggatcttgttagaaacgcaaaacctcaggccccacccagacctactgagccagcatgtgcattttcacaacatccccaggctgcgtgtaaacatgttgaaacttgagagaaatgatatgaagtagtgtctgtcatccctgggtgaatataaggtaaacttttacaaacaccagtaccccggccccgcccctagagagtcagatttaatgactctggatgtgactcgagcatctgcatacgtgaacagctgattccagattaaagcaagcactgagtcccatcagactggatgtggaaaggccaggatctagatcatttgtacatcattaaggcatagttgacacagatcaaaccatattagagggtatttacatcccaaaagaggatcttgttaaccccaataactctacaattgttagaactggtgagaaagacccatattttggagtagagaggccttctgttattcgctccacctctgttccggccttaaataaacgagcacgccaactttaagagtgtgtctgaataacctcattagtttgccgaatgacttctcacattttcaggcggcacctgagcgttgtgtgtttcacagagcttggtaaaaataaaatcctcactgtaagagagaatctgggctcacgctggtaacatttaaaacttccaattctatatgcaaagaccatctgcagctttgcttctcactttcttggttgaacctttcagaaaacttttaaaagtgcataatacttaagagtagagtctggagtcagggtgcctgggttcgaatcctcatcctgccacttacgcgtggctgtggctgtaggtcacttacttagcctccccatacctcggtttcctcctctgtaatgagacctttttttattgggttgttgtgagggtgaaaattgttatttgaaacagccatggaaaaatctgctgctttgtaaattttatatgaatgttggttaaataatcaaaatatatttgaaaaactgtgcagatttccatatgtggctaaatttagtaatttttaaaagatactgtggtgatttccaaggactttcatgggcgtgagtttttgaacacatatatttagagggtttctctgagtgttgttttacatttttttcccaagacagcacagaattctcaattgattcctcatcgcttcctattatttgagaggatcccagtaggaaggaagtaaatgtagttttcccatgagtattgttttctagagaacattctttacccctgcagtcctttgaagagtgagttgtgctatagatgtttagagacctccctggtccctgtcattctagtggcattgtctagtatcccaggagaacaatgtgtcattctcttagtcaaatattttagtgcttagggcgaggcagcaagaccatctgaaacactggcgtgagtttcaaagacatattgaaacagcagtcagattctcctatagaaatcagctaatgctgactaaaagaagggatggggatgaacagggaagtgctgaagtcacgcacattgtaagcaaaatgaaggctagactaagtagagtaacatttttttttttttttttttttttttgagacggagttttgctcttgttgcccaggctggagtgcaatagcacaatctcggctcaccgcaacctctacctcccaggttcaagtaattctcctgcctcagcctcccgaatagctgggattacaggcatgcatcaccacacccggttaattttgtgtttttagtagagatggggtttttccatgttggtcaggctggtctcaagctcctgacctcaggtgatccacgcacctcagcctcccaaagtgctgggattacaggcgtgagccactgcacctggcctggagtaacaccttttatgcttgtctgcttcaaccacactcaatgaagtgaagcatatgcaagaaaaataaggatacctggtagctctgggcacgtagcaagcatccgtcgggtcatctacaggaacctcacccatggtatgccacctgctgaacaatgtaatgcatgcatcgggctggaaactaaagcccatacattgagtgactttagaccagtcatgcaagctccctacacttgtgtcctgaaaggcagatagaggcatgggactgcaactgccttactgactcttaaacctatgctttctcttgggcttatctggattacattcggcagtctgccatgatttacgcctttttgcagcactgtttgaaaggagtcaaatcatacgtccaatgacttctactgcctggttattgatgttaagtaaatactttttagtaggcgatttgtcatcacatgtgtcattttgccatctgggttgaggtttatcaagtgaggtgaaaatcttaacaaaaggttaaaggaccagtatcattgaaagagattatatagaaataacttcttaaaacctctgttagaagctcaattttctagttgaaactttgtttcatttatttatttttatttattcatttatttttgagatggagtttcactctgtcacccaggctggagtgcaatggggtgatctcggctcactgcaacctccacctcctgggttcaagcgattctcctgcctcagcctcccaagtaactgggattacagacatgcgccaccacacctggctaatttttgtatttttagtagagacgggtttcaccatgttggtcaggttggtctcgaactcctaacctcaggtgatcctcctgcctcagcctcccaaagtgctgaaattacaggcatgagccacggcgcccagcctgaaactttgttttaaactggctgcctgaattctttgtgtatttaaagagcacctctgctgtttatgtaaccatgacttagcttttcttgttatttctattccatttgaaattgagcatatgcaacagtcgctaaatctgctatgaaaattgtgaagccttctccatgtggcccactgaaggccctgcacgatctggtgttctgcagcatttctgcccagatctccaccaccttcctcccagtgccattgcctccagcctctctagcctcccttccattgcctcccgcctctccagcctcccttccattgcctccagcctctccagcctcccttccattgcctctggcccctccagcctcccttcccttgcctccggcccctccagcctcccttccattgcctccggcctctccagcgtcccttccattgcctccggcctctccagcctcccttccattgcctccggcctctccagcctcccttccattcctggactgtgcctcatccagggccctggcttgcctggctcaatgtgatgggaatgccttccctgcccagtggcgaatgccatgcagcctccagctttcacgtgtctcttcctcaggaaggacttccctgctccaccagcgtagccccgccaccccctttttttaactcgtaaagaatcaccttcctcattccttctaaattcaggttcagttgcttgaatttgttggagtaattgatcggagcccctctcctccactagcctatcagctcccgcttgcccctcacatgacttacattcctcccgcaggtactgcattctgcctggccctaagtaggggccaatacgtagttgctgaataagtaaatgattaaataagttctgccgaaggcattaagcaacacaagagtacattttttggttctatatttatcagaacttgtgaaataaaaagtatctgatcatgtaaaaagcaaaacattatgtattctaattaagcagctgtttccaaccaagacgattctctgaaacattgctttgtagctacatatttggtttagaagctgtcttaagaggcaggtgccacttgcttttcccttcaggatataatatgttctgttatcttaatttgcatttattctaaaatagatttcaataaaacaagttacttgcattcatatatcatattcctagacctttttcacaaccatgtgatactctactagggtagagtgaggtccctgataaacatttcttctgattagggttattgagagaattatgtatttgtctatatattgcctggcagttataccacctgaaaccatatgtgattatttataatgtagttttatgagcagacaggcagatataaagtaacacatcaaccatgccacctggtcaggccatagtcattccaatggtatgaaactctttcttgtggccatattatgcataagttataaacagacaatgaatggtcactgactgagaagactggagatttgcaatcttattttctggcaaatagccaagtcatgtcaacaggagagataaggagagttttgtgtgtcatacactgtagagcaggggtcaaagcctgggataggagagggcttggtcttcactgcatttatttgaaaggagctatggaaacttttcttctaccacttgggcacaggaaggcttgctatggcccaacaatgttttaaaatgtattctttacacatgtgtaaaacactctgaaatcatcaagatacagcatgaaacgtatcttttctgagacattaaaaaactgaataaattaatccaacaagccatggcacaattccataattactatgaccacagaagttaatttagcagggatagtacataatacacaccgtgctaggaaagtgtccttgaaactcatgacggtgaaggacgaattaagcccaatgaaggacagttgaccagcattcaagaggtagaaggaactatagattccttatatcaagtacatgagaaaaacttcctaaatgaatgaggctggaaacacaaaccctcagagactggacataggaatattttctgcgttgtctgtcttctaagcagactctctctctacttctacttctgtgttagcaacgactacagtgctgcagtaatatagatctcctcagttctcaggtggccaagtgaggccttgggaagctaaagttcctggactggccacctctggctgttagcaacctcattggtttacctctgtgcctgcaaatattcttgattttatgtatagtatattatagagaagtctggaagggaatgctttaaccagcaaagtcaatccattaaacaaaaaggtatgggagagacacgttaagagatcagtaaccatgttgtagtttaaaaaaaaaatgcgaagtctttgttcagaccctcggggtaagcagaagtagactggtctccagtggcaggcatgagagggaatatcctgcccgcagtgatggacattttggtttcaggcagagaggcaggaagctgccctctgaatcagagtaaatgctcacattttgaccttctagcaagggccctctttttcttggcaagaattccttcgaggatcattttcagtttgaggttctgtctgatgttttattttacaattaagtcactattcccatattcattactctgtaaaataagtcaagtaggtaagaggtgtggtagacacttccttctgcctcctgaggatccattttgcagccttcctcactacagaatcctgacagtacggccagttaacaactgacctgcctggattccttgcagtttctgaccaataagctaaaggcaaggcatcctgttgaaaatttcatatgcacagtaacgacactaacctcccgagaagagggcttccttgtccttttctttcttttttgagacggagtctggatctgtcgcccaggctagagtgcagtgacgggatctcagctcactgcaagctctgcctcccgggttcacaccattctcctgcctcagcctcccgagtagctgggactacaggcacctgccaccactcccggctaattttttgtattttagtagagacggcatttcactatgttggccaggatggtctcgatctcctgacctcgtgatccgcccacctcggcctcccaaagtgctgggattacaagcgtgagccaccgcgccaggctgtccttttctttctaaccttgttctgctcctctttttgtagactgaaatgcagatgtcattctgtgggggtgcatgctaacagagagatgatacagcgatggagagaggatagagaggaacctactctgggctacctgtccgtgggatttcttgttatttgaggcaaacccaacctggtgaaatgactgtattgaggtcatctgttccatgaaagctagaaacagaaacaaaacaatcatctaaaaacaaccttccttacattagaccggctgaacgacagcaataaactattaggcctgccattaagatattagttaaaaaatacttccagaagttttgaaagaacttctgggcatcaacaacgaatgcttacaacagttgtggcattaagtctccggcccattatcatttcctaatggagcaaaatctgccatgaaaaatgagccgacatgcctaacgccccgggagctgcatcatttgaatatttttgactctaaatatagtgaagtagttggctcttttttctaaaactacaatttactgatcagtgatatcaagagaaataagaacacagcagtgatcaacaggaaacacaaaacaggaacgcattgtttattctgttctcggtggacactgccagatcattgttcagagagctttcaacagggttgcttcgatggagtttagggagtttttaaatctaaattgaagatgaaatgtgtcctcgggacagaaaaagcaattttgaaaaggttattcaaggccataaggtattgactttgagcgtttaaaaaaaaaaacaaaaaacctgtaagaatcttactgtggtttcttaaaatggtgaatgctgtcagtcataatggaggggaaggtaggtttgattaggcggccggtgaattttcagagttaaacaaagttaaaaatacacaggcaacatgaaaattgttctaagcgttcctgtgtcatggtttctgattaagtatcatgaatggaagaaatgaatataaatcataacgattccgttttataacagacagtctcgtgtaaatattttgtctttctagtcacatgtgccaagagctgtgtgagagtgtaatgatggagagcgtggtctgtacttacccgccaccatcaaacccaactctattactgccagcttctgtggctgctacaatcttcttgggcttcagttctcttacccaccaaataggcactgtgtggcccttgactcataattgttgtgaggcttaaatgagttaacacatgcaaagctcttaaacaacagcaactcacaggaggccctccccacgtgttggctgaggctgtttccatcatcatcttaagagcatgggcttggagaatcaagagttctgagttaagtttctggtacttcctcgaattagctccctggtttgggcataatcgttgagcctcattttcctcatctgagcaatgggaatatcgttcattaccttaaagcattaagaagaggggtgaagaatataatgctggaaaaccacacctggcacactggaatcattagataccattttgtttacattacacggaaaaaaattatttgcaaattgatcttcaaaaatatagagacttttactttgctgttggggaaaatgaaatggattgggcacacctagatattgaatttaatttccttatcatttatttcagatagctcacattcaaagttttatgttttgggtttttttttctattttaattttaaacaagaatacatgggactgtcaaacaactggattaagaaaatccccatatctgagctaatcactttgtcctatgattgacataacagtctccttcgagcaacagcattaccactgcttcatttagtaagtagagaaggctaaagaggaaaggtagtggcgttaaaagaaatgacctggaagaaatagagaagaatggactttgtaaggccctgtgagagtctatcattcctctagcagggggaggagcagagttataatcctatctaccttgttacaaacaaatacacactaacttaacattgattgactatggttataatgaatggtaattgaagaagtatccctctatcacagcagtgattacattccaaggaaagaactgagggtttggaaccaggcacagctgatctcaaggcgtggcttctcccatggcaagccatgtcactttaggagagttacttaatctccctgagcctggatttccttatctataaatagcagacaggctgggcatcgtggctcacgcctgtaatcccagcattttgggaggccggggcgagcaaatcacttgaggtcaggagttcaagaccagcctggccaacatggtgacaccctgtctctactaaaaatacaaaaactagccgtgtgtggtggtgtgtacctgtaatcccagctacttgggaggctgaggcaggagaatttgcttgaactcgggaggtggagtttgcagtgagctgagatcatgccactgcactccaatctggatgttcatccatttttttttttttttttgaggctctgtctcaaaaaaaaaaaaaaatagcagacaaccccatctacctctctgggaggtttctgagaggattaaatgagactttgcatgaatattggctactccatcaagtggttgcagaggaggggttcagtaggctgttgttgctgtttacctctttttcctactacactgcaggctccttgaggataggattcctttaaaaacaaaatacaaccagttcccagcacagtggctggtcgctagaatgtactgagtgaatatacaccaaataaagcaagacagggatactttgaatggaaagatcaaacaacagcaataatgaatagcaggcttgacttgtttaagtgaaaatggttaagagagactggcgtggacaaactgaactgatgcattggggaacagattaagtaaaaagtacgtaaaagacaacatcttcttcacacacatatttagaagggaaagataagccgtaagggacagagaaactgttatacgacccgaggggattataaatagcatccttaaatggggctatttctatatagcctctctattttttactttgtagaaagattgaatgactttgacctatgatttctgagagctctgtctgatttcttttttaatttacaaaagtttttatataaaattcaggtcttctcatttctctctgagcctccctcctcccatctgtctccaccctatcctaagtgcctccactttgggtactcttgggttttatggctaaatccagcaacgcagattgtgggcgggcaggtttcccgtattgttcctaccgcccatttctctacagcatttcttaaatagggcctagtctggagactttcaggacgagtgttatagttctcacttttcatttaaccttgaatcatagctggaaagcacattacgaaacctaggtaatcatcccctacacattttgaaaatttgggagcagaagatgattttacaggtaaagccatgaccagcgccagggtctaagaaacattgttgcggcgaatgggcaggtgacatcacatggcgcaggcagcatgttccagatccagatctgagatgggagagggctttccacggggcctgccgggctgttccgtgagcaccagggctgctccagcgccagctgctgctttgttctgcctgggagcagctttgtcggagacttgctactcaaacccctcatgaactaaatgagctgttaatgctgttcgcaatcgtagactcattgaagtgtcaggtggtagcatcaatggagcaacagaaagaggttttcatagagaaagaaaagagataccgacagagaaaatggggtttgcaataatttcagtaagaatggattcagcgggggaaagaaattaataggctatatcctaaaaagaaaaacaaataaaatttggtgcttcaaagtttcaaattaggcacatttcagttgagtcatagccagacactcaagtacggcagtgtgatctcagaatcagtcaactatcaaaggagaatagcaccatttaagataattagaaaaatgacttcagaaatgagataatctcagagaggaattattcgtacaaggctcgctggtgaaacttctgaaaaagagaaccttgcagctgagttcactttatagcattatattagggtatacttatttggtgaattttataattataccctgtaatgaatcttacctgcaaagacagagaaagactcaattcaagccacccttctatttgcatatataacgttgggtaagagaagaaggaattggaaagctcttcaccaacggtgcccatcactgtggccaaacgtgggttctaaattgcagagcctccaccattctgcaacttgaactctgttttcgtgttacagattaagatctatccacttggcctattttaaaaacagttgcacacatttgaacacaccttcgagactccaaattggacttctgtaccaccttctattttcggtaaccacaagggtgctggaaattcaagtactaacaaacgccacgacctacaaacttaagaacatgagctggagaatacatgattcctgggccgcagaacacacctgcgctctggactccaattattctttggggcgtttgacttacagatcaaggaccaggtcaggtcatctttgtttgggatgtttatactcttttttgtgaagtcttcaacattgcattgctctttttcttaacactcaaaagtcagcttaagatccagtgttaaagcttatttttgtgtttctttgagattaatatgatatttccattttccatgagaaatgagactgccttccttctactcttaagcagtcctgtagagaactcctaatactcattcatctccactcaccttatccagattcgaattagctacaaaggtactcagggattctatgcaataattattcaaaataaagtcataacaattttattatttagcaaagtataatttatgaaataaatcatatttataagtataattaatatataattgtgtattagataatagagtaattgcttatcaaatatggaatatatttatatataatcaagaaattaaatataatttcttataatgtttaaatataaattattaaatataattttagcaaataaagtcataatttcattctatagtctcctctatttttatgtttaaatggatacattggtgtcctcagaatataccatttttttacaacagaatcattcaagagagacattataactttttaattctcttgatttttaatgcaatatttcattaaactccttttaagcattagaagtttttgaaaatgtgccaggtgaggtattgttaggtaattttgctgctattcttgcttcttgaccattttctcactgttttagtgcatttggaaatgagtttgaccctaagtttcttcctacctatataaatacttagaaactcttgtactgtttccaaatcaactggagcagtgcctccatgggctacatttgccgttatctgtttcactgagaaacaatatatctactgtagttaaaaagttcatgaatggtccttgctaatttctaggctgttgaaacatgtctctaatttcacagattttgaggaggcaagagatctggagttttatttctttttttttttaatagcatagtgttggatttattcaggatatgagaagacagtcatctgcgcacaacacatttgctatgaaaaaaaattgttaaactacacttatctccactcactgcttcagtggttatgttaactttgtcctgagagtagctagcattggggtaagatgtaaaacacaaaaataatgatgtattattcgatcagtctattaacccatactgattagtggccacactcaaaaagacatattgtagcgaaaacattcccaattctcactcacatgataaccaccctggctctacaagtacaatacgtgtatctttgccacttatctgttgaatgtgtactaatagcttcctccaatgaataaggactctaaacttcagggatcattacaaggtacctgaggagctgggcgactctacagttggaattattttcacattaaaagagccaagaaatctatgaactcatattttactcaatttatttgtgcagccatatataaatagatggtctattcatgtaaaagaaactattatttcaattctaagaatgttaacttcattattcataaactagtccattggtctgataagaaagcatctctcatctcacagacaaatactctaaaatatgtttatcactaaacaactggctttatttagggaacaattcaagattccctgatcacattttctgaaatgatccaattttgtcactcagcattgactctgtaccacagaaattgcattcctgttccacattgtgtcaatggaaaggaaggctgattttggtacttagctatgaatattccatactctctgttctctgaaaaatgtgaacattgagtagaaaatcatgagtatgggggaaaaataataaaatatatgaatgtgcttttaagagcatggcaatgtagtgaggcttattaaaatgccacttttcataaacaatttaaaaagtttctctaagtactaatttgggaaagtatgctaattttcaatacttaaaacctacatctgtttaaattagaatgagcacatttttgccacatgtcacattttattaccatgcaatggtaagtataaatttaccacctacataagaacaaaatatgggcaatacatttatgaatacattaaatgtttaagaaaaagcttttctgcacttcatatgatcttgttttgtttgtacagactcatgtttgtgagctgggcaagttagcttcagatataaggtatacatagaccttgggtgtggaaggtccaggagggccatgacttctgttttattcatatagcacagtgcctgccccatagaaaaaacctagctcacagtggagaaaagtgaatgatggaataatggacgtacaaagccagccaaggtgaggctgtacagtgtttatcataaacagtggatgttctgaagatgacctcttgacttgttttttatttttcttactctaagtgcctcgggtgaactctttcacctagcatgttaggactaatctgcaacgtggaatttattataaaagtgagtgctcatacttgatatttgtcacactagatactcttaaaaatgtgaaaaaaataagattgtttttcccccacaagtacatgccgtcagagtaaccattttcttctttagatcagagtgctaatagtcaacaaagggaaattgttcaacatgtacagagccccaagactctggattccttttaaactccatgtgaactgtatttggttccaaagtagagctaatcattcttaatccaggggtaaaaccaccactgccagtaaacagacaggccccctggcattgaagatcaagttggtgatgatcagttttctaatgggacagcttctaaataatgtcccaatttaaaattgatgcaaattttgataatggaaattgacaaaatgtttatattcagagggttaaaaatttgttttctattgcttagtcttgtggcatcctagttagatgtctaaacatgattggtgctacctaaatttcctttggccccattctagatacatctccttattttgaaattttcataacgttaagtagatttagaaaatatgggacggcgtggtggcttacgcctataatcccagcactcgggaggccaagatgggaggatcacctgaggtcaagagtttgaaaccagcctggccaatatggtgaaaccccgtctctactaaaaatacaaaaattagctgggtgtggtggcaggtgcctgtaatctcagctcctcaggaggttgaggcaggagaattgcttgaacccaggaggcagaggctgcagttagctgagatcatgccactgcactccgacctgggcgacagggtgcgactccatcgaaaagaaaagaaaagaaaagaaagaagagagagagagggagggagggaaggaaggaaggaaggaaggggaggagggaaggaaggaaggaaagaaaatatgaacaagcaaagagaagaaaataaatcttcagaaaaaaaattgttgacatcctagactgttttttttcttcctccctctttttattgtcgtgctatttctgatcttgaggatacggaaatttggtgttcacttataaataacggtttccatagagcccatgagcaaaaaatacagagagaatgataaaatgagaaatgtaacattttcttttggctgatctgtagttcccacaaatgggcagtctagaaaactgttgacagtgcagggtttggaatgtggccgactcaagctggaatcccactttccccacatgtgtgaccctgtgcaagttgtttaacttctctgcgcctgtttcctcttctgtaaaatgagaataatgtactcatcagagcgtttgtgtgaatagtcaatgagaggtatttaaagaatttggcacgctgcctgacacactgtgcattgaatgaatggtggccattattattatttataagaatacttactgttattttactttcttaactaaccctgcagatcgcaaagctccaataccatgtgatgtgaagactcattttagatcagcccaagaaaaacaccattaagcaggtaaatccaaattctgttgggaaaagatcatatgatgcattctcaagcaagtgcttcaggattgtggcactgcagtctctactagcctaggcagtggcaggatggctgttctttgggaataaggtctttagaaaacagtgagctcccacattctatcctgtcatcatttttgccgtgaatactccacataatttatctccagatgattagtttgccttagtgcaatgtaattaattgggaccagaagatacaagagtgtgtttgttatactctaatgaagtttctttgagttttaagttggacttcaacagttaaagaacaacatgatcacggaaagtcaaatggattgtatattaagaagatttttatttatttatctattatggaaatttatttttattctgtgtatttttttatttttgacccagttgagccttgtttggtcaatacctctgggagatcttgacaaaacaaagcgtgtctgggccaaagatttcctttccatctctggggattttttttattgatgatgaagttattatggactgagagccagttatgtgccaggccctgtgaggtatcctttgcacaaattacttcatataagagaacgactggtcctatgatctatgcacagcatccttcttttacagagaccaagcctgtggttgaaagatatggagtcacatggcagcggccacacctcctcgaaagctaaatccatgactgggccttggtccccgcaggctcctgcctggcctgccccttcctgtcctgcaaaattggaaggacattggtgcagaattggaggagccctgcctttgacaaggcacatacaaagggaaagtctgtcaaaaagcatttgttttactttcttttttaaaagaaaaaaaaatactgttatttactgacttttaaaactaagtgaccaaacattggtgacataaaattgtttcttaagtataacaaatgtcacttcaaattgttttttggattttaaaaataaccaggtaaagaaatgacgttagggtggggagagagggcagcagaaagagagtggagagatggagaaggaggaggagggaggaaatccaggcagtgggtggggcacggccccactgatgagtgtctgagccatgggcgcttggtgctattcagggaggcaaggtcctatgttcataaataatgtactacagggacagtttgaaagtgatcattaaatttacatttttaaggcaggggagttgcagtcacagccacaaatataaaaatctaaataaggtgtcttcaagcattgtcctgggacaagaactgcagatacatggcccagcctcaactctctagatatcctgctgatctcagggaattcagatggtgtttcctgggtccagttctcccccgccacccctctgaggaagcccaatctaaagcatccatgttggatgcttttaccatgacaaggtgtggagaaagaggaatttctataagtagaatgataatgaggagctgccagatttctagcaggctggggactcggtggttccccttgacatgatgcttctgggcatgactgaggtcctgggtgtgtgactgagggtcagggtgatggtgtctgagcatgattgaagtcctgcctatgtgaggaatgtgggaaggatataacaggactggtgcacccagacctctggcctggggagaagctgctttcacctccagccaggaagagtggctcccagcagcaataccccacagtaactcaaagtcattaatcatctcactaagtaaactgtgtttgattcacagtaggcaagagtgttcacagatgatgcctaaaaacacaagtagtgtgtataggcgggcttcatgagcttgcaaactgagcatgtgcacctgaccctgtgcttagaacggccaggtgttctgtttgataccctgctgtcatcatctataacttattcatcatacttttggaattgccttttcatcttgcgctgggccctgcaaatttatatagcagattcttgttgggtaaatttcaacagagataaacaaagtttccaaagtttctgagactccaatctcacatcctacaccctcaaaaatagaagaaagaggtcggggcagcttcggcaattccttcctctctcctgccactgggacaagctcacctctgctgcaccctccctgcctcagcaatctttgatctgtaccttcagagaaggtttttatcctagtccatccccagcagacacctcctgcccagcctctctctgaaggtctacatggcaaccacgggctacatgtggctcccgggcacctgccttgcttgcactgagatgtgttatcctgcaaaatacacacaagatgcgaaaaaaaagaatgtcaaggaaatcattactattttttatacttgttgaaatcatattttggctgtactaggttaaaaatattataaaagttggtgtcatctgtttccttttactttttaaaatgtggctgatagaacattaaaaattacataggtggcttctctttgctgctcaatatatttctattggtctagacattttttttaaaaccacatatccacctaagtgttccacctatatctccatctcagaaagtctcaaaccagtttcactatcttcttcccccaaaacactttttccatgtcttgttttcccaagacagaaacctggtgattaaaccatagcctgcttctactcccaaatgccagctgagaactgttggttctgtctccataatctctccacgccagcacttttcccccagccctactgtcctgtctcagctgagccattcatcttttcttcctggattactgtactgtcctcctacaggaaattcccttattttttttaaattttcttgtagagatgggatctcactgtgttgcccagggtggtctcaaactactgggctcaagtaatcctcctgcctctgcctctgaaagtgttgggattaacaggcatgagccaccccacctggccctatgtgaaattcttgaattcattcccaccctacctcagtggtgctctcacaacagagaaactatcttataaaggaaatcctatttcaccttcctgcttgaaatgtctcacagttgccctgccatctggctctggtctgcttgctcgattttactcactatctctccatatcgggcatcctgcattccagccataccaatggctcccagggccctgcagatttatatgaaatccatcgctccatgcctgggcgctgtggccacgctgctccctggtcacggtgaggctgggcatgcctgggcgctgtggccacgctgttccctggtcacggtggggctgggcatgcctgggcgctgtggccacgctgttccctggtcacggtggggctgggcatgcctgggcgctgtggccacgctgttccctggtcacggtggggctgggcatgcctgggctctgtggccacgctgttccctggtcacggtggggctgggcatgcctgggctctgtggccacgctgttccctggtcacggtggggctgggcatgcctgggctctgtggccacgctgttccctggtcacggtggggctgggcatgcctgggctctgtggccacgctgttccctggtcacggtggggctgggcatgcctgggctctgtggccacgctgttccctggtcacggtgaggctgggcatgcctgggcgctgtggccacgctgttccctggtcacggtagggctgggcatgcctgggctctgtggccacgctattattccctggtcacagtggggctgggcagcttccagagcgaatgtggacatattcttaggccccacctcacgcacttcttcagagaaacctcagaggctcctccacaagccacgggtacccccagatttccctcactctatgcatcccatgcgcctctagcaacgcaggaccacactcgagtagagctgtctgtgccgaagactgtttggcagacactgtttcagatgcgttccagacacttaggagagcgactgacacagagcagggcttgactgattacatccctcgctcatttctcccggccccgtcaccttagttcatgcccaagttttcctcttgtcgaattcatcgacactatcatttcgtaatcttttcttgtgcccttcatttaatttgatactgttaccagttatatatttttcacccacaaatatgatcattacttttcctctgtaaagaagctccaatggttctctctctttctctctttttctttccctaaagaattaacccaaactacttaacatgatgatgatcctgatgctgatgacaaaaataggcatgggtggccattcattctgcctctgacgtgccaggcgctatgccggtcattttgcagtaatctcatttaatcctaatgataatactcagatgtaagtgctattatctcttccccctaagtagggaaataggggtcaggaaaagcccaggagcctgttccccaagaccaagttagcactacagagctgggaatgaattccaactttatgtgactgcaaagctcttccatgcccccacaccaccccacgcccggttctccctactgttcctacattccagacgcaccatccagcctgcaatgtgctttcacaccatgttcacctgcagacaatgctttctccatctaatgcccctgccttcaccatgcacacactgaagttgcctagaagggtcagtcacactctactctgtgccttccttctgcctcggcacttgtgatgctgcgggattatcagtttcccctccctcatcccaaagactgaacagtcaccaagagtagcaagtcgactagtcaccactgaacatacgcagcctggagaatcagaggtgcacggtgtgtgccttttacatgaactcatgcatacaccaagaatgatagtaatgcctgctcacatttgtttagcatctcccacatgccagacctcaccctacacaattagaatacataatccattcaatcctcccaccactctttaggataatgtatcatcttaatccttatttattttttccagaataaacttgtgattctaacaacttcaacataaaataaataacttttgctcaatatcaaactctataaaatcactaaaattggcccaatatcctgggttttttaacttgcattatttcttcctgataatgacatttaggccagtcaaatcctgtattaccgttttaaacaaagaaaaaaagattatgagttgcttttaaaattcacgtgtgacaagcagaaaaaactcgtggaggcagtttcaacatttaacctaagtgtacttagcaactacacttaatagctttttaaaaagcctcgtttttaaaaaaagtggatctttctttgcagagtgacttaaaatacatcatcatagtcttattaattaaacatgttcttatcagaaaaaagcgtctcgaaagctagtatatatgcttaattaagctgtatgcaaccatcagtccatatcttgaattaggctacatgtgaggccctgatttgccccattctttctgctacccagaacagcactgctcactgcctaccagtgtttccagcaaagatataaagttctacatgtctaaacgtttttgccctgatatcaaaagcaaagcaaaacaggtcttctccattcccattttggttaacagcatcaccatctgcccactggcctgatccacccagaagcctgtcttcttttttgaacttgaaatactcatgtgctttatttgtataaattcccattattccctcactgctccaaaaatagagaagaaagtaacataaatgtactgacatcaatttgagaactagaacatgttaccttcccgaagtatccatcttggatatagggaaggagacttagcctcataaaagcacatgaaggaatgctcagaggaaatactctaaacctagttttctggaattggtaagcagaagctctggagtcagttacaggttgtgagccttccaccaagaagagccacctaacataccaaaaaaataagcatgagattcacttaaagtttgacaaatttagcaactcctttccattgtctgcattttagagaacctattgatgctgttgtaacagctacagagaatcgtgagatgcccagtgacattggctatagtggtagcaaaccgggtagtgggaagttttctaacaaatactatgtaaaaggagaagcctgagtcttttaacaccacagatcaaacactgcaaatggtaggacgagcattagagtcccgctgaggtcgctgagacttacacttcacacgaattgtagtggtgcctagatctccctgaagagtggcagaagcagccgcccatcccttaaactacacatgtacctggcttctcaagactccagagtttacttagagatgagtaactagagcacaggaatttggaagagagtctttctataaactcccaggaacaaccaacaccagtagtggctgacgtctgtgagaccttctttgcgtcagatgcagtgctctcatcaacatccaacacacgtgcctttaatgcctgggactatggcgacactcatttagatgagggaactgtggcatagagggtttcgtacctcggcttacttcactgcaatcggctttctaaaccagaactcccacccgacaatgtgtgagtccaaagtccatgtttctaggtgcagtggctcactcctataatcccatcactttgggaggctgaggcagacggatcacttaaggccaggagttcgagaccagcctggccaacatggtgaaacccgtctctgctaaaaatactattagctgagcatggtggtgcacgcctgtaatcctagctgctcaggaggctgaggcaggagaattgcttgaacctggggaggcagaggttgcagtgagccaagatcatgccactgcacttcagcctggatgacagagcaagactccatctcaaaacacaaaaaatacaaaaagtccatgcttctaaccactagcaatcaccctataacatattcccctcaatgaaaaagactgaatccaagaaatctcacctgcgtcagactttctaagtcatagagatttatagtaataattttaaatgagtctttgactttcagacccagcgtatgaaggaggagagtgtgagtcagtgccgttcctgggcgtccgctgggaacttccctgactgtccttctggctctcaggagtggagctcacttgctcaattcattccagtgtcccagaggtcacagtctcccctctgtgagctgggctgtcctcggtccctgggcctatctctttgctgtcctccctgggatcttgcccctggggtagccctgcttcccttgcagctttcttctctgctgctggtgccttccccagggctgtgcatgggcttagctctttcttcatttctctccctctctcctcttttcttcctgctgtcttagctgggccccctccatccttttatttcctaattgtacctgttgcttccatacccttaaaagcatactccattttctccctagatgtattgaggtataattgacaaagctgcagacatttaaggtgaaccacgggctgctttgatacaggcatgcactgtgcactgatcaccacaatcaagttagtgatcacttcttatcttttttgtggatggtaagaacatttggatctactcccctagcaagctgcaagtgtgcaatgtggttttattcactacagtcaccacgctgcatgagatcctcagaacttatttgtcctataactgaaagtctgtgccctttgacctcattttcctccccccaccaattcctggcaaccaccattcgactctgtttctatgagttcaacatttagactccacatataagtgagattgtacagtatttgtctttctctgtctgacttgtttcacttaccataatgtcctcatatgtatgctgttgcaaatggcaggattttcttcttttttagggctgaataatatcccattgtgtgtatatacaccacattttctttatccattcatccatggacaggtccttaggttgtttccatatttattcctttcctttgtatgtatatccagaagtggagttgctagatcatatggtagttctggttgtaatttttgaggaaactctgcacaattttttacaatgtctgtaccaatttacattcccatcaacagcttacaagggttcccttttctccacatcctcaccaacactcgttatcttttgactttttggtgatagccatcctaacaggtgtgaggtggtgtctcactgtggttttgacttgcctttccatgatgcttagtgatgttgagcacgtttccatacgtctgtttgccatttgtatgtcttctttggaaaactatctatgctggccctttgcccattttttaactgaatcatctctctctctctctctctctctctgtgtgtgatgctcttgagttgtaaacacatttcttaatctttccatgtgctttaatctcagcactttagcaactgtcaagaacaaagttcttttcaaaaagttcatctcaaagttggccactgactcgtaacaggtaaaacccaatgagcacttccctgagcctcagtttcttcttttctcatgtgaaacagtgatgatagtgcatacctcccagggctgttgagccagactcaacaatttacatgaaagcactgagggggtgccaaatacatgtgagtggtataaaacaattcttgatgctacaaagcttgcttttccacactattgtcaaaatcccaccttgttcgagccccaattaaaataccattttctctaatccatctttcccgatcctctaacaaacttcaattctctgagcaatttattatcatcttctggaactccattgcttaagacgatcaaagagtttctttattgtataagttacttctgcgcatgtcttttgaaggaataaataaatgcattgattatatctgccttatagcactccatcaccttctatcttaaattacagtaactagcgttcctgtcttcctgcactaaattgtaagctctttcaatggcttcctggcttattctctcatcttttcctccggtccttgatggatgtataataaatgaatgagtaaattatatgaaaatgcaagtatgatttttttaatatacagttacaacttcgacatccacagttgggtctgaccacttgttaagttgtacccagaacttaggtctttctcgctctccacgttccctatcaaggccatcttttcaataccaaacaaattagaaagaatacaatcagctaacttacactaacatactaacaaatgggacaacagtcttcaaggtctggaagaggagagcagagaactcatcattgcctgctcaagcccatctaccaggaggggaaactccagatactgtgggccacttggcacttaggaactcatggtactgatctgtatattgggcagatatagttttttggtgatagtcttaaaaatcatgtgtcacctgtcatgacacttgccagatgaaattctgattttatttcccaagagaatgcactgacaaattaataatctgacctttaaacgggtgatatttctccatgtcaatcaacaagaggccattctgttttgttgaccagataaaatactctttcactctctgaggggttagcgagagtgcatgcagatttctccaatgctttgcttttggttggaagcagaaacatttaaatttcaaggcaacacttttcctaattcctactgaactcaaaagctctagtggttcagtgatcccattggtaacaaatacttagagggccagagtccttctgggtcctatccttacgctcctgttctctcctcctctcaggccttttctgcaccatgcaaacccagcacctcttctcacaggctgggctaaaggcagaatgcaataccatgactgaggagcctgggaatgaggcaattcattaacagaacattccccaggaaacataattttctgatcataatctctttgttcctgacagttgcaaaattaaataccagagccaaaaaaaagtgaggcaccgttttaagggtatgttttcctaattcgatcttcaaaggaagcacaagcttagggttcgaaatcattatgatgtaatattatgccacataataatacatagatccaatcattttaccagataaccgtcaatataaagcactgacaggacatttgggacttcgggtcaacaggaaggtggtttttcaaactaaactatattatttatggctttgattgtcatttacttttacaacataagggtgatggtaattctgctcttctgccaataaatctaaaaattaattgaaaatgtagtcaaaatccttggcacactttagaaggaagatttttttaattaaaaaagccatattaatcattatataaatgagttatattagtcctgtaaaattaaatctatggtggaaaggaagtcagtgagtgatataatcggatttcagaacacatatcatataaaaagttatgtttctaaataaagtgagtgtgaaagaattcaggatatattatcagtcatctgagttactgccctaagacagcccttctcccaaaacagatatggtttctctgacaaagaagataagtgtgccttctcatatttttattattttcttaactgtcagacataactcatatgtagttaagttgctcagaaggttaaattcggaggaaaaattctacaagtggtttaaatgagccaaatcatttttggttgcgtcatgtttcctccgttgaaaaagtctcgatgacttaaaaaggattgctttgatacttagcttagtgttttacccaaaaagcatactgaccaaaaacaaacaaacaaaaaacccataacaaaacaaacatttaaagatatgtagaccagatcagttttctcctgatgaaagtcacatggaaccacacgcaggttaccttgctttcagcaggtccctttccttgggtgtgaattttatttgttacaataaccgacttggcctagttactcagccatccttcgttcactcttggtagtggacatggcaagatggtgggtaaaaacacgtaaacaagactgctctctcgtggaggtcactttcacatggaaagactggacacgtcaaaacacttcattaacatgatataaaaataatacaacatgtaaagtggtatcggcgcatctaagacaaagcgattcaatgttaaatccctctttgggaaataatttaagattgcagaaaatgtttctgagaaattccaatgtaaacgtccttaaaagtccctactttttagtatttggtattatacttatagattttgtgattttccagatttttcattaaaagttaatatgcataaaactcttgggatggtagcaagtacagagtgaaatctatataaattattattattatcaatatcttttggagtgaacaaattgaacattttttgaataatcttttgcgtagttgactgaatactagttaataggtttctattgttttcttgagttaaatcagaagcagatattttgattgactgtgtaaggtcttgcagcttctatggttttttttaacttgaaaaggtcttcccagactgatacctctttctgtcttgaactctctgttcaactatattctaaagccttaaaatgaagatcttcaattttataactctggatttaaacttttctttcttattcttttttattttacaaaagaaaattttaactctttaggttgattatatttcttgatgaatgtgactgtaccaagaggctttaaaaaaattgagattagaaatcagtttttcttatcttctgaattattcaccatatgatgtgttgcatttgagctttatctatgcttctggtaatatttctgtcttatataattgttaaagtataatgcttctcaccaggaagactatatatatatatatgtttaataatagcctttttaaattttcatgtgttttttcttctcctttgttttctgatttttaaaaaatcagaaaaatgtctgaattgtcactttatctgtagattcaaagagcactttctaatcatgtgttggcattagcacaacaccggggaagatctgattgctgtaagccgttcattcattcagcaaatactgactgaatatgcagtatgttgacctgtttgctgagggcctctctgttccggctgccattctaaagcgagtcaagttttccctgtaacttttattctgcagaagtaacctgtacctttttccattctcttgccattcaccactctcctgacctccctttgcgtaaactggtttaagcctggcgctctaggtccatccaacaacaccggtctattcacactgtagcagagcaaccaagcagttatacaattttcatcttaactactagtaatactatgctataaaaattttgaaacctagattttgagatattgagcaaactaaaatatgtagtatttactatagtgcaagaatacgtctgacgggttaaatgcacgcgttttggaaagtgctcaaacccttcaccagatgacacagttatagcacaacaacagctgaggttattgttatctaatctcctttccctcgttaactttagcacagagaactgaaataattgggtgtgaaggcatcttgataatctaccaaaaaggctcatttttaagcagccaagcgttgctctcttaaacttttgttgtttagtagcataaagtgtaggcaacctgtatgaagtataaatatctggtattaaaaagacccagtgaggcagaagtcgctgactcctctcaataggtggaagaggattctccatgcagccgaaggcttaatgaagcacatttccaccagccaggctgctgcctctgtggtgttacctcttcagaggactcagtgcctctgagaagctggctgtcctcagcgagaagtaagtacagggacttctgtttagaggagactagaatgaatatttatactaataaattttctccaacatagccaaaatctcatttgaatatgtttttctttctgtgcatttaaaacacttgccattcttcatggcatcccatgcttgtactcttagaggatcttcacgagtggcacagctcttggctagaatcctatttttttttttttttttttttttttttttttttttttttgagacggagtctcgctctgtcgcccaggctggagtgcagtggcgggatctcggctcactgcaagctcctcctcccgggttcacgccattctcctgcctcagcctcccgagtagctgggactacaggcgcccgccactacgcccggctaattttttgtattttttagtagagacggggtttcaccgttttagccgggatggtctcgatctcctgacctcgtgatccgcccgcctcggcctcccaaagtgctgggattacaggcgtgagccaccgcgcccggcctagaatcctgtttttgctatagtttgttggactccttgcggctaatccttgcagctatattagtctctgagggatgctgaattgaatagaacatcagaagatttggagcctgacgggtttatgttgcccctgtcctcaaattcaactattccagaaaaaatgtactaggacaaggaacctgaaaagaagaactatttctaacaatggattggatgaactctcccattcaaagcagaggatataattcattataagacttgtaatttactttaaccactgggaaaacatctcagagggaagagagaaaaactgaatttctgattaaatttaaaaaatcaaaaatttaataagtaggcaaccgtataaatgaacagaaaaaaacaaaatatcaccgaaactttcagataatgttctttgttaaaaataagtttccctaaattataatatgaatatataaagagaaattagaaaatataatgagaacattaccaggcctttttgttttctttcttttttattgtgtttttgtttttttgaggtgggaaaatctttgaaagtaagacccttgattggattcaggaaagtgaaagctttctgaatttttgctcaaataatgcttctctaaggtacagaatttaatgctgaatttatgtctacctcacctgtatagggaagaggaaaccactgcttttttggccaaaattcctacttggtaaactagtatatttccgttttgaagaccaaggtgcagtgaagtgtggtggagttccatatggatctgttatgctgcaaacaccaaagtaaaaacccgtctttgctggttccccgtcatttattcagcaaatatcatcttaattgaacttaagctgaaacgtgagttcttatttgccaatactcagaactcaacagttgcagaagtgtttccttttaactgcatgtccatgtcttgagtttttcagaaataatacagaaaaacatattttgaaaacatatttatctgtatttttccacgtgacagtggcagtttaggatttaacaggcatatccataattaaattgttagtttgaggaacttccagaaaattatctaatgcaatcatatatcacaagtcttctttataaaatacaagtgcaactcatttcattatgctatccatgtagttagacataactgagacctttaaaaatattataaatgacttaaaatagaaaatgttagaaacagtacaggcatattacaaaatcatggtttctgaaatctaattactatatgcaatttaaaataattaaacatgattagtctttaagatgaatagaaccaattccaactttagctattatttaattatagcatgctgtacattaaaatcagctggaagatagccaaaataagctttaaaggacagcatgataattaagaattgctatttatcttacttttattagaaaactcaatgctggaatgaatgcaataatgtcaagaaatatgaatttaaataatttcctaaatattttactttctaatcccaaatatcaggatattttaaacttcctcatcaattctactttatatacaaaaattcatacagtattaattagaacttttgctttcaacacagatatcttaaagacaaggaattatgtatttataacttcttaataaaactatgggtacattcttatttttgattgtggcagttttttcataaaaaggctactgaaatcaggcttatttaaaaaatactaataatgttatctaatatagaacagagggtaggaagtctctgtaaacaaacctatatctatatcaagagtgattctaagagaatattctctcccttacccaggtactcaagttgtagggtaacataactagtgtaacgtaactagtgatttccagtcaccttttaggtttacttaggaacattaaaagaaatgctgccattgtagacttcatttcaattatttaatctctttccagttcacgacctttactttcttctggtttcagcaagaaaaacaacttcataagtgtcttacattataatcggctactaatcatcatcaactcaacattagttttaaacagtctgattccataacaaatttgtaatagggatattttctatacattttataatagccatggatagaaaaatagtattatttatatactaaaacattcaagttgttttgtttaaaacatacattgtaaaattttccctcgggaaatttggatttattataggacagttgtagcttttatgaaattgggatcctgaagccatattttcaaatcagaaaaatgaaagcctcattgttgtttttcaaatgttttaagtttccttgataaaaggcagtattaggacttctatttctaggtcaagtctatatttacagtaactaataggaaaatattgaagtctgaggttaccagtacaatgtctgaatgcaaaattctggacactggacaaagtactttagaatcagaggccagcaaagctctggaaggctgtgaacagggacaaatgcaatatggttcagcagacagaaagtcagaagtaagattcagatgtagccaagcagggtgggggacagtgaggggggatgtctagctggacttgaagggcgtatgaaagcagctgtccttgcaggggagatttaaaggaaatgactcttcagggggcactgcatttgcaaaaaaaaaaaaaaaaaaaaaaaaaaatctgatatagtatgttttggaaattccaaaatatttgatattgccagcagaagagttggaaagtggcagaaaataagggtctaaaaatagccataagcgaaagtgcaaagtcttgaaggatagagattatgtctctgaacctggttctcaaaattgttgaattattaactatggagatgcgctgtacagaattgaacttaaaatggtcatctgtgtatagcatgtcatcttaaaaggttactaaaataggaaagaacttgcacaggtataaagtgtgtgccattcctcccgtgggctaagggtcttgtctcacttggtgccactatcaatgcaacaggcacagcagtcgggtgtgccctggatatttctacacctcattcttctaaaagctcccccaagaaaaattaataggaaatcaggtgcttgctgcaggtctttgcactgtgtcaattctaagaaatcctttggcagtgtaaagctttgaaggaaattaaattggagagagattttctctacctttcattcagctcatatagaatcccttacttagctgatatttttgctcatagaattggactcagaactaagtctgttcatttagctttcctttgaatgttaaacataatgaagtacaaggccgtcacctcaccattttatcccctacaacccgcataggcgtacacttatcaccaaacgtttgcacatgtttggctccactgagattcttagtctctatctttatattttgactattttgacatttagaacaaaagtttggaaaactattctcctactgctttagcattctcttatcttagggcttatgaacattgctacatctctgaaacaggcggttcctgcccatatctatcagtgaaaattatacttaaaattctgaagagactcatgtcatccagattttggaggaaaaaggtagcaaataaaaatatacttcttagaagtagatctcagttactacttattttaaatttcacagtagattccatcttttgtagataggggttttgttcaaagtttttgaccaaacatttttattaaatattttcaatagtattataagtgatctgacatttttggtaacaaaacaaccaaagaactgacttgagtaaagctgaaatgttgctgaaccagaatctaatccttactccgtcattttcttaccagggattttgatttgactgaccagtttcaatccacagtaacagctttgttcctaagagactataaatcaaggaaatactcactaccaggcaattcctcctgcaattcggggtctgtgctgttattatgaagcaactgacagcaaacatttgctgcaagtatgagcgcagatttggatgaggtgtgcggtgtttttggtttcactctttatctctgaaacctatctgctt
